US012258632B2

(12) United States Patent
Markowitz et al.

(10) Patent No.: US 12,258,632 B2
(45) Date of Patent: *Mar. 25, 2025

(54) METHODS AND COMPOSITIONS FOR DETECTING ESOPHAGEAL NEOPLASIAS AND/OR METAPLASIAS IN THE ESOPHAGUS

(71) Applicant: Case Western Reserve University, Cleveland, OH (US)

(72) Inventors: Sanford D. Markowitz, Pepper Pike, OH (US); Helen Moinova, Beachwood, OH (US); Amitabh Chak, University Heights, OH (US); Joseph Willis, Shaker Heights, OH (US); Thomas LaFramboise, Shaker Heights, OH (US)

(73) Assignee: CASE WESTERN RESERVE UNIVERSITY, Cleveland, OH (US)

( * ) Notice: Subject to any disclaimer, the term of this patent is extended or adjusted under 35 U.S.C. 154(b) by 0 days.

This patent is subject to a terminal disclaimer.

(21) Appl. No.: 16/315,405

(22) PCT Filed: Jul. 5, 2017

(86) PCT No.: PCT/US2017/040708
§ 371 (c)(1),
(2) Date: Jan. 4, 2019

(87) PCT Pub. No.: WO2018/009535
PCT Pub. Date: Jan. 11, 2018

(65) Prior Publication Data
US 2019/0309372 A1    Oct. 10, 2019

Related U.S. Application Data

(60) Provisional application No. 62/358,701, filed on Jul. 6, 2016.

(51) Int. Cl.
C12Q 1/68        (2018.01)
C12Q 1/6827      (2018.01)
C12Q 1/6853      (2018.01)
C12Q 1/6886      (2018.01)
G01N 33/574      (2006.01)

(52) U.S. Cl.
CPC ......... *C12Q 1/6886* (2013.01); *C12Q 1/6827* (2013.01); *C12Q 1/6853* (2013.01); *G01N 33/574* (2013.01); *C12Q 2600/154* (2013.01); *C12Q 2600/156* (2013.01)

(58) Field of Classification Search
None
See application file for complete search history.

(56) References Cited

U.S. PATENT DOCUMENTS

| 7,485,420 | B2 | 2/2009 | Markowitz |
| 7,964,353 | B2 | 6/2011 | Markowitz |
| 8,221,977 | B2 | 7/2012 | Markowitz |
| 8,415,100 | B2 | 4/2013 | Markowitz et al. |
| 9,322,065 | B2 | 4/2016 | Renard et al. |
| 9,580,754 | B2 | 2/2017 | Markowitz et al. |
| 10,400,286 | B2 | 9/2019 | Markowitz |
| 10,450,615 | B2 | 10/2019 | Markowitz et al. |
| 11,136,629 | B2 | 10/2021 | Markowitz et al. |
| 2007/0161031 | A1 | 7/2007 | Trinklein et al. |
| 2008/0220433 | A1 | 9/2008 | Ahlquist et al. |
| 2010/0009359 | A1 | 1/2010 | Markowitz |
| 2010/0151468 | A1 | 6/2010 | Esteller et al. |
| 2012/0094287 | A1 | 4/2012 | Markowitz et al. |
| 2014/0206565 | A1 | 7/2014 | Selaru et al. |
| 2016/0317132 | A1 | 11/2016 | Markowitz et al. |
| 2017/0369948 | A1 | 12/2017 | Markowitz et al. |
| 2019/0136325 | A1 | 5/2019 | Markowitz et al. |

FOREIGN PATENT DOCUMENTS

| EP | 2626435 A1 | 8/2013 | |
| JP | 2004-505612 A | 2/2004 | |
| JP | 2008283947 A | 11/2008 | |
| WO | WO-2010118016 A2 | 10/2010 | |
| WO | WO-2012/178074 A1 | 12/2012 | |
| WO | WO-2013171504 A1 | 11/2013 | |
| WO | WO-2014159652 A2 | 10/2014 | |
| WO | WO2016109712 * | 7/2016 | ............... C12Q 1/68 |
| WO | WO-2016109712 A1 | 7/2016 | |
| WO | WO-2018009535 A1 | 1/2018 | |

OTHER PUBLICATIONS

Kitkumthorn et al. Cyclin A1 promoter hypermethylation in human papillomavirus-associated cervical cancer (2006) BMC Cancer, vol. 6, No. 55, 9 pages. (Year: 2006).*
Tokumaru et al. Aberrant Promoter Hypermethylation of Cyclin A1 in Cancer (2006) Japanese Journal of Head and Neck Cancer 32 (4) 410-416. (Year: 2006).*
Shaw et al. The Role of Pyrosequencing in Head and Neck Cancer Epigenetics (2008) Arch Otolaryngol Head Neck Surg, vol. 134, No. 3, 251-256. (Year: 2008).*
Lin et al. (J Gastrointest Oncol 2015;6(1):3-19) (Year: 2015).*
"Scientists Can Make Copies of a Gene through PCR", 2014, obtained from Sitable by Nature Education, Downloaded on May 31, 2023 from https://www.nature.com/scitable/topicpage/scientists-can-make-copies-of-a-gene-6525968/ (herein referred to as "Nature Education") (Year: 2014).*
Kitkumthom et al. BMC Cancer vol. 6, No. 55, 9 pages. (Year: 2006).*

(Continued)

Primary Examiner — Juliet C Switzer
(74) Attorney, Agent, or Firm — White & Case LLP

(57) ABSTRACT

The disclosure provides methods for identifying genomic loci (e.g., vimentin and/or SqBE18) that are differentially methylated in metaplasias (e.g., Barrett's esophagus) and/or neoplastic cancers (e.g., esophageal cancers). Identification of methylated genomic loci has numerous uses, including for example, to characterize disease risk, to predict responsiveness to therapy, to non-invasively diagnose subjects and to treat subjects determined to have gastrointestinal metaplasias and/or neoplasias.

14 Claims, 11 Drawing Sheets

Specification includes a Sequence Listing.

(56) References Cited

OTHER PUBLICATIONS

Lee et al. (Cancer Lett. Nov. 1, 2013; 340(2): doi:10.1016/j.canlet. 2012.10.040. sixteen pages) (Year: 2013).*
Tokumaru et al. 2006. Japanese Journal of Head and Neck Cancer 32(4) 410-416. (Year: 2006).*
Nava et al. (Lasers in Surgery and Medicine 43:705-712 (2011)) (Year: 2011).*
Andersson, et al., "Filtration Device for On-Site Collection, Storage and Shipment of Cells from Urine and Its Application to DNA-Based Detection of Bladder Cancer," PLOS One, vol. 10(7): e0131889 (2015).
Andersson, et al., "Size-Based Enrichment of Exfoliated Tumor Cells in Urine Increases the Sensitivity for DNA-Based Detection of Bladder Cancer," PLOS One, vol. 9(4): e94023 (2014).
Brait, et al., "Aberrant Promoter Methylation of Multiple Genes during Pathogenesis of Bladder Cancer," Cancer Epidemiology, Biomarkers and Prevention, vol. 17(1): 2786-2794 (2008).
Brait, et al., "Association of Promoter Methylation of VGF and PGP9.5 with Ovarian Cancer Progression," PLoS One, vol. 8(9): e70878 (2013).
Carvalho, et al., "Detection of Promoter Hypermethylation in Salivary Rinses as a Biomarker for Head and Neck Squamous Cell Carcinoma Surveillance," Clinical Cancer Research, vol. 17(14): 4782-4789 (2011).
Carvalho, et al., "TGFβR2 aberrant methylation is a potential prognostic marker and therapeutic target in multiple myeloma," International Journal of Cancer, vol. 125: 1985-1991 (2009).
Chujan, et al., "CCNA1 Promoter Methylation: a Potential Marker for Grading Papanicolaou Smear Cervical Squamous Intraepithelial Lesions," Asian Pacific Journal of Cancer Prevention, vol. 15(18): 7971-7975 (2014).
Colacino, et al., "Comprehensive Analysis of DNA Methylation in Head and Neck Squamous Cell Carcinoma Indicates Differences by Survival and Clinicopathologic Characteristics," PLoS One, vol. 8(1): e54742 (2013).
Galipeau, Patricia C., "Barrett's Esophagus and Esophael Adenocarcinoma Epigenetic Biomarker Discovery Using Infinium Methylation," illumina iCommunity Newsletter: 3-4 (2008).
Gonzalgo, et al., "Rapid quantitation of methylation differences at specific sites using methylation-sensitive single nucleotide primer extension (Ms-SNuPE)," Nucleic Acids Research, vol. 25(12): 2529-2531 (1997).
Hall, et al., "p16 Promoter Methylation is a Potential Predictor of Malignant Transformation in Oral Epithelial Dysplasia," Cancer Epidemiology, Biomarkers and Prevention, vol. 17(8): 2174-2179 (2008).
Heller, et al., "Genome-Wide Transcriptional Response to 5-Aza-2'-Deoxycytidine and Trichostatin A in Multiple Myeloma Cells," Cancer Research, vol. 68(1): 44-54 (2008).
Kaz et al. "Unique Methylation Signatures and Molecular Subclasses of Barrett's Esophagus and Esophageal Adenocarcinoma Revealed by Methylation Array Analysis," Gastroenterology vol. 140 (5) Suppl. 1, S818 (May 2011).
Kaz, et al. "Differential methylation in gene bodies and promoters in barrett's esophagus and esophageal adenocarcinoma revealed by genome-wide methylation array analysis," Gastroenterology, vol. 144 (5) Supp. 1 (May 2013).
Kaz, A.M. et al., "DNA methylation profiing in Barrett's esophagus and esophageal adenocarcinoma reveals unique methylation signatures and molecular subclasses," Epigenetics, Landes Bioscience, US, vol. 6(12): 1403-1412 (2011).
Kim, et al., "Histone demethylase JMJD2B-mediated cell proliferation regulated by hypoxia and radiation in gastric cancer cell," Biochimica et Biophysica Acta, vol. 1819: 1200-1207 (2012).
Kitkumthorn, et al., "Cyclin A1 promoter hypermethylation in human papillomavirus-associated cervical cancer," BMC Cancer, vol. 6(55) 9 pages (2006).
Klajic, et al., "DNA Methylation Status of Key Cell-Cycle Regulators Such as CDKNA2/p16 and CCNA1 Correlates with Treatment Response to Doxorubicin and 5-Fluorouracil in Locally Advanced Breast Tumors," Clinical Cancer Research, vol. 20(24): 6357-6366 (2014).
Li, et al., "A network-based, integrative approach to identify genes with aberrant co-methylation in colorectal cancer," Molecular BioSystems, vol. 10: 180-190 (2014).
Li, et al., "Sensitive digital quantification of DNA methylation in clinical samples," Nature Biotechnology, vol. 27(9): 858-863 (2009).
Li, et al., "Supplemental files for 'A network-based, integrative approach to identify genes with aberrant co-methylation in colorectal cancer'," Electronic Supplementary Material (ESI) for Molecular BioSystems, 16 pages (2013).
Liang, et al., "Integrative Identification of Epstein-Barr Virus-Associated Mutations and Epigenetic Alterations in Gastric Cancer," Gastroenterology, vol. 147(6): 1350-1362 (2014).
Lim, et al., "Cervical dysplasia: Assessing methylation status (Methylight) of CCNA1, DAPK1, HS3ST2, PAX1 and TFPI2 to improve diagnostic accuracy," Gynecologic Oncology, vol. 119: 225-231 (2010).
Lin et al. "Deletion or epigenetic silencing of AJAP1 on 1p36 in glioblastoma," Mol Cancer Res. vol. 10, pp. 208-217 (Jan. 2012).
Loh, et al., "DNA methylation subgroups and the CpG island methylator phenotype in gastric cancer: a comprehensive profiling approach," BMC Gastroenterology, vol. 14(55) 11 pages (2014).
Longo, et al., "Evaluation of the methylation profile of exfoliated cell samples from patients with head and neck squamous cell carcinoma," Head and Neck, vol. 36: 631-637 (2014).
Maldonado, et al., "An epigenetic marker panel for recurrence risk prediction of low grade papillary urothelial cell carcinoma (LGPUCC) and its potential use for surveillance after transurethral resection using urine," Oncotarget, vol. 5(14): 5218-5233 (2014).
Moinova et al, "Aberrant Vimentin Methylation is Characteristic of Upper Gastrointestinal Pathologies," Cancer Epidemiology, Biomarkers and Prevention, vol. 21(4): 594-600 Feb. 7, 2012.
Müller, et al., "Methylation of the Cyclin A1 Promoter Correlates with Gene Silencing in Somatic Cell Lines, while Tissue-Specific Expression of Cyclin A1 Is Methylation Independent," Molecular and Cell Biology, vol. 20(9): 3316-3329 (2000).
New England Biolabs, Random Primers, p. 111, 96/97 catalog (1997).
Ongenaert, et al., "Discovery of DNA methylation markers in cervical cancer using relaxation ranking," BMC Medical Genomics, vol. 1(57) 15 pages (2008).
Rettori, et al., "Prognostic significance of TIMP3 hypermethylation in post-treatment salivary rinse from head and neck squamous cell carcinoma patients," Carcinogenesis, vol. 34(1): 20-27 (2013).
Rettori, et al., "TIMP3 and CCNA1 hypermethylation in HNSCC is associated with an increased incidence of second primary tumors," Journal of Translational Medicine, vol. 11(316) 11 pages (2013).
Sartor, et al., "Genome-wide methylation and expression differences in HPV(+) and HPV(−) squamous cell carcinoma cell lines are consistent with divergent mechanisms of carcinogenesis," Epigenetics, vol. 6(6): 777-787 (2011).
Shah, et al. "Endoscopic options for early stage esophageal cancer", Journal of; Gastrointestinal Oncology. 2015, vol. 6, pp. 20-30 (2015).
Shaw, et al., "Methylation enrichment pyrosequencing: combining the specificity of MSP with validation by pyrosequencing," Nucleic Acids Research, vol. 34(11): e78 (2006).
Shaw, et al., "Promoter methylation of P16, RARβ, E-cadherin, cyclin A1 and cytoglobin in oral cancer: quantitative evaluation using pyrosequencing," British Journal of Cancer, vol. 94(4): 561-568 (2006).
Starlard-Davenport, et al., "Restoration of the methylation status of hypermethylated gene promoters by microRNA-29b in human breast cancer: A novel epigenetic therapeutic approach," Journal of Carcinogenesis, vol. 12(15) 18 pages (2013).
Stockdale et al. "Epigenetic alterations in Barrett's esophagus and esophageal adenocarcinoma: Identification and evaluation of potential biomarkers," Cancer Res., vol. 74, 19 Suppl, (Oct. 1, 2014).
Sun, et al., "Comparison of Promoter Hypermethylation Pattern in Salivary Rinses Collected with and without an Exfoliating Brush with Patients with HNSCC," PLOS One, vol. 7(3): e33642 (2012).

(56) References Cited

OTHER PUBLICATIONS

Sun, et al., "Detection of TIMP3 promoter hypermethylation in salivary rinse as an independent predictor of local recurrence-free survival in head and neck cancer," Clinical Cancer Research, vol. 18(4): 1082-1091 (2012).

Tan, et al., "Quantitative methylation analyses of resection margins predict local recurrences and disease-specific deaths in patients with head and neck squamous cell carcinomas," British Journal of Cancer, vol. 99(2): 357-363 (2008).

Tokumaru, et al., "Inverse Correlation between Cyclin A1 Hypermethylation and p53 Mutation in Head and Neck Cancer Identified by Reversal of Epigenetic Silencing," Cancer Research, vol. 64: 5982-5987 (2004).

Weiss, et al., "Promoter Methylation of Cyclin A1 Is Associated With Human Papillomavirus 16 Induced Head and Neck Squamous Cell Carcinoma Independently of p53 Mutation," Molecular Carcinogenesis, vol. 50: 680-688 (2011).

Wu, et al. "Aberrant gene methylation in the neoplastic progression of Barrett's; esophagus: identification of candidate diagnostic markers", Gastroenterology, vol. 140, p. S-222 (2011).

Xiong, et al., "COBRA: a sensitive and quantitative DNA methylation assay," Nucleic Acids Research, vol. 25(12): 2532-2534 (1997).

Xu, E. et al., "Genome-wide methylation analysis shows similar patterns in Barrett's Esophagus and Esophageal Adenocarcinoma," Carcinogenesis, vol. 34(12): 2750-2756 Aug. 29, 2013.

Yanatatsaneejit, et al., "Human Papillomavirus's Physical State and Cyclin A1 Promoter Methylation in Cervical Cancer," International Journal of Gynecological Cancer, vol. 21(5): 902-906 (2011).

Yanatatsaneejit, et al., "Promoter hypermethylation of CCNA1, RARRES1, and HRASLS3 in nasopharyngeal carcinoma," Oral Oncology, vol. 44: 400-406 (2008).

Yang, et al., "Gene promoter methylation patterns throughout the process of cervical carcinogenesis," Cellular Oncology, vol. 32: 131-143 (2010).

Yang, et al., "Methylation Markers for CCNA1 and C13ORF18 Are Strongly Associated with High-Grade Cervical Intraepithelial Neoplasia and Cervical Cancer in Cervical Scrapings," Cancer Epidemiology, Biomarkers and Prevention, vol. 18(11): 3000-3007 (2009).

Yu, et al., "A Novel Set of DNA Methylation Markers in Urine Sediments for Sensitive/Specific Detection of Bladder Cancer," Clinical Cancer Research, vol. 13(24): 7296-7304 (2007).

Adams, et al., "Promotor Methylation in Cytology Specimens as an Early Detection Marker for Esophageal Squamous Dysplasia and Early Esophageal Squamous Cell Carcinoma", Cancer Prevention Research, 1(5), Oct. 2008.

Redshaw, et al., "Quantification of epigenetic biomarkers: an evaluation of established and emerging methods for DNA methylation analysis", BMC Genomics, 15:1174, (2014).

Tokumaru, et al., "Aberrant Promoter Hypermethylation of Cyclin A1 in Cancer", Japanese Journal of Head and Neck Cancer, 32(4) pp. 410-416 (2006) (with English Abstract).

GenBank record having accession AF124143. Apr. 20, 1999. *Homo sapiens* cyclin A1 gene, promoter region, exon 1, and partial cds 2 pages (1999).

Dennis, J. et al., Aberrant Gene Methylation in the Neoplastic Progression of Barrett's Esophagus: Identification of Candidate Diagnostic Markers, Gastroenterology, vol. 140(5), Supplement 1 (Sa1092): S-222 (2011).

Haipeng, Bai et al., "The Research Progress of Esophageal Cancel and Its Treatment," Journal of Baotou Medical College, vol. 30(3): (3 pages) (2014).

International Search Report and Written Opinion for Application PCT/US2015/068131 dated Jun. 6, 2016, 6 pages.

International Search Report and Written Opinion for Application PCT/US2017/040708 dated Aug. 28, 2017, 8 pages.

Koss et al., Evaluation of Esophageal Cytology Using a Neural Net-Based Interative Scanning System (the PAPNET System); Am J Clin Pathol 1998; 109:549-557 (Year: 1998).

Lee et al., "Analyzing the Cancer Methylome through targeted bisulfite sequencing", Cancer Lett. Nov. 1, 2013; 340(2); 16 pages (2013).

Kato, H. & Nakajima, M., "Treatments for esophageal cancer: a review", Gen Thorac Cardiovasc Surg., vol. 61(6): 330-335 (Sep. 4, 2013).

Adams et al., "Promoter Methylation in Cytology Specimens as an Early Detection Marker for Esophageal Squamous Dysplasia and Early Esophageal Squamous Cell Carcinoma", Cancer Prevention Research, vol. 1: 357-361 (2008).

\* cited by examiner

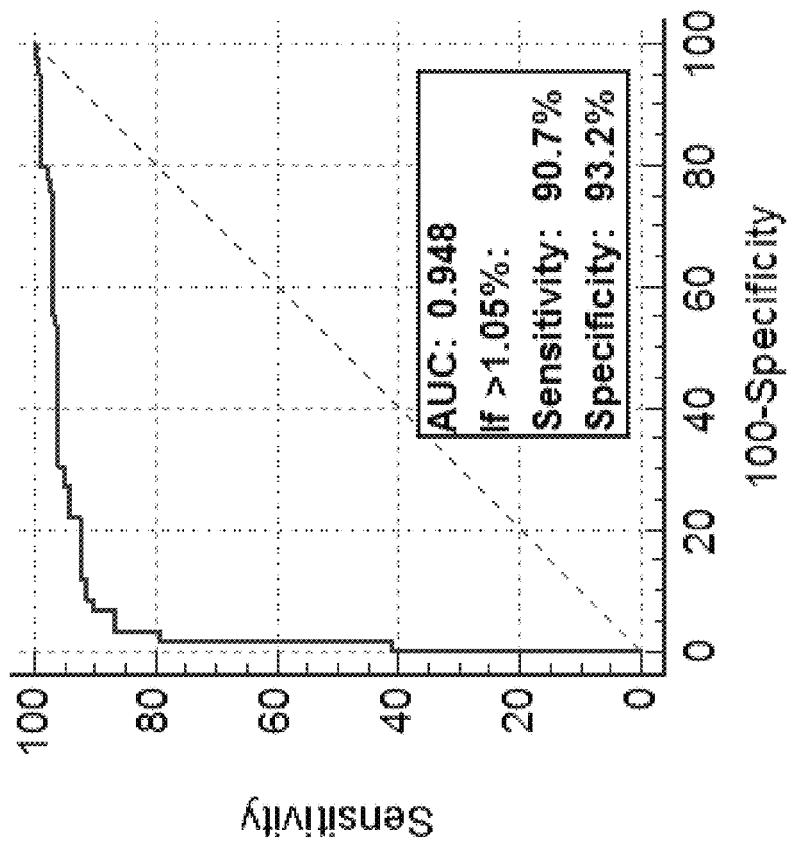

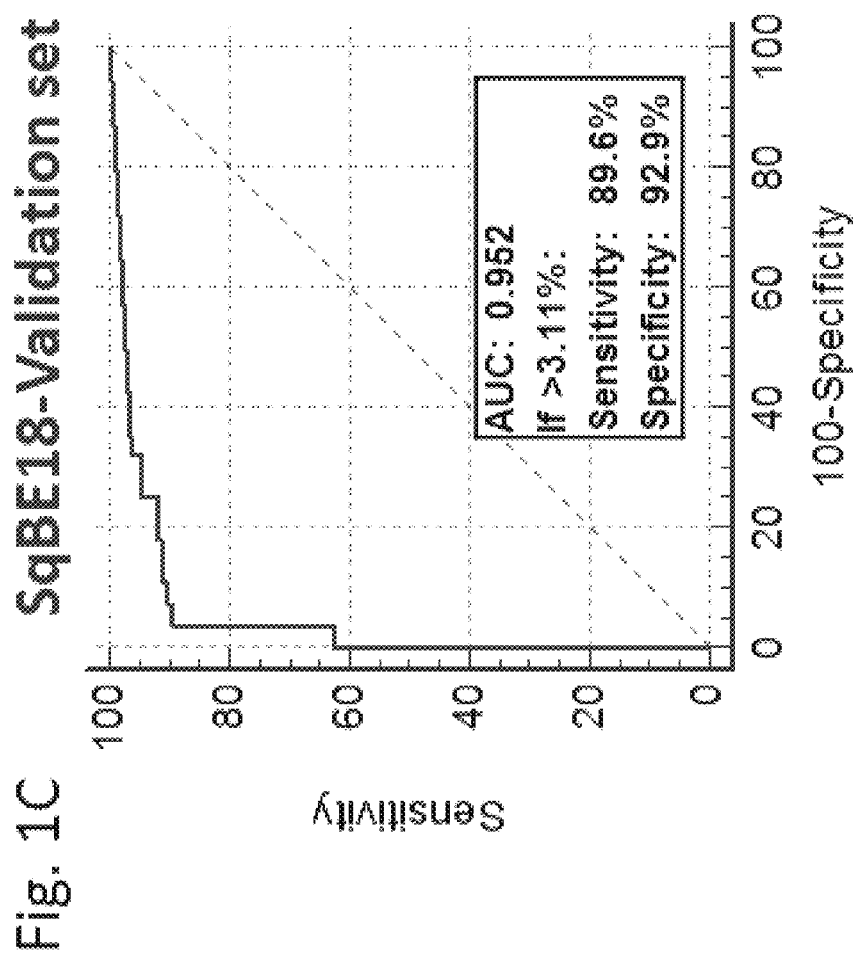

| | mVIM (Positive if > 1.05%) | | mSqBE18 (Positive if > 3.11%) | | Either mVIM or mSqBE18 Positive (one-marker fails censored) | | Either mVIM or mSqBE18 Positive (one-marker fails counted) | |
|---|---|---|---|---|---|---|---|---|
| | % | # | % | # | % | # | % | # |
| Specificity Control GEJ (GERD, EE, other) | 93.2% | 59 | 98.4% | 61 | 91.4% | 58 | 91.9% | 62 |
| Sensitivity ND SSBE | 91.7% | 12 | 83.3% | 12 | 91.7% | 12 | 91.7% | 12 |
| Sensitivity ND LSBE | 88.9% | 18 | 76.5% | 17 | 93.8% | 16 | 89.5% | 19 |
| Sensitivity NDBE combined | 90.0% | 30 | 79.3% | 29 | 92.9% | 28 | 90.3% | 31 |
| Sensitivity LGD | 100.0% | 7 | 87.5% | 8 | 100.0% | 7 | 100.0% | 8 |
| Sensitivity HGD | 100.0% | 10 | 100.0% | 10 | 100.0% | 10 | 100.0% | 10 |
| Sensitivity dysplastic BE combined | 100.0% | 17 | 94.4% | 18 | 100.0% | 17 | 100.0% | 18 |
| Sensitivity Cancer | 88.3% | 60 | 95.1% | 61 | 96.6% | 59 | 96.8% | 62 |
| All cases (NDBE through cancer) combined | 90.7% | 107 | 90.7% | 108 | 96.2% | 104 | 95.5% | 111 |

Fig. 3

| | mVIM (Positive if > 1.05%) | | mSqBE18 (Positive if > 3.11%) | | Either mVIM or mSqBE18 Positive (one-marker fails censored) | | Either mVIM or mSqBE18 Positive (one-marker fails counted) | |
|---|---|---|---|---|---|---|---|---|
| | % | # | % | # | % | # | % | # |
| Specificity Control GEJ (GERD, EE, other) | 92.6% | 27 | 92.9% | 28 | 88.5% | 26 | 89.7% | 29 |
| Sensitivity ND SSBE | 84.2% | 19 | 72.2% | 18 | 83.3% | 18 | 84.2% | 19 |
| Sensitivity ND LSBE | 100.0% | 22 | 86.4% | 22 | 100.0% | 22 | 100.0% | 22 |
| Sensitivity NDBE combined | 92.7% | 41 | 80.0% | 40 | 92.5% | 40 | 92.7% | 41 |
| Sensitivity LGD | 92.3% | 26 | 91.7% | 24 | 95.8% | 24 | 92.3% | 26 |
| Sensitivity HGD | 76.9% | 13 | 100.0% | 13 | 100.0% | 13 | 100.0% | 13 |
| Sensitivity dysplastic BE combined | 87.2% | 39 | 94.6% | 37 | 97.3% | 37 | 94.9% | 39 |
| Sensitivity Cancer | 94.6% | 37 | 94.7% | 38 | 94.6% | 37 | 94.7% | 38 |
| All cases (NDBE through cancer) combined | 91.5% | 117 | 89.6% | 115 | 94.7% | 114 | 94.1% | 118 |

Fig. 4

|  | mVIM (Positive if > 1.05%) | | mSqBE18 (Positive if > 3.11%) | | Either mVIM or mSqBE18 Positive | |
|---|---|---|---|---|---|---|
|  | % | # | % | # | % | # |
| Specificity Control GEJ (GERD, EE, other) | 93.0% | 86 | 96.6% | 89 | 90.5% | 84 |
| Sensitivity ND SSBE | 87.1% | 31 | 76.7% | 30 | 87.1% | 31 |
| Sensitivity ND LSBE | 95.0% | 40 | 82.1% | 39 | 95.1% | 41 |
| Sensitivity NDBE combined | 91.5% | 71 | 79.7% | 69 | 91.7% | 72 |
| Sensitivity LGD | 93.9% | 33 | 90.6% | 32 | 94.1% | 34 |
| Sensitivity HGD | 87.0% | 23 | 100.0% | 23 | 100.0% | 23 |
| Sensitivity dysplastic BE combined | 91.1% | 56 | 94.5% | 55 | 96.5% | 57 |
| Sensitivity Cancer | 90.7% | 97 | 94.9% | 99 | 96.0% | 100 |

Fig. 5

| | mVIM (Positive if > 1%) | | mSqBE18 (Positive if > 1%) | | Either mVIM or mSqBE18 Positive | |
|---|---|---|---|---|---|---|
| | % | # | % | # | % | # |
| Specificity Control GEJ (GERD, EE, other) | 89.5% | 38 | 100.0% | 38 | 89.5% | 38 |
| Sensitivity ND SSBE | 69.2% | 13 | 53.8% | 13 | 84.6% | 13 |
| Sensitivity ND LSBE | 88.9% | 18 | 83.3% | 18 | 94.4% | 18 |
| Sensitivity NDBE combined | 80.6% | 31 | 71.0% | 31 | 90.3% | 31 |
| Sensitivity LGD | 83.3% | 6 | 100.0% | 6 | 100.0% | 6 |
| Sensitivity HGD | 50.0% | 4 | 50.0% | 4 | 50.0% | 4 |
| Sensitivity dysplastic BE combined | 72.7% | 11 | 72.7% | 11 | 81.8% | 11 |
| Sensitivity Cancer | 87.5% | 8 | 75.0% | 8 | 87.5% | 8 |

Fig. 7

METHODS AND COMPOSITIONS FOR DETECTING ESOPHAGEAL NEOPLASIAS AND/OR METAPLASIAS IN THE ESOPHAGUS

CROSS-REFERENCE TO RELATED APPLICATIONS

This application is a United States National Stage filing under 35 U.S.C. § 371 of International Application No. PCT/US2017/040708, filed on Jul. 5, 2017 and claims priority to U.S. provisional application Ser. No. 62/358,701, filed on Jul. 6, 2016. The disclosures of the foregoing applications are hereby incorporated by reference in their entirety. International Application No. PCT/US2017/040708 was published under PCT Article 21 (2) in English.

FUNDING

This invention was made with government support under U01CA152756; U54CA163060; and P50CA150964 awarded by the National Institutes of Health (NIH). The government has certain rights in the invention.

SEQUENCE LISTING

The instant application contains a Sequence Listing which has been submitted via EFS-Web and is hereby incorporated by reference in its entirety. Said ASCII copy, created on Jan. 2, 2019, is named 1848493-0002-098-301_SL.TXT and is 14,247,811 bytes in size.

BACKGROUND

Over 15,000 new cases of esophageal cancer were diagnosed in 2010, and there were nearly as many deaths from this cancer alone. As with other cancers, this rate can be decreased by improved methods for diagnosis. Although methods for detecting esophageal cancer exist, the methods are not ideal. Generally, a combination of endoscopy, isolation of cells (for example, via collection of cells/tissues from a fluid sample or from a tissue sample), and/or imaging technologies are used to identify cancerous cells and tumors. While upper endoscopy, usually performed by a gastroenterologist, can detect neoplasias of the esophagus, as well as of the stomach and duodenum, it is an uncomfortable and expensive procedure. Other detection procedures, such as barium esophogography are also available, but are associated with false positives, false negatives, and cost and discomfort issues.

Because of the disadvantages of existing methods for detecting or treating esophageal neoplasias/cancers, new methods are needed for esophageal neoplasia/cancer diagnosis and therapy.

SUMMARY OF THE DISCLOSURE

In certain aspects, the present disclosure is based in part on the discovery of particular human genomic DNA regions (also referred to herein as informative loci or patches) in which the cytosines within CpG dinucleotides are differentially methylated in esophageal neoplasia compared to normal human tissues.

A first aspect of the present disclosure provides a method of diagnosing whether a subject has an esophageal neoplasia or metaplasia, comprising: obtaining a sample from a subject; measuring the amount of methylated cytosines in CpG dinucleotides in a vimentin nucleic acid sequence, or portion thereof, obtained from the sample; wherein if at least 80% of the cytosines in CpG dinucleotides in the vimentin nucleic acid sequence, or portion thereof, are methylated, than the vimentin nucleic acid sequence, or portion thereof, is considered a methylated read; and measuring the number of methylated reads present in the sample, wherein if at least 1% of the vimentin nucleic acid sequences, or portions thereof, in the sample are methylated reads, than the subject is determined to have an esophageal neoplasia or metaplasia.

In some embodiments, the vimentin nucleic acid sequences from the sample are treated with bisulfite. Optionally, the sequence of the bisulfite converted nucleic acid sequences is determined by next-generation sequencing. In some embodiments, the level of methylated cytosines is determined in an amplified portion of the vimentin nucleic acid sequence obtained from the subject. Optionally, between the amplification primers, the amplified portion comprises 10 dinucleotides that correspond to or are derived from 10 CpG dinucleotides present in the native non-bisulfite treated vimentin genomic sequence. In some embodiments, the primers used to amplify the portion of the vimentin nucleic acid sequence comprise SEQ ID NOs: 16209 and 16210. Optionally, the amplified portion comprises the nucleotide sequence of SEQ ID NOs: 16207 and/or 16208. In some embodiments, the 10 CpGs correspond to those that, after bisulfite treatment, are included in SEQ ID Nos: 16211 and 16212.

In some embodiments, if at least 1.05% of the vimentin nucleic acid sequences, or portions thereof, in the sample are methylated reads, than the subject is determined to have an esophageal neoplasia or metaplasia. Optionally, if at least 3% of the vimentin nucleic acid sequences, or portions thereof, in the sample are methylated reads, than the subject is determined to have an esophageal neoplasia or metaplasia. In some embodiments, if at least 5% of the vimentin nucleic acid sequences, or portions thereof, in the sample are methylated reads, than the subject is determined to have an esophageal neoplasia or metaplasia.

In some embodiments, if the subject is determined to have an esophageal neoplasia or metaplasia, then administering to the subject cryotherpy, photodynamic therapy (PDT); radiofrequency ablation (RFA); laser ablation; argon plasma coagulation (APC); electrocoagulation (electrofulguration); esophageal stent, surgery, and/or a therapeutic agent.

A second aspect of the present disclosure provides a method of treating a subject having an esophageal neoplasia or metaplasia, wherein it has been previously determined that at least 1% of the vimentin nucleic acid sequences, or portions thereof, in a sample from the subject have at least 80% of the CpG dinucleotides methylated, wherein the method comprises administering to the subject cryotherpy, photodynamic therapy (PDT); radiofrequency ablation (RFA); laser ablation; argon plasma coagulation (APC); electrocoagulation (electrofulguration); esophageal stent, surgery, and/or a therapeutic agent.

In some embodiments, the therapeutic agent is a proton pump inhibitor, a Histamine H2 receptor blocking agents, an anti-reflux medication, a drug that moves food thru the gastrointestinal tract more quickly, carboplatin and paclitaxel (Taxol®) (which may be combined with radiation); cisplatin and 5-fluorouracil (5-FU) (often combined with radiation); ECF: epirubicine (Ellence®), cisplatin, and 5-FU (especially for gastroesophageal junction tumors); DCF: docetaxel (Taxotere®), cisplatin, and 5-FU; Cisplatin with capecitabine (Xelodat®): oxaliplatin and either 5-FU or capecitabine: doxorubicin (Adriamycin®), bleomycin, mitomycin, methotrexate, vinorelbine (Navelbine®), topotecan, and irinotecan (Camptosar®), trastuzumab, and/or ramucirumab. Optionally, the surgery is endoscopic mucosal resection (EMR), esophagectomy, and/or anti-reflux surgery.

In some embodiments, the disclosure provides for a method of diagnosing whether a subject has an esophageal neoplasia or metaplasia, comprising: obtaining a sample from a subject by means of a brushing (e.g., a cytology brushing); measuring the amount of methylated cytosines in CpG dinucleotides in an SqBE18 nucleic acid sequence, or portion thereof, obtained from the sample; wherein if at least 70% or at least 75% of the cytosines in CpG dinucleotides in the SqBE18 nucleic acid sequence, or portion thereof, are methylated, than the SqBE18 nucleic acid sequence, or portion thereof, is considered a methylated read; and measuring the number of methylated reads present in the sample: wherein if at least 3% of the SqBE18 nucleic acid sequences, or portions thereof, in the sample are methylated reads, than the subject is determined to have an esophageal neoplasia or metaplasia. In some embodiments, the SqBE18 nucleic acid sequences from the sample are treated with bisulfite. In some embodiments, the sequence of the bisulfite converted nucleic acid sequences is determined by next-generation sequencing. In some embodiments, the level of methylated cytosines is determined in an amplified portion of the SqBE18 nucleic acid sequence obtained from the subject. In some embodiments, the amplified portion comprises 21 dinucleotides that correspond to or are derived from 21 CpG dinucleotides present in the native non-bisulfite treated SqBE18 genomic sequence. In some embodiments, if at least 3.11% of the SqBE18 nucleic acid sequences, or portions thereof, in the sample are methylated reads, than the subject is determined to have an esophageal neoplasia or metaplasia. In some embodiments, if the subject is determined to have an esophageal neoplasia or metaplasia, then the method further comprises administering to the subject cryotherpy, photodynamic therapy (PDT); radiofrequency ablation (RFA); laser ablation; argon plasma coagulation (APC); electrocoagulation (electrofulguration); esophageal stent, surgery, and/or a therapeutic agent.

In some embodiments, the disclosure provides for a method of treating a subject having an esophageal neoplasia or metaplasia, wherein it has been previously determined that at least 3% of the SqBE18 nucleic acid sequences, or portions thereof, in a brushing (e.g., a cytology brushing) sample from the subject have at least 70% or at least 75% of the CpG dinucleotides methylated, wherein the method comprises administering to the subject cryotherpy, photodynamic therapy (PDT); radiofrequency ablation (RFA); laser ablation; argon plasma coagulation (APC); electrocoagulation (electrofulguration); esophageal stent, surgery, and/or a therapeutic agent. In some embodiments, the therapeutic agent is a proton pump inhibitor, a Histamine H2 receptor blocking agents, an anti-reflux medication, a drug that moves food thru the gastrointestinal tract more quickly, carboplatin and paclitaxel (Taxol®) (which may be combined with radiation); cisplatin and 5-fluorouracil (5-FU) (often combined with radiation); ECF: epirubicine (Ellence®), cisplatin, and 5-FU (especially for gastroesophageal junction tumors); DCF: docetaxel (Taxotere®), cisplatin, and 5-FU; Cisplatin with capecitabine (Xeloda®); oxaliplatin and either 5-FU or capecitabine; doxorubicin (Adriamycin®), bleomycin, mitomycin, methotrexate, vinorelbine (Navelbine®), topotecan, and irinotecan (Camptosar®), trastuzumab, and/or ramucirumab. In some embodiments, the surgery is endoscopic mucosal resection (EMR), esophagectomy, and/or anti-reflux surgery. In some embodiments, the disclosure provides for a method of diagnosing whether a subject has an esophageal neoplasia or metaplasia, comprising: obtaining a sample from a subject by means of a balloon; measuring the amount of methylated cytosines in CpG dinucleotides in an SqBE18 nucleic acid sequence, or portion thereof, obtained from the sample; wherein if at least 70% or at least 75% of the cytosines in CpG dinucleotides in the SqBE18 nucleic acid sequence, or portion thereof, are methylated, than the SqBE18 nucleic acid sequence, or portion thereof, is considered a methylated read; and measuring the number of methylated reads present in the sample; wherein if at least 0.1% of the SqBE18 nucleic acid sequences, or portions thereof, in the sample are methylated reads, than the subject is determined to have an esophageal neoplasia or metaplasia. In some embodiments, the SqBE18 nucleic acid sequences from the sample are treated with bisulfite. In some embodiments, the sequence of the bisulfite converted nucleic acid sequences is determined by next-generation sequencing. In some embodiments, the level of methylated cytosines is determined in an amplified portion of the SqBE18 nucleic acid sequence obtained from the subject. In some embodiments, the amplified portion comprises 21 dinucleotides that correspond to or are derived from 21 CpG dinucleotides present in the native non-bisulfite treated SqBE18 genomic sequence. In some embodiments, if at least 0.76% of the SqBE18 nucleic acid sequences, or portions thereof, in the sample are methylated reads, than the subject is determined to have an esophageal neoplasia or metaplasia. In some embodiments, if at least 1% of the SqBE18 nucleic acid sequences, or portions thereof, in the sample are methylated reads, than the subject is determined to have an esophageal neoplasia or metaplasia. In some embodiments, if the subject is determined to have an esophageal neoplasia or metaplasia, then the method further comprises administering to the subject cryotherpy, photodynamic therapy (PDT); radiofrequency ablation (RFA): laser ablation; argon plasma coagulation (APC); electrocoagulation (electrofulguration); esophageal stent, surgery, and/or a therapeutic agent.

In some embodiments, the disclosure provides for a method of treating a subject having an esophageal neoplasia or metaplasia, wherein it has been previously determined that at least 1% of the SqBE18 nucleic acid sequences, or portions thereof, in a balloon sample from the subject have at least 70% of the CpG dinucleotides methylated, wherein the method comprises administering to the subject cryotherpy, photodynamic therapy (PDT); radiofrequency ablation (RFA); laser ablation; argon plasma coagulation (APC); electrocoagulation (electrofulguration); esophageal stent, surgery, and/or a therapeutic agent. In some embodiments, the therapeutic agent is a proton pump inhibitor, a Histamine H2 receptor blocking agents, an anti-reflux medication, a drug that moves food thru the gastrointestinal tract more quickly, carboplatin and paclitaxel (Taxol®) (which may be combined with radiation); cisplatin and 5-fluorouracil (5-FU) (often combined with radiation); ECF: epirubicine (Ellence®), cisplatin, and 5-FU (especially for gastroesophageal junction tumors); DCF: docetaxel (Taxotere®), cisplatin, and 5-FU; Cisplatin with capecitabine (Xeloda®); oxaliplatin and either 5-FU or capecitabine; doxorubicin (Adriamycin®), bleomycin, mitomycin, methotrexate, vinorelbine (Navelbine®), topotecan, and irinotecan (Camptosar®), trastuzumab, and/or ramucirumab. In some embodiments, the surgery is endoscopic mucosal resection (EMR), esophagectomy, and/or anti-reflux surgery.

In some embodiments, the disclosure provides for a method of diagnosing whether a subject has an esophageal neoplasia or metaplasia, comprising: obtaining a sample from a subject by means of a brushing (e.g., a cytology brushing), measuring the amount of methylated cytosines in CpG dinucleotides in a vimentin nucleic acid sequence, or portion thereof, obtained from the sample: wherein if at least 80% of the cytosines in CpG dinucleotides in the vimentin nucleic acid sequence, or portion thereof, are methylated, than the vimentin nucleic acid sequence, or portion thereof, is considered a vimentin methylated read; measuring the amount of methylated cytosines in CpG dinucleotides in an SqBE18 nucleic acid sequence, or portion thereof, obtained from the sample; wherein if at least 70% or 75% of the cytosines in CpG dinucleotides in the SqBE18 nucleic acid sequence, or portion thereof, are methylated, than the SqBE18 nucleic acid sequence, or portion thereof, is considered an SqBE18 methylated read; and measuring the number of methylated reads present in the sample; wherein if at least 1% of the vimentin nucleic acid sequences, or portions thereof, in the sample are vimentin methylated reads, and wherein if at least 3% of the SqBE18 nucleic acid sequences, or portions thereof, in the sample are SqBE18 methylated reads, than the subject is determined to have an esophageal neoplasia or metaplasia. In some embodiments, the vimentin and SqBE18 nucleic acid sequences from the sample are treated with bisulfite. In some embodiments, the sequence of the bisulfite converted nucleic acid sequences is determined by next-generation sequencing. In some embodiments, the level of methylated cytosines is determined in an amplified portion of the vimentin nucleic acid sequence and in an amplified portion of the SqBE18 nucleic acid sequence obtained from the subject. In some embodiments, the amplified portion of the SqBE18 nucleic acid sequence comprises 21 dinucleotides that correspond to or are derived from 21 CpG dinucleotides present in the native non-bisulfite treated SqBE18 genomic sequence. In some embodiments, the amplified portion of the vimentin nucleic acid sequence comprises 10 dinucleotides that correspond to or are derived from 10 CpG dinucleotides present in the native non-bisulfite treated vimentin genomic sequence. In some embodiments, if at least 1% of the vimentin nucleic acid sequences, or portions thereof, in the sample are vimentin methylated reads, wherein if at least 3.11% of the SqBE18 nucleic acid sequences, or portions thereof, in the sample are methylated reads, than the subject is determined to have an esophageal neoplasia or metaplasia. In some embodiments, if the subject is determined to have an esophageal neoplasia or metaplasia, then the method further comprises administering to the subject cryotherpy, photodynamic therapy (PDT); radiofrequency ablation (RFA); laser ablation; argon plasma coagulation (APC); electrocoagulation (electrofulguration); esophageal stent, surgery, and/or a therapeutic agent.

In some embodiments, the disclosure provides for a method of treating a subject having an esophageal neoplasia or metaplasia, wherein it has been previously determined that at least 1% of the vimentin nucleic acid sequences, or portions thereof, in a brushing (e.g., a cytology brushing) sample from the subject have at least 80% of the CpG dinucleotides methylated, wherein it has been previously determined that at least 3% of the SqBE18 nucleic acid sequences, or portions thereof, in a brushing (e.g., a cytology brushing) sample from the subject have at least 75% of the CpG dinucleotides methylated, and wherein the method comprises administering to the subject cryotherpy, photodynamic therapy (PDT); radiofrequency ablation (RFA); laser ablation; argon plasma coagulation (APC); electrocoagulation (electrofulguration); esophageal stent, surgery, and/or a therapeutic agent. In some embodiments, the therapeutic agent is a proton pump inhibitor, a Histamine H2 receptor blocking agents, an anti-reflux medication, a drug that moves food thru the gastrointestinal tract more quickly, carboplatin and paclitaxel (Taxol®) (which may be combined with radiation): cisplatin and 5-fluorouracil (5-FU) (often combined with radiation); ECF: epirubicine (Ellence®), cisplatin, and 5-FU (especially for gastroesophageal junction tumors); DCF: docetaxel (Taxotere®), cisplatin, and 5-FU; Cisplatin with capecitabine (Xeloda®); oxaliplatin and either 5-FU or capecitabine: doxorubicin (Adriamycin®), bleomycin, mitomycin, methotrexate, vinorelbine (Navelbine®), topotecan, and irinotecan (Camptosar®), trastuzumab, and/or ramucirumab. In some embodiments, the surgery is endoscopic mucosal resection (EMR), esophagectomy, and/or anti-reflux surgery. In some embodiments, method of diagnosing whether a subject has an esophageal neoplasia or metaplasia, comprising: obtaining a sample from a subject by means of a balloon; measuring the amount of methylated cytosines in CpG dinucleotides in a vimentin nucleic acid sequence, or portion thereof, obtained from the sample: wherein if at least 80% of the cytosines in CpG dinucleotides in the vimentin nucleic acid sequence, or portion thereof, are methylated, than the vimentin nucleic acid sequence, or portion thereof, is considered a vimentin methylated read; measuring the amount of methylated cytosines in CpG dinucleotides in an SqBE18 nucleic acid sequence, or portion thereof, obtained from the sample; wherein if at least 70% or at least 75% of the cytosines in CpG dinucleotides in the SqBE18 nucleic acid sequence, or portion thereof, are methylated, than the SqBE18 nucleic acid sequence, or portion thereof, is considered a SqBE18 methylated read; and measuring the number of methylated reads present in the sample; wherein if at least 0.95% of the vimentin nucleic acid sequences, or portions thereof, in the sample are vimentin methylated reads, and wherein if at least 0.1% of the SqBE18 nucleic acid sequences, or portions thereof, in the sample are SqBE18 methylated reads, than the subject is determined to have an esophageal neoplasia or metaplasia. In some embodiments, the vimentin and SqBE18 nucleic acid sequences from the sample are treated with bisulfite. In some embodiments, the sequence of the bisulfite converted nucleic acid sequences is determined by next-generation sequencing. In some embodiments, the level of methylated cytosines is determined in an amplified portion of the vimentin nucleic acid sequence and in an amplified portion of the SqBE18 nucleic acid sequence obtained from the subject. In some embodiments, the amplified portion comprises 21 dinucleotides that correspond to or are derived from 21 CpG dinucleotides present in the native non-bisulfite treated SqBE18 genomic sequence. In some embodiments, the amplified portion of the vimentin nucleic acid sequence comprises 10 dinucleotides that correspond to or are derived from 10 CpG dinucleotides present in the native non-bisulfite treated vimentin genomic sequence. In some embodiments, if at least 1% of the vimentin nucleic acid sequences, or portions thereof and if at least 0.76% of the SqBE18 nucleic acid sequences, or portions thereof, in the sample are methylated reads, than the subject is determined to have an esophageal neoplasia or metaplasia. In some embodiments, if at least 1% of the vimentin nucleic acid sequences, or portions thereof and at least 1% of the SqBE18 nucleic acid sequences, or portions thereof, in the sample are methylated reads, than the subject is determined to have an esophageal neoplasia or metaplasia. In some embodiments, if the subject is determined to have an esophageal neoplasia or metaplasia, then the method further comprises administering to the subject cryotherpy, photodynamic therapy (PDT); radiofrequency ablation (RFA); laser ablation; argon plasma coagulation (APC); electrocoagulation (electrofulguration); esophageal stent, surgery, and/or a therapeutic agent.

In some embodiments, the disclosure provides for a method of treating a subject having an esophageal neoplasia or metaplasia, wherein it has been previously determined that at least 1% of the SqBE18 nucleic acid sequences, or portions thereof, in a balloon sample from the subject have at least 70% or at least 75% of the CpG dinucleotides methylated, wherein the method comprises administering to the subject cryotherpy, photodynamic therapy (PDT); radiofrequency ablation (RFA); laser ablation; argon plasma coagulation (APC); electrocoagulation (electrofulguration); esophageal stent, surgery, and/or a therapeutic agent. In some embodiments, the therapeutic agent is a proton pump inhibitor, a Histamine H2 receptor blocking agents, an anti-reflux medication, a drug that moves food thru the gastrointestinal tract more quickly, carboplatin and paclitaxel (Taxol®) (which may be combined with radiation): cisplatin and 5-fluorouracil (5-FU) (often combined with radiation); ECF: epirubicine (Ellence®), cisplatin, and 5-FU (especially for gastroesophageal junction tumors); DCF: docetaxel (Taxotere®), cisplatin, and 5-FU; Cisplatin with capecitabine (Xeloda®); oxaliplatin and either 5-FU or capecitabine; doxorubicin (Adriamycin®), bleomycin, mitomycin, methotrexate, vinorelbine (Navelbine®), topotecan, and irinotecan (Camptosar®), trastuzumab, and/or ramucirumab. In some embodiments, the surgery is endoscopic mucosal resection (EMR), esophagectomy, and/or anti-reflux surgery.

In some embodiments, the primers used to amplify the portion of the SqBe18 nucleic acid sequence in any of the methods disclosed herein comprise SEQ ID NOs: 8388 and/or 8402. In some embodiments, the amplified portion comprises the nucleotide sequence of SEQ ID NOs: 8318, 8360, 8332 and/or 8374. In some embodiments, the amplified portion comprises the nucleotide sequence of SEQ ID NOs: 8332 and/or 8374. In some embodiments, the determination that the subject has an esophageal neoplasia or metaplasia is confirmed by an additional diagnostic assay. In some embodiments, the additional diagnostic assay is an endoscopic assay.

BRIEF DESCRIPTION OF THE FIGURES

FIG. 1A shows a ROC curve based on Next-Generation Bisulfite Sequencing assay for SqBE18 m the training set of 61 controls and 108 cases. FIG. 1B shows a ROC curve based on Next-Generation Bisulfite Sequencing VIM assay in the training set of 59 controls and 107 cases. FIG. 1C shows a ROC curve based on Next-Generation Bisulfite Sequencing assay for SqBE18 in the validation set of 28 controls and 115 cases.

FIG. 2A shows a VIM Sensitivity and specificity curve. The 8+ CpG cutoff (blue box), maximizes the sum of specificity for controls and sensitivity for cases. FIG. 2B shows a SqBE18 Sensitivity and specificity curve. The 15+, 16+, and 17+ CpG cutoffs offer identical maximum sensitivity+specificity sum for SqBE18. 16+ CpGs (blue box), was chosen as the middle of this range.

FIG. 3 is a table showing the performance of VIM and SqBE18 in a training set of brushings. Specificity Controls of the Gastroesophageal Junction (GEJ)=Unaffected controls (individuals with GERD, erosive esophagitis (EE), or no pathology detected during endoscopy ("other"): SSBE=short-segment Barrett's Esophagus (1 to 3 cm)): LSBE=Barrett's Esophagus (3 cm or more); LOD=Barret's Esophagus with Low-Grade Dysplasia; HGD=Barrett's Esophagus with High-Grade Dysplasia: Cancer=includes EAC (Esophageal adenocarcinoma) and JCA (Junctional cancer of the esophagus).

FIG. 4 is a table showing the performance of VIM and SqBE18 in VALIDATION set of bushings Specificity Controls of the Gastroesophageal Junction (GEJ)=Unaffected controls (individuals with GERD, erosive esophagitis (EE), or no pathology detected during endoscopy ("other")): SSBE=short-segment Barrett's Esophagus (1 to 3 cm)): LSBE=Barrett's Esophagus (3 cm or more); LOD=Barret's Esophagus with Low-Grade Dysplasia; HGD=Barrett's Esophagus with—High-Grade Dysplasia; Cancer=includes EAC (Esophageal adenocarcinoma) and JCA (Junctional cancer of the esophagus).

FIG. 5 is a table showing the performance of VIM and SqBE18 in a combination set of brushings. This table includes all the samples from training and validation set of brushings combined. Specificity Controls of the Gastroesophageal Junction (GEJ)===Unaffected controls (individuals with GERD, erosive esophagitis (EE), or no pathology detected during endoscopy ("other")): SSBE=short-segment Barrett's Esophagus (1 to 3 cm)): LSBE=Barrett's Esophagus (3 cm or more). LGD==Barret's Esophagus with Low-Grade Dysplasia; HGD=Barrett's Esophagus with High-Grade Dysplasia: Cancer=includes EAC (Esophageal adenocarcinoma) and JCA (Junctional cancer of the esophagus).

FIG. 6A shows a ROC curve based on Next-Generation Bisulfite Sequencing assay for VIM in the training set of 38 controls and 50 cases. FIG. 6B shows a ROC curve based on Next-Generation Bisulfite Sequencing SqBE18 assay in the training set of 38 controls and 50 cases. Area under the curve (AUC), and the sensitivity and specificity of the assay at the optimal cutpoint are listed for each graph.

FIG. 7 is a table showing performance of VIM and SqBE18 in Esophageal balloon samples. Specificity Controls of the Gastroesophageal Junction (GEJ)=Unaffected controls (individuals with GERD, erosive esophagitis (EE), or no pathology detected during endoscopy ("other")); SSBE===short-segment Barrett's Esophagus (1 to 3 cm)): LSBE==Barrett's Esophagus (3 cm or more): LGD=Barret's Esophagus with Low-Grade Dysplasia; HGD==Barrett's Esophagus with High-Grade Dysplasia; Cancer=: includes EAC (Esophageal adenocarcinoma) and JCA (Junctional cancer of the esophagus).

DETAILED DESCRIPTION OF THE INVENTION

I. Definitions

Figure 1A:
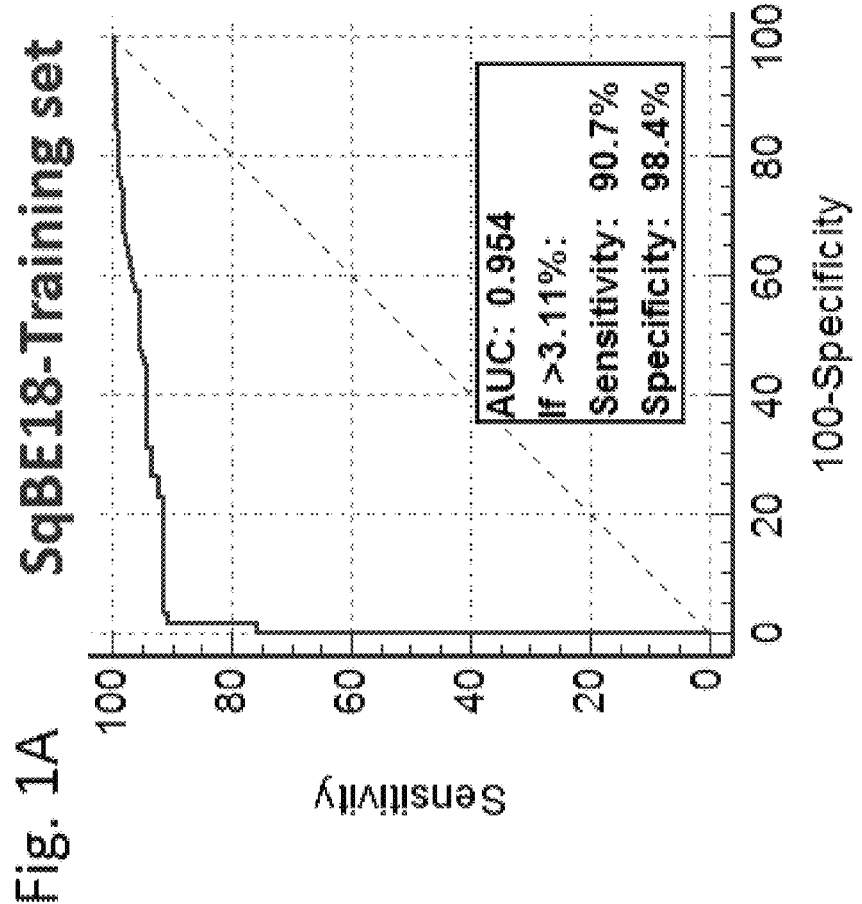
FIGS. 1A-ID show the Receiver Operating Characteristic (ROC) curves of methylated vimentin (VIM) and SqBE18 measurement in esophageal cytology brushings of the normal appearing GE junction or of endoscopically visualized BE or EAC.

For convenience, certain terms employed in the specification, examples, and appended claims are collected here. Unless defined otherwise, all technical and scientific terms used herein have the same meaning as commonly understood by one of ordinary skill in the art to which this invention belongs.

Although methods and materials similar or equivalent to those described herein can be used in the practice or testing of the present invention, suitable methods and materials are described below. The materials, methods and examples are illustrative only, and are not intended to be limiting. All publications, patents and other documents mentioned herein are incorporated by reference in their entirety.

Each embodiment of the invention described herein may be taken alone or in combination with one or more other embodiments of the invention.

Throughout this specification, the word "comprise" or variations such as "comprises" or "comprising" will be understood to imply the inclusion of a stated integer or groups of integers but not the exclusion of any other integer or group of integers.

The articles "a" and "an" are used herein to refer to one or to more than one (i.e., to at least one) of the grammatical object of the article. By way of example, "an element" means one element or more than one element.

The terms "adenoma" is used herein to describe any precancerous neoplasia or benign tumor of epithelial tissue, for example, a precancerous neoplasia of the gastrointestinal tract, pancreas, and/or the bladder.

The term "blood-derived fraction" herein refers to a component or components of whole blood. Whole blood comprises a liquid portion (i.e., plasma) and a solid portion (i.e., blood cells). The liquid and solid portions of blood are each comprised of multiple components, e.g., different proteins in plasma or different cell types in the solid portion. One of these components or a mixture of any of these components is a blood-derived fraction as long as such fraction is missing one or more components found in whole blood.

The term "esphophagus" is intended to encompass the upper portion of the digestive system spanning from the back of the oral cavity, passing downwards through the rear part of the mediastinum, through the diaphragm and into the stomach.

The term "esophageal cancer" is used herein to refer to any cancerous neoplasia of the esophagus.

"Barrett's esophagus" as used herein refers to an abnormal change (metaplasia) in the cells of the lower portion of the esophagus. Barrett's is characterized the finding of intestinal metaplasia in the esophagus.

A "brushing" of the esophagus, as referred to herein, may be obtained using any of the means known in the art. In some embodiments, a brushing is obtained by contacting the esophagus with a brush, a cytology brush, a sponge, a balloon, or with any other device or substance that contacts the esophagus and obtains an esophageal sample.

"Cells," "host cells" or "recombinant host cells" are terms used interchangeably herein. It is understood that such terms refer not only to the particular subject cell but to the progeny or potential progeny of such a cell. Because certain modifications may occur in succeeding generations due to either mutation or environmental influences, such progeny may not, in fact, be identical to the parent cell, but are still included within the scope of the term as used herein.

The terms "compound", "test compound," "agent", and "molecule" are used herein interchangeably and are meant to include, but are not limited to, peptides, nucleic acids, carbohydrates, small organic molecules, natural product extract libraries, and any other molecules (including, but not limited to, chemicals, metals, and organometallic compounds).

The term "compound-converted DNA" herein refers to DNA that has been treated or reacted with a chemical compound that converts unmethylated C bases in DNA to a different nucleotide base. For example, one such compound is sodium bisulfite, which converts unmethylated C to U. If DNA that contains conversion-sensitive cytosine is treated with sodium bisulfite, the compound-converted DNA will contain U in place of C. If the DNA which is treated with sodium bisulfite contains only methylcytosine, the compound-converted DNA will not contain uracil in place of the methylcytosine.

The term "de-methylating agent" as used herein refers agents that restore activity and/or gene expression of target genes silenced by methylation upon treatment with the agent. Examples of such agents include without limitation 5-azacytidine and 5-aza-2'-deoxycytidine.

The term "detection" is used herein to refer to any process of observing a marker, or a change in a marker (such as for example the change in the methylation state of the marker), in a biological sample, whether or not the marker or the change in the marker is actually detected. In other words, the act of probing a sample for a marker or a change in the marker, is a "detection" even if the marker is determined to be not present or below the level of sensitivity. Detection may be a quantitative, semi-quantitative or non-quantitative observation.

The term "differentially methylated nucleotide sequence" refers to a region of a genomic loci that is found to be methylated in a in cancer tissues or cell lines, but not methylated in the normal tissues or cell lines.

The term "neoplasia" as used herein refers to an abnormal growth of tissue. As used herein, the term "neoplasia" may be used to refer to cancerous and non-cancerous tumors, as well as to Barrett's esophagus (which may also be referred to herein as a metaplasia) and Barrett's esophagus with dysplasia. In some embodiments, the Barrett's esophagus with dysplasia is Barrett's esophagus with high grade dysplasia. In some embodiments, the Barrett's esophagus with dysplasia is Barrett's esophagus with low grade dysplasia. In some embodiments, the neoplasia is a cancer (e.g., esophageal adenocarcinoma).

"Gastrointestinal neoplasia" refers to neoplasia of the upper and lower gastrointestinal tract. As commonly understood in the art, the upper gastrointestinal tract includes the esophagus, stomach, and duodenum; the lower gastrointestinal tract includes the remainder of the small intestine and all of the large intestine.

The terms "healthy", "normal," and "non-neoplastic" are used interchangeably herein to refer to a subject or particular cell or tissue that is devoid (at least to the limit of detection) of a disease condition, such as a neoplasia.

"Homology" or "identity" or "similarity" refers to sequence similarity between two peptides or between two nucleic acid molecules. Homology and identity can each be determined by comparing a position in each sequence which may be aligned for purposes of comparison. When an equivalent position in the compared sequences is occupied by the same base or amino acid, then the molecules are identical at that position: when the equivalent site occupied by the same or a similar amino acid residue (e.g., similar in steric and/or electronic nature), then the molecules can be referred to as homologous (similar) at that position. Expression as a percentage of homology/similarity or identity refers to a function of the number of identical or similar amino acids at positions shared by the compared sequences. A sequence which is "unrelated or "non-homologous" shares, in some embodiments, less than 40% identity, and in particular embodiments, less than 25% identity with a sequence of the present invention. In comparing two sequences, the absence of residues (amino acids or nucleic acids) or presence of extra residues also decreases the identity and homology/similarity.

The term "homology" describes a mathematically based comparison of sequence similarities which is used to identify genes or proteins with similar functions or motifs. The nucleic acid and protein sequences of the present invention may be used as a "query sequence" to perform a search against public databases to, for example, identify other family members, related sequences or homologs. Such searches can be performed using the NBLAST and XBLAST programs (version 2.0) of Altschul, et al. (1990) *J Mol. Biol.* 215:403-10. BLAST nucleotide searches can be performed with the NBLAST program, score=100, wordlength=12 to obtain nucleotide sequences homologous to nucleic acid molecules of the invention. BLAST protein searches can be performed with the XBLAST program, score=50, wordlength=3 to obtain amino acid sequences homologous to protein molecules of the invention. To obtain gapped alignments for comparison purposes, Gapped BLAST can be utilized as described in Altschul et al., (1997) *Nucleic Acids Res.* 25(17):3389-3402. When utilizing BLAST and Gapped BLAST programs, the default parameters of the respective programs (e.g., XBLAST and BLAST) can be used. See www.ncbi.nlm.nih.gov.

As used herein, "identity" means the percentage of identical nucleotide or amino acid residues at corresponding positions in two or more sequences when the sequences are aligned to maximize sequence matching, i.e., taking into account gaps and insertions. Identity can be readily calculated by known methods, including but not limited to those described in (*Computational Molecular Biology*, Lesk, A. M., ed., Oxford University Press. New York, 1988; *Biocomputing: Informatics and Genome Projects*, Smith, D. W., ed., Academic Press, New York, 1993; *Computer Analysis of Sequence Data*, Part I, Griffin, A. M., and Griffin, H. G., eds., Humana Press, New Jersey, 1994; *Sequence Analysis in Molecular Biology*, von Heinje, G., Academic Press, 1987; and *Sequence Analysis Primer*, Gribskov, M, and Devereux, J., eds., M Stockton Press, New York, 1991; and Carillo, H., and Lipman, D., SIAM J. Applied Math., 48: 1073, 1988). Methods to determine identity are designed to give the largest match between the sequences tested. Moreover, methods to determine identity are codified in publicly available computer programs. Computer program methods to determine identity between two sequences include, but are not limited to, the GCG program package (Devereux, J., et al., *Nucleic Acids Research* 12(1): 387 (1984)), BLASTP, BLASTN, and FASTA (Altschul, S. F. et al., *J. Molec. Biol.* 215: 403-410 (1990) and Altschul et al. *Nuc. Acids Res.* 25: 3389-3402 (1997)). The BLAST X program is publicly available from NCBI and other sources (*BLAST Manual*, Altschul, S., et al., NCBI NLM NIH Bethesda, Md. 20894; Altschul, S., et al., *J. Mol. Biol.* 215: 403-410 (1990)). The well known Smith Waterman algorithm may also be used to determine identity.

The term "including" is used herein to mean, and is used interchangeably with, the phrase "including but not limited to."

The term "isolated" as used herein with respect to nucleic acids, such as DNA or RNA, refers to molecules in a form which does not occur in nature. Moreover, an "isolated nucleic acid" is meant to include nucleic acid fragments which are not naturally occurring as fragments and would not be found in the natural state.

The term "methylation-specific PCR" ("MSP") herein refers to a polymerase chain reaction in which amplification of the compound-converted template sequence is performed. Two sets of primers are designed for use in MSP. Each set of primers comprises a forward primer and a reverse primer. One set of primers, called methylation-specific primers (see below), will amplify the compound-converted template sequence if C bases in CpG dinucleotides within the DNA are methylated. Another set of primers, called unmethylation-specific primers or primers for unmethylated sequences and the like (see below), will amplify the compound-converted template sequences if C bases in CpG dinucleotides within the DNA are not methylated.

As used herein, the term "nucleic acid" refers to polynucleotides such as deoxyribonucleic acid (DNA), and, where appropriate, ribonucleic acid (RNA). The term should also be understood to include, as equivalents, analogs of either RNA or DNA made from nucleotide analogs, and, as applicable to the embodiment being described, single-stranded (such as sense or antisense) and double-stranded polynucleotides.

"Operably linked" when describing the relationship between two DNA regions simply means that they are functionally related to each other. For example, a promoter or other transcriptional regulatory sequence is operably linked to a coding sequence if it controls the transcription of the coding sequence.

The term "or" is used herein to mean, and is used interchangeably with, the term "and/or", unless context clearly indicates otherwise.

The terms "proteins" and "polypeptides" are used interchangeably herein.

A "sample" includes any material that is obtained or prepared for detection of a molecular marker or a change in a molecular marker such as for example the methylation state, or any material that is contacted with a detection reagent or detection device for the purpose of detecting a molecular marker or a change in the molecular marker.

As used herein. "obtaining a sample" includes directly retrieving a sample from a subject to be assayed, or directly retrieving a sample from a subject to be stored and assayed at a later time. Alternatively, a sample may be obtained via a second party. That is, a sample may be obtained via, e.g., shipment, from another individual who has retrieved the sample, or otherwise obtained the sample.

A "subject" is any organism of interest, generally a mammalian subject, such as a mouse, and in particular embodiments, a human subject.

As used herein, the term "specifically hybridizes" refers to the ability of a nucleic acid probe/primer of the invention to hybridize to at least 12, 15, 20, 25, 30, 35, 40, 45, 50 or 100 consecutive nucleotides of a target sequence, or a sequence complementary thereto, or naturally occurring mutants thereof, such that it has, in some embodiments, less than 15%, less than 10%, or less than 5% background hybridization to a cellular nucleic acid (e.g., mRNA or genomic DNA) other than the target gene. A variety of hybridization conditions may be used to detect specific hybridization, and the stringency is determined primarily by the wash stage of the hybridization assay. Generally high temperatures and low salt concentrations give high stringency, while low temperatures and high salt concentrations give low stringency. Low stringency hybridization is achieved by washing in, for example, about 2.0×SSC at 50° C., and high stringency is achieved with about 0.2×SSC at 50° C. Further descriptions of stringency are provided below.

As applied to polypeptides, the term "substantial sequence identity" means that two peptide sequences, when optimally aligned such as by the programs GAP or BESTFIT using default gap, share at least 90 percent sequence identity, in some embodiments, at least 95 percent sequence identity, or at least 99 percent sequence identity or more. In some embodiments, residue positions which are not identical differ by conservative amino acid substitutions. For example, the substitution of amino acids having similar chemical properties such as charge or polarity is not likely to affect the properties of a protein. Examples include glutamine for asparagine or glutamic acid for aspartic acid.

An "informative loci" as used herein, refers to any of the nucleic acid sequences disclosed herein that may have altered (e.g., increased) methylation in a sample (e.g., an esophageal tissue sample) from a subject having Barrett's esophagus and/or an esophageal neoplasia as compared to the methylation patterns of the corresponding nucleic acid sequence in a sample from a healthy control subject. An example of an informative loci is vimentin.

The term "Up3" as used herein refers to a nucleotide sequence comprising a sequence at least 80%, 85%, 90%, 91%, 92%, 93%, 94%, 95%, 96%, 97%, 98%, 99% or 100% identity to the sequence of SEQ ID NO: 12563, 12581, 12599, 12617, or fragments or reverse complements thereof. In some embodiments, the Up3 sequence refers to a bisulfite converted nucleotide sequence comprising a sequence at least 80%, 85%, 90%, 91%, 92%, 93%, 94%, 95%, 96%, 97%, 98%, 99% or 100% identity to the sequence of SEQ ID NO: 12569, 12587, 12605 or 12623, or fragments or reverse complements thereof. In some embodiments, the Up3 sequence refers to a bisulfite converted product of a methylated nucleotide sequence comprising a sequence at least 80%, 85%, 90%, 91%, 92%, 93%, 94%, 95%, 96%, 97%, 98%, 99% or 100% identity to the sequence of SEQ ID NO: 12575, 12593, 12611 or 12629, or fragments or reverse complements thereof. In some embodiments, the Up3 sequence may be amplified using primers comprising the sequence of SEQ ID NOs: 12635 and/or 12641, or fragments or reverse complements thereof.

The term "Up10" as used herein refers to a nucleotide sequence comprising a sequence at least 80%, 85%, 90%, 91%, 92%, 93%, 94%, 95%, 96%, 97%, 98%, 99% or 100% identity to the sequence of SEQ ID NO: 12564, 12582, 12600 or 12618, or fragments or reverse complements thereof. In some embodiments, the Up10 sequence refers to a bisulfite converted nucleotide sequence comprising a sequence at least 80%, 85%, 90%, 91%, 92%, 93%, 94%, 95%, 96%, 97%, 98%, 99% or 100% identity to the sequence of SEQ ID NO: 12570, 12588, 12606 or 12624, or fragments or reverse complements thereof. In some embodiments, the Up10 sequence refers to a bisulfite converted product of a methylated nucleotide sequence comprising a sequence at least 80%, 85%, 90%, 91%, 92%, 93%, 94%, 95%, 96%, 97%, 98%, 99% or 100% identity to the sequence of SEQ ID NO: 12576, 12594, 12612 or 12630, or fragments or reverse complements thereof. In some embodiments, the Up10 sequence may be amplified using primers comprising the sequence of SEQ ID NOs: 12636 and/or 12642, or fragments or reverse complements thereof.

The term "Up15-1" as used herein refers to a nucleotide sequence comprising a sequence at least 80%, 85%, 90%, 91%, 92%, 93%, 94%, 95%, 96%, 97%, 98%, 99% or 100% identity to the sequence of SEQ ID NO: 12565, 12583, 12601 or 12619, or fragments or reverse complements thereof. In some embodiments, the Up15-1 sequence refers to a bisulfite converted nucleotide sequence comprising a sequence at least 80%, 85%, 90%, 91%, 92%, 93%, 94%, 95%, 96%, 97%, 98%, 99% or 100% identity to the sequence of SEQ ID NO: 12571, 12589, 12607 or 12625, or fragments or reverse complements thereof. In some embodiments, the Up15-1 sequence refers to a bisulfite converted product of a methylated nucleotide sequence comprising a sequence at least 80%, 85%, 90%, 91%, 92%, 93%, 94%, 95%, 96%, 97%, 98%, 99% or 100% identity to the sequence of SEQ ID NO: 12577, 12595, 12613 or 12631, or fragments or reverse complements thereof. In some embodiments, the Up15-1 sequence may be amplified using primers comprising the sequence of SEQ ID NOs: 12637 and/or 12643, or fragments or reverse complements thereof.

The term "Up15-2" as used herein refers to a nucleotide sequence comprising a sequence at least 80%, 85%, 90%, 91%, 92%, 93%, 94%, 95%, 96%, 97%, 98%, 99% or 100% identity to the sequence of SEQ ID NO: 12565, 12583, 12647 or 12656, or fragments or reverse complements thereof. In some embodiments, the Up15-2 sequence refers to a bisulfite converted nucleotide sequence comprising a sequence at least 80%, 85%, 90%, 91%, 92%, 93%, 94%, 95%, 96%, 97%, 98%, 99% or 100% identity to the sequence of SEQ ID NO: 12571, 12589, 12650 or 12659, or fragments or reverse complements thereof. In some embodiments, the Up15-2 sequence refers to a bisulfite converted product of a methylated nucleotide sequence comprising a sequence at least 80%, 85%, 90%, 91%, 92%, 93%, 94%, 95%, 96%, 97%, 98%, 99% or 100% identity to the sequence of SEQ ID NO: 12577, 12595, 12653 or 12662, or fragments or reverse complements thereof. In some embodiments, the Up15-2 sequence may be amplified using primers comprising the sequence of SEQ ID NOs: 12665 and/or 12668, or fragments or reverse complements thereof.

The term "Up20-1" as used herein refers to a nucleotide sequence comprising a sequence at least 80%, 85%, 90%, 91%, 92%, 93%, 94%, 95%, 96%, 97%, 98%, 99% or 100% identity to the sequence of SEQ ID NO: 12566, 12584, 12602 or 12620, or fragments or reverse complements thereof. In some embodiments, the Up20-1 sequence refers to a bisulfite converted nucleotide sequence comprising a sequence at least 80%, 85%, 90%, 91%, 92%, 93%, 94%, 95%, 96%, 97%, 98%, 99% or 100% identity to the sequence of SEQ ID NO: 12572, 12590, 12608 or 12626, or fragments or reverse complements thereof. In some embodiments, the Up20-1 sequence refers to a bisulfite converted product of a methylated nucleotide sequence comprising a sequence at least 80%, 85%, 90%, 91%, 92%, 93%, 94%, 95%, 96%, 97%, 98%, 99% or 100% identity to the sequence of SEQ ID NO: 12578, 12596, 12614 or 12632, or fragments or reverse complements thereof. In some embodiments, the Up20-1 sequence may be amplified using primers comprising the sequence of SEQ ID NOs: 12638 and/or 12644, or fragments or reverse complements thereof.

The term "Up20-2" as used herein refers to a nucleotide sequence comprising a sequence at least 80%, 85%, 90%, 91%, 92%, 93%, 94%, 95%, 96%, 97%, 98%, 99% or 100% identity to the sequence of SEQ ID NO: 12566, 12584, 12648 or 12657, or fragments or reverse complements thereof. In some embodiments, the Up20-2 sequence refers to a bisulfite converted nucleotide sequence comprising a sequence at least 80%, 85%, 90%, 91%, 92%, 93%, 94%, 95%, 96%, 97%, 98%, 99% or 100% identity to the sequence of SEQ ID NO: 12572, 12590, 12651 or 12660, or fragments or reverse complements thereof. In some embodiments, the Up20-2 sequence refers to a bisulfite converted product of a methylated nucleotide sequence comprising a sequence at least 80%, 85%, 90%, 91%, 92%, 93%, 94%, 95%, 96%, 97%, 98%, 99% or 100% identity to the sequence of SEQ ID NO: 12578, 12596, 12654 or 12663, or fragments or reverse complements thereof. In some embodiments, the Up20-2 sequence may be amplified using primers comprising the sequence of SEQ ID NOs: 12666 and/or 12669, or fragments or reverse complements thereof.

The term "Up27" as used herein refers to a nucleotide sequence comprising a sequence at least 80%, 85%, 90%, 91%, 92%, 93%, 94%, 95%, 96%, 97%, 98%, 99% or 100% identity to the sequence of SEQ ID NO: 12567, 12585, 12603 or 12621, or fragments or reverse complements thereof. In some embodiments, the Up27 sequence refers to a bisulfite converted nucleotide sequence comprising a sequence at least 80%, 85%, 90%, 91%, 92%, 93%, 94%, 95%, 96%, 97%, 98%, 99% or 100% identity to the sequence of SEQ ID NO: 12573, 12591, 12609 or 12627, or fragments or reverse complements thereof. In some embodiments, the Up27 sequence refers to a bisulfite converted product of a methylated nucleotide sequence comprising a sequence at least 80%, 85%, 90%, 91%, 92%, 93%, 94%, 95%, 96%, 97%, 98%, 99% or 100% identity to the sequence of SEQ ID NO: 12579, 12597, 12615 or 12633, or fragments or reverse complements thereof. In some embodiments, the Up27 sequence may be amplified using primers comprising the sequence of SEQ ID NOs: 12639 and/or 12645, or fragments or reverse complements thereof.

The term "Up35-1" as used herein refers to a nucleotide sequence comprising a sequence at least 80%, 85%, 90%, 91%, 92%, 93%, 94%, 95%, 96%, 97%, 98%, 99% or 100% identity to the sequence of SEQ ID NO: 12568, 12586, 12604 or 12622, or fragments or reverse complements thereof. In some embodiments, the Up35-1 sequence refers to a bisulfite converted nucleotide sequence comprising a sequence at least 80%, 85%, 90%, 91%, 92%, 93%, 94%, 95%, 96%, 97%, 98%, 99% or 100% identity to the sequence of SEQ ID NO: 12574, 12592, 12610 or 12628, or fragments or reverse complements thereof. In some embodiments, the Up35-1 sequence refers to a bisulfite converted product of a methylated nucleotide sequence comprising a sequence at least 80%, 85%, 90%, 91%, 92%, 93%, 94%, 95%, 96%, 97%, 98%, 99% or 100% identity to the sequence of SEQ ID NO: 12580, 12598, 12616 or 12634, or fragments or reverse complements thereof. In some embodiments, the Up35-1 sequence may be amplified using primers comprising the sequence of SEQ ID NOs: 12640 and/or 12646, or fragments or reverse complements thereof.

The term "Up35-2" as used herein refers to a nucleotide sequence comprising a sequence at least 80%, 85%, 90%, 91%, 92%, 93%, 94%, 95%, 96%, 97%, 98%, 99% or 100% identity to the sequence of SEQ ID NO: 12568, 12586, 12649 or 12658, or fragments or reverse complements thereof. In some embodiments, the Up35-2 sequence refers to a bisulfite converted nucleotide sequence comprising a sequence at least 80%, 85%, 90%, 91%, 92%, 93%, 94%, 95%, 96%, 97%, 98%, 99% or 100% identity to the sequence of SEQ ID NO: 12574, 12592, 12652 or 12661, or fragments or reverse complements thereof. In some embodiments, the Up35-2 sequence refers to a bisulfite converted product of a methylated nucleotide sequence comprising a sequence at least 80%, 85%, 90%, 91%, 92%, 93%, 94%, 95%, 96%, 97%, 98%, 99% or 100% identity to the sequence of SEQ ID NO: 12580, 12598, 12655 or 12664, or fragments or reverse complements thereof. In some embodiments, the Up35-2 sequence may be amplified using primers comprising the sequence of SEQ ID NOs: 12667 and/or 12670, or fragments or reverse complements thereof.

The term "SqBE 2" as used herein refers to a nucleotide sequence comprising a sequence at least 80%, 85%, 90%, 91%, 92%, 93%, 94%, 95%, 96%, 97%, 98%, 99% or 100% identity to the sequence of SEQ ID NO: 8209, 8251, 8293 or 8335, or fragments or reverse complements thereof. In some embodiments, the SqBE 2 sequence refers to a bisulfite converted nucleotide sequence comprising a sequence at least 80%, 85%, 90%, 91%, 92%, 93%, 94%, 95%, 96%, 97%, 98%, 99% or 100% identity to the sequence of SEQ ID NO: 8223, 8265, 8307 or 8349, or fragments or reverse complements thereof. In some embodiments, the SqBE 2 sequence refers to a bisulfite converted product of a methylated nucleotide sequence comprising a sequence at least 80%, 85%, 90%, 91%, 92%, 93%, 94%, 95%, 96%, 97%, 98%, 99% or 100% identity to the sequence of SEQ ID NO: 8237, 8279, 8321 or 8363, or fragments or reverse complements thereof. In some embodiments, the SqBE 2 sequence may be amplified using primers comprising the sequence of SEQ ID NOs: 8377 and/or 8391, or fragments or reverse complements thereof.

The term "SqBE 5" as used herein refers to a nucleotide sequence comprising a sequence at least 80%, 85%, 90%, 91%, 92%, 93%, 94%, 95%, 96%, 97%, 98%, 99% or 100% identity to the sequence of SEQ ID NO: 8210, 8252, 8294 or 8336, or fragments or reverse complements thereof. In some embodiments, the SqBE 5 sequence refers to a bisulfite converted nucleotide sequence comprising a sequence at least 80%, 85%, 90%, 91%, 92%, 93%, 94%, 95%, 96%, 97%, 98%, 99% or 100% identity to the sequence of SEQ ID NO: 8224, 8266, 8308 or 8350, or fragments or reverse complements thereof. In some embodiments, the SqBE 5 sequence refers to a bisulfite converted product of a methylated nucleotide sequence comprising a sequence at least 80%, 85%, 90%, 91%, 92%, 93%, 94%, 95%, 96%, 97%, 98%, 99% or 100% identity to the sequence of SEQ ID NO: 8238, 8280, 8322 or 8364, or fragments or reverse complements thereof. In some embodiments, the SqBE 5 sequence may be amplified using primers comprising the sequence of SEQ ID NOs: 8378 and/or 8392, or fragments or reverse complements thereof.

The term "SqBE 7" as used herein refers to a nucleotide sequence comprising a sequence at least 80%, 85%, 90%, 91%, 92%, 93%, 94%, 95%, 96%, 97%, 98%, 99% or 100% identity to the sequence of SEQ ID NO: 8211, 8253, 8295 or 8337, or fragments or reverse complements thereof. In some embodiments, the SqBE 7 sequence refers to a bisulfite converted nucleotide sequence comprising a sequence at least 80%, 85%, 90%, 91%, 92%, 93%, 94%, 95%, 96%, 97%, 98%, 99% or 100% identity to the sequence of SEQ ID NO: 8225, 8267, 8309 or 8351, or fragments or reverse complements thereof. In some embodiments, the SqBE 7 sequence refers to a bisulfite converted product of a methylated nucleotide sequence comprising a sequence at least 80%, 85%, 90%, 91%, 92%, 93%, 94%, 95%, 96%, 97%, 98%, 99% or 100% identity to the sequence of SEQ ID NO: 8239, 8281, 8323 or 8365, or fragments or reverse complements thereof. In some embodiments, the SqBE 7 sequence may be amplified using primers comprising the sequence of SEQ ID NOs: 8379 and/or 8393, or fragments or reverse complements thereof.

The term "SqBE 9" as used herein refers to a nucleotide sequence comprising a sequence at least 80%, 85%, 90%, 91%, 92%, 93%, 94%, 95%, 96%, 97%, 98%, 99% or 100% identity to the sequence of SEQ ID NO: 8212, 8254, 8296 or 8338, or fragments or reverse complements thereof. In some embodiments, the SqBE 9 sequence refers to a bisulfite converted nucleotide sequence comprising a sequence at least 80%, 85%, 90%, 91%, 92%, 93%, 94%, 95%, 96%, 97%, 98%, 99% or 100% identity to the sequence of SEQ ID NO: 8226, 8268, 8310 or 8352, or fragments or reverse complements thereof. In some embodiments, the SqBE 9 sequence refers to a bisulfite converted product of a methylated nucleotide sequence comprising a sequence at least 80%, 85%, 90%, 91%, 92%, 93%, 94%, 95%, 96%, 97%, 98%, 99% or 100% identity to the sequence of SEQ ID NO: 8240, 8282, 8324 or 8366, or fragments or reverse complements thereof. In some embodiments, the SqBE 9 sequence may be amplified using primers comprising the sequence of SEQ ID NOs: 8380 and/or 8394, or fragments or reverse complements thereof.

The term "SqBE 10" as used herein refers to a nucleotide sequence comprising a sequence at least 80%, 85%, 90%, 91%, 92%, 93%, 94%, 95%, 96%, 97%, 98%, 99% or 100% identity to the sequence of SEQ ID NO: 8213, 8255, 8297 or 8339, or fragments or reverse complements thereof. In some embodiments, the SqBE 10 sequence refers to a bisulfite converted nucleotide sequence comprising a sequence at least 80%, 85%°, 90%, 91%, 92%, 93%, 94%, 95%, 96%, 97%, 98%, 99% or 100% identity to the sequence of SEQ ID NO: 8227, 8269, 8311 or 8353, or fragments or reverse complements thereof. In some embodiments, the SqBE 10 sequence refers to a bisulfite converted product of a methylated nucleotide sequence comprising a sequence at least 80%, 85%, 90%, 91%, 92%, 93%, 94%, 95%, 96%, 97%, 98%, 99% or 100% identity to the sequence of SEQ ID NO: 8241, 8283, 8325 or 8367, or fragments or reverse complements thereof. In some embodiments, the SqBE 10 sequence may be amplified using primers comprising the sequence of SEQ ID NOs: 8381 and/or 8395, or fragments or reverse complements thereof.

The term "SqBE 11-1" as used herein refers to a nucleotide sequence comprising a sequence at least 80%, 85%, 90%, 91%, 92%, 93%, 94%, 95%, 96%, 97%, 98%, 99% or 100% identity to the sequence of SEQ ID NO: 8214, 8256, 8298 or 8340, or fragments or reverse complements thereof. In some embodiments, the SqBE 11-1 sequence refers to a bisulfite converted nucleotide sequence comprising a sequence at least 80%, 85%, 90%, 91%, 92%, 93%, 94%, 95%, 96%, 97%, 98%, 99% or 100% identity to the sequence of SEQ ID NO: 8228, 8270, 8312 or 8354, or fragments or reverse complements thereof. In some embodiments, the SqBE 11-1 sequence refers to a bisulfite converted product of a methylated nucleotide sequence comprising a sequence at least 80%, 85%, 90%, 91%, 92%, 93%, 94%, 95%, 96%, 97%, 98%, 99% or 100% identity to the sequence of SEQ ID NO: 8242, 8284, 8326 or 8368, or fragments or reverse complements thereof. In some embodiments, the SqBE 11-1 sequence may be amplified using primers comprising the sequence of SEQ ID NOs: 8382 and/or 8396, or fragments or reverse complements thereof.

The term "SqBE 11-2" as used herein refers to a nucleotide sequence comprising a sequence at least 80%, 85%, 90%, 91%, 92%, 93%, 94%, 95%, 96%, 97%, 98%, 99% or 100% identity to the sequence of SEQ ID NO: 8214, 8256, 8405 or 8420, or fragments or reverse complements thereof. In some embodiments, the SqBE 11-2 sequence refers to a bisulfite converted nucleotide sequence comprising a sequence at least 80%, 85%, 90%, 91%, 92%, 93%, 94%, 95%, 96%, 97%, 98%, 99% or 100% identity to the sequence of SEQ ID NO: 8228, 8270, 8410 or 8425, or fragments or reverse complements thereof. In some embodiments, the SqBE 11-2 sequence refers to a bisulfite converted product of a methylated nucleotide sequence comprising a sequence at least 80%, 85%, 90%, 91%, 92%, 93%, 94%, 95%, 96%, 97%, 98%, 99% or 100% identity to the sequence of SEQ ID NO: 8242, 8284, 8415 or 8430, or fragments or reverse complements thereof. In some embodiments, the SqBE 11-2 sequence may be amplified using primers comprising the sequence of SEQ ID NOs: 8435 and/or 8440, or fragments or reverse complements thereof.

The term "SqBE 13" as used herein refers to a nucleotide sequence comprising a sequence at least 80%, 85%, 90%, 91%, 92%, 93%, 94%, 95%, 96%, 97%, 98%, 99% or 100% identity to the sequence of SEQ ID NO: 8215, 8257, 8299 or 8341, or fragments or reverse complements thereof. In some embodiments, the SqBE 13 sequence refers to a bisulfite converted nucleotide sequence comprising a sequence at least 80%, 85%, 90%, 91%, 92%, 93%, 94%, 95%, 96%, 97%, 98%, 99% or 100% identity to the sequence of SEQ ID NO: 8229, 8271, 8313 or 8355, or fragments or reverse complements thereof. In some embodiments, the SqBE 13 sequence refers to a bisulfite converted product of a methylated nucleotide sequence comprising a sequence at least 80%, 85%, 90%, 91%, 92%, 93%, 94%, 95%, 96%, 97%, 98%, 99% or 100% identity to the sequence of SEQ ID NO: 8243, 8285, 8327 or 8369, or fragments or reverse complements thereof. In some embodiments, the SqBE 13 sequence may be amplified using primers comprising the sequence of SEQ ID NOs: 8383 and/or 8397, or fragments or reverse complements thereof.

The term "SqBE 14-2" as used herein refers to a nucleotide sequence comprising a sequence at least 80%, 85%, 90%, 91%, 92%, 93%, 94%, 95%, 96%, 97%, 98%, 99% or 100% identity to the sequence of SEQ ID NO: 8216, 8258, 8406 or 8421, or fragments or reverse complements thereof. In some embodiments, the SqBE 14-2 sequence refers to a bisulfite converted nucleotide sequence comprising a sequence at least 80%, 85%, 90%, 91%, 92%, 93%, 94%, 95%, 96%, 97%, 98%, 99% or 100% identity to the sequence of SEQ ID NO: 8230, 8272, 8411 or 8426, or fragments or reverse complements thereof. In some embodiments, the SqBE 14-2 sequence refers to a bisulfite converted product of a methylated nucleotide sequence comprising a sequence at least 80%, 85%, 90%, 91%, 92%, 93%, 94%, 95%, 96%, 97%, 98%, 99% or 100% identity to the sequence of SEQ ID NO: 8244, 8286, 8416 or 8431, or fragments or reverse complements thereof. In some embodiments, the SqBE 14-2 sequence may be amplified using primers comprising the sequence of SEQ ID NOs: 8436 and/or 8441, or fragments or reverse complements thereof.

The term "SqBE 15" as used herein refers to a nucleotide sequence comprising a sequence at least 80%, 85%, 90%, 91%, 92%, 93%, 94%, 95%, 96%, 97%, 98%, 99% or 100% identity to the sequence of SEQ ID NO: 8217, 8259, 8301 or 8343, or fragments or reverse complements thereof. In some embodiments, the SqBE 15 sequence refers to a bisulfite converted nucleotide sequence comprising a sequence at least 80%, 85%, 90%, 91%, 92%, 93%, 94%, 95%, 96%, 97%, 98%, 99% or 100% identity to the sequence of SEQ ID NO: 8231, 8273, 8315 or 8357, or fragments or reverse complements thereof. In some embodiments, the SqBE 15 sequence refers to a bisulfite converted product of a methylated nucleotide sequence comprising a sequence at least 80%, 85%, 90%, 91%, 92%, 93%, 94%, 95%, 96%, 97%, 98%, 99% or 100% identity to the sequence of SEQ ID NO: 8245, 8287, 8329 or 8371, or fragments or reverse complements thereof. In some embodiments, the SqBE 15 sequence may be amplified using primers comprising the sequence of SEQ ID NOs: 8385 and/or 8399, or fragments or reverse complements thereof.

The term "SqBE 16-1" as used herein refers to a nucleotide sequence comprising a sequence at least 80%, 85%, 90%, 91%, 92%, 93%, 94%, 95%, 96%, 97%, 98%, 99% or 100% identity to the sequence of SEQ ID NO: 8218, 8260, 8302 or 8344, or fragments or reverse complements thereof. In some embodiments, the SqBE 16-1 sequence refers to a bisulfite converted nucleotide sequence comprising a sequence at least 80%, 85%, 90%, 91%, 92%, 93%, 94%, 95%, 96%, 97%, 98%, 99% or 100% identity to the sequence of SEQ ID NO: 8232, 8274, 8316 or 8358, or fragments or reverse complements thereof. In some embodiments, the SqBE 16-1 sequence refers to a bisulfite converted product of a methylated nucleotide sequence comprising a sequence at least 80%, 85%, 90%, 91%, 92%, 93%, 94%, 95%, 96%, 97%, 98%, 99% or 100% identity to the sequence of SEQ ID NO: 8246, 8288, 8330 or 8372, or fragments or reverse complements thereof. In some embodiments, the SqBE 16-1 sequence may be amplified using primers comprising the sequence of SEQ ID NOs: 8386 and/or 8400, or fragments or reverse complements thereof.

The term "SqBE 16-2" as used herein refers to a nucleotide sequence comprising a sequence at least 80%, 85%, 90%, 91%, 92%, 93%, 94%, 95%, 96%, 97%, 98%, 99% or 100% identity to the sequence of SEQ ID NO: 8218, 8260, 8407 or 8422, or fragments or reverse complements thereof. In some embodiments, the SqBE 16-2 sequence refers to a bisulfite converted nucleotide sequence comprising a sequence at least 80%, 85%, 90%, 91%, 92%, 93%, 94%, 95%, 96%, 97%, 98%, 99% or 100% identity to the sequence of SEQ ID NO: 8232, 8274, 8412 or 8427, or fragments or reverse complements thereof. In some embodiments, the SqBE 16-2 sequence refers to a bisulfite converted product of a methylated nucleotide sequence comprising a sequence at least 80%, 85%, 90%, 91%, 92%, 93%, 94%, 95%, 96%, 97%, 98%, 99% or 100% identity to the sequence of SEQ ID NO: 8246, 8288, 8417 or 8432, or fragments or reverse complements thereof. In some embodiments, the SqBE 16-2 sequence may be amplified using primers comprising the sequence of SEQ ID NOs: 8437 and/or 8442, or fragments or reverse complements thereof.

The term "SqBE 17-1" as used herein refers to a nucleotide sequence comprising a sequence at least 80%, 85%, 90%, 91%, 92%, 93%, 94%, 95%, 96%, 97%, 98%, 99% or 100% identity to the sequence of SEQ ID NO: 8219, 8261, 8303 or 8345, or fragments or reverse complements thereof. In some embodiments, the SqBE 17-1 sequence refers to a bisulfite converted nucleotide sequence comprising a sequence at least 80%, 85%, 90%, 91%, 92%, 93%, 94%, 95%, 96%, 97%, 98%, 99% or 100% identity to the sequence of SEQ ID NO: 8233, 8275, 8317 or 8359, or fragments or reverse complements thereof. In some embodiments, the SqBE 17-1 sequence refers to a bisulfite converted product of a methylated nucleotide sequence comprising a sequence at least 80%, 85%, 90%, 91%, 92%, 93%, 94%, 95%, 96%, 97%, 98%, 99% or 100% identity to the sequence of SEQ ID NO: 8247, 8289, 8331 or 8373, or fragments or reverse complements thereof. In some embodiments, the SqBE 17-1 sequence may be amplified using primers comprising the sequence of SEQ ID NOs: 8387 and/or 8401, or fragments or reverse complements thereof.

The term "SqBE18" as used herein refers to a nucleotide sequence comprising a sequence at least 80%, 85%, 90%, 91%, 92%, 93%, 94%, 95%, 96%, 97%, 98%, 99% or 100% identity to the sequence of SEQ ID NO: 8220, 8262, 8304 or 8346, or fragments or reverse complements thereof. In some embodiments, the SqBE18 sequence refers to a bisulfite converted nucleotide sequence comprising a sequence at least 80%, 85%, 90%, 91%, 92%, 93%, 94%, 95%, 96%, 97%, 98%, 99% or 100% identity to the sequence of SEQ ID NO: 8234, 8276, 8318 or 8360, or fragments or reverse complements thereof. In some embodiments, the SqBE18 sequence refers to a bisulfite converted product of a methylated nucleotide sequence comprising a sequence at least 80%, 85%, 90%, 91%, 92%, 93%, 94%, 95%, 96%, 97%, 98%, 99% or 100% identity to the sequence of SEQ ID NO: 8248, 8290, 8332 or 8374, or fragments or reverse complements thereof. In some embodiments, the SqBE18 sequence may be amplified using primers comprising the sequence of SEQ ID NOs: 8388 and/or 8402, or fragments or reverse complements thereof.

The term "SqBE 22-1" as used herein refers to a nucleotide sequence comprising a sequence at least 80%, 85%, 90%, 91%, 92%, 93%, 94%, 95%, 96%, 97%, 98%, 99% or 100% identity to the sequence of SEQ ID NO: 8221, 8263, 8305 or 8347, or fragments or reverse complements thereof. In some embodiments, the SqBE 22-1 sequence refers to a bisulfite converted nucleotide sequence comprising a sequence at least 80%, 85%, 90%, 91%, 92%, 93%, 94%, 95%, 96%, 97%, 98%, 99% or 100% identity to the sequence of SEQ ID NO: 8235, 8277, 8319 or 8361, or fragments or reverse complements thereof. In some embodiments, the SqBE 22-1 sequence refers to a bisulfite converted product of a methylated nucleotide sequence comprising a sequence at least 80%, 85%, 90%, 91%, 92%, 93%, 94%, 95%, 96%, 97%, 98%, 99% or 100% identity to the sequence of SEQ ID NO: 8249, 8291, 8333 or 8375, or fragments or reverse complements thereof. In some embodiments, the SqBE 22-1 sequence may be amplified using primers comprising the sequence of SEQ ID NOs: 8389 and/or 8403, or fragments or reverse complements thereof.

The term "SqBE 22-2" as used herein refers to a nucleotide sequence comprising a sequence at least 80%, 85%, 90%, 91%, 92%, 93%, 94%, 95%, 96%, 97%, 98%, 99% or 100% identity to the sequence of SEQ ID NO: 8221, 8263, 8409 or 8424, or fragments or reverse complements thereof. In some embodiments, the SqBE 22-2 sequence refers to a bisulfite converted nucleotide sequence comprising a sequence at least 80%, 85%, 90%, 91%, 92%, 93%, 94%, 95%, 96%, 97%, 98%, 99% or 100% identity to the sequence of SEQ ID NO: 8235, 8277, 8414 or 8429, or fragments or reverse complements thereof. In some embodiments, the SqBE 22-2 sequence refers to a bisulfite converted product of a methylated nucleotide sequence comprising a sequence at least 80%, 85%, 90%, 91%, 92%, 93%, 94%, 95%, 96%, 97%, 98%, 99% or 100% identity to the sequence of SEQ ID NO: 8249, 8291, 8419 or 8434, or fragments or reverse complements thereof. In some embodiments, the SqBE 22-2 sequence may be amplified using primers comprising the sequence of SEQ ID NOs: 8439 and/or 8444, or fragments or reverse complements thereof.

The term "SqBE 23" as used herein refers to a nucleotide sequence comprising a sequence at least 80%, 85%, 90%, 91%, 92%, 93%, 94%, 95%, 96%, 97%, 98%, 99% or 100% identity to the sequence of SEQ ID NO: 8222, 8264, 8306 or 8348, or fragments or reverse complements thereof. In some embodiments, the SqBE 23 sequence refers to a bisulfite converted nucleotide sequence comprising a sequence at least 80%, 85%, 90%, 91%, 92%, 93%, 94%, 95%, 96%, 97%, 98%, 99% or 100% identity to the sequence of SEQ ID NO: 8236, 8278, 8320 or 8362, or fragments or reverse complements thereof. In some embodiments, the SqBE 23 sequence refers to a bisulfite converted product of a methylated nucleotide sequence comprising a sequence at least 80%, 85%, 90%, 91%, 92%, 93%, 94%, 95%, 96%, 97%, 98%, 99% or 100% identity to the sequence of SEQ ID NO: 8250, 8292, 8334 or 8376, or fragments or reverse complements thereof. In some embodiments, the SqBE 23 sequence may be amplified using primers comprising the sequence of SEQ ID NOs: 8390 and/or 8404, or fragments or reverse complements thereof.

In some instances, any of the nucleotide sequences disclosed herein contain one or more "Y" positions. Cytosine residues that may be methylated or unmethylated, and hence may be bisulfite converted to T (if unmethylated) or remain as a C (if methylated), are designated with a "Y." In some embodiments, a parental nucleotide sequence is fully unmethylated if the sequence comprises a T at every Y position following bisulfite conversion. In some embodiments, a parental nucleotide sequence is fully methylated if the sequence comprises a C at every Y position following bisulfite conversion. In some embodiments, a parental nucleotide sequence is partially methylated if the sequence comprises at least one C at a Y position and at least one T at a Y position of the sequence following bisulfite conversion. In some embodiments, the bisulfite converted sequences disclosed herein comprise at least one C at a Y position and at least one T at a Y position, i.e., the parental sequence is partially methylated.

II. Overview

This disclosure is based at least in part on the recognition that differential methylation of particular genomic loci (e.g., vimentin and/or SqBE18) may be indicative of a neoplasia or metaplasia of the upper gastrointestinal tract. e.g., esophagus. The present findings demonstrate that methylation at these genomic loci may be a useful biomarker of neoplasia in the upper gastrointestinal tract. The present findings further demonstrate that the status of methylation at these genomic loci used in combination with the status of somatic mutation(s) in TP53 may be a highly sensitive and specific biomarker of neoplasia in the upper gastrointestinal tract.

In general, neoplasias may develop through one of at least three different pathways, termed chromosomal instability, microsatellite instability, and the CpG island methylator phenotype (CIMP). Although there is some overlap, these pathways tend to present somewhat different biological behavior. By understanding the pathway of tumor development, the target genes involved, and the mechanisms underlying the genetic instability, it is possible to implement strategies to detect and treat the different types of neoplasias.

This disclosure is based, at least in part, on the recognition that certain target genes may be silenced or inactivated by the differential methylation of CpG islands in the 5' flanking or promoter regions of the target gene. CpG islands are clusters of cytosine-guanosine residues in a DNA sequence, which are prominently represented in the 5-flanking region or promoter region of about half the genes in our genome. In particular, this application is based at least in part on the recognition that differential methylation of particular genomic loci may be indicative of neoplasia of the upper gastrointestinal tract including, but not limited to, esophageal neoplasia.

Additionally, this disclosure is based, at least in part, on the recognition that somatic mutations in TP53 (e.g., any of the somatic TP53 mutations disclosed herein), in combination with methylation of certain informative loci as disclosed herein, may serve as useful indicators of neoplasia, including esophageal neoplasia (e.g., esophageal adenocarcinoma). In certain embodiments, the TP53 somatic mutation is any of the TP53 mutations disclosed herein. In certain embodiments, the TP53 somatic mutation is any nonsynonymous somatic mutation known in the art. In certain embodiments, the TP53 somatic mutation is any one or more mutation at any one or more amino acid residue corresponding to amino acid residue 72, 105, 108, 110, 113, 124, 127, 132, 144, 152, 163, 175, 183, 194, 213, 214, 218, 232, 234, 248, 265, 273, 278, 306, 337, 347, or 639 of SEQ ID NO: 16205. In certain embodiments, the TP53 somatic mutation is any one or more mutation selected from the group consisting of: Leu194Arg. Gly105Asp, Arg273His, Tyr163His, Ile232Thr, Arg213Ter. Arg273His, Arg248Gln, Arg175His, Arg110delinsGlnSer, Ser183Ter, Arg248Gln, Arg337Leu, Lys132Arg, Leu265ThrfsTer7. Arg306Ter, Cys124TrpfsTer25, Pro72Arg. Val218Glu, His214Leu, Gln144Ter, Phe113Ser, Tyr234His. Ser127Phe, Pro278Ala, Ala347Thr, and Pro152Leu of SEQ ID NO: 16205. In certain embodiments, the TP53 mutation is any one or more mutation at any one or more nucleotide position corresponding to nucleotide position 108, 215, 314, 338, 380, 395, 430, 455, 487, 524, 548, 581, 637, 639, 641, 653, 695, 700, 743, 818, 832, 916, 1010, or 1039 of SEQ ID NO: 16206.

The sequence of SEQ ID NO: 16205 (corresponding to GenBank Accession No. NP_000537.3) is as follows:

```
MEEPQSDPSVEPPLSQETFSDLWKLLPENNVLSPLPSQAMDDLMLSPD
DIEQWFTEDPGPDEAPRMPEAAPPVAPAPAAPTPAAPAPAPSWPLSSS
VPSQKTYQGSYGFRLGFLHSGTAKSVTCTYSPALNKMFCQLAKTCPVQ
LWVDSTPPPGTRVRAMAIYKQSQHMTEVVRRCPHHERCSDSDGLAPPQ
HLIRVEGNLRVEYLDDRNTFRHSVVVPYEPPEVGSDCTTIHYNYMCNS
SCMGGMNRRPILTIITLEDSSGNLLGRNSFEVRVCACPGRDRRTEEEN
LRKKGEPHHELPPGSTKRALPNNTSSSPQPKKKPLDGEYFTLQIRGRE
RFEMFRELNEALELKDAQAGKEPGGSRAHSSHLKSKKGQSTSRHKKLM
FKTEGPDSD
```

The sequence of SEQ ID NO: 16206 (corresponding to GenBank Accession No. NM_000546.5) is as follows:

```
GATGGGATTGGGGTTTTCCCCTCCCATGTGCTCAAGACTGGCGCTAA
AAGTTTTGAGCTTCTCAAAAGTCTAGAGCCACCGTCCAGGGAGCAGG
TAGCTGCTGGGCTCCGGGGACACTTTGCGTTCGGGCTGGGAGCGTGC
TTTCCACGACGGTGACACGCTTCCCTGGATTGGCAGCCAGACTGCCT
TCCGGGTCACTGCCATGGAGGAGCCGCAGTCAGATCCTAGCGTCGAG
CCCCCTCTGAGTCAGGAAACATTTTCAGACCTATGGAAACTACTTCC
TGAAAACAACGTTCTGTCCCCCTTGCCGTCCCAAGCAATGGATGATT
```

-continued
```
TGATGCTGTCCCCGGACGATATTGAACAATGGTTCACTGAAGACCCA

GGTCCAGATGAAGCTCCCAGAATGCCAGAGGCTGCTCCCCCCGTGGC

CCCTGCACCAGCAGCTCCTACACCGGCGGCCCCTGCACCAGCCCCCT

CCTGGCCCCTGTCATCTTCTGTCCCTTCCCAGAAAACCTACCAGGGC

AGCTACGGTTTCCGTCTGGGCTTCTTGCATTCTGGGACAGCCAAGTC

TGTGACTTGCACGTACTCCCCTGCCCTCAACAAGATGTTTTGCCAAC

TGGCCAAGACCTGCCCTGTGCAGCTGTGGGTTGATTCCACACCCCG

CCCGGCACCCGCGTCCGCGCCATGGCCATCTACAAGCAGTCACAGCA

CATGACGGAGGTTGTGAGGCGCTGCCCCCACCATGAGCGCTGCTCAG

ATAGCGATGGTCTGGCCCCTCCTCAGCATCTTATCCGAGTGGAAGGA

AATTTGCGTGTGGAGTATTTGGATGACAGAAACACTTTTCGACATAG

TGTGGTGGTGCCCTATGAGCCGCCTGAGGTTGGCTCTGACTGTACCA

CCATCCACTACAACTACATGTGTAACAGTTCCTGCATGGGCGGCATG

AACCGGAGGCCCATCCTCACCATCATCACACTGGAAGACTCCAGTGG

TAATCTACTGGGACGGAACAGCTTTGAGGTGCGTGTTTGTGCCTGTC

CTGGGAGAGACCGGCGCACAGAGGAAGAGAATCTCCGCAAGAAAGGG

GAGCCTCACCACGAGCTGCCCCCAGGGAGCACTAAGCGAGCACTGCC

CAACAACACCAGCTCCTCTCCCCAGCCAAAGAAGAAACCACTGGATG

GAGAATATTTCACCCTTCAGATCCGTGGGCGTGAGCGCTTCGAGATG

TTCCGAGAGCTGAATGAGGCCTTGGAACTCAAGGATGCCCAGGCTGG

GAAGGAGCCAGGGGGAGCAGGGCTCACTCCAGCCACCTGAAGTCCA

AAAAGGGTCAGTCTACCTCCCGCCATAAAAAACTCATGTTCAAGACA

GAAGGGCCTGACTCAGACTGACATTCTCCACTTCTTGTTCCCCACTG

ACAGCCTCCCACCCCCATCTCTCCCTCCCCTGCCATTTTGGGTTTTG

GGTCTTTGAACCCTTGCTTGCAATAGGTGTGCGTCAGAAGCACCCAG

GACTTCCATTTGCTTTGTCCCGGGGCTCCACTGAACAAGTTGGCCTG

CACTGGTGTTTTGTTGTGGGGAGGAGGATGGGGAGTAGGACATACCA

GCTTAGATTTTAAGGTTTTTACTGTGAGGGATGTTTGGGAGATGTAA

GAAATGTTCTTGCAGTTAAGGGTTAGTTTACAATCAGCCACATTCTA

GGTAGGGCCCACTTCACCGTACTAACCAGGGAAGCTGTCCCTCACT

GTTGAATTTTCTCTAACTTCAAGGCCCATATCTGTGAAATGCTGGCA

TTTGCACCTACCTCACAGAGTGCATTGTGAGGGTTAATGAAATAATG

TACATCTGGCCTTGAAACCACCTTTTATTACATGGGTCTAGAACTT

GACCCCCTTGAGGGTGCTTGTCCCTCTCCCTGTTGGTCGGTGGGTT

GGTAGTTTCTACAGTTGGGCAGCTGGTTAGGTAGAGGGAGTTGTCAA

GTCTCTGCTGGCCCAGCCAAACCCTGTCTGACAACCTCTTGGTGAAC

CTTAGTACCTAAAAGGAAATCTCACCCCATCCCACACCCTGGAGGAT

TTCATCTCTTGTATATGATGATCTGGATCCACCAAGACTTGTTTTAT

GCTCAGGGTCAATTTCTTTTTTCTTTTTTTTTTTTTTTTCTTTTT

CTTTGAGACTGGGTCTCGCTTTGTTGCCCAGGCTGGAGTGGAGTGGC

GTGATCTTGGCTTACTGCAGCCTTTGCCTCCCCGGCTCGAGCAGTCC

TGCCTCAGCCTCCGGAGTAGCTGGGACCACAGGTTCATGCCACCATG

GCCAGCCAACTTTTGCATGTTTTGTAGAGATGGGGTCTCACAGTGTT

GCCCAGGCTGGTCTCAAACTCCTGGGCTCAGGCGATCCACCTGTCTC

AGCCTCCCAGAGTGCTGGGATTACAATTGTGAGCCACCACGTCCAGC

TGGAAGGGTCAACATCTTTTACATTCTGCAAGCACATCTGCATTTTC

ACCCCACCCTTCCCCTCCTTCTCCCTTTTTATATCCCATTTTTATAT

CGATCTCTTATTTTACAATAAAACTTTGCTGCCACCTGTGTGTCTGA

GGGGTG.
```

Esophageal adenocarcinoma (EAC) has steadily increased in incidence over recent decades. With an 85% mortality rate this cancer is the most rapidly increasing cause of cancer mortality from solid tumors in the American population. There has thus been substantial interest in development of screening approaches for early detection of EAC and its precursor lesions of Barrett's esophagus (BE). However, the majority of EACs develop in patients without prior symptoms, and current approaches of endoscopic screening of individuals with persistent symptoms of gastro-esophageal reflux disease, combined with longitudinal screening of those found to have BE, have accordingly not had significant impact on reducing deaths from EACs.

As noted above, early detection of gastrointestinal neoplasia (e.g., neoplasia of the upper gastrointestinal tract) coupled with appropriate intervention, is important for increasing patient survival rates. Present systems for screening for esophageal neoplasia are deficient for a variety of reasons, including a lack of specificity and/or sensitivity (e.g., barium swallow) or a high cost and intensive use of medical resources (e.g., upper endoscopy or CT scan). Alternative systems for detection of esophageal neoplasia would be useful in a wide range of other clinical circumstances as well. For example, detecting esophageal neoplasia may select the patient to undergo therapies that include, but are not limited, to resection of the neoplasia (via endoscopic resection or surgical resection), ablation of the neoplasia, chemotherapy, or radiation therapy. As a further example, patients who have received surgical and/or pharmaceutical therapy for esophageal cancer may experience a relapse. It would be advantageous to have an alternative system for determining whether such patients have a recurrent or relapsed neoplasia of the upper gastrointestinal tract. As a further example, an alternative diagnostic system would facilitate monitoring an increase, decrease or persistence of neoplasia of the upper gastrointestinal tract in a patient known to have such a neoplasia. A patient undergoing chemotherapy may be monitored to assess the effectiveness of the therapy.

III. Methylation of Informative Loci as Disease Biomarkers

The present disclosure relates at least in part to the identification of genomic loci whose altered DNA methylation is indicative of the presence of esophageal neoplasias and/or metaplasias that include Barrett's esophagus (BE) and/or esophageal adenocarcinoma (EAC). In some embodiments, the Barrett's esophagus is associated with dysplasia. In some embodiments, the dysplasia is high-grade dysplasia. In some embodiments, the dysplasia is low-grade dysplasia. In some embodiments, the methylation patterns of the informative loci as disclosed herein are determined in a sample taken from a subject as described herein and may be used to distinguish between subjects having Barrett's esophagus and subjects having high grade dysplasia and/or low grade dysplasia and/or esophageal adenocarcinoma. Examples of the informative loci are provided herein.

In some embodiments, any of the nucleotide sequences disclosed herein, or fragments or reverse complements thereof, may contain one or more "Y" residues. Cytosine residues that may be methylated or unmethylated, and hence may be bisulfite converted to T (if unmethylated) or remain as a C (if methylated), are designated with a "Y." In some embodiments, one or more of the Y residues in any of the sequences disclosed herein (or fragments or reverse complements thereof) designates a methylated C. In some embodiments, one or more of the Y residues in any of the sequences disclosed herein (or fragments or reverse complements thereof) designates an unmethylated C. In some embodiments, at least 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 of the Y residues in any of the sequences disclosed herein (or fragments or reverse complements thereof) correspond to methylated C residues. In some embodiments, at least 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 of the Y residues in any of the sequences disclosed herein (or fragments or reverse complements thereof) correspond to unmethylated C residues. In some embodiments, at least 10%, 20%, 30%, 40%, 50%, 60%, 70%, 80%, 90%, or 100% of the Y residues in any of the sequences disclosed herein (or fragments or reverse complements thereof) correspond to methylated C residues. In some embodiments, at least 10%, 20%, 30%, 40%, 50%, 60%, 70%, 80%, 90%, or 100% of the Y residues in any of the sequences disclosed herein (or fragments or reverse complements thereof) are correspond to unmethylated C residues. In some embodiments, any of the sequences disclosed herein (or fragments or reverse complements thereof) is bisulfite-converted. In some embodiments, at least 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 of the Y residues in any of the bisulfite-converted sequences disclosed herein (or fragments or reverse complements thereof) correspond to C. In some embodiments, at least 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 of the Y residues in any of the bisulfite-converted sequences disclosed herein (or fragments or reverse complements thereof) correspond to T. In some embodiments, at least 10%, 20%, 30%, 40%, 50%, 60%, 70%, 80%, 90%, or 100% of the Y residues in any of the bisulfite-converted sequences disclosed herein (or fragments or reverse complements thereof) correspond to C residues. In some embodiments, at least 10%, 20%, 30%, 40%, 50%, 60%, 70%, 80%, 90%, or 100% of the Y residues in any of the bisulfite-converted sequences disclosed herein (or fragments or reverse complements thereof) correspond to T residues.

In some embodiments, an informative loci in a subject is considered "methylated" for the purposes of determining whether or not the subject is prone to developing and/or has developed a metaplasia in the esophagus (e.g., Barrett's esophagus) or neoplasia (e.g., Barrett's esophagus with dysplasia such as high-grade or low-grade dysplasia) (e.g., esophageal cancer such as esophageal adenocarcinoma) if the loci is at least 10%, 20%, 30%, 40%, 50%, 60%, 70%, 80%, 90%, or 100% methylated. In some embodiments, a DNA sample from a subject is treated with bisulfite, and the resulting bisulfite sequence corresponds to any of the nucleotide sequences disclosed herein comprising a "Y" nucleotide. In some embodiments, if at least 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 of the Y residues of the bisulfite-converted sequence have a C, the sequence is considered "methylated" for the purposes of determining whether or not the subject is prone to developing and/or has developed a metaplasia in the esophagus (e.g., Barrett's esophagus) or neoplasia (e.g., Barrett's esophagus with dysplasia such as high-grade or low-grade dysplasia) (e.g., esophageal cancer such as esophageal adenocarcinoma). In some embodiments, a DNA sample from a subject is treated with bisulfite, and the resulting bisulfite sequence corresponds to any of the nucleotide sequences disclosed herein comprising a "Y" nucleotide. In some embodiments, if at least 10%, 20%, 30%, 40%, 50%, 60%, 70%, 80%, 90%, or 100% of the Y residues of the bisulfite-converted sequence have a C, the sequence is considered "methylated" for the purposes of determining whether or not the subject is prone to developing and/or has developed a metaplasia in the esophagus (e.g., Barrett's esophagus) or neoplasia (e.g., Barrett's esophagus with dysplasia such as high-grade or low-grade dysplasia) (e.g., esophageal cancer such as esophageal adenocarcinoma). The disclosure provides for informative loci that may be used to assess whether a subject (e.g. a human) has or is prone to developing a metaplasia in the esophagus (e.g., Barrett's esophagus) or neoplasia (e.g., Barrett's esophagus with dysplasia such as high-grade or low-grade dysplasia) (e.g., esophageal cancer such as esophageal adenocarcinoma). In some embodiments, one or more informative loci, as defined herein, may be used for determining whether a subject has or is likely to develop, a metaplasia (e.g., Barrett's esophagus). In some embodiments, one or more informative loci, as defined herein, may be used for determining whether a subject has or is likely to develop, a neoplasia (e.g., Barrett's esophagus with high grade dysplasia, or an esophageal cancer such as esophageal adenocarcinoma). In some embodiments, one or more informative loci, as defined herein, may be used to distinguish between whether a subject has a metaplasia in the esophagus (e.g., Barrett's esophagus) or an esophageal neoplasia (e.g., Barrett's esophagus with high grade dysplasia, or an esophageal cancer such as esophageal adenocarcinoma).

In some embodiments, the informative loci include sequences associated with any one or more of the plus strand DNA sequences having at least 80%, 85%, 87%, 90%, 91%, 92%, 93%, 94%, 95%, 96%, 97%, 98%, 99% or 100% identity to any of SEQ ID NOs: 1-428, 2569-2996, 5137-5531, 7507-7532, 7663-7668, 7819-7842, 7963-7976, 8047-8060, 8131-8143, 8209-8222, 8293-8306, 8405-8409, 8447-8632, 9563-9748, 10679-10825, 11561-11611, 11867-11917, 12173-12219, 12455-12460, 12491-12496, 12527-12532, 12563-12568, 12599-12604, 12647-12649, 12671-12907, 14093-14329, 15515-15537, 15653-15692, 15893-15932, 16133-16137, 16163-16165, 16181-16183, or 16199, or fragments or complements thereof. In particular embodiments, the informative loci include sequences associated with any one or more of the plus strand DNA sequences having at least 80%, 85%, 87%, 90%, 91%, 92%, 93%, 94%, 95%, 96%, 97%, 98%, 99% or 100% identity to any of SEQ ID NOs: 7963-7976, 8047-8060, 8131-8143, 12455-12460, 12491-12496, 12527-12532, 16163-16165, 16181-16183, or 16199, or fragments or complements thereof. In some embodiments, the informative loci are associated with increased methylation in both Barrett's esophagus and esophageal adenocarcinoma samples, as compared to the same sample types taken from a healthy control subject. In some embodiments, the informative loci that are associated with increased methylation in both Barrett's esophagus and esophageal adenocarcinoma samples include sequences associated with any one or more of the plus strand DNA sequences having at least 80%, 85%, 87%, 90%, 91%, 92%, 93%, 94%, 95%, 96%, 97%, 98%, 99% or 100% identity to any of SEQ ID NOs: 1-428, 2569-2996, 5137-5531, 7507-7532, 7663-7668, 7819-7842, 7963-7976, 8047-8060, 8131-8143, 8209-8222, 8293-8306, or 8405-8409, or fragments or complements thereof. In particular embodiments, the informative loci that are associated with increased methylation in both Barrett's esophagus and esophageal adenocarcinoma samples include sequences associated with any one or more of the plus strand DNA sequences having at least 80%, 85%, 87%, 90%, 91%, 92%, 93%, 94%, 95%, 96%, 97%, 98%, 99% or 100% identity to any of SEQ ID NOs: 7963-7976, 8047-8060, or 8131-8143, or fragments or complements thereof. In some embodiments, the informative loci are associated with increased methylation in an esophageal adenocarcinoma sample and/or a Barrett's with low grade or high grade dysplasia as compared to a sample of the same type taken from a subject having Barrett's esophagus without dysplasia. In some embodiments, the informative loci that are associated with increased methylation in an esophageal adenocarcinoma sample or a Barrett's with low grade or high grade dysplasia sample include any one or more of the sequences having at least 80%, 85%, 87%, 90%, 91%, 92%, 93%, 94%, 95%, 96%, 97%, 98%, 99% or 100% identity to any of SEQ ID NOs: 8447-8632, 9563-9748, 10679-10825, 11561-11611, 11867-11917, 12173-12219, 12455-12460, 12491-12496, or 12527-12532, or fragments or complements thereof. In particular embodiments, the informative loci that are associated with increased methylation in Barrett's with low grade dysplasia sample include any one or more of the sequences having at least 80%, 85%, 87%, 90%, 91%, 92%, 93%, 94%, 95%, 96%, 97%, 98%, 99% or 100% identity to any of SEQ ID NOs: 12455-12460, 12491-12496, or 12527-12532, or fragments or complements thereof. In particular embodiments, the informative loci that are associated with increased methylation in an esophageal adenocarcinoma sample or a Barrett's with high grade dysplasia sample include any one or more of the sequences having at least 80%, 85%, 87%, 90%, 91%, 92%, 93%, 94%, 95%, 96%, 97%, 98%, 99% or 100% identity to any of SEQ ID NOs: 12455-12460, 12491-12496, or 12527-12532, or fragments or complements thereof. In some embodiments, the informative loci are associated with reduced methylation in an esophageal adenocarcinoma sample as compared to a sample of the same type taken from a subject having Barrett's esophagus. In some embodiments, the informative loci that are associated with reduced methylation in an esophageal adenocarcinoma sample include any one or more of the sequences having at least 80%, 85%, 87%, 90%, 91%, 92%, 93%, 94%, 95%, 96%, 97%, 98%, 99% or 100% identity to any of SEQ ID NOs: 12671-12908, 14093-14329, 15515-15537, 15653-15692, 15893-15932, 16133-16137, 16163-16165, 16181-16183, or 16199, or fragments or complements thereof. In particular embodiments, the informative loci that are associated with reduced methylation in an esophageal adenocarcinoma sample include any one or more of the sequences having at least 80%, 85%, 87%, 90%, 91%, 92%, 93%, 94%, 95%, 96%, 97%, 98%, 99% or 100% identity to any of SEQ ID NOs: 16163-16165, 16181-16183, or 16199, or fragments or complements thereof.

In some embodiments, the informative loci or amplicon of the informative loci are treated with an agent, such as bisulfite. In some embodiments, the informative loci include sequences that have been treated with bisulfite. In some embodiments, the disclosure provides for bisulfite control sequences of any of the plus DNA strands disclosed herein. In some embodiments, the disclosure provides for bisulfite-treated unmethylated sequences of any of the plus DNA strands disclosed herein. In some embodiments, the bisulfite-converted plus-strand control DNA sequences include any one or more having at least 80%, 85%, 87%, 90%, 91%, 92%, 93%, 94%, 95%, 96%, 97%, 98%, 99% or 100% identity to any of SEQ ID NOs: 857-1284, 3425-3852, 5927-6321, 7559-7584, 7715-7740, 7867-7890, 7991-8004, 8075-8088, 8157-8169, 8223-8236, 8307-8320, 8410-8414, 8819-9004, 9935-10120, 10973-11119, 11663-11713, 11969-12019, 12267-12313, 12467-12472, 12503-12508, or 12539-12544, 12569-12574, 12605-12610, 12650-12652, or fragments or complements thereof. In particular embodiments, the bisulfite-converted plus-strand control DNA sequences include any one or more having at least 80%, 85%, 87%, 90%, 91%, 92%, 93%, 94%, 95%, 96%, 97%, 98%, 99% or 100% identity to any of SEQ ID NOs: 7991-8004, 8075-8088, 8157-8169, 8223-8236, 8307-8320, 8410-8414, 12467-12472, 12503-12508, or 12539-12544, 12569-12574, 12605-12610, 12650-12652, or fragments or complements thereof. In some embodiments, the informative loci are associated with increased methylation in both Barrett's esophagus and esophageal adenocarcinoma samples, as compared to the same sample types taken from a healthy control subject. In some embodiments, the disclosure provides for bisulfite-treated unmethylated sequences of any of the plus DNA strands that are associated with increased methylation in both Barrett's esophagus and esophageal adenocarcinoma samples, as compared to the same sample types taken from a healthy control subject. In some embodiments, the bisulfite converted sequences of any of the plus DNA strands that are associated with increased methylation in both Barrett's esophagus and esophageal adenocarcinoma samples are selected from the group consisting of sequences having at least 80%, 85%, 87%, 90%, 91%, 92%, 93%, 94%, 95%, 96%, 97%, 98%, 99% or 100% identity to any of SEQ ID NOs: 857-1284, 3425-3852, 5927-6321, 7559-7584, 7715-7740, 7867-7890, 7991-8004, 8075-8088, 8157-8169, 8223-8236, 8307-8320, or 8410-8414, or fragments or complements thereof. In particular embodiments, the bisulfite converted sequences of any of the plus DNA strands that are associated with increased methylation in both Barrett's esophagus and esophageal adenocarcinoma samples include any one or more bisulfite-converted methylated plus-strand DNA sequences selected from the group consisting of sequences having at least 80%, 85%, 87%, 90%, 91%, 92%, 93%, 94%, 95%, 96%, 97%, 98%, 99% or 100% identity to any of: SEQ ID NOs: 7991-8004, 8075-8088, 8157-8169, 8223-8236, 8307-8320, or 8410-8414, or fragments or complements thereof. In some embodiments, the disclosure provides for bisulfite-treated unmethylated sequences of any of the plus DNA strands that are associated with increased methylation in an esophageal adenocarcinoma sample or a Barrett's with low grade or high grade dysplasia sample as compared to a sample of the same type taken from a subject having Barrett's esophagus without dysplasia. In some embodiments, the bisulfite converted sequences of any of the plus DNA strands that are associated with increased methylation in an esophageal adenocarcinoma sample or a Barrett's with low grade or high grade dysplasia sample include any one or more bisulfite-converted methylated plus-strand DNA sequences selected from the group consisting having at least 80%, 85%, 87%, 90%, 91%, 92%, 93%, 94%, 95%, 96%, 97%, 98%, 99% or 100% identity to any of SEQ ID NOs: 8819-9004, 9935-10120, 10973-11119, 11663-11713, 11969-12019, 12267-12313, 12467-12472, 12503-12508, 12539-12544, 12569-12574, 12605-12610, or 12650-12652, or fragments or complements thereof. In particular embodiments, the bisulfite converted sequences of any of the plus DNA strands that are associated with increased methylation in an esophageal adenocarcinoma sample or a Barrett's with low grade or high grade dysplasia sample include any one or more of the sequences having at least 80%, 85%, 87%, 90%, 91%, 92%, 93%, 94%, 95%, 96%, 97%, 98%, 99% or 100% identity to any of SEQ ID NOs: 12467-12472, 12503-12508, 12539-12544, 12569-12574, 12605-12610, or 12650-12652, or fragments or complements thereof. In some embodiments, the informative loci are associated with reduced methylation in an esophageal adenocarcinoma sample as compared to a sample of the same type taken from a subject having Barrett's esophagus. In some embodiments, the disclosure provides for methylated control sequences of the plus DNA strand that are associated with reduced methylation in an esophageal adenocarcinoma sample as compared to a sample of the same type taken from a subject having Barrett's esophagus. In some embodiments, the methylated control sequences of any of the plus DNA strands that are associated with reduced methylation in an esophageal adenocarcinoma sample include any one or more bisulfite-converted methylated plus-strand DNA sequences selected from the group consisting having at least 80%, 85%, 87%, 90%, 91%, 92%, 93%, 94%, 95%, 96%, 97%, 98%, 99% or 100% identity to any of SEQ ID NOs: 13145-13381, 14567-14803, 15561-15583, 15733-15772, 15973-16012, 16143-16147, 16169-16171, 16187-16189 or 16201, or fragments or complements thereof. In particular embodiments, the methylated control sequences of any of the plus DNA strands that are associated with reduced methylation in an esophageal adenocarcinoma sample include any one or more bisulfite-converted methylated plus-strand DNA sequences selected from the group consisting having at least 80%, 85%, 87%, 90%, 91%, 92%, 93%, 94%, 95%, 96%, 97%, 98%, 99% or 100% identity to any of SEQ ID NOs: 16169-16171, 16187-16189 or 16201, or fragments or complements thereof.

In some embodiments, the informative loci or amplicon of the informative loci are treated with an agent, such as bisulfite. In some embodiments, the informative loci include sequences that have been treated with bisulfite. In some embodiments, the informative loci include methylated nucleic acid sequences that have been treated with bisulfite. In some embodiments, the bisulfite-converted methylated plus-strand DNA sequences have at least 80%, 85%, 87%, 90%, 91%, 92%, 93%, 94%, 95%, 96%, 97%, 98%, 99% or 100% identity to any of SEQ ID NOs: 1285-1712, 3853-4280, 6322-6716, 7585-7610, 7741-7766, 7891-7914, 8005-8018, 8089-8102, 8170-8182, 8237-8250, 8321-8334, 8415-8419, 9005-9190, 10121-10306, 11120-11266, 11714-11764, 12020-12070, 12314-12360, 12473-12478, 12509-12514 or 12545-12550, 12575-12580, 12611-12616, 12653-12655, or fragments or complements thereof. In particular embodiments, the bisulfite-converted methylated plus-strand DNA sequences have at least 80%, 85%, 87%, 90%, 91%, 92%, 93%, 94%, 95%, 96%, 97%, 98%, 99% or 100% identity to any of SEQ ID NOs: 8005-8018, 8089-8102, 8170-8182, 12473-12478, 12509-12514 or 12545-12550, or fragments or complements thereof. In some embodiments, the informative loci are associated with increased methylation in both Barrett's esophagus and esophageal adenocarcinoma samples, as compared to the same sample types taken from a healthy control subject. In some embodiments, the informative loci that are associated with increased methylation in both Barrett's esophagus and esophageal adenocarcinoma samples include any one or more bisulfite-converted methylated plus-strand DNA sequences selected from the group consisting of sequences having at least 80%, 85%, 87%, 90%, 91%, 92%, 93%, 94%, 95%, 96%, 97%, 98%, 99% or 100% identity to any of SEQ ID NOs: 1285-1712, 3853-4280, 6322-6716, 7585-7610, 7741-7766, 7891-7914, 8005-8018, 8089-8102, 8170-8182, 8237-8250, 8321-8334, or 8415-8419, or fragments or complements thereof. In particular embodiments, the informative loci that are associated with increased methylation in both Barrett's esophagus and esophageal adenocarcinoma samples include any one or more bisulfite-converted methylated plus-strand DNA sequences selected from the group consisting of sequences having at least 80%, 85%, 87%, 90%, 91%, 92%, 93%, 94%, 95%, 96%, 97%, 98%, 99% or 100% identity to: SEQ ID NOs: 8005-8018, 8089-8102, 8170-8182, 8237-8250, 8321-8334, or 8415-8419, or fragments or complements thereof. In some embodiments, the informative loci are associated with increased methylation in an esophageal adenocarcinoma sample or a Barrett's with low grade or high grade dysplasia sample as compared to a sample of the same type taken from a subject having Barrett's esophagus without dysplasia. In some embodiments, the informative loci that are associated with increased methylation in an esophageal adenocarcinoma sample or a Barrett's with low grade or high grade dysplasia sample include any one or more bisulfite-converted methylated plus-strand DNA sequences selected from the group consisting of sequences having at least 80%, 85%, 87%, 90%, 91%, 92%, 93%, 94%, 95%, 96%, 97%, 98%, 99% or 100% identity to SEQ ID NOs: 9005-9190, 10121-10306, 11120-11266, 11714-11764, 12020-12070, 12314-12360, 12473-12478, 12509-12514, 12545-12550, 12575-12580, 12611-12616, or 12653-12655, or fragments or complements thereof. In particular embodiments, the informative loci that are associated with increased methylation in an esophageal adenocarcinoma sample or a Barrett's with low grade or high grade dysplasia sample include any one or more of the sequences having at least 80%, 85%, 87%, 90%, 91%, 92%, 93%, 94%, 95%, 96%, 97%, 98%, 99% or 100% identity to SEQ ID NOs: 12473-12478, 12509-12514, 12545-12550, 12575-12580, 12611-12616, or 12653-12655, or fragments or complements thereof. In some embodiments, the informative loci are associated with reduced methylation in an esophageal adenocarcinoma sample as compared to a sample of the same type taken from a subject having Barrett's esophagus. In some embodiments, the informative loci that are associated with reduced methylation in an esophageal adenocarcinoma sample include any one or more bisulfite-converted methylated plus-strand DNA sequences selected from the group consisting of sequences having at least 80%, 85%, 87%, 90%, 91%, 92%, 93%, 94%, 95%, 96%, 97%, 98%, 99% or 100% identity to SEQ ID NOs: 13382-13618, 14804-15040, 15584-15606, 15773-15812, 16013-16052, 16148-16152, 16172-16174, 16190-16192 or 16202. In particular embodiments, the informative loci that are associated with reduced methylation in an esophageal adenocarcinoma sample include any one or more of the sequences having at least 80%, 85%, 87%, 90%, 91%, 92%, 93%, 94%, 95%, 96%, 97%, 98%, 99% or 100% identity to SEQ ID NOs: 16172-16174, 16190-16192 or 16202, or fragments or complements thereof.

In some embodiments, the informative loci include sequences associated with any of the minus strand DNA sequences having at least 80%, 85%, 87%, 90%, 91%, 92%, 93%, 94%, 95%, 96%, 97%, 98%, 99% or 100% identity to any of SEQ ID NOs: 429-856, 2997-3424, 5532-5926, 7533-7558, 7689-7714, 7843-7866, 7977-7990, 8061-8074, 8144-8156, 8251-8264, 8335-8348, 8420-8424, 8633-8818, 9749-9934, 10826-10972, 11612-11662, 11918-11968, 12220-12266, 12461-12466, 12497-12502, 12533-12538, 12581-12586, 12617-12622, 12656-12658, 12909-13144, 14330-14566, 15538-15560, 15693-15732, 15933-15972, 16138-16142, 16166-16168, 16184-16186 or 16200, or fragments or complements thereof. In particular embodiments, the informative loci include sequences associated with any of the minus strand DNA sequences having at least 80%, 85%, 87%, 90%, 91%, 92%, 93%, 94%, 95%, 96%, 97%, 98%, 99% or 100% identity to any of SEQ ID NOs: 7977-7990, 8061-8074, 8144-8156, 8251-8264, 8335-8348, 8420-8424, 12461-12466, 12497-12502, 12533-12538, 12581-12586, 12617-12622, 12656-12658, 16166-16168, 16184-16186 or 16200, or fragments or complements thereof. In some embodiments, the informative loci are associated with increased methylation in both Barrett's esophagus and esophageal adenocarcinoma samples, as compared to the same sample types taken from a healthy control subject. In some embodiments, the informative loci that are associated with increased methylation in both Barrett's esophagus and esophageal adenocarcinoma samples include sequences associated with any one or more of the minus strand DNA sequences having at least 80%, 85%, 87%, 90%, 91%, 92%, 93%, 94%, 95%, 96%, 97%, 98%, 99% or 100% identity to any of SEQ ID NOs: 429-856, 2997-3424, 5532-5926, 7533-7558, 7689-7714, 7843-7866, 7977-7990, 8061-8074, 8144-8156, 8251-8264, 8335-8348, 8420-8424, or fragments or complements thereof. In particular embodiments, the informative loci that are associated with increased methylation in both Barrett's esophagus and esophageal adenocarcinoma samples include sequences associated with any one or more of the plus strand DNA sequences having at least 80%, 85%, 87%, 90%, 91%, 92%, 93%, 94%, 95%, 96%, 97%, 98%, 99% or 100% identity to any of SEQ ID NOs: 8251-8264, 8335-8348. 8420-8424, or fragments or complements thereof. In some embodiments, the informative loci are associated with increased methylation in an esophageal adenocarcinoma sample or a Barrett's with low grade or high grade dysplasia sample as compared to a sample of the same type taken from a subject having Barrett's esophagus without dysplasia. In some embodiments, the informative loci that are associated with increased methylation in an esophageal adenocarcinoma sample or a Barrett's with low grade or high grade dysplasia sample include any one or more of the sequences having at least 80%, 85%, 87%, 90%, 91%, 92%, 93%, 94%, 95%, 96%, 97%, 98%, 99% or 100% identity to any of SEQ ID NOs: 8633-8818, 9749-9934, 10826-10972, 11612-11662, 11918-11968, 12220-12266, 12461-12466, 12497-12502, 12533-12538, 12581-12586, 12617-12622, or 12656-12658, or fragments or complements thereof. In particular embodiments, the informative loci that are associated with increased methylation in an esophageal adenocarcinoma sample or a Barrett's with low grade or high grade dysplasia sample include any one or more of the sequences having at least 80%, 85%, 87%, 90%, 91%, 92%, 93%, 94%, 95%, 96%, 97%, 98%, 99% or 100% identity to any of SEQ ID NOs: 12461-12466, 12497-12502, 12533-12538, 12581-12586, 12617-12622, or 12656-12658, or fragments or complements thereof. In some embodiments, the informative loci are associated with reduced methylation in an esophageal adenocarcinoma sample as compared to a sample of the same type taken from a subject having Barrett's esophagus. In some embodiments, the informative loci that are associated with reduced methylation in an esophageal adenocarcinoma sample include any one or more of the sequences having at least 80%, 85%, 87%, 90%, 91%, 92%, 93%, 94%, 95%, 96%, 97%, 98%, 99% or 100% identity to any of SEQ ID NOs: 12909-13144, 14330-14566, 15538-15560, 15693-15732, 15933-15972, 16138-16142, 16166-16168, 16184-16186 or 16200, or fragments or complements thereof. In particular embodiments, the informative loci that are associated with reduced methylation in an esophageal adenocarcinoma sample include any one or more of the sequences having at least 80%, 85%, 87%, 90%, 91%, 92%, 93%, 94%, 95%, 96%, 97%, 98%, 99% or 100% identity to any of SEQ ID NOs: 16166-16168, 16184-16186 or 16200, or fragments or complements thereof.

In some embodiments, the informative loci or amplicon of the informative loci are treated with an agent, such as bisulfite. In some embodiments, the informative loci include sequences that have been treated with bisulfite. In some embodiments, the disclosure provides for bisulfite control sequences of any of the minus DNA strands disclosed herein. In some embodiments, the disclosure provides for bisulfite-treated sequences of any of the minus DNA strands disclosed herein. In some embodiments, the bisulfite-converted minus-strand control DNA sequences include any one or more of the sequences having at least 80%, 85%, 87%, 90%, 91%, 92%, 93%, 94%, 95%, 96%, 97%, 98%, 99% or 100% identity to any of SEQ ID NOs: 1713-2140, 4281-4708, 6717-7111, 7611-7636, 7767-7792, 7915-7938, 8019-8032, 8103-8116, 8183-8195, 8265-8278, 8349-8362, 8425-8429, 9191-9376, 10307-10492, 11267-11413, 11765-11815, 12071-12121, 12361-12407, 12479-12484, 12515-12520, 12551-12556, 12587-12592, 12623-12628, or 12659-12661, or fragments or complements thereof. In particular embodiments, the bisulfite-converted minus-strand control DNA sequences include any one or more the sequences having at least 80%, 85%, 87%, 90%, 91%, 92%, 93%, 94%, 95%, 96%, 97%, 9, 98%, 99% or 100% identity to any of SEQ ID NOs: 8019-8032, 8103-8116, 8183-8195, 12479-12484, 12515-12520, or 12551-12556, or fragments or complements thereof. In some embodiments, the informative loci are associated with increased methylation in both Barrett's esophagus and esophageal adenocarcinoma samples, as compared to the same sample types taken from a healthy control subject. In some embodiments, the disclosure provides for bisulfite-treated sequences of any of the minus DNA strands that are associated with increased methylation in both Barrett's esophagus and esophageal adenocarcinoma samples, as compared to the same sample types taken from a healthy control subject. In some embodiments, the sequences of any of the minus DNA strands that are associated with increased methylation in both Barrett's esophagus and esophageal adenocarcinoma samples are selected from the group consisting of sequences having at least 80%, 85%, 87%, 90%, 91%, 92%, 93%, 94%, 95%, 96%, 97%, 98%, 99% or 100% identity to any of SEQ ID NOs: 1713-2140, 4281-4708, 6717-7111, 7611-7636, 7767-7792, 7915-7938, 8019-8032, 8103-8116, 8183-8195, 8265-8278, 8349-8362, or 8425-8429, or fragments or complements thereof. In particular embodiments, the sequences of any of the minus DNA strands that are associated with increased methylation in both Barrett's esophagus and esophageal adenocarcinoma samples include any one or more bisulfite-converted methylated minus-strand DNA sequences selected from the group consisting of sequences having at least 80%, 85%, 87%, 90%, 91%, 92%, 93%, 94%, 95%, 96%, 97%, 98%, 99% or 100% identity to: SEQ ID NOs: 8019-8032, 8103-8116, 8183-8195, 8265-8278, 8349-8362, or 8425-8429, or fragments or complements thereof. In some embodiments, the disclosure provides for bisulfite-treated sequences of any of the minus DNA strands that are associated with increased methylation in an esophageal adenocarcinoma sample or a Barrett's with low grade or high grade dysplasia sample as compared to a sample of the same type taken from a subject having Barrett's esophagus without dysplasia. In some embodiments, the sequences of any of the minus DNA strands that are associated with increased methylation in an esophageal adenocarcinoma sample or a Barrett's with low grade or high grade dysplasia sample include any one or more bisulfite-converted methylated minus-strand DNA sequences selected from the group consisting of sequences having at least 80%, 85%, 87%, 90%, 91%, 92%, 93%, 94%, 95%, 96%, 97%, 98%, 99% or 100% identity to SEQ ID NOs: 9191-9376, 10307-10492, 11267-11413, 11765-11815, 12071-12121, 12361-12407, 12479-12484, 12515-12520, or 12551-12556, 12587-12592, 12623-12628, or 12659-12661, or fragments or complements thereof. In particular embodiments, the unmethylated sequences of any of the minus DNA strands that are associated with increased methylation in an esophageal adenocarcinoma sample or a Barrett's with low grade or high grade dysplasia sample include any one or more of the sequences having at least 80%, 85%, 87%, 90%, 91%, 92%, 93%, 94%, 95%, 96%, 97%, 98%, 99% or 100% identity to SEQ ID NOs: 12479-12484, 12515-12520, 12551-12556, 12587-12592, 12623-12628, or 12659-12661, or fragments or complements thereof. In some embodiments, the informative loci are associated with reduced methylation in an esophageal adenocarcinoma sample as compared to a sample of the same type taken from a subject having Barrett's esophagus. In some embodiments, the disclosure provides for methylated control sequences of the minus DNA strand that are associated with reduced methylation in an esophageal adenocarcinoma sample as compared to a sample of the same type taken from a subject having Barrett's esophagus. In some embodiments, the methylated control sequences of any of the minus DNA strands that are associated with reduced methylation in an esophageal adenocarcinoma sample include any one or more bisulfite-converted methylated minus-strand DNA sequences selected from the group consisting of sequences having at least 80%, 85%, 87%, 90%, 91%, 92%, 93%, 94%, 95%, 96%, 97%, 98%, 99% or 100% identity to SEQ ID NOs: 13619-13855, 15041-15277, 15607-15629, 15813-15852, 16053-16092, 16153-16157, 16175-16177, 16192-16195 or 16203, or fragments or complements thereof. In particular embodiments, the methylated control sequences of any of the minus DNA strands that are associated with reduced methylation in an esophageal adenocarcinoma sample include any one or more bisulfite-converted methylated minus-strand DNA sequences selected from the group consisting of sequences having at least 80%, 85%, 87%, 90%, 91%, 92%, 93%, 94%, 95%, 96%, 97%, 98%, 99% or 100% identity to SEQ ID NOs: 16175-16177, 16192-16195 or 16203, or fragments or complements thereof.

In some embodiments, the informative loci or amplicon of the informative loci are treated with an agent, such as bisulfite. In some embodiments, the informative loci include sequences that have been treated with bisulfite. In some embodiments, the informative loci include methylated nucleic acid sequences that have been treated with bisulfite.

In some embodiments, the bisulfite-converted methylated minus-strand DNA sequences include any one or more of sequences having at least 80%, 85%, 87%, 90%, 91%, 92%, 93%, 94%, 95%, 96%, 97%, 98%, 99% or 100% identity to SEQ ID NOs: 2141-2568, 4709-5136, 7112-7506, 7637-7662, 7793-7818, 7939-7962, 8033-8046, 8117-8130, 8196-8208, 8279-8292, 8363-8376, 8430-8434, 9377-9562, 10493-10678, 11414-11560, 11816-11866, 12122-12172, 12408-12454, 12485-12490, 12521-12526, 12557-12562, 12593-12598, 12269-12634, or 12662-12664, or fragments or complements thereof. In particular embodiments, the bisulfite-converted methylated minus-strand DNA sequences include any one or more of sequences having at least 80%, 85%, 87&% 90%, 91%, 92&% 93%, 94%, 95%, 96%, 97%, 98&% 99% or 100% identity to SEQ ID NOs: 8033-8046, 8117-8130, 8196-8208, 8279-8292, 8363-8376, 8430-8434, 12485-12490, 12521-12526, 12557-12562, 12593-12598, 12269-12634, or 12662-12664, or fragments or complements thereof. In some embodiments, the informative loci are associated with increased methylation in both Barrett's esophagus and esophageal adenocarcinoma samples, as compared to the same sample types taken from a healthy control subject. In some embodiments, the informative loci that are associated with increased methylation in both Barrett's esophagus and esophageal adenocarcinoma samples include any one or more bisulfite-converted methylated minus-strand DNA sequences selected from the group consisting of sequences having at least 80%, 85%, 87%, 90%, 91%, 92%, 93%, 94%, 95%, 96%, 97%, 98%, 99% or 100% identity to SEQ ID NOs: 2141-2568, 4709-5136, 7112-7506, 7637-7662, 7793-7818, 7939-7962, 8033-8046, 8117-8130, 8196-8208, 8279-8292, 8363-8376, or 8430-8434, or fragments or complements thereof. In particular embodiments, the informative loci that are associated with increased methylation in both Barrett's esophagus and esophageal adenocarcinoma samples include any one or more bisulfite-converted methylated minus-strand DNA sequences selected from the group consisting of sequences having at least 80%, 85%, 87%, 90%, 91%, 92%, 93%, 94%, 95%, 96%, 97%, 98%, 99% or 100% identity to: SEQ ID NOs: 8033-8046, 8117-8130, 8196-8208, 8279-8292, 8363-8376, or 8430-8434, or fragments or complements thereof. In some embodiments, the informative loci are associated with increased methylation in an esophageal adenocarcinoma sample or a Barrett's with high grade dysplasia sample as compared to a sample of the same type taken from a subject having Barrett's esophagus without dysplasia. In some embodiments, the informative loci that are associated with increased methylation in an esophageal adenocarcinoma sample or a Barrett's with low grade or high grade dysplasia sample include any one or more bisulfite-converted methylated minus-strand DNA sequences selected from the group consisting of sequences having at least 80%, 85%, 87%, 90%, 91%, 92%, 93%, 94%, 95%, 96%, 97%, 98%, 99% or 100% identity to SEQ ID NOs: 9377-9562, 10493-10678, 11414-11560, 11816-11866, 12122-12172, 12408-12454, 12485-12490, 12521-12526, 12557-12562, 12593-12598, 12269-12634, or 12662-12664, or fragments or complements thereof. In particular embodiments, the informative loci that are associated with increased methylation in an esophageal adenocarcinoma sample or a Barrett's with low grade or high grade dysplasia sample include any one or more of the sequences of sequences having at least 80%, 85%, 87%, 90%, 91%, 92%, 93%, 94%, 95%, 96%, 97%, 98%, 99% or 100% identity to SEQ ID NOs: 12485-12490, 12521-12526, 12557-12562, 12593-12598, 12269-12634, or 12662-12664, or fragments or complements thereof. In some embodiments, the informative loci are associated with reduced methylation in an esophageal adenocarcinoma sample as compared to a sample of the same type taken from a subject having Barrett's esophagus. In some embodiments, the informative loci that are associated with reduced methylation in an esophageal adenocarcinoma sample include any one or more bisulfite-converted methylated minus-strand DNA sequences selected from the group consisting of sequences having at least 80%, 85%, 87%, 90%, 91%, 92%, 93%, 94%, 95%, 96%, 97%, 98%, 99% or 100% identity to SEQ ID NOs: 13856-14092, 15278-15514, 15630-15652, 15853-15892, 16093-16132, 16158-16162, 16178-16180, 16196-16198, or 16204, or fragments or complements thereof. In particular embodiments, the informative loci that are associated with reduced methylation in an esophageal adenocarcinoma sample include any one or more of the sequences having at least 80%, 85%, 87%, 90%, 91%, 92%, 93%, 94%, 95%, 96%, 97%, 98%, 99% or 100% identity to SEQ ID NOs: 16178-16180, 16196-16198, or 16204, or fragments or complements thereof.

In some embodiments, the disclosure provides for a bisulfite-converted nucleotide sequence comprising the bisulfite-converted nucleotide sequence of any one of the following: Up3, Up10, Up15-1, Up15-2, Up20-1, Up20-2, Up20-2, Up27, Up35-1, Up35-2, SqBE2, SqBE5. SqBE7, SqBE9, SqBE10, SqBE11-1, SqBE 1-2, SqBE13, SqBE14-2. SqBE15, SqBE16-1, SqBE16-2, SqBE17-1, SqBE18. SqBE22-1, SqBE22-2 or SqBE23. In particular embodiments, the sequence comprises the bisulfite-converted nucleotide sequence of any one of the following: Up3, Up10, Up15-1, Up15-2, Up20-1, Up20-2, Up20-2, Up27, Up35-1, or Up35-2. In particular embodiments, the sequence comprises the bisulfite-converted nucleotide sequence of any one of the following: SqBE2, SqBE5, SqBE7, SqBE9, SqBE 10, SqBE11-1, SqBE11-2, SqBE13, SqBE14-2. SqBE15, SqBE16-1, SqBE16-2, SqBE17-1, SqBE18, SqBE22-1, SqBE22-2 or SqBE23.

In some embodiments, the disclosure provides for a panel of any of the sequences disclosed herein. In some embodiments, the panel comprises any of the following combinations of sequences: a) Up3, Up10, Up15-1, Up15-2, Up20-1, Up20-2, Up27, Up35-1, and Up35-2; b) Up3, Up15-1, Up15-2, Up20-1, Up27, and Up35-1: c) Up10, Up3, Up15-1, Up15-2, Up20-1, Up27, and Up35-1; d) Up35-2, Up3, Up15-1, Up15-2, Up20-1, Up27 and Up35-1; e) Up15-1 and Up35-1; f) Up15-1, Up35-1, and Up10; g) Up15-1, Up35-1 and Up20-1; h) Up15-1, Up35-1, Up10, and Up15-2; i) Up15-1, Up35-1, Up10, and Up27; j) Up15-1, Up35-1, Up15-2, and Up20-1; k) Up15-1, Up35-1, Up15-2 and Up27: 1) Up15-1, Up35-1, Up20-1, and Up27; m) Up3 and Up35-1: n) Up3 and Up35-2; o) Up3 and Up10; p) Up3 and Up27; q) Up35-1 and Up35-2; r) Up35-1 and Up27; s) Up35-2 and Up10; t) Up10 and Up27; u) Up3, Up35-1 and Up35-2; v) Up3, Up35-1 and Up10; w) Up3, Up35-1, and Up27; x) Up3, Up35-2 and Up10; y) Up3, Up35-2, and Up27; z) Up3, Up10, and Up27; aa) Up35-1, Up10, and Up27; ab) Up35-2, Up10, and Up27; ac) Up3, Up35-1, Up35-2 and Up10; ad) Up3, Up35-1, Up35-2 and Up27; ae) Up35-1, Up35-2, Up10 and Up27; af) Up3, Up35-2, Up10 and Up27; ag) Up3, Up35-1, Up10 and Up27; ah) Up3, Up10, Up27, Up35-1, and Up35-2; ai) Up35-1 and Up10, aj) Up35-1 and Up27; ak) Up35-2 and Up10; al) Up35-2 and Up27; am) Up3, Up35-1 and Up35-2; an) Up3, Up35-1, and Up10; ao) Up3, Up35-1, and Up27; ap) Up3, Up35-2 and Up10; aq) Up3, Up35-2 and Up27; ar) Up3, Up10 and Up27; at) Up35-1, Up10, and Up27; au) Up3, Up35-1, Up35-2, and Up10; av) Up3, Up35-1, Up35-2 and Up27; aw) Up35-1, Up35-2, Up10 and Up27; ax) Up3, Up35-2, Up10 and Up27; ay) Up3, Up35-1, Up10 and Up27; az) Up3, Up10, Up27, Up35-1, and Up35-2; ba) SqBE5 and SqBE7; bb) SqBE5 and SqBE16; bc) SqBE5 and SqBE17; bd) SqBE5 and SqBE18: be) SqBE7 and SqBE16; bf) SqBE7 and SqBE17; SqBE7 and SqBE17; bg) SqBE7 and SqBE18; bh) SqBE16 and SqBE17 and bi) SqBE16 and SqBE18. In some embodiments, the disclosure provides for a method of detecting the methylation status of the sequences in any of the panels disclosed herein. In some embodiments, the disclosure provides for a method of detecting the methylation status of the sequences in any of the panels disclosed herein, and further comprises detecting the mutation status of p53. In particular embodiments, the disclosure provides for a method of a) detecting the methylation status of a panel comprising the sequences of Up-3 and Up35-2, and b) further detecting the mutation status of TP53.

In some embodiments, the disclosure provides for a method of detecting the methylation status of any of the loci disclosed herein, and further comprises detecting the methylation status of vimentin. In some embodiments, the vimentin methylation is detected in a manner consistent with that described in Li et al. (Li M, et al. (2009) Sensitive digital quantification of DNA methylation in clinical samples. *Nat Biotechnol* 27(9):858-863). In some embodiments, the vimentin methylation patterns are determined in a nucleotide sequence having at least 80%, 85%, 90%, 91%, 92%, 93%, 94%, 95%, 96%, 97%, 98%, 99% or 100% identity to SEQ ID NO: 16207 or 16208. In some embodiments, the methylation patterns are determined in any of the following nucleic acid sequence combinations: a) vimentin and SQBE5; b) vimentin and SQBE7, c) vimentin and SQBE16, d) vimentin and SQBE17 or e) vimentin and SQBE 18.

In particular embodiments, the disclosure provides for a nucleotide sequence comprising a sequence having at least 80%, 85%, 90%, 91%, 92%, 93%, 94%, 95%, 96%, 97%, 98%, 99% or 100% identity to any of the following sequences: 8209-8222, 8251-8264, 8293-8306, 8335-8348, 8405-8409, 8420-8424, 12563-12568, 12581-12586, 12599-12604, 12617-12622, 12647-12649 or 12656-12658, or fragments and/or reverse complements thereof. In particular embodiments, the disclosure provides for a nucleotide sequence comprising a sequence having at least 80%, 85%, 90%, 91%, 92%, 93% 94%, 95%, 96% 97%, 98%, 99% or 100% identity to any of the following sequences: 12563-12568, 12581-12586, 12599-12604, 12617-12622, 12647-12649 or 12656-12658, or fragments and/or reverse complements thereof. In particular embodiments, the disclosure provides for a nucleotide sequence comprising a sequence having at least 80%, 85%, 90%, 91%, 92%, 93%, 94%, 95%, 96%, 97%, 98%, 99% or 100% identity to any of the following sequences: 8209-8222, 8251-8264, 8293-8306, 8335-8348, 8405-8409, or 8420-8424, or fragments and/or reverse complements thereof.

In some embodiments, the disclosure provides for a bisulfite-converted nucleotide sequence comprising a sequence having at least 80%, 85%, 90%, 91%, 92%, 93%, 94%, 95%, 96%, 97%, 98%, 99% or 100% identity to any of the following sequences: SEQ ID NOs: 8307-8313, 8315-8327, 8329-8334, 8349-8355, 8357-8369, 8371-8376, 8411, 8412, 8414, 8416, 8417, 8419, 8426, 8427, 8429, 8431, 8432, 8434, 12605-12616, 12623-12634, 12650-12655, or 12659-12664, or fragments and/or reverse complements thereof. In some embodiments, the sequence comprises a sequence having at least 80%, 85%, 90%, 91%, 92%, 93%, 94%, 95%, 96%, 97%, 98%, 99% or 100% identity to any of the following sequences: SEQ ID NOs: 8307-8313, 8315-8327, 8329-8334, 8349-8355, 8357-8369, 8371-8376, 8411, 8412, 8414, 8416, 8417, 8419, 8426, 8427, 8429, 8431, or 8432, 8434. In some embodiments, the sequence comprises a sequence having at least 80%, 85%, 90%, 91%, 92%, 93%, 94%, 95%, 96%, 97%, 98%, 99% or 100% identity to any of the following sequences: SEQ ID NOs: 12605-12616, 12623-12634, 12650-12655, or 12659-12664.

In some embodiments, the disclosure provides for a bisulfite-converted nucleotide sequence comprising a sequence having at least 80%, 85%, 90%° 91%, 92%, 93%, 94%, 95%, 96%, 97%, 98%, 99% or 100% identity to any of the following sequences: SEQ ID NOs: 8223-8250, 8265-8292, 12569-12580, or 12587-12598, or fragments and/or reverse complements thereof. In some embodiments, the sequence comprises a sequence having at least 80%, 85%, 90%, 91%, 92%, 93%, 94%, 95%, 96%, 97%, 98%, 99% or 100% identity to any of the following sequences: SEQ ID NOs: 8223-8250 or 8265-8292. In some embodiments, the sequence comprises a sequence having at least 80%, 85%, 90%, 91%, 92%, 93%, 94%, 95%, 96%, 97%, 98%, 99% or 100% identity to any of the following sequences: SEQ ID NOs: 12569-12580 or 12587-12598.

In some embodiments, the sample for use in any of the methods disclosed herein is a tissue sample taken from the subject. In some embodiments, the sample is tissue sample from the esophagus. In some embodiments, the sample is a biopsy or a brushing. In some embodiments, the sample is a biopsy or brushing of the esophagus. In some embodiments, the sample is a body fluid. In some embodiments, the body fluid is blood, serum, saliva, spit, stool, urine or an esophageal washing.

The present disclosure contemplates methods of selecting an individual to undergo a diagnostic procedure to determine the presence of Barrett's esophagus, Barrett's esophagus with dysplasia (e.g., Barrett's esophagus with low-grade or high-grade dysplasia), or of esophageal adenocarcinoma, by obtaining a biological sample from an individual, and determining in the sample the presence of DNA methylation in at least one of any of the sequences disclosed herein. In some embodiments, the disclosure provides for a method of selecting a subject for monitoring of esophageal neoplasia, wherein the presence of DNA methylation in at least one of any of the sequences disclosed herein is detected in a sample from the subject. In some embodiments, detection is achieved by any one or more of DNA sequencing, next generation sequencing, methylation specific PCR, methylation specific PCR combined with a fluorogenic hybridization probe, real time methylation specific PCR, or hybridization to an array. In some embodiments, the detection in the sample is indicative that the subject is at high risk of progression to esophageal neoplasia (e.g., esophageal cancer). In some embodiments, the subject is monitored by endoscopy. In some embodiments, a sample from a subject in which DNA methylation of at least one of any of the sequences disclosed herein is detected, is indicative that the subject should be administered a particular treatment. In some embodiments, the treatment is selected from the group consisting of endoscopic removal or ablation of an esophageal neoplasia, and/or surgery, radiation, or chemotherapy treatment of esophageal adenocarcinoma. In some embodiments, the sequence is any one or more sequence selected from the group consisting of a sequence having at least 80%, 85%, 90%, 91%, 92%, 93%, 94%, 95%, 96%, 97%, 98%, 99% or 100% identity to any of the following sequences: SEQ ID NOs: 1-856, 2569-3424, 5137-5926: 7507-7558, 7663-7714, 7819-7866, 7963-7990, 8047-8074, 8131-8156, 8209-8222, 8251-8264, 8293-8306, 8335-8348, 8405-8409, and 8420-8424, or fragments or complements thereof.

The present disclosure also contemplates methods of selecting an individual to undergo a diagnostic procedure to determine presence of Barrett's esophagus with low-grade dysplasia, Barrett's esophagus with high grade dysplasia or of esophageal adenocarcinoma, by obtaining a biological sample from an individual, and determining in the sample the presence of DNA methylation in at least one of any of the sequences disclosed herein. In some embodiments, the sequence is any one or more sequence selected from the group consisting of sequences having at least 80%, 85%, 90%, 91%, 92%, 93%, 94%, 95%, 96%, 97%, 98%, 99% or 100% identity to any of the following sequences: SEQ ID NOs: 8447-8818, 9563-9934, 10679-10972, 11561-11662, 11867-11968, 12173-12266, 12455-12466, 12491-12502, 12527-12538, 12563-12568, 12581-12586, 12599-12604, 12617-12622, 12647-12649, or 12656-12658, or fragments or complements thereof. The present disclosure further contemplates that the method may further comprise determining the status of somatic mutation(s) in TP53 in the sample. For example, a method comprising determining the status of methylation of chromosomal loci e.g. Up15-1, Up35-1, Up35-2, Up3, Up27, and Up100 in a sample; and determining the presence or absence of somatic mutation(s) in TP53 in the sample is contemplated.

The present disclosure further contemplates that the method may further comprise determining the status of somatic mutation(s) in TP53 in the sample. For example, a method comprising determining the status of methylation of chromosomal loci e.g., Up15-1, Up35-1, Up35-2, Up3, Up27, and Up10 in a sample; and determining the presence or absence of somatic mutation(s) in TP53 in the sample is contemplated. In certain embodiments, the method optionally further comprises detecting the presence or absence of a somatic mutation in TP53. In certain embodiments, the TP53 somatic mutation, as described herein, is any one or more mutation at any one or more amino acid residue corresponding to amino acid residue 72, 105, 108, 110, 113, 124, 127, 132, 144, 152, 163, 175, 183, 194, 213, 214, 218, 232, 234, 248, 265, 273, 278, 306, 337, 347, or 639 of SEQ ID NO: 16205. In certain embodiments, the TP53 somatic mutation is any non-synonymous somatic mutation known in the art. In certain embodiments, the TP53 somatic mutation is any one or more mutation selected from the group consisting of: Leu194Arg, Gly105Asp, Arg273His, Tyr163His, Ile232Thr, Arg213Ter, Arg273His. Arg248Gln, Arg175His, Arg110delinsGlnSer, Ser183Ter, Arg248Gln, Arg337Leu, Lys132Arg, Leu265ThrfsTer7, Arg306Ter, Cys124TrpfsTer25, Pro72Arg, Val218Glu, His214Leu, Gln144Ter, Phe113Ser, Tyr234His, Ser127Phe, Pro278Ala, Ala347Thr, and Pro152Leu of SEQ ID NO: 16205 In certain embodiments, the TP53 mutation is any one or more non-synonymous somatic mutation at any one or more nucleotide position corresponding to nucleotide position 108, 215, 314, 338, 380, 395, 430, 455, 487, 524, 548, 581, 637, 639, 641, 653, 695, 700, 743, 818, 832, 916, 1010, or 1039 of SEQ ID NO: 16206.

The present disclosure also contemplates methods of selecting an individual to undergo a treatment for Barrett's esophagus, Barrett's esophagus with low grade dysplasia. Barrett's esophagus with high grade dysplasia or for esophageal adenocarcinoma, by obtaining a biological sample from an individual, and determining in the sample the presence of DNA methylation in at least one of any of the sequences disclosed herein. In some embodiments, the sequence is any one or more sequence selected from the group consisting of sequence having at least 80%, 85%, 90%, 91%, 92%, 93%, 94%, 95%, 96%, 97%, 98%, 99% or 100% identity to any of the following sequences: SEQ ID NOs: 1-856, 2569-3424, 5137-5926: 7507-7558, 7663-7714, 7819-7866, 7963-7990, 8047-8074, 8131-8156, 8209-8222, 8251-8264, 8293-8306, 8335-8348, 8405-8409, or 8420-8424, or fragments or complements thereof. In some embodiments, the present disclosure further contemplates that the method may further comprise determining the status of somatic mutation(s) in TP53 in the sample. For example, a method comprising determining the status of methylation of chromosomal loci e.g., Up15-1, Up35-1, Up35-2, Up3, Up27, and Up10 in a sample; and determining the presence or absence of somatic mutation(s) in TP53 in the sample is contemplated.

The present disclosure also contemplates methods of selecting an individual to undergo a treatment for Barrett's esophagus, Barrett's esophagus with low-grade dysplasia, Barrett's esophagus with high grade dysplasia or for esophageal adenocarcinoma, by obtaining a biological sample from an individual, and determining in the sample the presence of DNA methylation in at least one of any of the sequences disclosed herein. In some embodiments, the sequence is any one or more sequence selected from the group consisting of sequence having at least 80%, 85%, 90%, 91%, 92%, 93%, 94%, 95%, 96%, 97%, 98%, 99% or 100% identity to any of the following sequences: SEQ ID NOs: 8447-8818, 9563-9934, 10679-10972, 11561-11662, 11867-11968, 12173-12266, 12455-12466, 12491-12502, 12527-12538, 12563-12568, 12581-12586, 12599-12604, 12617-12622, 12647-12649, or 12656-12658, or fragments or complements thereof. The present disclosure further contemplates that the method may further comprise determining the status of somatic mutation(s) in TP53 in the sample. For example, a method comprising determining the status of methylation of chromosomal loci e.g., Up15-1, Up35-1, Up35-2, Up3, Up27, and Up10 in a sample; and determining the presence or absence of somatic mutation(s) in TP53 in the sample is contemplated. The present disclosure also contemplates methods of selecting an individual to undergo enhanced surveillance for the development of Barrett's esophagus with low grade dysplasia. Barrett's esophagus with high grade dysplasia or of esophageal adenocarcinoma, by obtaining a biological sample from an individual, and determining in the sample the presence of DNA methylation in at least one of any of the sequences disclosed herein. In some embodiments, the sequence is any one or more sequence selected from the group consisting of a sequence having at least 80%, 85%, 90%, 91%, 92%, 93%, 94%, 95%, 96%, 97%, 98%, 99% or 100% identity to any of the following sequences: SEQ ID NOs: 8447-8818, 9563-9934, 10679-10972, 11561-11662, 11867-11968, 12173-12266, 12455-12466, 12491-12502, 12527-12538, 12563-12568, 12581-12586, 12599-12604, 12617-12622, 12647-12649, or 12656-12658, or fragments or complements thereof. The present disclosure further contemplates that the method may further comprise determining the status of somatic mutation(s) in TP53 in the sample. For example, a method comprising determining the status of methylation of chromosomal loci e.g., Up15-1, Up35-1, Up35-2, Up3, Up27, and Up10 in a sample; and determining the presence or absence of somatic mutation(s) in TP53 in the sample is contemplated. The present disclosure also contemplates methods of determining the response of an individual with esophageal cancer to therapy by obtaining a biological sample from an individual with esophageal cancer, and determining the presence of methylation in at least one of any of the sequences disclosed herein. In some embodiments, the sequence is any one or more sequence selected from the group consisting of sequences having at least 80%, 85%, 90%, 91%, 92%, 93%, 94%, 95%, 96%, 97%, 98%, 99% or 100% identity to any of the following sequences: SEQ ID NOs: 1-856, 2569-3424, 5137-5926: 7507-7558, 7663-7714, 7819-7866, 7963-7990, 8047-8074, 8131-8156, 8209-8222, 8251-8264, 8293-8306, 8335-8348, 8405-8409, or 8420-8424, 8447-8818, 9563-9934, 10679-10972; SEQ ID NOs: 11561-11662, 11867-11968, 12173-12266: SEQ ID NOs: 12455-12466, 12491-12502, 12527-12538, 12563-12568, 12581-12586, 12599-12604, 12617-12622, 12647-12649, and 12656-12658, or fragments or complements thereof. In some implementations, an increase in levels of methylation over time is indicative of disease progression and a need for a change in therapy (such as modifying the dosing regime of an exiting therapy, or administering a new therapeutic(s) either alone or in combination with the existing therapy), and an absence of increase in levels of methylation over time or decrease in levels of methylation over time is indicative that a change in therapy is not required. The present disclosure further contemplates that the method may further comprise determining the status of somatic mutation(s) in TP53 in the sample. For example, a method comprising determining the status of methylation of chromosomal loci e.g., Up15-1, Up35-1, Up35-2, Up3, Up27, and Up10 in a sample; and determining the presence or absence of somatic mutation(s) in TP53 in the sample is contemplated.

The present disclosure also contemplates method of distinguishing EAC and/or low/high grade dysplasia from BE by obtaining a biological sample from an individual, and determining in the sample the presence of DNA methylation in at least one of any of the sequences disclosed herein. In some embodiments, the sequence is any one or more sequence selected from the group consisting of sequences having at least 80%, 85%, 90%, 91%, 92%, 93%, 94%, 95%, 96%, 97%, 98%, 99% or 100% identity to any of the following sequences: SEQ ID NOs: 8447-8818, 9563-9934, 10679-10972; SEQ ID NOs: 11561-11662, 11867-11968, 12173-12266, SEQ ID NOs: 12455-12466, 12491-12502, 12527-12538, 12563-12568, 12581-12586, 12599-12604, 12617-12622, 12647-12649, and 12656-12658, or fragments or complements thereof. The present disclosure further contemplates that the method may further comprise determining the status of somatic mutation(s) in TP53 in the sample. For example, a method comprising determining the status of methylation of chromosomal loci e.g., Up15-1, Up35-1, Up35-2, Up3, Up27, and Up10 in a sample; and determining the presence or absence of somatic mutation(s) in TP53 in the sample is contemplated. In certain embodiments, the absence of methylation at Up15-1, Up35-1, Up35-2, Up3, Up27, and Up10; and the absence of a somatic mutation in TP53 may be indicative of non-dysplastic Barret's esophagus. In certain embodiments, the presence of methylation at any one of Up15-1, Up35-1, Up35-2, Up3, Up27, and Up10; or the presence of a somatic mutation in TP53 may be indicative of esophageal adenocarcinoma or of Barrett's with high grade dysplasia.

The present disclosure also contemplates method of distinguishing EAC and/or low/high grade dysplasia from BE by obtaining a biological sample from an individual, and determining in the sample the presence of DNA methylation in at least one of any of the sequences disclosed herein. In some embodiments, the sequence is any one or more sequence selected from the group consisting of sequences having at least 80%, 85%, 90%, 91%, 92%, 93%, 94%, 95%, 96%, 97%, 98%, 99% or 100% identity to any of the following sequences: SEQ ID NOs: 8447-8818, 9563-9934, 10679-10972; SEQ ID NOs: 11561-11662, 11867-11968, 12173-12266, SEQ ID NOs: 12455-12466, 12491-12502, 12527-12538, 12563-12568, 12581-12586, 12599-12604, 12617-12622, 12647-12649, and 12656-12658, or fragments or complements thereof. The present disclosure further contemplates that the method may further comprise determining the status of somatic mutation(s) in TP53 in the sample. For example, a method comprising determining the status of methylation of chromosomal loci e.g., Up15-1, Up35-1, Up35-2, Up3, Up27, and Up10 in a sample; and determining the presence or absence of somatic mutation(s) in TP53 in the sample is contemplated. In certain embodiments, the absence of methylation at Up15-1, Up35-1, Up35-2, Up3, Up27, and Up10; and the absence of a somatic mutation in TP53 may be indicative of non-dysplastic Barret's esophagus. In certain embodiments, the presence of methylation at any one of Up15-1, Up35-1, Up35-2, Up3, Up27, and Up10; or the presence of a somatic mutation in TP53 may be indicative of esophageal adenocarcinoma.

The present disclosure also contemplates a method of monitoring the progression (or regression) of esophageal neoplasias over time. The method involves detecting the methylation status of one or more nucleotide sequences selected from the group consisting of sequences having at least 80%, 85%, 90%, 91%, 92%, 93%, 94%, 95%, 96%, 97%, 98%, 99% or 100% identity to any of the following sequences: SEQ ID NOs: 1-856, 2569-3424, 5137-5926; 7507-7558, 7663-7714, 7819-7866, 7963-7990, 8047-8074, 8131-8156, 8209-8222, 8251-8264, 8293-8306, 8335-8348, 8405-8409, and 8420-8424, 8447-8818, 9563-9934, 10679-10972: SEQ ID NOs: 11561-11662, 11867-11968, 12173-12266; SEQ ID NOs: 12455-12466, 12491-12502, 12527-12538, 12563-12568, 12581-12586, 12599-12604, 12617-12622, 12647-12649, and 12656-12658, or fragments or complements thereof in samples from a subject at a first time and at a later time. In certain embodiments, neoplasia regression may be indicated by the absence of methylation in the nucleotide sequence taken at a later time and the presence of methylation in the nucleotide sequence taken at the first time. In certain embodiments, neoplasia progression may be indicated by the presence of methylation in the nucleotide sequence taken at a later time and the absence of methylation in the nucleotide sequence taken at the first time. The present disclosure further contemplates that the method may further comprise determining the status of somatic mutation(s) in TP53 in the samples. In some embodiments, neoplastic regression may be indicated by the presence of methylated chromosomal loci e.g., methylation of Up15-1, Up35-1, Up35-2, Up3, Up27, and/or Up10 or the presence of a somatic mutation in TP53 in a first sample; and the absence of methylated chromosomal loci e.g., unmethylated Up15-1, Up35-1, Up35-2, Up3, Up27, and Up10, and the absence of somatic mutation(s) in TP53 in a later sample. In some embodiments, neoplastic progression may be indicated by the presence of unmethylated chromosomal loci e.g., unmethylated Up15-1, Up35-1, Up35-2, Up3, Up27, and Up10; and the absence of somatic mutation(s) in TP53 in a first sample; and the presence of methylated chromosomal loci e.g., methylated Up15-1, Up35-1, Up35-2, Up3, Up27, and/or Up10, or the presence of a somatic mutation in TP53 in a later sample.

The present disclosure also provides sequences that will hybridize under highly stringent conditions to the nucleotide sequences of any one or more of SEQ ID NOs: 1-8444 and 8447-16204, or fragments or complements thereof. As discussed above, one of ordinary skill in the art will understand readily that appropriate stringency conditions which promote DNA hybridization can be varied. One of ordinary skill in the art will understand readily that appropriate stringency conditions which promote DNA hybridization can be varied. For example, one could perform the hybridization at 6.0× sodium chloride/sodium citrate (SSC) at about 45° C., followed by a wash of 2.0×SSC at 50° C. For example, the salt concentration in the wash step can be selected from a low stringency of about 2.0×SSC at 50° C. to a high stringency of about 0.2×SSC at 50° C. In addition, the temperature in the wash step can be increased from low stringency conditions at room temperature, about 22° C., to high stringency conditions at about 65° C. Both temperature and salt may be varied, or temperature or salt concentration may be held constant while the other variable is changed. In one embodiment, the disclosure provides nucleic acids which hybridize under low stringency conditions of 6×SSC at room temperature followed by a wash at 2×SSC at room temperature.

In other embodiments, the disclosure also provides the methylated forms of the nucleotide sequences of any one or more of SEQ ID NOs: 1-8444 and 8447-16204, or fragments thereof, wherein the cytosine bases of the CpG islands present in the sequences are methylated. In other words, the nucleotide sequences listed of any one or more of SEQ ID NOs: 1-8444 or 8447-16204 or fragments or complements thereof may be either in the methylated status (e.g., as seen in neoplasias) or in the unmethylated status (e.g., as seen in normal cells). In further embodiments, the nucleotide sequences of the disclosure can be isolated, recombinant, and/or fused with a heterologous nucleotide sequence, or in a DNA library.

In certain embodiments, the present disclosure provides bisulfite-converted nucleotide sequences, for example, bisulfite-converted sequences selected from any of the sequences disclosed herein. In some embodiments, the sequence is selected from the group consisting of sequences having at least 80%, 85%, 90%, 91%, 92%, 93%, 94%, 95%, 96%, 97%, 98%, 99% or 100% identity to any of the following sequences: SEQ ID NOs: 857-2568, 3425-5136, 5927-7506, 7559-7662, 7715-7818, 7867-7962, 7991-8046, 8075-8130, 8157-8208, 8223-8250, 8265-8292, 8307-8334, 8349-8376, 8410-8419, 8425-8434, and/or fragments thereof, and/or the reverse complements thereof. In yet other embodiments, the disclosure provides bisulfite-converted sequences selected from the group consisting of sequences having at least 80%, 85%, 90%, 91%, 92%, 93%, 94%, 95%, 96%, 97%, 98%, 99% or 100% identity to any of the following sequences: SEQ ID NOs: 8819-9562, 9935-10678, 10973-11560; 11663-11866, 11969-12172, 12267-12454; 12467-12490, 12503-12526, 12539-12562, 12569-12580, 12587-12598, 12605-12616, 12623-12634, 12650-12655, and 12659-12664, and/or fragments thereof, and/or the reverse complements thereof. In yet other embodiments, the disclosure provides bisulfite-converted sequences selected from the group consisting of sequences having at least 80%, 85%, 90%, 91%, 92%, 93%, 94%, 95%, 96%, 97%, 98%, 99% or 100% identity to any of the following sequences: SEQ ID NOs: 13145-14092, 14567-15514, 15561-15652; 15733-15892, 15973-16132, 16143-16162; 16169-16180, 16187-16198, and 16201-16204, and/or fragments thereof, and/or the reverse complements thereof.

A fragment/portion of any of the nucleotide sequences disclosed herein may be of any length, so long as the methylation status of that nucleotide sequence may be determined. In some embodiments, the nucleotide sequence is at least 10, 15, 25, 30, 40, 50, 60, 70, 80, 90, 100, 110, 120, 130, 140, 150, 160, 170, 180, 190, 200, 250, 300, 350, 400, 450, 500, 600, 700, 800, 900, 1000, 1200, 1400, 1500, 1700, or 2000 nucleotides in length. In some embodiments, the nucleotide sequence is at least 10-2000, 10-1000, 10-500, 10-200, 10-150, 10-100, 50-2000, 50-1000, 50-500, 50-200, 50-150, 50-100, 80-2000, 80-1000, 80-500, 80-150, 80-100, 100-2000, 100-1000, 100-500, 100-200, or 100-150 nucleotides in length.

Such bisulfite-converted nucleotide sequences can be used for detecting the methylation status, for example, by an MSP reaction or by direct sequencing (e.g., next generation sequencing). These bisulfite-converted sequences are also of use for designing primers for MSP reactions that specifically detect methylated or unmethylated nucleotide sequences following bisulfite conversion. In yet other embodiments, the bisulfite-converted nucleotide sequences of the disclosure also include nucleotide sequences that will hybridize under highly stringent conditions to any nucleotide sequence of any one or more of SEQ ID NOs: 1-8444 and 8447-16204, or fragments or complements thereof.

In further aspects, the application provides methods for producing such bisulfite-converted nucleotide sequences, for example, the application provides methods for treating a nucleotide sequence with a bisulfite agent such that the unmethylated cytosine bases are converted to a different nucleotide base such as a uracil.

In yet other aspects, the application provides oligonucleotide primers for amplifying a region within the nucleic acid sequence of any one or more of SEQ ID NOs: 1-8444 and 8447-16204. In certain aspects, a pair of the oligonucleotide primers can be used in a detection assay, such as the HpaII assay. In certain aspects, primers used in an MSP reaction can specifically distinguish between methylated and non-methylated DNA.

The primers of the disclosure have sufficient length and appropriate sequence so as to provide specific initiation of amplification nucleic acids. Primers of the disclosure are designed to be "substantially" complementary to each strand of the nucleic acid sequence to be amplified. In some embodiments, the primer is selected from the group consisting of sequences having 80%, 85%, 90%, 91%, 92%, 93%, 94%, 95%, 96%, 97%, 98%, 99%, or 100% identity to any of SEQ ID NOs: 8377-8404, 8435-8446, 12635-12646, and 12665-12670. In some embodiments, the primer comprises at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, or 35 consecutive nucleotides of any of the primer sequences of SEQ ID NOs: 8377-8404, 8435-8446, 12635-12646, and 12665-12670. While exemplary primers include the sequences of any sequence having at least 80%, 85%, 90%, 91%, 92%, 93%, 94%, 95%, 96%, 97%, 98%, 99%, or 100% identity to any of SEQ ID NOs: 8377-8404, 8435-8446, 12635-12646, and 12665-12670, or fragments thereof, it is understood that any primers that hybridize with the bisulfite-converted sequence of any one or more of SEQ ID NOs: 1-8444 and 8447-16204 are included within the scope of this disclosure and is useful in the method of the disclosure for detecting methylated nucleic acid, as described. Similarly, it is understood that any primers that would serve to amplify a methylation sensitive restriction site or sites within the differentially methylated region of the informative loci of any of the sequences of SEQ ID NOs: 1-8444 or 8447-16204, or fragments or complements thereof are included within the scope of this disclosure and is useful in the method of the disclosure for detecting nucleic methylated nucleic acid, as described.

The oligonucleotide primers of the disclosure may be prepared by using any suitable method, such as conventional phosphotriester and phosphodiester methods or automated embodiments thereof. In one such automated embodiment, diethylphosphoramidites are used as starting materials and may be synthesized as described by Beaucage, et al. (*Tetrahedron Letters,* 22:1859-1862, 1981). One method of synthesizing oligonucleotides on a modified solid support is described in U.S. Pat. No. 4,458,066.

IV. Assays and Drug Screening Methodologies

In certain aspects, the application provides assays and methods using any of the informative loci, or bisulfite converted methylated or unmethylated sequences thereof, disclosed herein. In some embodiments, the informative loci comprise a sequence having at least 80%, 85%, 90%, 91%, 92%, 93%, 94%, 95%, 96%, 97%, 98%, 99%, or 100% identity to any of the sequences of SEQ ID NOs: 1-428, 2569-2996, 5137-5531, 7507-7532, 7663-7668, 7819-7842, 7963-7976, 8047-8060, 8131-8143, 8209-8222, 8293-8306, 8405-8409, 8447-8632, 9563-9748, 10679-10825, 11561-11611, 11867-11917, 12173-12219, 12455-12460, 12491-12496, 12527-12532, 12563-12568, 12599-12604, 12647-12649, 12671-12908, 14093-14329, 15515-15537, 15653-15692, 15893-15932, 16133-16137, 16163-16165, 16181-16183, 16199, 429-856, 2997-3424, 5532-5926, 7533-7558, 7689-7714, 7843-7866, 7977-7990, 8061-8074, 8144-8156, 8251-8264, 8335-8348, 8420-8424, 8633-8818, 9749-9934, 10826-10972, 11612-11662, 11918-11968, 12220-12266, 12461-12466, 12497-12502, 12533-12538, 12581-12586, 12617-12622, 12656-12658, 12909-13144, 14330-14566, 15538-15560, 15693-15732, 15933-15972, 16138-16142, 16166-16168, 16184-16186 or 16200 or any fragments or complements thereof. In some embodiments, the informative loci are used as molecular markers to distinguish between healthy cells and metaplastic cells (e.g., Barrett's esophageal cells). In some embodiments, the informative loci are used as molecular markers to distinguish between healthy cells and neoplastic cells (e.g., cancer cells). In particular embodiments, the informative loci are used as molecular markers to distinguish between healthy cells and esophageal adenocarcinoma cells. In some embodiments, the informative loci are used as molecular markers to distinguish between Barrett's esophagus cells and cancer cells. In some embodiments, the informative loci are used as molecular markers to distinguish between Barrett's esophagus cells and esophageal adenocarcinoma cells. For example, in one embodiment, the application provides methods and assays using any of the informative loci comprising a sequence having at least 80%, 85%, 90%, 91%, 92%, 93%, 94%, 95%, 96%, 97%, 98%, 99%, or 100% identity to any one or more of SEQ ID NOs: 8447-8818, 9563-9934, 10679-10972, 11561-11662, 11867-11968, 12173-12266, 12455-12466, 12491-12502, 12527-12538, 12563-12568, 12581-12586, 12599-12604, 12617-12622, 12647-12649, OR 12656-12658, or any fragments or complements thereof as markers that distinguish between healthy cells and neoplasia cells. In other embodiments, the application provides methods and assays using the informative loci comprising a sequence having at least 80%, 85%, 90%, 91%, 92%, 93%, 94%, 95%, 96%, 97%, 98%, 99%, or 100% identity to any one or more of SEQ ID NOs: 1-856, 2569-3424, 5137-5926, 7507-7558, 7663-7714, 7819-7866, 7963-7990, 8047-8047, 8131-8156, 8209-8222, 8251-8264, 8293-8306, 8335-8348, 8405-8409, 8420-8424, 8447-8818, 9563-9934, 10679-10972, 11561-11662, 11867-11968, 12173-12266, 12455-

12466, 12491-12502, 12527-12538, 12563-12568, 12581-12586, 12599-12604, 12617-12622, 12647-12649, 12656-12658, 12671-13144, 14093-14566, 15515-15560, 15653-15732, 15893-15972, 16135-16142, 16163-16168, 16181-16186 and/or 16199-16200 or any fragments or complements thereof as markers that distinguish between healthy cells and cells derived from neoplasias of the upper gastrointestinal tract. In one aspect, a molecular marker of the invention is a differentially methylated sequence of an informative locus. In certain aspects, the application provides assays and methods using the informative loci comprising a sequence having at least 80%, 85%, 90%, 91%, 92%, 93%, 94%, 95%, 96%, 97%, 98%, 99%, or 100% identity to any one or more of SEQ ID NOs: 1-856, 2569-3424, 5137-5926, 7507-7558, 7663-7714, 7819-7866, 7963-7990, 8047-8047, 8131-8156, 8209-8222, 8251-8264, 8293-8306, 8335-8348, 8405-8409, 8420-8424, 8447-8818, 9563-9934, 10679-10972, 11561-11662, 11867-11968, 12173-12266, 12455-12466, 12491-12502, 12527-12538, 12563-12568, 12581-12586, 12599-12604, 12617-12622, 12647-12649, 12656-12658, 12671-13144, 14093-14566, 15515-15560, 15653-15732, 15893-15972, 16135-16142, 16163-16168, 16181-16186 and/or 16199-16200 or any fragments or complements thereof in combination with the status of somatic mutation(s) in TP53 as molecular markers that distinguish between healthy cells and cancer cells. For example, in one embodiment, the application provides methods and assays using the informative loci comprising a sequence having at least 80%, 85%, 90%, 91%, 92%, 93%, 94%, 95%, 96%, 97%, 98%, 99%, or 100% identity to any one or more of SEQ ID NOs: 1-856, 2569-3424, 5137-5926, 7507-7558, 7663-7714, 7819-7866, 7963-7990, 8047-8047, 8131-8156, 8209-8222, 8251-8264, 8293-8306, 8335-8348, 8405-8409, 8420-8424, 8447-8818, 9563-9934, 10679-10972, 11561-11662, 11867-11968, 12173-12266, 12455-12466, 12491-12502, 12527-12538, 12563-12568, 12581-12586, 12599-12604, 12617-12622, 12647-12649, 12656-12658, 12671-13144, 14093-14566, 15515-15560, 15653-15732, 15893-15972, 16135-16142, 16163-16168, 16181-16186 and/or 16199-16200 or any fragments or complements thereof and the status of somatic mutation(s) in TP53 as markers that distinguish between healthy cells and neoplasia cells (e.g. cancer/esophageal adenocarcinoma cells). In other embodiments, the application provides methods and assays using the informative loci disclosed herein (e.g., chromosomal loci Up15-1, Up35-1, Up35-2, Up3, Up27, and Up10) and the status of somatic mutation(s) in TP53 as markers that distinguish between healthy cells and cells derived from neoplasias of the upper gastrointestinal tract. In one aspect, a molecular marker of the invention is a differentially methylated sequence of an informative locus.

In certain embodiments, the application provides assays for detecting differentially methylated nucleotide sequences (e.g., vimentin and/or SqBE18). Thus, a differentially methylated nucleotide sequence, in its methylated state, can serve as a target for detection using various methods described herein and the methods that are well within the purview of the skilled artisan in view of the teachings of this application.

In certain aspects, such methods for detecting methylated nucleotide sequences (e.g., vimentin and/or SqBE18) are based on treatment of genomic DNA with a chemical compound which converts non-methylated C, but not methylated C (i.e., 5 mC), to a different nucleotide base. One such compound is sodium bisulfite (also referred to simply as "bisulfite" herein), which converts C, but not 5 mC, to U. Methods for bisulfite treatment of DNA are known in the art (Herman, et al., 1996, *Proc Natl Acad Sci USA*, 93:9821-6; Herman and Baylin, 1998. *Current Protocols in Human Genetics*, N. E. A. Dracopoli, ed., John Wiley & Sons, 2:10.6.1-10.6.10: U.S. Pat. No. 5,786,146). To illustrate, when a DNA molecule that contains unmethylated C nucleotides is treated with sodium bisulfite to become a compound-converted DNA, the sequence of that DNA is changed (C→U). Detection of the U in the converted nucleotide sequence is indicative of an unmethylated C.

The different nucleotide base (e.g., U) present in compound-converted nucleotide sequences can subsequently be detected in a variety of ways. In a particular embodiment, the present invention provides a method of detecting U in compound-converted DNA sequences by using "methylation sensitive PCR" (MSP) (see, e.g., Herman, et al., 1996, *Proc. Natl. Acad. Sci. USA*, 93:9821-9826; U.S. Pat. Nos. 6,265,171; 6,017,704; 6,200,756). In MSP, one set of primers (i.e., comprising a forward and a reverse primer) amplifies the compound-converted template sequence if C bases in CpG dinucleotides within the DNA are methylated. This set of primers is called "methylation-specific primers." Another set of primers amplifies the compound-converted template sequence if C bases in CpG dinucleotides within the 5' flanking sequence are not methylated. This set of primers is called "unmethylation-specific primers."

In MSP, the reactions use the compound-converted DNA from a sample in a subject. In assays for methylated DNA, methylation-specific primers are used. In the case where C within CpG dinucleotides of the target sequence of the DNA are methylated, the methylation-specific primers will amplify the compound-converted template sequence in the presence of a polymerase and an MSP product will be produced. If C within CpG dinucleotides of the target sequence of the DNA is not methylated, the methylation-specific primers will not amplify the compound-converted template sequence in the presence of a polymerase and an MSP product will not be produced. In some embodiments, any of the bisulfite converted methylated sequences disclosed herein is used as a marker for a particular indication.

It is often also useful to run a control reaction for the detection of unmethylated DNA. The reaction uses the compound-converted DNA from a sample in a subject and unmethylation-specific primers are used. In the case where C within CpG dinucleotides of the target sequence of the DNA are unmethylated, the unmethylation specific primers will amplify the compound-converted template sequence in the presence of a polymerase and an MSP product will be produced. If C within CpG dinucleotides of the target sequence of the DNA is methylated, the unmethylation-specific primers will not amplify the compound-converted template sequence in the presence of a polymerase and an MSP product will not be produced. Note that a biologic sample will often contain a mixture of both neoplastic cells that give rise to a signal with methylation specific primers, and normal cellular elements that give rise to a signal with unmethylation-specific primers. The unmethylation specific signal is often of use as a control reaction, but does not in this instance imply the absence of neoplasia as indicated by the positive signal derived from reactions using the methylation specific primers. In some embodiments, any of the bisulfite converted unmethylated sequences disclosed herein are used as controls. In some embodiments, the unmethylated control sequences are any of the bisulfite converted sequences of SEQ ID NOs: 857-1284, 3425-3852, 5927-6321, 7559-7584, 7715-7740, 7867-7890, 7991-8004, 8075-8088, 8157-8169, 8223-8236, 8307-8320, 8410-8414, 8819-9004, 9935-10120, 10973-11119, 11663-11713, 11969-

12019, 12267-12313, 12467-12472, 12503-12508, or 12539-12544, 12569-12574, 12605-12610, 12650-12652, 1713-2140, 4281-4708, 6717-7111, 7611-7636, 7767-7792, 7915-7938, 8019-8032, 8103-8116, 8183-8195, 8265-8278, 8349-8362, 8425-8429, 9191-9376, 10307-10492, 11267-11413, 11765-11815, 12071-12121, 12361-12407, 12479-12484, 12515-12520, 12551-12556, 12587-12592, 12623-12628, or 12659-12661 in which every "Y" position is a "T."

Primers for a MSP reaction are derived from the compound-converted template sequence. Herein, "derived from" means that the sequences of the primers are chosen such that the primers amplify the compound-converted template sequence in a MSP reaction. Each primer comprises a single-stranded DNA fragment which is at least 8 nucleotides in length. In some embodiments, the primers are less than 50 nucleotides in length, or in some embodiments, from 15 to 35 nucleotides in length. Because the compound-converted template sequence can be either the Watson strand or the Crick strand of the double-stranded DNA that is treated with sodium bisulfite, the sequences of the primers is dependent upon whether the Watson or Crick compound-converted template sequence is chosen to be amplified in the MSP. Either the Watson or Crick strand can be chosen to be amplified.

The compound-converted template sequence, and therefore the product of the MSP reaction, is, in some embodiments, between 20 to 3000 nucleotides in length. In other embodiments, the product of the MSP reaction is between 50 to 1000 nucleotides in length. In other embodiments, the product of the MSP reaction is between 50 to 500 nucleotides in length. In other embodiments, the product of the MSP reaction is between 80-150 nucleotides in length. In some embodiments, the product of the MSP reaction is at least 20, 30, 40, 50, 60, 70, 80, 90, 100, 110, 120, 130, 140, 150, 160, 170, 180, 190, 200, 210, 220, 230, 240 or 250 nucleotides in length. In some embodiments, the methylation-specific primers result in an MSP product of a different length than the MSP product produced by the unmethylation-specific primers.

A variety of methods can be used to determine if an MSP product has been produced in a reaction assay. One way to determine if an MSP product has been produced in the reaction is to analyze a portion of the reaction by agarose gel electrophoresis. For example, a horizontal agarose gel of from 0.6 to 2.0% agarose is made and a portion of the MSP reaction mixture is electrophoresed through the agarose gel. After electrophoresis, the agarose gel is stained with ethidium bromide. MSP products are visible when the gel is viewed during illumination with ultraviolet light. By comparison to standardized size markers, it is determined if the MSP product is of the correct expected size.

Other methods can be used to determine whether a product is made in an MSP reaction. One such method is called "real-time PCR." Real-time PCR utilizes a thermal cycler (i.e., an instrument that provides the temperature changes necessary for the PCR reaction to occur) that incorporates a fluorimeter (i.e. an instrument that measures fluorescence). The real-time PCR reaction mixture also contains a reagent whose incorporation into a product can be quantified and whose quantification is indicative of copy number of that sequence in the template. One such reagent is a fluorescent dye, called SYBR Green I (Molecular Probes, Inc.; Eugene, Oregon) that preferentially binds double-stranded DNA and whose fluorescence is greatly enhanced by binding of double-stranded DNA. When a PCR reaction is performed in the presence of SYBR Green I, resulting DNA products bind SYBR Green I and fluorescence. The fluorescence is detected and quantified by the fluorimeter. Such technique is particularly useful for quantification of the amount of the product in the PCR reaction. Additionally, the product from the PCR reaction may be quantitated in "real-time PCR" by the use of a variety of probes that hybridize to the product including TaqMan probes and molecular beacons. Quantitation may be on an absolute basis, or may be relative to a constitutively methylated DNA standard, or may be relative to an unmethylated DNA standard. In one instance the ratio of methylated derived product to unmethylated derived product may be constructed.

Methods for detecting methylation of the DNA according to the present disclosure are not limited to MSP, and may cover any assay for detecting DNA methylation. Another example method of detecting methylation of the DNA is by using "methylation-sensitive" restriction endonucleases. Such methods comprise treating the genomic DNA isolated from a subject with a methylation-sensitive restriction endonuclease and then using the restriction endonuclease-treated DNA as a template in a PCR reaction. Herein, methylation-sensitive restriction endonucleases recognize and cleave a specific sequence within the DNA if C bases within the recognition sequence are not methylated. If C bases within the recognition sequence of the restriction endonuclease are methylated, the DNA will not be cleaved. Examples of such methylation-sensitive restriction endonucleases include, but are not limited to HpaII, SmaI, SacII, EagI, BstUI, and BssHII. In this technique, a recognition sequence for a methylation-sensitive restriction endonuclease is located within the template DNA, at a position between the forward and reverse primers used for the PCR reaction. In the case that a C base within the methylation-sensitive restriction endonuclease recognition sequence is not methylated, the endonuclease will cleave the DNA template and a PCR product will not be formed when the DNA is used as a template in the PCR reaction. In the case that a C base within the methylation-sensitive restriction endonuclease recognition sequence is methylated, the endonuclease will not cleave the DNA template and a PCR product will be formed when the DNA is used as a template in the PCR reaction. Therefore, methylation of C bases can be determined by the absence or presence of a PCR product (Kane, et al., 1997, *Cancer Res.* 57:808-11). No sodium bisulfite is used in this technique.

Yet another exemplary method of detecting methylation of the DNA is called the modified MSP, which method utilizes primers that are designed and chosen such that products of the MSP reaction are susceptible to digestion by restriction endonucleases, depending upon whether the compound-converted template sequence contains CpG dinucleotides or UpG dinucleotides.

Yet other methods for detecting methylation of the DNA include the MS-SnuPE methods. This method uses compound-converted DNA as a template in a primer extension reaction wherein the primers used produce a product, dependent upon whether the compound-converted template contains CpG dinucleotides or UpG dinucleotides (see e.g., Gonzalgo, et al., 1997, *Nucleic Acids Res.*, 25:2529-31).

Another exemplary method of detecting methylation of the DNA is called COBRA (i.e., combined bisulfite restriction analysis). This method has been routinely used for DNA methylation detection and is well known in the art (see, e.g., Xiong, et al., 1997, *Nucleic Acids Res*, 25:2532-4). In this technique, methylation-sensitive restriction endonucleases recognize and cleave a specific sequence within the DNA if C bases within the recognition sequence are methylated. If C bases within the recognition sequence of the restriction endonuclease are not methylated, the DNA will not be cleaved. In some embodiments, the method utilizes methylation-sensitive restriction endonucleases.

Another exemplary method of detecting methylation of DNA requires hybridization of a compound converted DNA to arrays that include probes that hybridize to sequences derived from a methylated template.

Another exemplary method of detecting methylation of DNA includes precipitation of methylated DNA with antibodies that bind methylated DNA or with other proteins that bind methylated DNA, and then detection of DNA sequences in the precipitate. The detection of DNA could be done by PCR based methods, by hybridization to arrays, or by other methods known to those skilled in the art.

Another exemplary method of detecting methylated DNA is bisulfite sequencing that involves amplification of a target region of bisulfite converted DNA using methylation indifferent PCR primers that amplify converted DNAs derived from both methylated and unmethylated templates. The methylation indifferent primers are often designed to be both methylation indifferent and bisulfite specific, i.e. to amplify only bisulfite converted target DNAs and not to amplify non-converted target sequences. In some embodiments, the amplified DNAs then may be characterized by Next Generation Sequencing methods that allow each cytosine base in the original template to be assessed within each DNA sequence read for the presence of methylation (retention of cytosine) or the absence of methylation (conversion to thymidine). The percent of methylation at each cytosine base in the original template can then be calculated by the percent of DNA reads in which the cytosine is preserved as cytosine versus is converted to thymidine. Similarly, the percent of methylation across a region of interest can be assessed by determining a rule for assessing the region as methylated or unmethylated in an individual DNA read (i.e. determining a cutoff for methylation in the region that will categorize the region as "methylated"), and then determining the percent of DNA reads in which the region qualifies as methylated.

In certain embodiments, the disclosure provides methods that involve directly sequencing the product resulting from an MSP reaction to determine if the compound-converted template sequence contains CpG dinucleotides or UpG dinucleotides. Molecular biology techniques such as directly sequencing a PCR product are well known in the art.

In some embodiments, methylation of DNA may be measured as a percentage of total DNA. High levels of methylation may be 1-100% methylation, for example, 1%, 10%, 20%, 30%, 40%, 50%, 60%, 70%, 80%, 90%, or 100% methylation. Low levels of methylation may be 0%-0.99% methylation, for example, 0%, 0.1%, 0.5%, 0.6%, 0.7%, 0.8%, 0.9%. At least some normal tissues, for example, normal esophagus samples, may not have any detectable methylation.

The skilled artisan will appreciate that the present disclosure is based in part, on the recognition that any one of the informative loci disclosed herein may include nucleotide sequences that encode polypeptides that, for example, may function as a tumor suppressor gene. Accordingly, the application further provides methods for detecting such polypeptides in cell samples. In some embodiments, the disclosure provides detection methods by assaying such polypeptides so as to determine whether a patient has or does not have a disease condition. Further, such a disease condition may be characterized by decreased levels of such polypeptides. In certain embodiments, the disclosure provides methods for determining whether a patient is or is not likely to have cancer by detecting such polypeptides. In further embodiments, the disclosure provides methods for determining whether the patient is having a relapse or determining whether a patient's cancer is responding to treatment.

Optionally, such methods involve obtaining a quantitative measure of the protein in the sample. In view of this specification, one of skill in the art will recognize a wide range of techniques that may be employed to detect and optionally quantitate the presence of a protein. In some embodiments, a protein is detected with an antibody. In many embodiments, an antibody-based detection assay involves bringing the sample and the antibody into contact so that the antibody has an opportunity to bind to proteins having the corresponding epitope. In many embodiments, an antibody-based detection assay also typically involves a system for detecting the presence of antibody-epitope complexes, thereby achieving a detection of the presence of the proteins having the corresponding epitope. Antibodies may be used in a variety of detection techniques, including enzyme-linked immunosorbent assays (ELISAs), immunoprecipitations, Western blots. Antibody-independent techniques for identifying a protein may also be employed. For example, mass spectroscopy, particularly coupled with liquid chromatography, permits detection and quantification of large numbers of proteins in a sample. Two-dimensional gel electrophoresis may also be used to identify proteins, and may be coupled with mass spectroscopy or other detection techniques, such as N-terminal protein sequencing. RNA aptamers with specific binding for the protein of interest may also be generated and used as a detection reagent. Samples should generally be prepared in a manner that is consistent with the detection system to be employed. For example, a sample to be used in a protein detection system should generally be prepared in the absence of proteases. Likewise, a sample to be used in a nucleic acid detection system should generally be prepared in the absence of nucleases. In many instances, a sample for use in an antibody-based detection system will not be subjected to substantial preparatory steps. For example, urine may be used directly, as may saliva and blood, although blood will, in certain embodiments, be separated into fractions such as plasma and serum.

In certain embodiments, a method of the disclosure comprises detecting the presence of an informative loci-expressed nucleic acid, such as an mRNA, in a sample. Optionally, the method involves obtaining a quantitative measure of the informative loci-expressed nucleic acid in the sample. In view of this specification, one of skill in the art will recognize a wide range of techniques that may be employed to detect and optionally quantitate the presence of a nucleic acid. Nucleic acid detection systems generally involve preparing a purified nucleic acid fraction of a sample, and subjecting the sample to a direct detection assay or an amplification process followed by a detection assay. Amplification may be achieved, for example, by polymerase chain reaction (PCR), reverse transcriptase (RT) and coupled RT-PCR. Detection of a nucleic acid is generally accomplished by probing the purified nucleic acid fraction with a probe that hybridizes to the nucleic acid of interest, and in many instances, detection involves an amplification as well. Northern blots, dot blots, microarrays, quantitative PCR, and quantitative RT-PCR are all well known methods for detecting a nucleic acid in a sample.

In certain embodiments, the disclosure provides nucleic acid probes that bind specifically to an informative loci nucleic acid. Such probes may be labeled with, for example, a fluorescent moiety, a radionuclide, an enzyme or an affinity tag such as a biotin moiety. For example, the TaqMan® system employs nucleic acid probes that are labeled in such a way that the fluorescent signal is quenched when the probe is free in solution and bright when the probe is incorporated into a larger nucleic acid.

Immunoscintigraphy using monoclonal antibodies directed at the informative loci may be used to detect and/or diagnose a cancer. For example, monoclonal antibodies against the informative loci labeled with $^{99}$Technetium, $^{111}$Indium, $^{125}$Iodine—may be effectively used for such imaging. As will be evident to the skilled artisan, the amount of radioisotope to be administered is dependent upon the radioisotope. Those having ordinary skill in the art can readily formulate the amount of the imaging agent to be administered based upon the specific activity and energy of a given radionuclide used as the active moiety. Typically 0.1-100 millicuries per dose of imaging agent, 1-10 millicuries, or often 2-5 millicuries are administered. Thus, compositions according to the present invention useful as imaging agents comprising a targeting moiety conjugated to a radioactive moiety comprise 0.1-100 millicuries, in some embodiments 1-10 millicuries, in some embodiments 2-5 millicuries, in some embodiments 1-5 millicuries.

A variety of methods can be used to determine if TP53 contains a somatic mutation, as will be evident to the skilled artisan. In some embodiments, the TP53 gene or protein sequence is determined and any change in the determined sequence relative to the wildtype sequence is detected. In some embodiments, the TP53 gene sequence is determined by PCR, RT-PCR, Northern Blot, Southern Blot, and/or in situ hybridization. Another way to determine if TP53 contains a somatic mutation may involve the use of an antibody-based detection assay (e.g. ELISA, immunohistochemistry, and/or Western Blot). In some embodiments, the antibody-based detection assay utilizes an antibody that binds to a mutant TP53 protein with a tighter affinity than it binds to a wildtype TP53 protein. The skilled artisan will also readily appreciate methods of determining somatic mutations in TP53 based on the disclosures of U.S. Pat. Nos. 5,843,654, 5,620,848, EP0390323 and U.S. Pat. No. 5,527,676, all of which are herein incorporated by reference in their entirely.

In some embodiments, the disclosure provides for a device useful for detecting the methylation status of any of the informative loci, or fragments or complements thereof, disclosed herein. In some embodiments, the disclosure provides for a kit comprising components useful for detecting the methylation status of the informative loci, or fragments, or complements thereof, disclosed herein. In some embodiments, the kit comprises a swallowable balloon for collecting an esophageal sample from the subject. In some embodiments, the kit comprises any of the swallowable balloon devices disclosed in WO 2015/089422, which is incorporated herein in its entirety. In some embodiments, the disclosure provides for a kit comprising primers for amplifying any of the informative loci described herein, and instructions for performing any of the methods disclosed herein. In some embodiments, the kit further comprises bisulfite. In some embodiments, the kit further comprises an object suitable for collecting a sample from a subject (e.g., a brush and or balloon). In some embodiments, the disclosure provides for a kit comprising any of the therapeutic agents disclosed herein and instructions for performing any of the therapeutic methods disclosed herein.

In certain embodiments, the present disclosure provides drug screening assays for identifying test compounds which potentiate the tumor suppressor function of polypeptides encoded by sequences located in the informative loci disclosed herein. In one aspect, the assays detect test compounds which potentiate the expression level of polypeptides encoded by sequences located in the informative loci disclosed herein. In another aspect, the assays detect test compounds which inhibit the methylation of DNA. In certain embodiments, drug screening assays can be generated which detect test compounds on the basis of their ability to interfere with stability or function of polypeptides encoded by sequences located in the informative loci disclosed herein.

A variety of assay formats may be used and, in light of the present disclosure, those not expressly described herein will nevertheless be considered to be within the purview of ordinary skill in the art. Assay formats can approximate such conditions as protein expression level, methylation status of nucleotide sequences, tumor suppressing activity, and may be generated in many different forms. In many embodiments, the disclosure provides assays including both cell-free systems and cell-based assays which utilize intact cells.

Compounds to be tested can be produced, for example, by bacteria, yeast or other organisms (e.g., natural products), produced chemically (e.g., small molecules, including peptidomimetics), or produced recombinantly. The efficacy of the compound can be assessed by generating dose response curves from data obtained using various concentrations of the test compound. Moreover, a control assay can also be performed to provide a baseline for comparison. In the control assay, the formation of complexes is quantitated in the absence of the test compound.

In many drug screening programs which test libraries of compounds and natural extracts, high throughput assays are desirable in order to maximize the number of compounds surveyed in a given period of time. Assays of the present invention which are performed in cell-free systems, such as may be developed with purified or semi-purified proteins or with lysates, are often preferred as "primary" screens in that they can be generated to permit rapid development and relatively easy detection of an alteration in a molecular target which is mediated by a test compound. Moreover, the effects of cellular toxicity and/or bioavailability of the test compound can be generally ignored in the in vitro system, the assay instead being focused primarily on the effect of the drug on the molecular target as may be manifest in an alteration of binding affinity with other proteins or changes in enzymatic properties of the molecular target.

In certain embodiments, test compounds identified from these assays may be used in a therapeutic method of treating cancer.

Still another aspect of the application provides transgenic non-human animals which express a gene located within any one of the informative loci disclosed herein, or which have had one or more of such genomic gene(s) disrupted in at least one of the tissue or cell-types of the animal.

In another aspect, the application provides an animal model for cancer, which has a mis-expressed allele of a gene located within any one of the informative loci disclosed herein. Such a mouse model can then be used to study disorders arising from mis-expression of genes located within any one of the informative loci disclosed herein.

Genetic techniques which allow for the expression of transgenes can be regulated via site-specific genetic manipulation in vivo are known to those skilled in the art. For instance, genetic systems are available which allow for the regulated expression of a recombinase that catalyzes the genetic recombination a target sequence. As used herein, the phrase "target sequence" refers to a nucleotide sequence that is genetically recombined by a recombinase. The target sequence is flanked by recombinase recognition sequences and is generally either excised or inverted in cells expressing recombinase activity. Recombinase catalyzed recombination events can be designed such that recombination of the target sequence results in either the activation or repression of expression of the polypeptides. For example, excision of a target sequence which interferes with the expression of a recombinant gene can be designed to activate expression of that gene. This interference with expression of the protein can result from a variety of mechanisms, such as spatial separation of the gene from the promoter element or an internal stop codon. Moreover, the transgene can be made wherein the coding sequence of the gene is flanked recombinase recognition sequences and is initially transfected into cells in a 3' to 5' orientation with respect to the promoter element. In such an instance, inversion of the target sequence will reorient the subject gene by placing the 5' end of the coding sequence in an orientation with respect to the promoter element which allow for promoter driven transcriptional activation.

In an illustrative embodiment, either the cre/loxP recombinase system of bacteriophage P1 (Lakso et al., (1992) *Proc. Natl. Acad. Sci. USA* 89:6232-6236; Orban et al., (1992) *Proc. Natl. Acad. Sci. USA* 89:6861-6865) or the FLP recombinase system of *Saccharomyces cerevisiae* (O'Gorman et al., (1991) *Science* 251:1351-1355; PCT publication WO 92/15694) can be used to generate in vivo site-specific genetic recombination systems. Cre recombinase catalyzes the site-specific recombination of an intervening target sequence located between loxP sequences. loxP sequences are 34 base pair nucleotide repeat sequences to which the Cre recombinase binds and are required for Cre recombinase mediated genetic recombination. The orientation of loxP sequences determines whether the intervening target sequence is excised or inverted when Cre recombinase is present (Abremski et al., (1984) *J. Biol. Chem.* 259:1509-1514); catalyzing the excision of the target sequence when the loxP sequences are oriented as direct repeats and catalyzes inversion of the target sequence when loxP sequences are oriented as inverted repeats.

V. Subjects and Samples

In certain aspects, the invention relates to a subject suspected of having or has: a cancer, a metaplasia, or a neoplasia of the upper gastrointestinal tract (e.g., esophageal cancer). Alternatively, a subject may be undergoing routine screening and may not necessarily be suspected of having such metaplasia or neoplasia. In some embodiments, the subject is a human subject, and the neoplasia is a neoplasia of the upper gastrointestinal tract, such as the esophagus. In some embodiments, the subject is a human subject, and the metaplasia is Barrett's esophagus.

Assaying for biomarkers discussed above in a sample from subjects not known to have, e.g., a metaplasia or neoplasia of the upper or lower gastrointestinal tract can aid in diagnosis of such a metaplasia or neoplasia in the subject. To illustrate, detecting the methylation status of the nucleotide sequences by MSP can be used by itself, or in combination with detecting the somatic mutation status of TP53 or other various assays, to improve the sensitivity and/or specificity for detecting, e.g., a neoplasia of the upper or lower gastrointestinal tract. In some embodiments, such detection is made at an early stage in the development of cancer, so that treatment is more likely to be effective.

In some embodiments, an informative loci in a subject is considered "methylated" for the purposes of determining whether or not the subject is prone to developing and/or has developed a metaplasia in the esophagus (e.g., Barrett's esophagus) or neoplasia (e.g., Barrett's esophagus with dysplasia such as high-grade or low-grade dysplasia) (e.g., esophageal cancer such as esophageal adenocarcinoma) if the loci is at least 10%, 20%, 30%, 40%, 50%, 60%, 70%, 80%, 90%, or 100% methylated. In some embodiments, a DNA sample from a subject is treated with bisulfite, and the resulting bisulfite sequence corresponds to any of the nucleotide sequences disclosed herein comprising a "Y" nucleotide. In some embodiments, if at least 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 of the Y residues of the bisulfite-converted sequence have a C, the sequence is considered "methylated" for the purposes of determining whether or not the subject is prone to developing and/or has developed a metaplasia in the esophagus (e.g., Barrett's esophagus) or neoplasia (e.g., Barrett's esophagus with dysplasia such as high-grade or low-grade dysplasia) (e.g., esophageal cancer such as esophageal adenocarcinoma). In some embodiments, a DNA sample from a subject is treated with bisulfite, and the resulting bisulfite sequence corresponds to any of the nucleotide sequences disclosed herein comprising a "Y" nucleotide. In some embodiments, if at least 10%, 20%, 30%, 40%, 50%, 60%, 70%, 80%, 90%, or 100% of the Y residues of the bisulfite-converted sequence have a C, the sequence is considered "methylated" for the purposes of determining whether or not the subject is prone to developing and/or has developed a metaplasia in the esophagus (e.g., Barrett's esophagus) or neoplasia (e.g., Barrett's esophagus with dysplasia such as high-grade or low-grade dysplasia) (e.g., esophageal cancer such as esophageal adenocarcinoma). In some embodiments, a subject is determined to be prone to developing and/or has developed a metaplasia in the esophagus (e.g., Barrett's esophagus) or neoplasia (e.g., Barrett's esophagus with dysplasia such as high-grade or low-grade dysplasia) (e.g., esophageal cancer such as esophageal adenocarcinoma) if a certain number of "Y" nucleotides in a bisulfite converted sequence are cytosines. In some embodiments, the certain number is at least 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 of the Y residues of the bisulfite-converted sequence. In some embodiments, the certain number is least 10%, 20%, 30%, 40%, 50%, 60%, 70%, 80%, 90%, or 100% of the Y residues of the bisulfite-converted sequence. In certain embodiments, a subject is determined to be prone to developing and/or has developed a metaplasia in the esophagus (e.g., Barrett's esophagus) or neoplasia (e.g., esophageal cancer such as esophageal adenocarcinoma) (e.g., Barrett's esophagus with dysplasia such as high-grade or low-grade dysplasia) if a certain percentage of DNA molecules from a sample from a subject are determined to be "methylated." as defined herein. In some embodiments, the certain percentage of DNA molecules is at least 10%, 20%, 30%, 40%, 50%, 60%, 70%, 80%, 90%, or 100% of the DNA molecules from the sample are determined to be "methylated." In some embodiments, the percentage of methylated DNA molecules is determined using next-generation sequencing. Exemplary cut-offs of DNA methylation and DNA molecule percentages may be found in the Examples section provided herein.

In particular embodiments, a vimentin sequence is considered "methylated" or a "methylated read" if at least 70%, 75%, 80%, 90% or 100% of the CpG cytosines in a vimentin sequence, or portion thereof, are methylated. In some embodiments, if at least 8, 9 or 10 of the "Y" nucleotides in a portion of a vimentin sequence (such as the sequence of SEQ ID NOs: 16207 and/or 16208, or a portion thereof, such as the sequence of SEQ ID NOs: 16209 and/or 16210) have a C, then the vimentin sequence is considered "methylated" or a "read." In some embodiments, the primers used to amplify the portion of the vimentin nucleic acid sequence comprise the nucleotide sequences of SEQ ID NOs: 16209 and/or 16210. In some embodiments, if at least 0.5%, 0.8%, 0.9%, 1%, 2%, 3%, 4%, 5%, 6%, 7%, 8%, or 9% of the vimentin nucleic acid sequences in a sample from a subject are considered methylated or a read, then the subject is determined to have an esophageal metaplasia and/or neoplasia. In particular embodiments, if at least 1% (e.g., at least 1.05%) of the vimentin nucleic acid sequences in a sample from a subject are considered methylated or a read, then the subject is determined to have an esophageal metaplasia and/or neoplasia.

In particular embodiments, a SqBE18 sequence is considered "methylated" or a "methylated read" if at least 65%, 70%, 75%, 80%, 90% or 100% of the CpG cytosines in a SqBE18 sequence (e.g., a nucleotide sequence at least 80%, 85%, 90%, 91%, 92%, 93%, 94%, 95%, 96%, 97%, 98%, 99% or 100% identity to the sequence of SEQ ID NO: 8220, 8262, 8304 or 8346), or a portion thereof, are methylated. In some embodiments, if at least 0.5%, 0.8%, 0.9%, 1%, 2%, 3%, 4%, 5%, 6%, 7%, 8%, or 9% of the SqBE18 nucleic acid sequences in a sample from a subject are considered methylated or a read, then the subject is determined to have an esophageal metaplasia and/or neoplasia. In particular embodiments, if at least 2%, 2.5%, or 3% (e.g., at least 3.11%) of the SqBE18 nucleic acid sequences in a brushing sample from a subject are considered methylated or a read, then the subject is determined to have an esophageal metaplasia and/or neoplasia. In particular embodiments, if at least 1% of the SqBE18 nucleic acid sequences in a balloon sample from a subject are considered methylated or a read, then the subject is determined to have an esophageal metaplasia and/or neoplasia.

In some embodiments, the disclosure provides for a method of diagnosing whether a subject has an esophageal neoplasia or metaplasia, comprising: obtaining a sample from a subject; measuring the amount of methylated cytosines in CpG dinucleotides in a vimentin nucleic acid sequence, or portion thereof, obtained from the sample; wherein if at least 65%, at least 70%, at least 75%, or preferably at least 80% of the cytosines in CpG dinucleotides in the vimentin nucleic acid sequence, or portion thereof, are methylated, than the vimentin nucleic acid sequence, or portion thereof, is considered a read; and measuring the number of reads present in the sample; wherein if at least 1% of the vimentin nucleic acid sequences, or portions thereof, in the sample are reads, than the subject is determined to have an esophageal neoplasia or metaplasia. In some embodiments, the vimentin nucleic acid sequences from the sample are treated with bisulfite. In some embodiments, the sequence of the bisulfite converted nucleic acid sequences is determined by next-generation sequencing. In some embodiments, the level of methylated cytosines is determined in an amplified portion of the bisulfite converted vimentin nucleic acid sequence obtained from the subject. In some embodiments, the amplified portion comprises 10 CpGs. In some embodiments, the primers used to amplify the portion of the vimentin nucleic acid sequence comprise SEQ ID NOs: 16209 and 16210. In some embodiments, the amplified portion comprises the nucleotide sequence of SEQ ID NOs: 16207 and/or 16208, and the region between the amplification primers comprises the nucleotide sequences of SEQ ID Nos: 16209 and/or 162010. In some embodiments, if at least 0.5% to 5% of the vimentin nucleic acid sequences, or portions thereof, in the sample are reads, than the subject is determined to have an esophageal neoplasia or metaplasia. In some embodiments, if at least 0.5% to 3% of the vimentin nucleic acid sequences, or portions thereof, in the sample are reads, than the subject is determined to have an esophageal neoplasia or metaplasia. In some embodiments, if at least 0.5% to 1.5% of the vimentin nucleic acid sequences, or portions thereof, in the sample are reads, than the subject is determined to have an esophageal neoplasia or metaplasia. In some embodiments, if at least 0.95% to 1.16% of the vimentin nucleic acid sequences, or portions thereof, in the sample are reads, than the subject is determined to have an esophageal neoplasia or metaplasia. In some embodiments, if at least 1.02% of the vimentin nucleic acid sequences, or portions thereof, in the sample are reads, than the subject is determined to have an esophageal neoplasia or metaplasia. In some embodiments, if at least 3% of the vimentin nucleic acid sequences, or portions thereof, in the sample are reads, than the subject is determined to have an esophageal neoplasia or metaplasia. In some embodiments, if at least 5% of the vimentin nucleic acid sequences, or portions thereof, in the sample are reads, than the subject is determined to have an esophageal neoplasia or metaplasia. In some embodiments, if the sample is obtained from a brushing, and if at least 0.5% to 1.5% of the vimentin nucleic acid sequences, or portions thereof, in the sample are reads, than the subject is determined to have an esophageal neoplasia or metaplasia. In some embodiments, if the sample is obtained from a brushing, and if at least 1.05% of the vimentin nucleic acid sequences, or portions thereof, in the sample are reads, than the subject is determined to have an esophageal neoplasia or metaplasia. In some embodiments, if the sample is obtained from a balloon, and if at least 0.5% to 1.5% of the vimentin nucleic acid sequences, or portions thereof, in the sample are reads, than the subject is determined to have an esophageal neoplasia or metaplasia. In some embodiments, if the sample is obtained from a balloon, and if at least 0.95% to 1.16% of the vimentin nucleic acid sequences, or portions thereof, in the sample are reads, than the subject is determined to have an esophageal neoplasia or metaplasia. In some embodiments, if the sample is obtained from a balloon, and if at least 1% of the vimentin nucleic acid sequences, or portions thereof, in the sample are reads, than the subject is determined to have an esophageal neoplasia or metaplasia. In some embodiments, if the subject is determined to have an esophageal neoplasia or metaplasia, then the subject may be administered any of cryotherapy, photodynamic therapy (PDT); radiofrequency ablation (RFA); laser ablation; argon plasma coagulation (APC); electrocoagulation (electrofulguration); esophageal stent, surgery, and/or a therapeutic agent.

In some embodiments, the disclosure provides for a method of diagnosing whether a subject has an esophageal neoplasia or metaplasia, comprising: obtaining a sample from a subject; measuring the amount of methylated cytosines in CpG dinucleotides in a SqBE18 nucleic acid sequence, or portion thereof, obtained from the sample; wherein if at least 65%, at least 70%, or at least 75% (e.g., at least 71% or at least 76%) of the cytosines in CpG dinucleotides in the SqBE18 nucleic acid sequence, or portion thereof, are methylated, than the SqBE18 nucleic acid sequence, or portion thereof, is considered a read, and measuring the number of reads present in the sample; wherein if at least 0.5%, at least 1%, at least 2%, or at least 3% (e.g. least 3.11%) of the SqBE18 nucleic acid sequences, or portions thereof, in the sample are reads, than the subject is determined to have an esophageal neoplasia or metaplasia. In some embodiments, the SqBE18 nucleic acid sequences from the sample are treated with bisulfite. In some embodiments, the sequence of the bisulfite converted nucleic acid sequences is determined by next-generation sequencing. In some embodiments, the level of methylated cytosines is determined in an amplified portion of the bisulfite converted SqBE18 nucleic acid sequence obtained from the subject. In some embodiments, if at least 0.5% to 50% of the SqBE18 nucleic acid sequences, or portions thereof, in the sample are reads, than the subject is determined to have an esophageal neoplasia or metaplasia. In some embodiments, if at least 0.5% to 3.5% of the SqBE18 nucleic acid sequences, or portions thereof, in the sample are reads, than the subject is determined to have an esophageal neoplasia or metaplasia. In some embodiments, if at least 1% to 3.11% of the SqBE18 nucleic acid sequences, or portions thereof, in the sample are reads, than the subject is determined to have an esophageal neoplasia or metaplasia. In some embodiments, if at least 0.76% to 1.06% of the SqBE18 nucleic acid sequences, or portions thereof, in the sample are reads, than the subject is determined to have an esophageal neoplasia or metaplasia. In some embodiments, if at least 3.11% of the SqBE18 nucleic acid sequences, or portions thereof, in the sample are reads, than the subject is determined to have an esophageal neoplasia or metaplasia. In some embodiments, if at least 0.1% of the SqBE18 nucleic acid sequences, or portions thereof, in the sample are reads, than the subject is determined to have an esophageal neoplasia or metaplasia. In some embodiments, if at least 1% of the SqBE18 nucleic acid sequences, or portions thereof, in the sample are reads, than the subject is determined to have an esophageal neoplasia or metaplasia. In some embodiments, if the sample is obtained from a brushing, and if at least 2% to 3.11% of the SqBE18 nucleic acid sequences, or portions thereof, in the sample are reads, than the subject is determined to have an esophageal neoplasia or metaplasia. In some embodiments, if the sample is obtained from a brushing, and if at least 3.11% of the SqBE18 nucleic acid sequences, or portions thereof, in the sample are reads, than the subject is determined to have an esophageal neoplasia or metaplasia. In some embodiments, if the sample is obtained from a balloon, and if at least 0.5% to 1.5% of the SqBE18 nucleic acid sequences, or portions thereof, in the sample are reads, than the subject is determined to have an esophageal neoplasia or metaplasia. In some embodiments, if the sample is obtained from a balloon, and if at least 0.76% to 1.06% of the SqBE18 nucleic acid sequences, or portions thereof, in the sample are reads, than the subject is determined to have an esophageal neoplasia or metaplasia. In some embodiments, if the sample is obtained from a balloon, and if at least 1% of the SqBE18 nucleic acid sequences, or portions thereof, in the sample are reads, than the subject is determined to have an esophageal neoplasia or metaplasia. In some embodiments, if the subject is determined to have an esophageal neoplasia or metaplasia, then the subject may be administered any of cryotherapy, photodynamic therapy (PDT); radiofrequency ablation (RFA); laser ablation; argon plasma coagulation (APC); electrocoagulation (electrofulguration); esophageal stent, surgery, and/or a therapeutic agent.

In some embodiments, the disclosure provides for a method of diagnosing whether a subject has an esophageal neoplasia or metaplasia, comprising: obtaining a sample from a subject; measuring the amount of methylated cytosines in CpG dinucleotides in a vimentin nucleic acid sequence and in a SqBE18 nucleic acid sequence, or portions thereof, obtained from the sample; wherein if at least 65%, at least 70%, at least 75%, or preferably at least 80% of the cytosines in CpG dinucleotides in the vimentin nucleic acid sequence, or portion thereof, are methylated, than the vimentin nucleic acid sequence, or portion thereof, is considered a read for VIM (vimentin); wherein if at least 65%, at least 70%, or at least 75% (e.g., at least 71% or at least 76%) of the cytosines in CpG dinucleotides in the SqBE18 nucleic acid sequence, or portion thereof, are methylated, than the SqBE18 nucleic acid sequence, or portion thereof, is considered a read for SqBE18; and measuring the number of VIM and SqBE18 reads present in the sample; wherein if at least 1% of the vimentin nucleic acid sequences, or portions thereof, in the sample are VIM reads and if at least 0.5%, at least 1%° at least 2%, or at least 3% (e.g. least 3.11%) of the SqBE18 nucleic acid sequences, or portions thereof, in the sample are SqBE18 reads, than the subject is determined to have an esophageal neoplasia or metaplasia. In some embodiments, the vimentin or SqBE18 nucleic acid sequences from the sample are treated with bisulfite. In some embodiments, the sequence of the bisulfite converted nucleic acid sequences is determined by next-generation sequencing. In some embodiments, the level of methylated cytosines is determined in an amplified portion of the bisulfite converted vimentin or SqBE18 nucleic acid sequence obtained from the subject. In some embodiments, the amplified vimentin portion comprises 10 CpGs. In some embodiments, the amplified SqBE18 portion comprises 21 CpGs. In some embodiments, the primers used to amplify the portion of the bisulfite converted vimentin nucleic acid sequence comprise SEQ ID NOs: 16209 and 16210. In some embodiments, the amplified portion comprises the nucleotide sequence of SEQ ID NOs: 16207 and/or 16208, and the region between the amplification primers comprises the nucleotide sequences of SEQ ID Nos: 16209 and/or 16210. In some embodiments, the primers used to amplify the portion of the bisulfite converted SqBE18 nucleic acid sequence comprise SEQ ID NOs: 8388 and 8402. In some embodiments, the amplified portion comprises the nucleotide sequence of SEQ ID NOs: 8318 and/or 8360, or fragments and/or reverse complements thereof. In some embodiments, the amplified portion comprises the nucleotide sequences of SEQ ID NOs: 8332 and/or 8374, or fragments and/or reverse complements thereof, which may be generated from fully methylated parental templates. In some embodiments, if at least 0.5% to 5% of the vimentin nucleic acid sequences, or portions thereof, in the sample are VIM reads, and if at least 0.50% to 5% of the SqBE18 nucleic acid sequences, or portions thereof, in the sample are SqBE18 reads, than the subject is determined to have an esophageal neoplasia or metaplasia. In some embodiments, if at least 0.5% to 3% of the vimentin nucleic acid sequences, or portions thereof, in the sample are VIM reads, and if at least 0.5% to 3.5% of the SqBE18 nucleic acid sequences, or portions thereof, in the sample are SqBE18 reads, than the subject is determined to have an esophageal neoplasia or metaplasia. In some embodiments, if at least 0.5% to 1.5% of the vimentin nucleic acid sequences, or portions thereof, in the sample are VIM reads, and if at least 1% to 3.11% of the SqBE18 nucleic acid sequences, or portions thereof, in the sample are SqBE18 reads, than the subject is determined to have an esophageal neoplasia or metaplasia. In some embodiments, if at least 1% of the vimentin nucleic acid sequences, or portions thereof, in the sample are VIM reads, and if at least 1% of the SqBE18 nucleic acid sequences, or portions thereof, in the sample are SqBE18 reads, than the subject is determined to have an esophageal neoplasia or metaplasia. In some embodiments, if at least 1.05% of the vimentin nucleic acid sequences, or portions thereof, in the sample are VIM reads, and if at least 3.11% of the SqBE18 nucleic acid sequences, or portions thereof, in the sample are SqBE18 reads, than the subject is determined to have an esophageal neoplasia or metaplasia. In some embodiments, if the sample is obtained from a brushing, and if at least 0.5% to 1.5% of the vimentin nucleic acid sequences, or portions thereof, in the sample are VIM reads, and if at least 2% to 3.11% of the SqBE18 nucleic acid sequences, or portions thereof, in the sample are SqBE18 reads, than the subject is determined to have an esophageal neoplasia or metaplasia. In some embodiments, if the sample is obtained from a brushing, and if at least 1.05% of the vimentin nucleic acid sequences, or portions thereof, in the sample are VIM reads, and if at least 3.11% of the SqBE18 nucleic acid sequences, or portions thereof, in the sample are SqBE18 reads, than the subject is determined to have an esophageal neoplasia or metaplasia. In some embodiments, if the sample is obtained using a balloon, and if at least 0.5% to 1.5% of the vimentin nucleic acid sequences, or portions thereof, in the sample are VIM reads, and if at least 0.5% to 1.5% of the SqBE18 nucleic acid sequences, or portions thereof, in the sample are SqBE18 reads, than the subject is determined to have an esophageal neoplasia or metaplasia. In some embodiments, if the sample is obtained using a balloon, and if at least 0.95% to 1.16% of the vimentin nucleic acid sequences, or portions thereof, in the sample are reads, and if at least 0.76% to 1.06% of the SqBE18 nucleic acid sequences, or portions thereof, in the sample are SqBE18 reads, than the subject is determined to have an esophageal neoplasia or metaplasia. In some embodiments, if the sample is obtained from a balloon, and if at least 1% of the vimentin nucleic acid sequences, or portions thereof, in the sample are reads, and if at least 1% of the SqBE18 nucleic acid sequences, or portions thereof, in the sample are SqBE18 reads, than the subject is determined to have an esophageal neoplasia or metaplasia. In some embodiments, if the subject is determined to have an esophageal neoplasia or metaplasia, then the subject may be administered any of cryotherapy, photodynamic therapy (PDT); radiofrequency ablation (RFA); laser ablation; argon plasma coagulation (APC); electrocoagulation (electrofulguration); esophageal stent, surgery, and/or a therapeutic agent.

In addition to diagnosis, assaying of a marker in a sample from a subject not known to have, e.g., a metaplasia or neoplasia of the upper gastrointestinal tract, can be prognostic for the subject (i.e., indicating the probable course of the disease). To illustrate, subjects having a predisposition to develop a metaplasia or neoplasia of the upper gastrointestinal tract may possess methylated nucleotide sequences. Assaying of methylated informative loci (e.g., vimentin and/or SqBE18) in a sample from subjects either by itself, or in combination with assaying for somatic mutation(s) in TP53, can also be used to select a particular therapy or therapies which are particularly effective against, e.g., a neoplasia or metaplasia of the upper gastrointestinal tract in the subject, or to exclude therapies that are not likely to be effective.

Assaying of methylated informative loci (e.g., vimentin and/or SqBE18) in samples from subjects that are known to have, or to have had, a cancer is also useful. For example, the present methods can be used to identify whether therapy is effective or not for certain subjects. One or more samples are taken from the same subject prior to and following therapy, and assayed for any one or more of the informative loci markers either by itself or themselves, or in combination with assaying for somatic mutation(s) in TP53. A finding that an informative locus is methylated in the sample taken prior to therapy and absent (or at a lower level) after therapy may indicate that the therapy is effective and need not be altered. In those cases where the informative locus is methylated in the sample taken before therapy and in the sample taken after therapy, it may be desirable to alter the therapy to increase the likelihood that the cancer will be reduced in the subject. Thus, the present method may obviate the need to perform more invasive procedures which are used to determine a patient's response to therapy.

Cancers frequently recur following therapy in patients with advanced cancers. In this and other instances, the assays of the invention are useful for monitoring over time the status of a cancer associated with silencing of genes located in the informative loci disclosed herein. For subjects in whom a cancer is progressing, there can be no DNA methylation in some or all samples when the first sample is taken and then appear in one or more samples when the second sample is taken. For subjects in which cancer is regressing, DNA methylation may be present in one or a number of samples when the first sample is taken and then be absent in some or all of these samples when the second sample is taken.

Samples for use with the methods described herein may be essentially any biological material of interest, e.g., a collection of cells taken from a subject. For example, a sample may be a bodily fluid sample from a subject, a tissue sample from a subject, a solid or semi-solid sample from a subject, a primary cell culture or tissue culture of materials derived from a subject, cells from a cell line, or medium or other extracellular material from a cell or tissue culture, or a xenograft (meaning a sample of a cancer from a first subject, e.g., a human, that has been cultured in a second subject, e.g., an immuno-compromised mouse). The term "sample" as used herein is intended to encompass both a biological material obtained directly from a subject (which may be described as the primary sample) as well as any manipulated forms or portions of a primary sample. A sample may also be obtained by contacting a biological material with an exogenous liquid, resulting in the production of a lavage liquid containing some portion of the contacted biological material. Furthermore, the term "sample" is intended to encompass the primary sample after it has been mixed with one or more additive, such as preservatives, chelators, anti-clotting factors, etc. In some embodiments, a sample is obtained by means of a cytology brushing and/or a balloon. In some embodiments, the sample is obtained from a subject's gastroesophageal junction.

In certain embodiments, a bodily fluid sample is a blood sample. In this case, the term "sample" is intended to encompass not only the blood as obtained directly from the patient but also fractions of the blood, such as plasma, serum, cell fractions (e.g., platelets, erythrocytes, and lymphocytes), protein preparations, nucleic acid preparations, etc. In some embodiments, the bodily fluid may be derived from the stomach, for example, gastric secretions, acid reflux, or vomit. In other embodiments, the bodily fluid may be a fluid secreted by the pancreas or bladder. In other embodiments, the body fluid may be saliva, spit, or an esophageal washing. In certain embodiments, a tissue sample is a biopsy taken from the mucosa of the gastrointestinal tract. In other embodiments, a tissue sample is the brushings from, e.g., the esophagus of a subject.

A subject is in some embodiments a human subject, but it is expected that the molecular markers disclosed herein, and particularly their homologs from other animals, are of similar utility in other animals. In certain embodiments, it may be possible to detect a biomarker described herein (e.g., DNA methylation or protein expression level) directly in an organism without obtaining a separate portion of biological material. In such instances, the term "sample" is intended to encompass that portion of biological material that is contacted with a reagent or device involved in the detection process.

In certain embodiments, DNA which is used as the template is obtained from a bodily fluid sample. Examples of bodily fluids are blood, saliva, spit or an esophageal washing. Other body fluids can also be used. Because they can be easily obtained from a subject and can be used to screen for multiple diseases, blood or blood-derived fractions are especially useful. Blood-derived fractions can comprise blood, serum, plasma, or other fractions. For example, a cellular fraction can be prepared as a "buffy coat" (i.e., leukocyte-enriched blood portion) by centrifuging 5 ml of whole blood for 10 min at 800 times gravity at room temperature. Red blood cells sediment most rapidly and are present as the bottom-most fraction in the centrifuge tube. The buffy coat is present as a thin creamy white colored layer on top of the red blood cells. The plasma portion of the blood forms a layer above the buffy coat. Fractions from blood can also be isolated in a variety of other ways. One method is by taking a fraction or fractions from a gradient used in centrifugation to enrich for a specific size or density of cells.

In some embodiments, DNA is isolated from samples. Procedures for isolation of DNA from such samples are well known to those skilled in the art. Commonly, such DNA isolation procedures comprise lysis of any cells present in the samples using detergents, for example. After cell lysis, proteins are commonly removed from the DNA using various proteases. RNA is removed using RNase. The DNA is then commonly extracted with phenol, precipitated in alcohol and dissolved in an aqueous solution.

VI. Therapeutic Methods

In some embodiments, the disclosure provides for a method of determining whether a subject has any one or more of the methylated informative loci disclosed herein (e.g., vimentin and/or SqBE18) that are indicative of the presence of a metaplasia in the esophagus (e.g., Barrett's esophagus), wherein if the subject is determined to have a metaplasia in the esophagus (e.g., Barrett's esophagus), the subject is treated with an agent that treats the metaplasia in the esophagus (e.g., Barrett's esophagus). In some embodiments, the disclosure provides for a method of treating a subject determined to have a metaplasia in the esophagus (e.g., Barrett's esophagus). In some embodiments, the treatment of a metaplasia in the esophagus (e.g, Barrett's esophagus) encompasses administration of any one or more of the following compounds: proton pump inhibitors (PPIs) such as omeprazole (Prilosec, Zegerid), lansoprazole (Prevacid), pantoprazole (Protonix), rabeprazole (AcipHex), esomeprazole (Nexium), dexlansoprazole (Dexilant). Histamine H2 receptor blocking agents such as cimetidine (Tagamet), ranitidine (Zantac), famotidine (Pepcid) and nizatidine (Axid). Tums, Rolaids, or other quick-acting reflux medications. Prokinetic agents, or drugs that help move food through the gastrointestinal tract more quickly, offer an attractive alternative either alone or in combination with acid inhibition. In some embodiments, the treatment of a metaplasia in the esophagus (e.g., Barrett's esophagus) is endoscopic mucosal resection (EMR); photodynamic therapy (PDT), radiofrequency ablation (RFA); argon plasma coagulation (APC); cryotherapy, and/or surgery (e.g. esophagectomy, anti-reflux surgery).

In some embodiments, the disclosure provides for a method of determining whether a subject has any one or more of the methylated informative loci disclosed herein that are indicative of esophageal neoplasia (e.g., esophageal cancer), wherein if the subject is determined to have an esophageal neoplasia (e.g., esophageal cancer), the subject is treated with an agent that treats the esophageal neoplasia (e.g., esophageal cancer). In some embodiments, the disclosure provides for a method of determining whether a subject has any one or more of the methylated informative loci disclosed herein in combination with any of the TP53 somatic mutations disclosed herein that are indicative of esophageal neoplasia (e.g., esophageal cancer), wherein if the subject is determined to have an esophageal neoplasia (e.g., esophageal cancer), the subject is treated with an agent that treats the esophageal neoplasia (e.g., esophageal cancer). In some embodiments, the disclosure provides for a method of treating a subject determined to have esophageal neoplasia (e.g., esophageal cancer). In some embodiments, the esophageal neoplasia is Barrett's esophagus with low grade dysplasia, Barrett's esophagus with high grade dysplasia (HGD) and/or esophageal adenocarcinoma (EAC). In some embodiments, the treatment of esophageal neoplasia (e.g., esophageal cancer) encompasses surgery (e.g. esophagectomy), radiation therapy, chemoradiation therapy and/or chemotherapy. In some embodiments, the treatment of esophageal neoplasia (e.g., esophageal cancer) encompasses administering one or more chemotherapeutic agent, such as any one or more therapeutic agent selected from the group consisting of: carboplatin and paclitaxel (Taxol®) (which may be combined with radiation); cisplatin and 5-fluorouracil (5-FU) (often combined with radiation): ECF: epirubicine (Ellence®), cisplatin, and 5-FU (especially for gastroesophageal junction tumors); DCF: docetaxel (Taxoteret®), cisplatin, and 5-FU; Cisplatin with capecitabine (Xeloda®); oxaliplatin and either 5-FU or capecitabine: doxorubicin (Adriamycin®), bleomycin, mitomycin, methotrexate, vinorelbine (Navelbine®), topotecan, and irinotecan (Camptosar®). In some embodiments, for some esophagus cancers that overexpress the HER2 protein on the surface of their cells, chemotherapy may be used along with the targeted drug trastuzumab. Ramucirumab may be used to treat cancers that start at the gastroesophageal (GE) junction when they are advanced. In some embodiments, the treatment encompasses endoscopic treatments, such as endoscopic mucosal resection (EMR) followed by treatment with proton pump inhibitors, photodynamic therapy (PDT); radiofrequency ablation (RFA); laser ablation; argon plasma coagulation (APC); electrocoagulation (electrofulguration); or esophageal stent.

The terms "treatment", "treating", "alleviation" and the like are used herein to generally mean obtaining a desired pharmacologic and/or physiologic effect, and may also be used to refer to improving, alleviating, and/or decreasing the severity of one or more symptoms of a condition being treated. The effect may be prophylactic in terms of completely or partially delaying the onset or recurrence of a disease, condition, or symptoms thereof, and/or may be therapeutic in terms of a partial or complete cure for a disease or condition and/or adverse effect attributable to the disease or condition. "Treatment" as used herein covers any treatment of a disease or condition of a mammal, particularly a human, and includes: (a) preventing the disease or condition from occurring in a subject which may be predisposed to the disease or condition but has not yet been diagnosed as having it; (b) inhibiting the disease or condition (e.g., arresting its development); or (c) relieving the disease or condition (e.g., causing regression of the disease or condition, providing improvement in one or more symptoms).

Treating a metaplasia (e.g., Barrett's esophagus) and/or a neoplasia (e.g., esophageal cancer) in a subject refers to improving (improving the subject's condition), alleviating, delaying or slowing progression or onset, decreasing the severity of one or more symptoms associated with a metaplasia (e.g., Barrett's esophagus) and/or a neoplasia (e.g., esophageal cancer). For example, treating a metaplasia or neoplasia includes any one or more of: reducing growth, proliferation and/or survival of metaplastic/neoplastic cells, killing metaplastic/neoplastic cells (e.g., by necrosis, apoptosis or autophagy), decreasing metaplasia/neoplasia size, decreasing rate of metaplasia/neoplasia size increase, halting increase in metaplasia/neoplasia size, improving ability to swallow, decreasing internal bleeding, decreasing incidence of vomiting, reducing fatigue, decreasing the number of metastases, decreasing pain, increasing survival, and increasing progression free survival.

EXEMPLIFICATION

The invention now being generally described, it will be more readily understood by reference to the following examples, which are included merely for purposes of illustration of certain aspects and embodiments of the present invention, and are not intended to limit the invention.

Example 1: Identification of Esophageal Cancer Informative Loci

Methylated informative loci were initially identified using the technique of reduced representation bisulfite sequencing (RRBS) in a discovery set of 23 paired biopsies of normal squamous esophagus and matched esophageal adenocarcinomas, along with biopsies of 8 Barrett's esophagus tissue, and along with brushings of 8 Barrett's esophagus tissues (one BE brushing case also having a matched biopsy).

Discovery data were initially analyzed for each individual CpG residue in the RRBS data set. Individual CpGs were considered methylated in EAC if they showed methylation in less than 10% of DNA sequence reads in all of the informative squamous samples, where at least 4 squamous samples were informative, where an informative sample had equal to or greater than 20 reads covering the CpG, and if 8 or more of the informative EAC samples demonstrated percent methylation at a level that was at least 20 percentage points greater than the methylation level of the most methylated normal squamous sample. CpGs were similarly defined as methylated in Barrett's esophagus if they showed methylation of less than 10% of DNA sequence reads of all informative squamous samples, where an informative sample had equal to or greater than 20 reads covering the CpG, and if 3 or more of the informative BE samples demonstrated percent methylation at a level that was at least 20 percentage points greater than the methylation level of the most methylated normal squamous sample. CpGs meeting criteria for methylation in both EACs and BE were defined as methylated in both EAC and BE. Such methylated CpGs were then aggregated into patches by grouping together methylated CpGs that were within 200 bp of one another. Patches may consist of 1 CpG up to any number of CpGs that meet the above criteria.

The names assigned to 428 genomic patches defined as methylated in both EAC and BE by the criteria above were recorded, and the sequences of these loci correspond to SEQ ID NOs: 1-856. The genomic coordinates of the genomic patches defined as methylated by the above criteria were also recorded. The genomic sequences of these patches on the respective genomic (+) and (−) strands were determined and recorded. (Upper and lower case designations were used according to those of the UCSC browser, where lower case sequences are lower complexity DNA sequences). The bisulfite converted sequences of these corresponding patches (i.e. the bisulfite converted sequence of the (+) strand and the bisulfite converted sequence of the (−) strand) were determined and recorded (see sequences of SEQ ID NOs: 857-1281 and 1713-2140 for the bisulfite converted sequences of the respective (+) and (−) strands). C residues that may be methylated or unmethylated, and hence may be bisulfite converted to T (if unmethylated) or remain as a C (if methylated), were designated with a Y (where Y denotes C or T), and where, after bisulfite conversion, actual maintenance of a Y designated base as a C was scored as methylation at that base. Thus, these sequences represent the group of all combinations of all sequences in which 0, 1, or more than one Y is converted to a T. The reverse complements of the bisulfite converted sequences of the (+) and (−) strands will be obvious to one of ordinary skill in the art and are also included by implication in this disclosure. The bisulfite converted sequences of the fully methylated form of the corresponding patches (i.e. in which all Y bases in every bisulfite converted sequence are retained as a C), corresponding to the (+) strand the (−) strand were determined and recorded (see sequences of SEQ ID NOs: 1285-1712 and 2141-2568 for the bisulfite converted sequences of the fully methylated form of the (+) and (−) strands respectively of the corresponding patches). The reverse complements of the bisulfite converted methylated (+) stand and (−) stand sequences will be obvious to one of ordinary skill in the art and are also included by implication in this disclosure.

Patches were expanded by 100 base pairs on either side so as to accommodate either the design of amplification primers or to enclude additional presumptively methylated bases. The sequences of these expanded patches correspond to SEQ ID NOs: 2569-3424 and their genomic coordinates were also recorded. The genomic sequences of these expanded patches on the respective genomic (+) and (−) strands were determined and recorded. (Upper and lower case designations were used according to those of the UCSC browser, where lower case sequences are lower complexity DNA sequences). The bisulfite converted sequences of these corresponding expanded patches (i.e. the bisulfite converted sequence of the (+) strand and the bisulfite converted sequence of the (−) strand) were determined and recorded (see sequence of SEQ ID NOs: 3425-3852 and 4281-4708 for the bisulfite converted sequences of the respective (+) and (−) strands). C residues that may be methylated or unmethylated, and hence may be bisulfite converted to T (if unmethylated) or remain as a C (if methylated), were designated with a Y (where Y denotes C or T), and where, after bisulfite conversion, actual maintenance of a Y designated base as a C was scored as methylation at that base. Thus, these sequences represent the group of all combinations of all sequences in which 0, 1, or more than one Y is converted to a T. The reverse complements of the bisulfite converted sequences of the (+) and (−) strands will be obvious to one of ordinary skill in the art and are also included by implication in this disclosure. The bisulfite converted sequences of the fully methylated form of the corresponding expanded patches (i.e. in which all Y bases in every bisulfite converted sequence are retained as a C), corresponding to the (+) strand the (−) strand were determined and recorded (see sequences of SEQ ID NOs: 3853-4280 and 4789-5136 for the bisulfite converted sequences of the fully methylated form of the (+) and (−) strands respectively of the corresponding expanded patches). The reverse complements of the bisulfite converted methylated (+) stand and (−) stand sequences will be obvious to one of ordinary skill in the art and are also included by implication in this disclosure.

CpG islands overlapping patches that may contain additional CpGs that are methylated coordinately with patches were also defined. The sequences of these CpG islands correspond to SEQ ID NOs: 5137-5926. The genomic coordinates of the CpG islands were also recorded. The genomic sequences of these expanded patches on the respective genomic (+) and (−) strands were determined and recorded. (Upper and lower case designations were used according to those of the UCSC browser, where lower case sequences are lower complexity DNA sequences). The bisulfite converted sequences of these corresponding CpG islands (i.e. the bisulfite converted sequence of the (+) strand and the bisulfite converted sequence of the (−) strand) were determined and recorded (see sequences of SEQ ID NOs: 5927-6321 and 6717-7111 for the bisulfite converted sequences of the respective (+) and (−) strands). C residues that may be methylated or unmethylated, and hence may be bisulfite converted to T (if unmethylated) or remain as a C (if methylated), were designated with a Y (where Y denotes C or T), and where, after bisulfite conversion, actual maintenance of a Y designated base as a C was scored as methylation at that base. Thus, these sequences represent the group of all combinations of all sequences in which 0, 1, or more than one Y is converted to a T. The reverse complements of the bisulfite converted sequences of the (+) and (−) strands will be obvious to one of ordinary skill in the art and are also included by implication in this disclosure. The bisulfite converted sequences of the fully methylated form of the corresponding CpG islands (i.e. in which all Y bases in every bisulfite converted sequence are retained as a C), corresponding to the (+) strand the (−) strand were determined and recorded (see sequences of SEQ ID NOs: 6322-6716 and 7112-7506 for the bisulfite converted sequences of the fully methylated form of the (+) and (−) strands respectively of the corresponding CpG islands). The reverse complements of the bisulfite converted methylated (+) stand and (−) stand sequences will be obvious to one of ordinary skill in the art and are also included by implication in this disclosure.

Regions of Interest (ROI) were defined that provided preferred regions for design of PCR amplicons that would encompass preferred patches. The genomic coordinates of the ROI were also recorded. The sequences of the (+) strands of the Regions of Interest correspond to SEQ ID NOs: 8209-8222, and the sequences of the (−) strands Regions of Interest correspond to SEQ ID NOs: 8251-8261. (Upper and lower case designations were used according to those of the UCSC browser, where lower case sequences are lower complexity DNA sequences). The bisulfite converted sequences of these corresponding Regions of Interest (i.e. the bisulfite converted sequence of the (+) strand and the bisulfite converted sequence of the (−) strand) were determined and recorded (see sequences of SEQ ID NOs: 8223-8236 and 8265-8278 for the bisulfite converted sequences of the respective (+) and (−) strands). C residues that may be methylated or unmethylated, and hence may be bisulfite converted to T (if unmethylated) or remain as a C (if methylated), were designated with a Y (where Y denotes C or T), and where, after bisulfite conversion, actual maintenance of a Y designated base as a C was scored as methylation at that base. Thus, these sequences represent the group of all combinations of all sequences in which 0, 1, or more than one Y is converted to a T. The reverse complements of the bisulfite converted sequences of the (+) and (−) strands will be obvious to one of ordinary skill in the art and are also included by implication in this disclosure. The bisulfite converted sequences of the fully methylated form of the Regions of Interest (i.e. in which all Y bases in every bisulfite converted sequence are retained as a C), corresponding to the (+) strand the (−) strand were determined and recorded (see sequences of SEQ ID NOs: 8237-8250 and 8279-8292 for the bisulfite converted sequences of the fully methylated form of the (+) and (−) strands respectively of the corresponding Regions of Interest). The reverse complements of the bisulfite converted methylated (+) stand and (−) stand sequences will be obvious to one of ordinary skill in the art and are also included by implication in this disclosure.

Specific PCR Amplicons were defined within the Regions of Interest (ROI). The genomic coordinates of the Amplicons were recorded. The sequences of the (+) strands of the Amplicons correspond to SEQ ID NOs: 8293-8306 and 8405-8409, and the sequences of the (−) strands of the Amplicons correspond to SEQ ID NOs: 8335-8348 and 8420-8424. (Upper and lower case designations were used according to those of the UCSC browser, where lower case sequences are lower complexity DNA sequences). The bisulfite converted sequences of these Amplicons (i.e. the bisulfite converted sequence of the (+) strand and the bisulfite converted sequence of the (−) strand) were determined and recorded (see sequences of SEQ ID NOs: 8307-8320 and 8410-8414 for the bisulfite converted sequences of the (+) strands and see sequences of SEQ ID NOs: 8349-8362 and 8425-8429 and for the bisulfite converted sequences of the (−) strands). C residues that may be methylated or unmethylated, and hence may be bisulfite converted to T (if unmethylated) or remain as a C (if methylated), were designated with a Y (where Y denotes C or T), and where, after bisulfite conversion, actual maintenance of a Y designated base as a C was scored as methylation at that base. Thus, these sequences represent the group of all combinations of all sequences in which 0, 1, or more than one Y is converted to a T. The reverse complements of the bisulfite converted sequences of the (+) and (−) strands will be obvious to one of ordinary skill in the art and are also included by implication in this disclosure. The bisulfite converted sequences of the fully methylated form of the Amplicons (i.e. in which all Y bases in every bisulfite converted sequence are retained as a C), corresponding to the (+) strand the (−) strand were determined and recorded (see sequences of SEQ ID NOs: 8321-8334 and 8415-8419 for the bisulfite converted sequences of the fully methylated form of the (+) strands and see sequences of SEQ ID NOs: 8363-8376 and 8430-8434 for the bisulfite converted sequences of the fully methylated form of the (−) strands). The reverse complements of the bisulfite converted methylated (+) stand and (−) stand sequences will be obvious to one of ordinary skill in the art and are also included by implication in this disclosure. Sequences of PCR primers used in amplification of the Amplicons are provided as SEQ ID NOs: 8377-8404 and 8435-8444.

Confirmatory analysis of candidate loci was then done using bisulfite sequencing of candidate loci that were amplified using bisulfite specific but methylation independent amplification primers. This employed a new sample set of biopsies from: 23 EACs, 8 HGD, 15 non-dysplastic BE from individuals without known higher grade lesions. In addition, biopsies were obtained from 5 cases of BE adjacent to HGD, and from 11 cases of BE adjacent to an EAC. These were not included in analyses of non-dysplastic BE. In addition biopsies were obtained from 33 normal squamous mucosa samples.

Table 1 describes the performance in the confirmatory sample set using bisulfite sequencing analysis of amplicons of select loci having strong performance characteristics and identified in the studies discussed above. In Table 1, columns C-S disclose the performance of the select amplicons. For each DNA sequence read across each amplicon, the number of CpGs that were methylated between the amplification primers was counted, and the read was classified as methylated or unmethyled using cutoffs for a required number of methylated CpGs on the amplicon. Table 1, row 3 lists the number of CpGs between the amplification primers for each of the amplicons. Table 1, row 4 lists the number of CpGs that need to be methylated on an individual read to count that read as methylated (e.g. for SqBE 2 there are 16 CpG residues between the primers, and 14+(meaning >=14) CpGs must be methylated on a read to score it as methylated. Table 1, rows 6, 7, and 8 record the sensitivity for detecting esophageal adenocarcinomas (EACs) (row 6), high grade dysplasias (HGD) (row 7) and non-dysplastic Barrett's esophagus (non-dysplastic BE) (row 8), using criteria in which a sample was detected if it demonstrated methylation in greater than 10% (0.1) of all DNA reads. Table 1, row 9 records the specificity of each amplicon for not detecting normal squamous mucosa again using criteria in which a sample was detected if it demonstrated methylation in greater than 10% (0.1) of all DNA reads. Table 1, row 11 records the specificity of each amplicon for not detecting normal squamous mucosa now using criteria in which a sample was detected if it demonstrated methylation in greater than 1% (0.01) of all DNA reads. As a comparator, Table 1, column B provides the same data for detecting methylation in the Vimentin (VIM) locus amplified using primers disclosed in Li et al. (Li M. et al. (2009) Sensitive digital quantification of DNA methylation in clinical samples. Nat Biotechnol 27(9):858-863). These primers correspond to SEQ ID NOs: 8445-8446. The amplicon amplified using these primers is derived from the parental (−) strand and is as follows:

```
Vimentin amplicon (-) strand (SEQ ID NO: 16208):
GtTGtttAGGtTGTAGGTGYGGGTGGAYGTAGTtAYGTAGtTtYGGtT GGAGtTYGGtYGGtTYGYGGTGttYGGGtYGtYGAAtATttTGYGGTA

GGAGGAYGAG
```

The reverse complement of SEQ ID NO: 16208 is also generated.

The region of this amplicon lying between the amplification primers, in which methylation is analyzed, is as follows:

```
Vimentin amplicon (-) strand (SEQ ID NO: 16212):
GGAYGTAGTtAYGTAGtTtYGGtTGGAGtTYGGtYGGtTYGYGGTGtt YGGGtYGtYGA
```

The reverse complement of SEQ ID NO: 16212 is also generated and analyzed.

For reference, the bisulfite converted sequence that would be derived from amplifying the corresponding bisulfite converted region derived from the Vimentin (+) strand would be.

```
Vimentin amplicon (+) strand (SEQ ID NO: 16207):
tTYGTttTttTAtYGtAGGATGTTYGGYGGttYGGGtAtYGYGAGtYG GtYGAGtTttAGtYGGAGtTAYGTGAtTAYGTttAttYGtAttTAtAG ttTGGGtAGt
```

Along with the reverse complement of SEQ ID NO: 16207. And the corresponding portion of SEQ ID NO: 16211 that falls between the primers used to amplify the Vimentin (−) strand amplicon is:

```
Vimentin amplicon (+) strand (SEQ ID NO: 16211):
TYGGYGGttYGGGtAtYGYGAGtYGGtYGAGtTttAGtYGGAGtTAYG TGAtTAYGTtt
```

Along with reverse complement of SEQ ID NO: 16211.

Amplicons (and patches) need not be used individually, but can be combined into panels for detection of esophageal neoplasia. Examples of such panels, and their associated performance statistics, are provided in Table 1, columns T through AG that provide the markers in the panel and the sensitivity and specificity resulting from the marker combination (when the combination is positive if any member of the combination is positive).

The sensitivity for detection of EAC (100%), HGD (88%), and BE (100%) is the same among the combinations shown of: all amplicons, 17 amplicons, 15 amplicons, 4 amplicons, three of four combinations of 3 amplicons (columns Y, Z, AA), and for one combination of 2 amplicons (column AF). Specificity for not detecting normal squamous (97%), at a detection cutoff of 10% of reads being methylated, is the same for all combinations shown of: 15 amplicons, 4 amplicons, 3 amplicons, or 2 amplicons. When specificity is determined using a cutoff of 1% of reads being methylated, then among amplicons with the highest sensitivity, the highest specificity is 94%, demonstrated by the combination of 3 amplicons of Table 1, column Z, followed by 91% specificity demonstrated by combinations shown of: 4 amplicons, two combinations of three amplicons, and one combination of 2 amplicons.

TABLE 1A

| A | B VIM | C SqBE 2 | D SqBE 5 | E SqBE 7 | F SqBE 9 | G SqBE 10 | H SqBE 11-1 | I SqBE 11-2 | J SqBE 13 | K SqBE 14-2 | L SqBE 15 | M SqBE 16-1 | N SqBE 16-2 | O SqBE 17-1 | P SqBE 18 | Q SqBE 22-1 | R SqBE 22-2 | S SqBE 23 |
|---|---|---|---|---|---|---|---|---|---|---|---|---|---|---|---|---|---|---|
| Number of CpGs in amplicon analysis | 10 | 16 | 15 | 27 | 31 | 10 | 17 | 10 | 19 | 22 | 11 | 26 | 26 | 22 | 21 | 9 | 20 | 10 |
| Number of CpGs used for methylation call Cut-off = 0.1 | 5+ | 14+ | 8+ | 10+ | 16+ | 5+ | 8+ | 5+ | 10+ | 14+ | 5+ | 9+ | 8+ | 12+ | 9+ | 6+ | 11+ | 6+ |
| Sensitivity EAC | 70% | 74% | 100% | 40% | 65% | 96% | 4% | 87% | 38% | 64% | 74% | 52% | 9% | 74% | 91% | 87% | 82% | 59% |
| Sensitivity HGD | 63% | 50% | 100% | 57% | 50% | 75% | 0% | 63% | 33% | 43% | 63% | 50% | 0% | 63% | 63% | 88% | 88% | 43% |
| Sensitivity for non-dysplastic Barrets | 100% | 81% | 70% | 56% | 69% | 88% | 0% | 94% | 21% | 56% | 100% | 44% | 13% | 100% | 81% | 100% | 88% | 63% |
| Specificity Sq Cut-off = 0.01 | 97% | 97% | 100% | 100% | 97% | 97% | 100% | 97% | 97% | 97% | 94% | 97% | 100% | 97% | 97% | 97% | 97% | 97% |
| Specificity Sq | 91% | 94% | 100% | 100% | 94% | 94% | 91% | 91% | 93% | 91% | 91% | 94% | 94% | 94% | 94% | 94% | 94% | 94% |

TABLE 1B

| A | T<br>All amplicon together, including VIM | U<br>All 17 SqBE amplicons:<br>SqBE 2<br>SqBE 5<br>SqBE 7<br>SqBE 9<br>SqBE 10<br>SqBE 11-1<br>SqBE 11-2<br>SqBE 13<br>SqBE 14-2<br>SqBE 15<br>SqBE 16-1<br>SqBE 16-2<br>SqBE 17-1<br>SqBE 18<br>SqBE 22-1<br>SqBE 22-2<br>SqBE 23 | V<br>15 SqBE amplicons:<br>SqBE 5<br>SqBE 7<br>SqBE 9<br>SqBE 10<br>SqBE 11-1<br>SqBE 11-2<br>SqBE 13<br>SqBE 14-2<br>SqBE 16-1<br>SqBE 16-2<br>SqBE 17-1<br>SqBE 18<br>SqBE 22-1<br>SqBE 22-2<br>SqBE 23 | W<br>4 best amplicons with highest EAC calls (SqBE 10 SqBE 11-2 SqBE 18 SqBE 22-1) perform as well as 16 amplicons | X<br>trio1<br>(SqBE 10<br>SqBE 11-2<br>SqBE 18) | Y<br>trio2<br>(SqBE 10<br>SqBE 11-2<br>SqBE 22-1) | Z<br>trio3<br>(SqBE 10<br>SqBE 18<br>SqBE 22-1) | AA<br>trio4<br>(SqBE 11-2<br>SqBE 18<br>SqBE 22-1) | AB<br>double 1<br>(SqBE 10<br>SqBE 11-2) | AC<br>double 2<br>(SqBE 10<br>SqBE 18) | AD<br>double 3<br>(SqBE 11-2<br>SqBE 18) | AE<br>double 4<br>(SqBE 10<br>SqBE 22-1) | AF<br>double 5<br>(SqBE 11-2<br>SqBE 22-1) | AG<br>double 6<br>(SqBE 18<br>SqBE 22-1) |
|---|---|---|---|---|---|---|---|---|---|---|---|---|---|
| Number of CpGs in amplicon analysis | | | | | | | | | | | | | |
| Number of CpGs used for methylation call | | | | | | | | | | | | | |
| Cut-off = 0.1 | | | | | | | | | | | | | |
| Sensitivity EAC | 100% | 100% | 100% | 100% | 100% | 100% | 100% | 100% | 100% | 100% | 100% | 96% | 100% | 96% |
| Sensitivity HGD | 88% | 88% | 88% | 88% | 75% | 88% | 88% | 88% | 75% | 75% | 63% | 88% | 88% | 88% |
| Sensitivity for non-dysplastic Barrets | 100% | 100% | 100% | 100% | 100% | 100% | 100% | 100% | 100% | 94% | 100% | 100% | 100% | 100% |
| Specificity Sq | 91% | 91% | 97% | 97% | 97% | 97% | 97% | 97% | 97% | 97% | 97% | 97% | 97% | 97% |

Confirmatory analysis of candidate loci was further done using bisulfite sequencing of candidate loci that were amplified using the bisulfite specific but methylation independent amplification primers described above. This employed a new sample set of esophageal brushings obtained using a cytology brush under endoscopic guidance that were obtained first from 59 control subjects with or without symptomatic gastroesophageal reflux disease (GERD), but all without Barrett's esophagus (BE). These controls included persons with normal endoscopic findings or with erosive esophagitis. In these controls brushings were obtained from the gastroesophageal junction to sample the glandular mucosa, and brushings were also obtained from squamous esophagus mucosa. Brushing were also obtained from esophageal lesions of 107 cases that included 60 individuals with cancers, either adenocarcinoma of the esophagus (EAC) (N=46) or adenocarcinoma of the gastroesophageal junction (JCA) (N=14), and included 47 individuals with BE. Of BE cases, 12 had non-dysplastic short-segment BE (SSBE, <3 cm), 17 had nondysplastic long segment BE (LSBE 23 cm), 8 had low-grade dysplasia (LGD), and 10 had high-grade dysplasia (HGD).

Table 1.5 Columns B-F disclose the performance of individual amplicons of select loci having strong performance characteristics and identified in the studies discussed above in the esophageal brushings sample set analyzed using bisulfite sequencing performed on a Next Generation DNA sequencing instrument (an Illumina MiSeq instrument). Table 1.5, row 3 lists the number of CpGs between the amplification primers for each of the amplicons. Table 1.5, row 4, provides the coordinates in hg19 of the genomic interval that covers the the CpGs that lie between the primers (and that may include several non CpG bases within the primers). Table 1.5, row 5 lists the number of CpGs lying between the primers that were required to be methylated on an individual DNA read to count that read as methylated (e.g. for VIM there are 10 CpG residues between the primers, and 8+(meaning >=8) CpGs were required to be methylated on a read to score the read as methylated). Table 1.5 row 6 lists the minimum percent of methylated reads (cut-off) identified by bisulfite sequencing that were required in order to score a sample as methylated and thus detected (e.g. for VIM>=0.0102 fraction of total reads were required to be methylated). Table 1.5 rows 7, 8, 9, 10 and 11 record the sensitivity of each amplicon for detecting: esophageal adenocarcinomas (EACs) (row 7), adenocarcinomas of the gastroesophageal junction (JCAs) (row 8), low grade dysplasias (LGD) (row 9), high grade dysplasias (HGD) (row 10), and non-dysplastic Barrett's esophagus (non-dysplastic BE) (row 11), using criteria in which a sample was detected if it demonstrated methylation at greater than the cut-off value of row 5. Table 1.5 row 12 records the specificity of each amplicon for not detecting normal squamous esophagus mucosa (normal Sq) and row 13 records the specificity of each amplicon for not detecting normal gastroesophageal junction (GEJ).

In Table 1.5, column B provides data for detecting methylation in the Vimentin (VIM) locus amplified using primers disclosed in Li et al. (Li M, et al. (2009) Sensitive digital quantification of DNA methylation in clinical samples. Nat Biotechnol 27(9):858-863). These primers are:

```
Forward Primer:
                                         (SEQ ID 16209)
CTCRTCCTCCTACCRCAAAATATTC
``` and

```
Reverse Primer:
                                         (SEQ ID 16210)
GTTGTTTAGGTTGTAGGTGYGGG
```

(In these notations R denotes alternative sequences that may have either an A or G base, and Y denotes alternative sequences that may have either a C or T base).

The amplicon amplified using these primers is derived from the parental (−) strand and is as follows:

```
Vimentin amplicon (-) strand (SEQ ID NO: 16208):
GtTGtttAGGtTGTAGGTGYGGGTGGAYGTAGTtAYGTAGtTtYGGtT GGAGtTYGGtYGGtTYGYGGTGttYGGGtYGtYGAAtATttTGYGGTA

GGAGGAYGAG
```

The reverse complement of SEQ ID NO: 16208 is also generated.

The region of this amplicon lying between the amplification primers, in which methylation is analysed, is as follows:

```
Vimentin amplicon (-) strand (SEQ ID NO: 16212):
GGAYGTAGTtAYGTAGtTtYGGtTGGAGtTYGGtYGGtTYGYGGTGtt YGGGtYGtYGA
```

The reverse complement of SEQ ID NO: 16212 is also generated and analyzed.

For reference, the bisulfite converted sequence that would be derived from amplifying the corresponding bisulfite converted region derived from the Vimentin (+) strand would be.

```
Vimentin amplicon (+) strand (SEQ ID NO: 16207):
tTYGTtttTttTAtYGtAGGATGTTYGGYGGttYGGGtAtYGYGAGtYG GtYGAGtTtttAGtYGGAGtTAYGTGAtTAYGTttAttYGtAttTAtAG ttTGGGtAGt
```

Along with the reverse complement of SEQ ID NO: 16207. And the corresponding portion of SEQ ID NO: 16211 that falls between the primers used to amplify the Vimentin (−) strand amplicon is:

```
Vimentin amplicon (+) strand (SEQ ID NO: 16211):
TYGGYGGttYGGGtAtYGYGAGtYGGtYGAGtTttAGtYGGAGtTAYG TGAtTAYGTtt
```

Along with reverse complement of SEQ ID NO: 16211.

DNA sequencing reads from each sample were aligned to bisulfite converted and unconverted versions of the human reference genome (hg18) using Bowtie2, and the aligned reads were classified as methylated if they had 8 or more CpG dinucleotides methylated (out of total of 10 CpGs present between the primers in the VIM Bisulfite-seq PCR fragment). These analyses were facilitated by the Bismark software, developed for processing bisulfite-sequencing data.

A sample was considered methylated for VIM if the methylated vimentin allele frequency was greater than 1.02%, i.e. if more than 1.02% of the sequence reads were classified as methylated (a cut-off that maximized the sum of sensitivity plus specificity on the receiver operating curve of all the samples studied). Alternative cutoffs in the range of 0.5-3.0% are also possible. The performance of VIM methylation in detecting esophageal lesions is shown in rows 3-12. Overall, at the cutoff of 1.02% methylation, VIM methylation showed sensitivity of 90.7% for identifying BE or esophageal neoplasia and showed specificity for rejecting normal gastroesophageal junction of 93%. When the cutoff for VIM methylation is varied from 0-100%, and sensitivity is plotted versus (100−specificity) (a receiver operating curve), the area under the curve for the VIM assay=0.949.

In this same sample set, we compared assay of VIM methylation by next generation bisulfite sequencing and the analysis algorithm above (in which >=8 methylated CpG is required to score a read as methylated and >1% of methylated reads defines a cutoff of scoring a sample as methylated and detected) versus performing assay of VIM methylation by quantitative methylated specific PCR (qMSP) (as described in Moinova et al. Cancer Epidemiol Biomarkers Prev. 2012; 21(4):594-600.). The bisulfite sequencing method showed superiority with both better sensitivity and better specificity. In particular, area under the receiver operating curve for the qMSP assay=0.925, and at the optimal cutoff of 2.2% VIM methylation measured by qMSP (as defined by the receiver operating curve), assay sensitivity was 82.9% and assay specificity was 91.3%, which are all inferior to the results obtained with the next generation bisulfite sequencing assay and the analysis algorithm laid out in Table 1.5.

Amplicons need not be used individually, but can be combined into panels for detection of esophageal neoplasia. Examples of such panels, and their associated performance statistics, are provided in Table 1.5, columns G through L, that specify the markers in the panel and the sensitivity and specificity resulting from the marker combination (when the combination is scored positive if any member of the combination is positive). In these marker combinations, each individual member of the panel is analysed using the conditions specified for that marker individually in rows 4 and 5 of columns B-F. The marker combination of methylation in amplicons of VIM or of SqBE18 is of particular interest, as the combination of these two markers show detection of 96% of esophageal adenocarcinomas, 93% of carcinomas of the gastroesophageal junction, 100% of high grade dysplasias, 100% of low grade dysplasias, and 94% of non-dysplastic long segment Barrett's esophagus, while preserving a specificity of 91% for normal gastroesophageal junction.

TABLE 1.5

| A | B<br>VIM | C<br>SqBE 5 | D<br>SqBE 16-1 | E<br>SqBE 18 |
|---|---|---|---|---|
| Number of CpGs in amplicon analysis | 10 | 15 | 26 | 21 |
| hg19 Interval covering CpGs in the amplicon analysis | chr10:<br>17271466-17271524 | chr5:<br>1,883,203-1,883,380 | chr11:<br>110,582,495-110,582,696 | chr13:<br>37,005,877-37,006,009 |
| Number of CpGs used for methylation call | 8+ | 13+ | 15+ | 16+ |
| Cut-off = | 0.0105 | 0.0046 | 0.0106 | 0.0312 |
| Sensitivity EAC | 89% | 86% | 80% | 96% |
| Sensitivity JCA | 79% | 57% | 50% | 86% |
| Sensitivity LGD | 88% | 63% | 75% | 86% |
| Sensitivity HGD | 100% | 78% | 80% | 100% |
| Sensitivity for non-dysplastic Barrets | 94% | 89% | 67% | 78% |
| Specificity Normal Sq | 87% | 97% | 93% | 98% |
| Specificity Normal GEJ | 93% | 93% | 97% | 98% |

| A | F<br>VIM +<br>SqBE 5 | F<br>VIM +<br>SqBE 16-1 | F<br>VIM +<br>SqBE 18 | I<br>SqBE +<br>SqBE 16-1 | J<br>SqBE 5 +<br>SqBE 18 | K<br>SqBE 16-1 +<br>SqBE 18 | L<br>SqBE 5 +<br>SqBE 16-1 +<br>SqBE 18 |
|---|---|---|---|---|---|---|---|
| Number of CpGs in amplicon analysis | | | | | | | |
| hg19 Interval covering CpGs in the amplicon analysis | | | | | | | |
| Number of CpGs used for methylation call | | | | | | | |
| Cut-off = | | | | | | | |
| Sensitivity EAC | 96% | 89% | 96% | 90% | 98% | 96% | 98% |
| Sensitivity JCA | 79% | 79% | 93% | 64% | 86% | 93% | 93% |
| Sensitivity LGD | 88% | 88% | 100% | 75% | 86% | 86% | 86% |
| Sensitivity HGD | 100% | 100% | 100% | 89% | 100% | 100% | 100% |
| Sensitivity for non-dysplastic Barrets | 100% | 94% | 94% | 100% | 100% | 78% | 100% |
| Specificity Normal Sq | 83% | 83% | 87% | 93% | 95% | 92% | 92% |
| Specificity Normal GEJ | 86% | 89% | 91% | 92% | 93% | 97% | 90% |

Figure 1D:
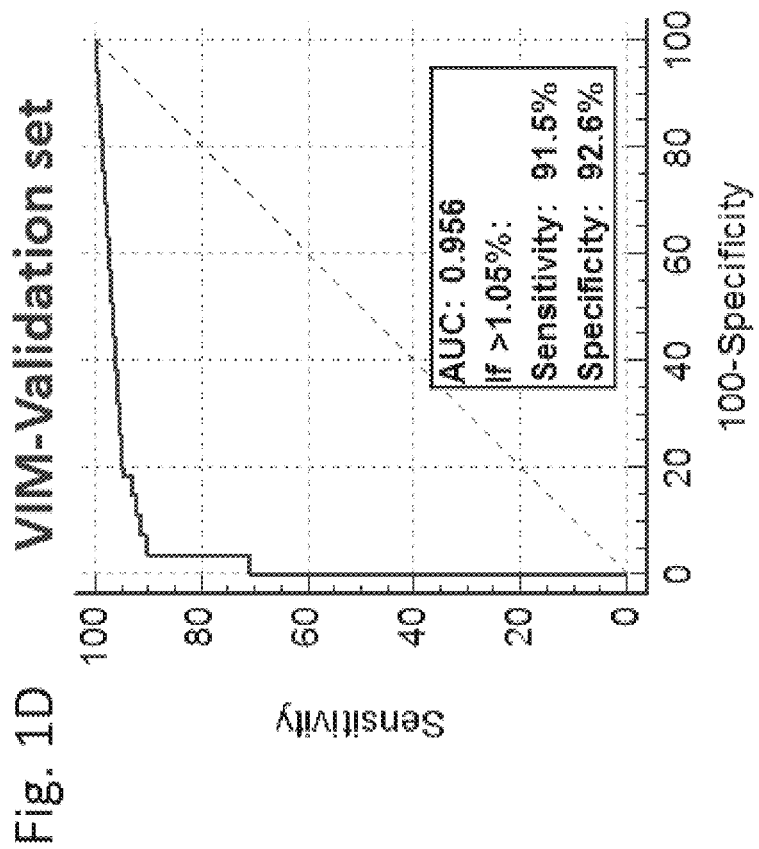
FIG. 1D shows a ROC curve based on Next-Generation Bisulfite Sequencing VIM assay in the validation set of 27 controls and 117 cases. Area under the curve (AUC), and the sensitivity and specificity of the assay at the optimal cutpoint are listed for each of FIGS. 1A-1D. The numbers of cases and controls for each marker in the training and validation set reflect the number of samples that were sequenced with the depth of greater than 80 reads for each marker. (median read depth was 3,809 for SqBE18, and 10,021 for VIM).
Figure 2A:
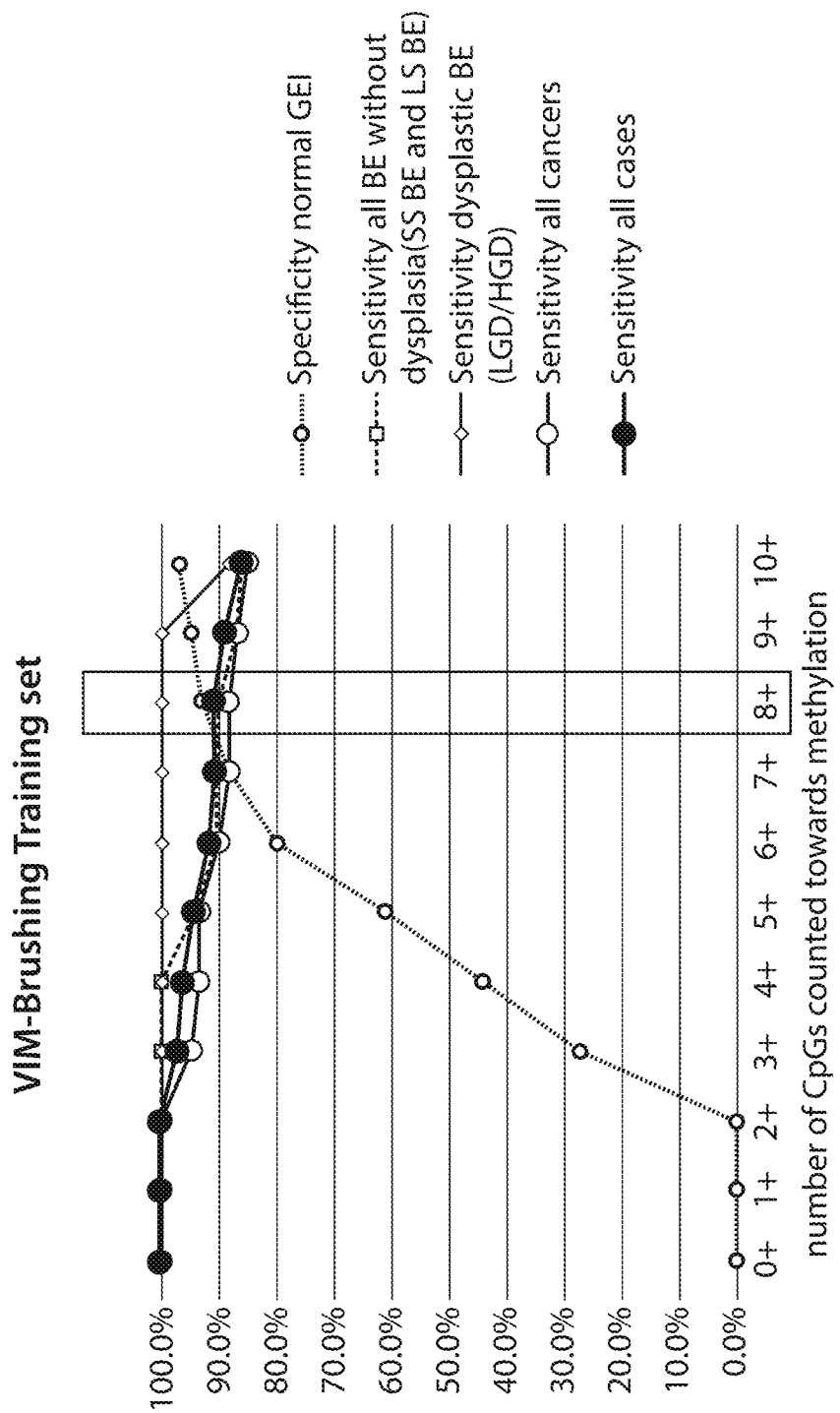
FIGS. 2A and 2B show VIM and SqBE18 performance at different numbers of CpG cutoff for positivity, using the ROC cutoff for percent methylation.

The marker combination of methylation in amplicons of VIM or of SqBE18 was further assessed in esophageal cytology brushings of normal-appearing gastroesophageal junction (GEJ) or of endoscopically visualized BE or EAC. In these experiments, the same vimentin amplicons described above were used and contained 10 CpGs. Vimentin specificity for Normal GEJ samples increases with the requirement that more CpGs in the read should be unmethylated, in order for the sample to be called "unmethylated." Conversely, Vimentin Sensitivity for BE/Cancer decreases with the requirement that more CpGs in the read are required to be called "methylated." The 8+ CpG cutoff (blue box in FIG. 2A), maximizes the sum of specificity for controls and sensitivity for cases. As such, a VIM read was considered methylated if any 8 CpGs out of 10 were methylated. The output for each sample was the fraction of methylated reads in the total number of reads for each sample. These values were then used to generate the Receiver Operating Characteristic (ROC) curve. See FIGS. 1B and 1D that respectively describe training and validation sets of esophageal brushings samples.

Figure 2B:
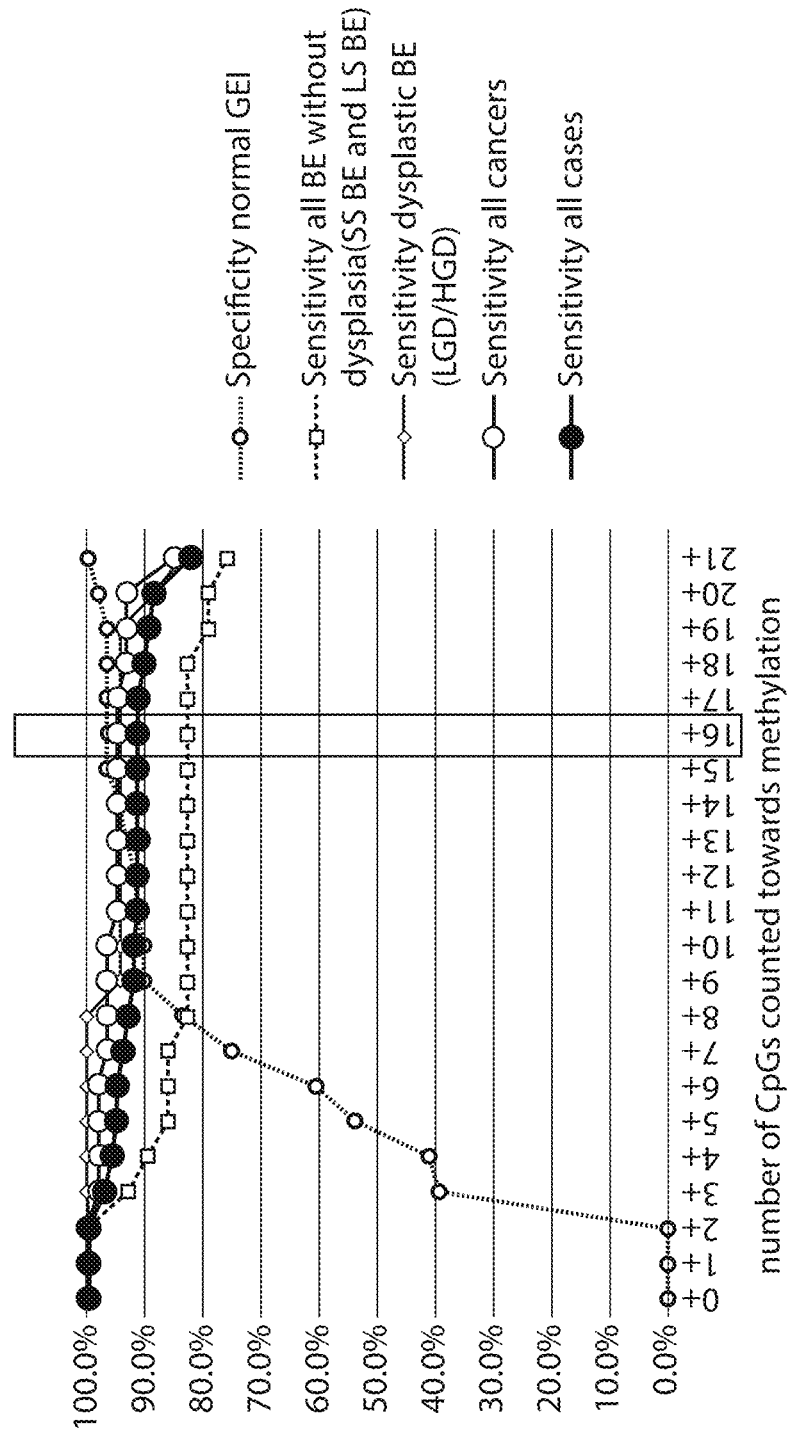

The SqBE18 amplicon used on the same samples described in the paragraph above contained 21 CpGs. These amplicons were generated as described above, and were obtained by amplifying bisulfite converted DNA with PCR primers having the nucleotide sequence of SEQ ID Nos: 8388 and 8402 to derive amplicon sequences having the nucleotide sequence of SEQ ID NO: 8318. SqBE 8 specificity for Normal GEJ samples increases with the requirement that more CpGs in the read should be unmethylated, in order for the sample to be called "unmethylated." Conversely, SqBE18 Sensitivity for BE/Cancer decreases with the requirement that more CpGs in the read are required to be called "methylated." The 15+, 16+, and 17+ CpG cutoffs offer identical maximum sensitivity+specificity sum for SqBE18, 16+ CpGs (blue box of FIG. 2B), was chosen as the middle of this range. As such, a read was considered methylated for the SqBE18 amplicon if any 16 CpGs out of 21 were methylated. The output for each sample was the fraction of methylated reads in the total number of reads for each sample. These values were then used to generate the ROC curve. See FIGS. 1A and 1C.

Due to the patchy nature of methylation, normal samples can contain a few random methylated CpGs, while, conversely, the methylated DNA could contain some unmethylated CpGs. Different CpG islands have different methylation density, and as a result, a cutoff was established for each region that would optimally differentiate methylated and unmethylated DNA. In this study, if greater than 1.05% of VIM reads were methylated, this sample was considered "positive" for VIM methylation, and if greater than 3.11% of SqBE18 reads were methylated, this sample was considered "positive" for VIM methylation.

Vimentin and SqBE18 gene methylation (mVLM and mSqBE18) was assayed in DNA samples from either a training set or a validation set of cytology brushings of the distal esophagus. Both the training and validation sets of brushings of the distal esophagus were from: Unaffected controls (individuals with GERD, erosive esophagitis, or no pathology detected during endoscopy—each brushed at the GE Junction); SSBE (short-segment Barrett's Esophagus (1 to 3 cm)); LSBE (Barrett's Esophagus (3 cm or more); LGD (Barret's Esophagus with Low-Grade Dysplasia); HGD (Barrett's Esophagus with High-Grade Dysplasia); Cancer—includes EAC (Esophageal adenocarcinoma) and JCA (Junctional cancer of the esophagus). In the case of the training sets, samples were scored as methylated when the mVIM methylated allele frequency was measured as >1.05%, and mSqBE 8 methylated allele frequency was measured as >3, 11% by bisulfite sequencing (representing the ROC cutpoints that provide optimal performance for each of these assays, respectively). In the case of the validation sets, samples were scored as methylated when the mVIM methylated allele frequency was measured as >1.05%, and mSqBE18 methylated allele frequency was measured as >3.11% by bisulfite sequencing (representing the ROC cutpoints from the training set of brushings for each of these assays, respectively). For the combination of the two markers, the calculations were performed in two ways:

One-marker fails censored: if either mVIM or mSqBE18 sequencing failed, the sample was excluded from analysis One-marker fails allowed: if one marker failed, the sample was still included in the analysis and scored as positive or negative based on the performance of the one working marker.

The data from the training set analyses are summarized in FIG. 3, and the data from the validation set analyses are summarized in FIG. 4.

All the samples from the training and validation sets of brushings described in the paragraph above were combined and then scored as methylated when the mVIM methylated allele frequency was measured as >1.05%, and mSqBE18 methylated allele frequency was measured as >3.11% by bisulfite sequencing (representing the ROC cutpoints from the training set of brushings for each of these assays, respectively). For the combination of the two markers, the calculations were performed as follows:

Controls—One-marker fails censored: if either mVIM or mSqBE18 sequencing failed, the sample was excluded from analysis. This underscores the specificity of the assay.

Cases—One-marker falls allowed: if one marker failed, the sample was still included in the analysis and scored as positive or negative based on the performance of the one working marker. This underscores the sensitivity of the assay.

For controls: if one marker failed, the sample was censored in order not to overestimate the specificity. For cases: if one marker failed, and the other marker worked, the sample was still counted. The results of these analyses are provided in FIG. 5.

Figure 6A:
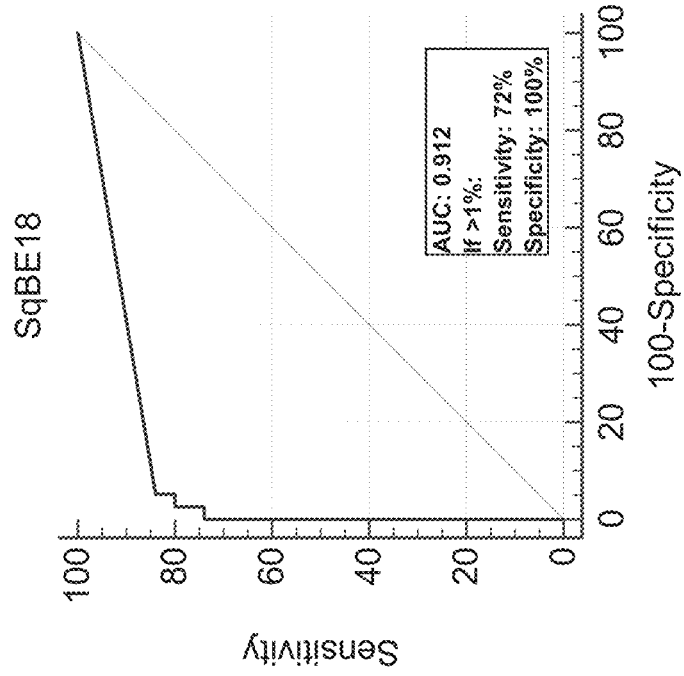
FIGS. 6A and 6B show Receiver Operating Characteristic (ROC) curves of methylated VIM assayed on esophageal balloon samplings of the distal esophagus.

Esophageal balloon samplings of the distal esophagus were assayed for VIM methylation and ROC curves were obtained. FIG. 6A shows a ROC curve based on next-generation bisulfite sequencing assay for VIM in the training set of 38 controls and 50 cases. Similar to the experiments described above, the vimentin amplicon that was used contained 10 CpGs, and a read was considered methylated, if any 8 CpGs out of 10 are methylated (based on the analysis of data in slide 3). The output for each sample was the fraction of methylated reads in the total number of reads for each sample. These values were then used to generate the ROC curve. Optimal ROC cutpoint for mVIM assay on balloons was between 0.95% and 1.16%, and 1% was chosen as a convenient number in the middle of this range. The actual cutoff picked by MedCalc for VIM balloons was 0.95%.

Figure 6B:
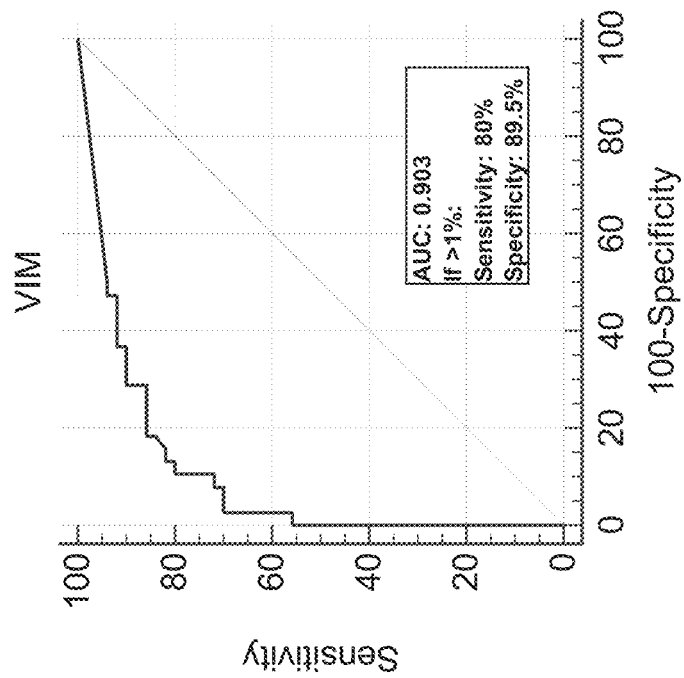

Esophageal balloon samplings of the distal esophagus were also assayed for SqBE18 methylation and ROC curves were obtained. FIG. 6B shows a ROC curve based on next-generation bisulfite sequencing SqBE18 assay in the training set of 38 controls and 50 cases. Similar to the experiments described above, the SqBE18 amplicon that was used contained 21 CpGs, and a read was considered methylated if any 16 CpGs out of 21 were methylated. The output for each sample was the fraction of methylated reads in the total number of reads for each sample. These values were then used to generate the ROC curve. Optimal ROC cutpoint for SqBE18 assay on balloons was between 0.1%, based on maximizing the sum of sensitivity and specificity. However, a higher cutpoint was chosen to maintain higher specificity of the assay. Any cutpoint between 0.76% and 1.06%, would give the same value of sensitivity and specificity. 1% was chosen as the convenient number in the middle of this range. The actual cutoff picked by MedCalc for SqBE18 balloons was 0.1%. However, 1% was chosen as the cutoff to maximize specificity. Any number between 0.76% and 1.06% would have worked the same as 1%. If >0, 1%, then the sensitivity: 84.0%, and the specificity: 94.7%.

Vimentin and SqBE18 gene methylation (mVIM and mSqBE 8) was assayed in esophageal balloon DNA samples of the distal esophagus from: Unaffected controls (individuals with GERD, erosive esophagitis, or no pathology detected during endoscopy; SSBE (short-segment Barrett's Esophagus (1 cm to less than 3 cm)); LSBE (Barrett's Esophagus (3 cm or more); LGD (Barret's Esophagus with Low-Grade Dysplasia); HGD (Barrett's Esophagus with High-Grade Dysplasia); Cancer—includes EAC (Esophageal adenocarcmnoma) and JCA (Junctional cancer of the esophagus). Samples were scored as methylated when die mVIM and SqBE18 methylated allele frequency was measured as >1%, based on balloon ROC curves described in the preceding two paragraphs. The results from these analyses are provided in FIG. 7.

Example 2: Identification of Esophageal Cancer Informative Loci to Detect Progression of Esophageal Neoplasia Discovery data were also analyzed for each individual CpG residue in the RRBS data set to identify loci that could be used to distinguish EAC from BE. Individual CpGs were considered methylated in EAC versus BE if they showed methylation of less than 10% of reads of all informative BE samples, where at least 3 BE samples were informative, and if they showed methylation of less than 10% of reads of all informative normal squamous samples, and where an informative sample had equal to or greater than 20 reads covering the CpG, and if 6 or more of the EAC samples demonstrated percent methylation at a level that was at least 20 percentage points greater than the methylation level of the most methylated BE sample. CpGs meeting criteria for methylation in EAC versus and BE are defined as methylated in EAC vs BE. Such methylated CpGs were then aggregated into patches in instances in which methylated CpGs were within 200 bp one another.

186 genomic patches defined as methylated in EACs versus BE in the discovery set were identified (see SEQ ID NOs: 8447-8818). The genomic coordinates of the genomic patches defined as methylated by the above criteria were also recorded. The genomic sequences of these patches on the respective genomic (+) and (−) strands were determined and recorded. (Upper and lower case designations were used according to those of the UCSC browser, where lower case sequences are lower complexity DNA sequences). The bisulfite converted sequences of these corresponding patches (i.e. the bisulfite converted sequence of the (+) strand and the bisulfite converted sequence of the (−) strand) were determined and recorded (see sequences of SEQ ID NOs: 8819-9004 and 9191-9376 for the bisulfite converted sequences of the respective (+) and (−) strands). C residues that may be methylated or unmethylated, and hence may be bisulfite converted to T (if unmethylated) or remain as a C (if methylated), were designated with a Y (where Y denotes C or T), and where, after bisulfite conversion, actual maintenance of a Y designated base as a C was scored as methylation at that base. Thus, these sequences represent the group of all combinations of all sequences in which 0, 1, or more than one Y is converted to a T. The reverse complements of the bisulfite converted sequences of the (+) and (−) strands will be obvious to one of ordinary skill in the art and are also included by implication in this disclosure. The bisulfite converted sequences of the fully methylated form of the corresponding patches (i.e. in which all Y bases in every bisulfite converted sequence are retained as a C), corresponding to the (+) strand the (−) strand were determined and recorded (see sequences of SEQ ID NOs: 9005-9190 and 9377-9562 for the bisulfite converted sequences of the fully methylated form of the (+) and (−) strands respectively of the corresponding patches). The reverse complements of the bisulfite converted methylated (+) stand and (−) stand sequences will be obvious to one of ordinary skill in the art and are also included by implication in this disclosure.

Patches were expanded by 100 base pairs on either side so as to accommodate either the design of amplification primers or to enclude additional presumptively methylated bases. The sequences of these expanded patches correspond to SEQ ID NOs: 9563-9934 and their genomic coordinates were also recorded. The genomic sequences of these expanded patches on the respective genomic (+) and (−) strands were determined and recorded. (Upper and lower case designations were used according to those of the UCSC browser, where lower case sequences are lower complexity DNA sequences). The bisulfite converted sequences of these corresponding expanded patches (i.e. the bisulfite converted sequence of the (+) strand and the bisulfite converted sequence of the (−) strand) were determined and recorded (see sequences of SEQ ID NOs: 9935-10120 and 10307-10492 for the bisulfite converted sequences of the respective (+) and (−) strands). C residues that may be methylated or unmethylated, and hence may be bisulfite converted to T (if unmethylated) or remain as a C (if methylated), were designated with a Y (where Y denotes C or T), and where, after bisulfite conversion, actual maintenance of a Y designated base as a C was scored as methylation at that base. Thus, these sequences represent the group of all combinations of all sequences in which 0, 1, or more than one Y is converted to a T. The reverse complements of the bisulfite converted sequences of the (+) and (−) strands will be obvious to one of ordinary skill in the art and are also included by implication in this disclosure. The bisulfite converted sequences of the fully methylated form of the corresponding expanded patches (i.e. in which all Y bases in every bisulfite converted sequence are retained as a C), corresponding to the (+) strand the (−) strand were determined and recorded (see sequences of SEQ ID NOs: 10121-10306 and 10493-10678 for the bisulfite converted sequences of the fully methylated form of the (+) and (−) strands respectively of the corresponding expanded patches). The reverse complements of the bisulfite converted methylated (+) stand and (−) stand sequences will be obvious to one of ordinary skill in the art and are also included by implication in this disclosure.

CpG islands overlapping patches that may contain additional CpGs that are methylated coordinately with patches were also defined. The sequences of these CpG islands correspond to SEQ ID NOs: 10679-10972. The genomic coordinates of the CpG islands were also recorded. The genomic sequences of these expanded patches on the respective genomic (+) and (−) strands were determined and recorded. (Upper and lower case designations were used according to those of the UCSC browser, where lower case sequences are lower complexity DNA sequences). The bisulfite converted sequences of these corresponding CpG islands (i.e. the bisulfite converted sequence of the (+) strand and the bisulfite converted sequence of the (−) strand) were determined and recorded (see sequences of SEQ ID NOs: 10973-11119 and 11267-11413 for the bisulfite converted sequences of the respective (+) and (−) strands). C residues that may be methylated or unmethylated, and hence may be bisulfite converted to T (if unmethylated) or remain as a C (if methylated), were designated with a Y (where Y denotes C or T), and where, after bisulfite conversion, actual maintenance of a Y designated base as a C was scored as methylation at that base. Thus, these sequences represent the group of all combinations of all sequences in which 0, 1, or more than one Y is converted to a T. The reverse complements of the bisulfite converted sequences of the (+) and (−) strands will be obvious to one of ordinary skill in the art and are also included by implication in this disclosure. The bisulfite converted sequences of the fully methylated form of the corresponding CpG islands (i.e. in which all Y bases in every bisulfite converted sequence are retained as a C), corresponding to the (+) strand the (−) strand were determined and recorded (see sequences of SEQ ID NOs: 11120-11266 and 11414-11266 for the bisulfite converted sequences of the fully methylated form of the (+) and (−) strands respectively of the corresponding CpG islands). The reverse complements of the bisulfite converted methylated (+) stand and (−) stand sequences will be obvious to one of ordinary skill in the art and are also included by implication in this disclosure.

Regions of Interest (ROI) were defined that provided preferred regions for design of PCR amplicons that would encompass preferred patches. The genomic coordinates of the ROI were also recorded. The sequences of the (+) strands of the Regions of Interest correspond to SEQ ID NOs: 12563-12568, and the sequences of the (−) strands Regions of Interest correspond to SEQ ID NOs: 12581-12586. (Upper and lower case designations were used according to those of the UCSC browser, where lower case sequences are lower complexity DNA sequences). The bisulfite converted sequences of these corresponding Regions of Interest (i.e. the bisulfite converted sequence of the (+) strand and the bisulfite converted sequence of the (−) strand) were determined and recorded (see sequences of SEQ ID NOs: 12569-12574 and 12587-12592 for the bisulfite converted sequences of the respective (+) and (−) strands). C residues that may be methylated or unmethylated, and hence may be bisulfite converted to T (if unmethylated) or remain as a C (if methylated), were designated with a Y (where Y denotes C or T), and where, after bisulfite conversion, actual maintenance of a Y designated base as a C was scored as methylation at that base. Thus, these sequences represent the group of all combinations of all sequences in which 0, 1, or more than one Y is converted to a T. The reverse complements of the bisulfite converted sequences of the (+) and (−) strands will be obvious to one of ordinary skill in the art and are also included by implication in this disclosure. The bisulfite converted sequences of the fully methylated form of the Regions of Interest (i.e. in which all Y bases in every bisulfite converted sequence are retained as a C), corresponding to the (+) strand the (−) strand were determined and recorded (see sequences of SEQ ID NOs: 12575-12580 and 12593-12598 for the bisulfite converted sequences of the fully methylated form of the (+) and (−) strands respectively of the corresponding Regions of Interest). The reverse complements of the bisulfite converted methylated (+) stand and (−) stand sequences will be obvious to one of ordinary skill in the art and are also included by implication in this disclosure.

Specific PCR Amplicons were defined within the Regions of Interest (ROI). The genomic coordinates of the Amplicons were recorded. The sequences of the (+) strands of the Amplicons correspond to SEQ ID NOs: 12599-12604 and 12647-12649, and the sequences of the (−) strands of the Amplicons correspond to SEQ ID NOs: 12617-12622 and 12656-12658. (Upper and lower case designations were used according to those of the UCSC browser, where lower case sequences are lower complexity DNA sequences). The bisulfite converted sequences of these Amplicons (i.e. the bisulfite converted sequence of the (+) strand and the bisulfite converted sequence of the (−) strand) were determined and recorded (see sequences of SEQ ID NOs: 12605-12610 and 12650-12652 for the bisulfite converted sequences of the (+) strands and see sequences of SEQ ID NOs: 12623-12628 and 12659-12661 and for the bisulfite converted sequences of the (−) strands). C residues that may be methylated or unmethylated, and hence may be bisulfite converted to T (if unmethylated) or remain as a C (if methylated), were designated with a Y (where Y denotes C or T), and where, after bisulfite conversion, actual maintenance of a Y designated base as a C was scored as methylation at that base. Thus, these sequences represent the group of all combinations of all sequences in which 0, 1, or more than one Y is converted to a T. The reverse complements of the bisulfite converted sequences of the (+) and (−) strands will be obvious to one of ordinary skill in the art and are also included by implication in this disclosure. The bisulfite converted sequences of the fully methylated form of the Amplicons (i.e. in which all Y bases in every bisulfite converted sequence are retained as a C), corresponding to the (+) strand the (−) strand were determined and recorded (see sequences of SEQ ID NOs: 12611-12616 and 12653-12655 for the bisulfite converted sequences of the fully methylated form of the (+) strands and see sequences of SEQ ID NOs: 12629-12634 and 12662-12664 for the bisulfite converted sequences of the fully methylated form of the (−) strands). The reverse complements of the bisulfite converted methylated (+) stand and (−) stand sequences will be obvious to one of ordinary skill in the art and are also included by implication in this disclosure. Sequences of PCR primers used in amplification of the Amplicons are provided as SEQ ID NOs: 12635-12646 and 12665-12670.

Confirmatory analysis of candidate loci was then done using bisulfite sequencing of candidate loci that were amplified using bisulfite specific but methylation independent amplification primers. This employed a new sample set of biopsies from: 23 EACs, 8 HGD, 15 non-dysplastic BE from individuals without known higher grade lesions. In addition, biopsies were obtained from 5 cases of BE adjacent to HGD, and from 11 cases of BE adjacent to an EAC. These are not included in analyses of non-dysplastic BE. In addition biopsies were obtained from 33 normal squamous mucosa samples.

Table 2 describes the performance in the confirmatory sample set using bisulfite sequencing analysis of amplicons from select loci defined as methylated in EACs versus BE and having preferred marker characteristics. In Table 2, Columns B-J disclose the performance of the amplicons in the confirmatory data set. In this data set, methylation was calculated as the average level of methylation of all CpGs in between the primers for amplifying the amplicon. For each read across each amplicon the number of CpGs that were methylated was counted and the read was classified as methylated or unmethylated using cutoffs for a required number of methylated CpGs on the amplicon. Table 2, row 3 lists the number of CpGs between the amplification primers for each of the amplicons. Table 2, row 4 lists the number of CpGs that need to be methylated on an individual read to count that read as methylated (e.g. for Up3 there are 36 CpG residues between the primers, and 25+(meaning >=25) CpGs must be methylated on a read to score it as methylated). Table 2, rows 6 and 7 record the sensitivity for detecting EACs (row 6) and HGD (row 7) using criteria in which a sample was detected if it demonstrated methylation in greater than 10% (0.1) of all DNA reads. Table 2, rows 8 and 9 record the specificity of each amplicon for not detecting non-dysplastic BE (row 8) and for not detecting normal squamous mucosa (row 9) again using criteria in which a sample was detected if it demonstrated methylation in greater than 10% (0.1) of all DNA reads. Table 2, rows 11 and 12 record the specificity of each amplicon for not detecting non-dysplastic BE (row 11) and for not detecting normal squamous mucosa (row 12) using criteria in which a sample was detected if it demonstrated methylation in greater than 1% (0.01) of all DNA reads. Amplicons (and patches) need not be used individually, but can be combined into panels for detection of esophageal neoplasia. Performance statistics of selected panels of amplicons are provided in Table 2 columns K through V that provides the sensitivity and specificity of the panels (when the combination is positive if any member of the combination is positive).

TABLE 2A

| A | B<br>Up3 | C<br>Up10 | D<br>Up15_ampl1 | E<br>Up15_ampl2 | F<br>Up20_ampl2 | G<br>Up20_ampl2 | H<br>Up27 | I<br>Up35_ampl1 | J<br>Up35_ampl2 |
|---|---|---|---|---|---|---|---|---|---|
| Number of CpGs in amplicon analysis | 36 | 30 | 25 | 26 | 21 | 16 | 21 | 26 | 18 |
| Number of CpGs used for methylation call | 25+ | 17+ | 15+ | 15+ | 11+ | 6+ | 11+ | 14+ | 10+ |
| Cut-off = 0.1 | | | | | | | | | |
| Sensitivity EAC | 15% | 40% | 22% | 26% | 37% | 0% | 20% | 45% | 30% |
| Sensitivity HGD | 0% | 25% | 13% | 0% | 33% | 0% | 17% | 17% | 25% |
| Specificity for non-dysplastic BE | 100% | 100% | 100% | 94% | 100% | 100% | 100% | 100% | 100% |
| Specificity Sq | 100% | 100% | 100% | 97% | 100% | 100% | 97% | 100% | 100% |
| Cut-off = 0.01 | | | | | | | | | |
| Specificity for non-dysplastic BE | 100% | 100% | 100% | 94% | 94% | 100% | 100% | 100% | 100% |
| Specificity Sq | 100% | 88% | 100% | 91% | 90% | 100% | 93% | 100% | 100% |

TABLE 2B

| A | K<br>All amplicons together:<br>Up3, Up10, Up15-1, Up15-2, Up20-1, Up20-2, Up27, Up35-1, Up35-2 | L<br>6 core amplicon:<br>Up3, Up15-1, Up15-2, Up27, Up35-1 | M<br>7 amplicon: combo 1:<br>up10 and Up3, Up15-1, Up15-2, Up20-1, Up27, Up35-1 | N<br>7 amplicon combo 2:<br>Up35-2 and Up3, Up15-1, Up15-2, Up20-1, Up27, Up35-1 | O<br>2 amplicon combo 1:<br>Up15-1, Up35-1 | P<br>3 amplicon combo:<br>Up15-1, Up35-1, Up10 | Q<br>3 amplicon combo 2:<br>Up15-1, Up35-1, Up20-1 | R<br>4 amplicon combo 1:<br>Up15-1, Up35-1, Up10, Up15-2 | S<br>4 amplicon combo 2:<br>Up15-1, Up35-1, Up10, Up27 | T<br>4 amplicon combo 3:<br>Up15-1, Up35-1, Up15-2, Up20-1 | U<br>4 amplicon combo 4:<br>Up15-1, Up35-1, Up15-2, Up27 | V<br>4 amplicon combo 5:<br>Up15-1, Up35-1, Up20-1, Up27 |
|---|---|---|---|---|---|---|---|---|---|---|---|---|
| Number of CpGs in amplicon analysis | | | | | | | | | | | | |
| Number of CpGs used for methylation call | | | | | | | | | | | | |
| Cut-off = 0.1 | | | | | | | | | | | | |
| Sensitivity EAC | 65% | 65% | 65% | 65% | 52% | 57% | 57% | 61% | 61% | 61% | 61% | 61% |

TABLE 2B-continued

| A | K All amplicons together: Up3, Up10, Up15-1, Up15-2, Up20-1, Up20-2, Up27, Up35-1, Up35-2 | L 6 core amplicon: Up3, Up15-1, Up15-2, Up20-1, Up27, Up35-1 | M 7 amplicon combo 1: up10 and Up3, Up15-1, Up15-2, Up20-1, Up27, Up35-1 | N 7 amplicon combo 2: Up35-2 and Up3, Up15-1, Up15-2, Up20-1, Up27, Up35-1 | O 2 amplicon combo: Up15-1, Up35-1 | P 3 amplicon combo 1: Up15-1, Up35-1, Up10 | Q 3 amplicon combo 2: Up15-1, Up35-1, Up20-1 | R 4 amplicon combo 1: Up15-1, Up35-1, Up10, Up15-2 | S 4 amplicon combo 2: Up15-1, Up35-1, Up10, Up27 | T 4 amplicon combo 3: Up15-1, Up35-1, Up15-2, Up20-1 | U 4 amplicon combo 4: Up15-1, Up35-1, Up15-2, Up27 | V 4 amplicon combo 5: Up15-1, Up35-1, Up20-1, Up27 |
|---|---|---|---|---|---|---|---|---|---|---|---|---|
| Sensitivity HGD | 50% | 38% | 50% | 50% | 25% | 38% | 38% | 38% | 38% | 38% | 25% | 38% |
| Specificity for non-dysplastic BE | 94% | 94% | 94% | 94% | 100% | 100% | 100% | 94% | 100% | 94% | 94% | 100% |
| Specificity Sq Cut-off = 0.01 | 94% | 94% | 94% | 94% | 100% | 100% | 100% | 97% | 97% | 97% | 94% | 97% |
| Specificity for non-dysplastic BE | 88% | 88% | 88% | 88% | 100% | 100% | 94% | 94% | 100% | 88% | 94% | 94% |
| Specificity Sq | 82% | 82% | 82% | 82% | 100% | 94% | 91% | 88% | 91% | 85% | 88% | 88% |

In addition, RRBS discovery data was analyzed to identify CpG residues that demonstrated: i) at least 3 informative BE, which in every informative BE demonstrated at least 90% methylation; and where ii) no more than 5% of informative normal squamous samples demonstrated methylation level below 90%; and that iii) demonstrated at least 6 informative EAC, where in these informative EACs the level of methylation was at least 20 percentage points lower than the methylation level of the least methylated BE. CpGs meeting these criteria are defined as unmethylated in EAC versus BE. Such unmethylated CpGs were then aggregated into patches by grouping together unmethylated CpGs that were within 200 bp of one another. Unmethylated in EAC patches may consist of 1 CpG up to any number of CpGs that meet the above criteria.

Example 3: Identification of Esophageal Cancer Informative Loci to Detect Progression of Esophageal Neoplasia Biopsy samples (that overlapped with the confirmatory biopsy sample set) were further analyzed in tests of panels of markers for detecting the progression of Barrett's esophagus to Barrett's esophagus high grade dysplasia (HGD) or to esophageal adenocarcinoma (EAC). Three panels of markers were selected for study. The first marker panel consisted of detecting at least one of the following four methylated markers: Up15-1, Up35-1, Up27, and Up10 (using bisulfite sequencing analysis of the corresponding amplicons and using the criteria for detection specified in table 2A). The second panel consisted of testing for somatic non-synonymous mutations in TP53 in assays in which TP53 was amplified from genomic DNA using a set of PCR amplicons that spanned the TP53 coding region and in which Next Generation DNA Sequencing was then used to compare TP53 sequences from esophageal lesions versus matched normal esophagus tissue. Samples were classified as detected if a TP53 mutant allele frequency of greater than or equal to 10% was identified. The third panel was a combination of detection of methylation in any of Up15-1, Up35-1, Up27, and Up10 or detection of mutation in TP53.

Table 3 shows the individual performance of biomarkers in detecting the different sample types of the 1st validation biopsies set using different cut-off criteria for methylation than the analysis of table 2. Shown is the performance for detection of different sample types of 5 different methylated DNA markers tested by bisulfite sequencing analysis of the corresponding amplicons (Up3, Up10, Up27, Up35-1, Up35-2). Table 3 specifies the number of CpGs required to be methylated on a DNA sequence read to classify that read as methylated for this analysis. Results are presented when samples are considered methylated if greater than or equal to 1% of all DNA sequence reads are classified as methylated, or if greater than or equal to 10% of all DNA sequence reads are classified as methylated. Also shown is the performance for detecting samples of testing for non-synonymous somatic mutation in assays in which TP53 was amplified from genomic DNA using a set of PCR amplicons that spanned the TP53 coding region and in which Next Generation DNA Sequencing was then used to compare TP53 sequences from esophageal lesions versus matched normal esophagus tissue. Shown are rates of sample detection (expressed as sensitivity or specificity) when samples are classified as TP53 mutant if greater than or equal to 3% of TP53 reads are scored as mutant, or if greater than or equal to 100% of TP53 reads are scored as mutant.

TABLE 3

| Category | Unchanged CpG # cut-off applied to all sample sets | | | Updated CpG # Cut-off applied to all sample sets | | |
|---|---|---|---|---|---|---|
| | Up3 25+ CpGs >1% = positive | Up35-1 14+CpGs >1% = positive | Up35-2 10+CpGs >1% = positive | Up10 26+CpGs >1% = positive | Up27 15+CpGs >1% = positive | p53 >3% |
| Sensitivity EAC | 20% | 50% | 35% | 30% | 20% | 70% |
| Sensitivity for BEs synchronous to EAC or HGD | 7% | 20% | 19% | 0% | 7% | 25% |
| Sensitivity HGD | 17% | 33% | 38% | 0% | 17% | 25% |
| Specificity Sq | 100% | 100% | 100% | 100% | 97% | 100% |
| Specificity for non-dysplastic BE | 100% | 100% | 100% | 100% | 100% | 100% |
| | >10% = positive | >1.0% = positive | >10% = positive | >10% = positive | >1.0% = positive | >10% = positive |
| Sensitivity EAC | 15% | 45% | 30% | 10% | 15% | 61% |
| Sensitivity for BEs matching higher pathologies, either EAC or HGD | 7% | 7% | 6% | 0% | 7% | 19% |
| Sensitivity HGD | 0% | 17% | 25% | 0% | 17% | 25% |

Table 4 shows the performance of selected combinations of the methylated DNA markers (Up3, Up10, Up27, Up35-1, Up35-2) for detection of different sample types in the experiment presented in Table 3. Samples are scored as methylated if any member of the marker combination panel scores the sample as methylated. Results are presented when the individual markers are considered methylated if greater than or equal to 1% of all DNA sequence reads are classified as methylated, or if greater than or equal to 10% of all DNA sequence reads are classified as methylated.

TABLE 4A

| Cut-off for positivity (e.i. samples is positive if more than this % of reads are methylated at the given number of CpGs) | Category | Up3 and Up35-1 | Up3 and Up35-2 | Up3 and Up10 | Up3 and Up27 | Up35-1 and Up35-2 | Up35-1 and Up10 | Up35-1 and Up27 | Up35-2 and Up10 | Up35-2 and Up27 | Up10 and Up27 | Up3. Up35-1, Up35-2 | Up3. Up354, Up10 |
|---|---|---|---|---|---|---|---|---|---|---|---|---|---|
| 1% | Sensitivity EAC | 50% | 45% | 50% | 35% | 50% | 60% | 60% | 50% | 50% | 40% | 50% | 60% |
| 1% | Sensitivity for BEs synchronous to EAC or HGD | 20% | 20% | 11% | 13% | 27% | 11% | 20% | 11% | 27% | 0% | 27% | 11% |
| 1% | Sensitivity HGD | 33% | 33% | 25% | 33% | 33% | 50% | 50% | 50% | 50% | 0% | 33% | 50% |
| 1% | Specificity Sq | 100% | 100% | 100% | 97% | 97% | 100% | 97% | 100% | 97% | 94% | 100% | 100% |
| 1% | Specificity for non-dysplastic BE | 100% | 100% | 100% | 100% | 100% | 100% | 100% | 100% | 100% | 100% | 100% | 100% |

TABLE 4A-continued

| Cut-off for positivity (e.i. samples is positive if more than this % of reads are methylated at the given number of CpGs) | Category | Up3 and Up35-1 | Up3 and Up35-2 | Up3 and Up10 | Up3 and Up27 | Up35-1 and Up35-2 | Up35-1 and Up10 | Up35-1 and Up27 | Up35-2 and Up10 | Up35-2 and Up27 | Up10 and Up27 | Up3. Up35-1, Up35-2 | Up3. Up354, Up10 |
|---|---|---|---|---|---|---|---|---|---|---|---|---|---|
| 10% | Sensitivity EAC | 45% | 35% | 30% | 25% | 45% | 50% | 50% | 30% | 40% | 20% | 45% | 50% |
|  | Sensitivity for BEs matching higher pathologies, either EAC or HGD | 13% | 13% | 11% | 13% | 7% | 0% | 13% | 0% | 13% | 0% | 13% | 11% |
| 10% | Sensitivity GD | 17% | 33% | 0% | 17% | 33% | 25% | 33% | 50% | 50% | 0% | 33% | 25% |

TABLE 4B

| Cut-off for positivity (e.i. samples is positive if more than this % of reads are methylated at the given CpGs) | Category | Up3, Up35-1, Up27 | Up3, Up35-2, Up10 | Up3, Up35-2, Up27 | Up3, Up10, Up27 | Up35-1, Up10, up27 | Up35-2, Up10, up27 | Up3, Up35-1, Up35-2, Up10 | Up3, Up35-1, Up35-2, Up27 | Up35-1, Up35-2, Up10, Up27 | Up3, Up35-2, Up10, Up27 | Up3, Up35-1, Up10, Up27 | All 5 markers together |
|---|---|---|---|---|---|---|---|---|---|---|---|---|---|
| 1% | Sensitivity EAC | 60% | 60% | 55% | 60% | 70% | 60% | 60% | 60% | 70% | 70% | 70% | 70% |
| 1% | Sensitivity for BEs synchronous to EAC or HGD | 20% | 11% | 27% | 11% | 11% | 11% | 11% | 27% | 11% | 11% | 11% | 11% |
| 1% | Sensitivity HGD | 50% | 50% | 50% | 25% | 50% | 50% | 50% | 50% | 50% | 50% | 50% | 50% |
| 1% | Specificity Sq | 97% | 100% | 97% | 94% | 94% | 94% | 100% | 97% | 94% | 94% | 94% | 94% |
| 1% | Specificity for non-dysplastic BE | 100% | 100% | 100% | 100% | 100% | 100% | 100% | 100% | 100% | 100% | 100% | 100% |
| 10% | Sensitivity EAC | 50% | 30% | 40% | 40% | 60% | 40% | 50% | 50% | 40% | 40% | 60% | 60% |
| 10% | Sensitivity for BEs matching higher pathologies, either EAC or HGD | 20% | 11% | 20% | 11% | 0% | 0% | 11% | 20% | 11% | 11% | 11% | 11% |
| 10% | Sensitivity HGD | 33% | 50% | 50% | 0% | 25% | 50% | 50% | 50% | 50% | 50% | 25% | 50% |

Samples summarized in Table 3 and Table 4 were additionally tested for non-synonymous somatic mutations in TP53. Table 5 shows performance of selected combinations of methylated DNA markers (Up3, Up100, Up27, Up35-1, Up35-2) plus testing for mutations in TP53 (p53) for detection of different sample types. Samples are scored as detected if any member of the marker combination panel scores the sample as methylated or if analysis for TP53 mutations scores the sample as TP53 mutant. Shown is the performance of the marker panel in which samples are scored as detected if any methylation marker is detected as methylated at greater than or equal to 1% of DNA reads, or if TP53 is detected as mutant at greater than or equal to 10% of the DNA sequence reads. Also shown is the performance of the marker panel in which samples are scored as detected if any methylation marker is detected as methylated at greater than or equal to 10% of DNA reads, or if TP53 is detected as mutant at greater than or equal to 10% of the DNA sequence reads.

TABLE 5A

| Cut-off for positivity (e.i. sample is positive if more than this % of reads are methylated at the given number of CpGs) | P53 cut-off | Category | Up3 and p53 | Up35-1 and p53 | Up-3 and P53 | Up10 and P53 | Up27 and p53 |
|---|---|---|---|---|---|---|---|
| 1% | 10% | Sensitivity EAC | 70% | 80% | 70% | 60% | 70% |
| 1% | 10% | Sensitivity for BEs synchronous to EAC or HGD | 20% | 20% | 19% | 11% | 27% |
| 1% | 10% | Sensitivity HGD | 33% | 50% | 38% | 25% | 33% |
| 1% | 10% | Specificity Sq | 100% | 100% | 100% | 100% | 97% |
| 1% | 10% | Specificity for non-dysplastic BE | 100% | 100% | 100% | 100% | 100% |
| | | Individual Methylation Markers + P53 | | | | | |
| 10% | 10% | Sensitivity EAC | 70% | 80% | 70% | 60% | 70% |
| | 10% | Sensitivity for BEs matching higher pathologies, either EAC or HGD | 20% | 20% | 19% | 11% | 27% |
| 10% | 10% | Sensitivity GD | 33% | 50% | 38% | 25% | 33% |

TABLE 5B

| Cut-off for positivity (e.i. sample is positive if more than this % of reads are methylated at the given number of CpGs) | P53 cut-off | Category | Up3 and Up35-2 and p53 | Up3 and Up10 and p53 | Up3 and Up27 and p53 | Up35-2 and Up10 and p53 | Up35-2 and Up27 and p53 | Up10 and Up27 and p53 | Up3, Up35-2, Up10 and p53 | Up3, Up35-2, Up27 and p53 | Up3, Up10, Up27 and p53 | Up35-2, Up10, Up27 and p53 | Up35-1, Up35-2, Up10 Up27 and p53 | Up3, Up35-2, Up10 Up27 and p53 |
|---|---|---|---|---|---|---|---|---|---|---|---|---|---|---|
| 1% | 10% | Sensitivity EAC | 80% | 80% | 80% | 70% | 80% | 80% | 60% | 85% | 90% | 80% | 90% | 90% |
| 1% | 10% | Sensitivity for BEs synchronous to EAC or HGD | 20% | 11% | 27% | 11% | 27% | 11% | 11% | 27% | 11% | 11% | 11% | 11% |
| 1% | 10% | Sensitivity HGD | 50% | 25% | 33% | 50% | 50% | 25% | 50% | 50% | 25% | 50% | 50% | 50% |
| 1% | 10% | Specificity Sq | 100% | 100% | 97% | 100% | 97% | 94% | 100% | 97% | 94% | 94% | 94% | 94% |
| 1% | 10% | Specificity for non-dysplastic BE | 100% | 100% | 100% | 100% | 100% | 100% | 100% | 100% | 100% | 100% | 100% | 100% |
| | | Methylation Marker Combinations Merged with P53 Mutation | | | | | | | | | | | | |
| 10% | 10% | Sensitivity EAC | 75% | 70% | 75% | 70% | 80% | 70% | 30% | 80% | 80% | 80% | 80% | 80% |
| | 10% | Sensitivity for BEs matching higher pathologies, either EAC or HGD | 20% | 11% | 27% | 11% | 27% | 11% | 11% | 27% | 11% | 11% | 11% | 11% |
| 10% | 10% | Sensitivity HGD | 50% | 25% | 33% | 50% | 50% | 25% | 50% | 50% | 25% | 50% | 50% | 50% |

DNA was also extracted from esophageal samples that were also obtained by cytology brushings of the esophagus. The sample set included brushings from 49 esophageal adenocarcinomas (EAC); 14 carcinomas of the gastro-sophageal junction (JCA); 8 Barrett's esophagus with low grade dysplasia (LGD); 9 Barrett's esophagus with high-grade dysplasia (HGD); 33 cases of Barrett's esophagus without dysplasia from cases without HGD or EAC, otherwise termed non-dysplastic BE, that included 13 cases of short segment Barrett's esophagus (SSBE). Also included were brushings of the gastroesophageal junction (normal GEJ) from 62 individuals without Barrett's esophagus, without HGD, without EAC. This included individuals with gastroesophageal reflux disease, with eosinophilic esophagitis, or without any disease. Also included were 176 brushings of normal squamous esophagus from each of the above individuals. These DNA samples were analyzed for methylation by bisulfite sequencing of selected amplicons and were also analyzed for non-synonymous somatic mutations in TP53.

Table 6 shows the individual performance of biomarkers in detecting the different sample types of the validation brushings set. Shown is the performance for detection of different sample types of 5 different methylated DNA markers analyzed by bisulfite sequencing of selected amplicons (Up3, Up10, Up27, Up35-1, Up35-2). The table specifies the number of CpGs required to be methylated on a DNA sequence read to classify that read as methylated. Results are presented when samples are considered methylated if greater than or equal to 1% of all DNA sequence reads are classified as methylated, or if greater than or equal to 10% of all DNA sequence reads are classified as methylated. Also shown is the performance for detecting samples of testing for somatic mutation in assays in which TP53 was amplified from genomic DNA using a set of PCR amplicons that spanned the TP53 coding region and in which Next Generation DNA Sequencing was then used to compare TP53 sequences from esophageal lesions versus matched normal esophagus tissue. Shown are rates of sample detection (expressed as sensitivity or specificity) when samples are classified as TP53 mutant if greater than or equal to 3% of TP53 reads are scored as mutant, or if greater than or equal to 10% of TP53 reads are scored as mutant.

TABLE 6A

| | Unchanged CpG # cut-off applied to all sample sets | | |
|---|---|---|---|
| Category | Up-3 25 + CpGs >1% = positive | Up35-1 14 + CpGs >1% = positive | Up35-2 10 + CpGs >1% = positive |
| Sensitivity EAC | 44% | 57% | 57% |
| Sensitivity JCA | 14% | 43% | 21% |
| Sensitivity LGD | 25% | 38% | 25% |
| Sensitivity HGD | 67% | 56% | 50% |
| Specificity normal GEJ | 98% | 98% | 98% |
| Specificity for "non-dysplastic BE"- excluding SSBE | 95% | 100% | 100% |
| Specificity for all BE without dysplasia (including SSBE and non-dysplastic BE) | 97% | 85% | 94% |
| | >10% = positive | >10% = positive | >10% = positive |
| Sensitivity EAC | 21% | 57% | 45% |
| Sensitivity JCA | 7% | 29% | 7% |
| Sensitivity LGD | 13% | 38% | 25% |
| Sensitivity HGD | 33% | 56% | 30% |
| Specificity normal GEJ | 100% | 100% | 100% |
| Specificity for "non-dysplastic BE"- excluding SSBE | 100% | 100% | 100% |
| Specificity for all BE without dysplasia (including SSBE and non-dysplastic BE) | 100% | 88% | 97% |

TABLE 6B

| | Updated CpG # Cut-off applied to all sample sets | | |
|---|---|---|---|
| Category | Up10 26 + CpGs >1% = positive | Up27 15 + CpGs >1% = positive | p53 >3% |
| Sensitivity EAC | 31% | 43% | 59% |
| Sensitivity JCA | 43% | 14% | 50% |
| Sensitivity LGD | 0% | 13% | 13% |
| Sensitivity HGD | 22% | 20% | 40% |
| Specificity normal GEJ | 98% | 100% | 100% |
| Specificity for "non-dysplastic BE"- excluding SSBE | 100% | 95% | 100% |
| Specificity for all BE without dysplasia (including SSBE mid non-dysplastic BE) | 100% | 94% | 97% |
| | >10% = positive | >10% = positive | >10% = positive |
| Sensitivity EAC | 25% | 29% | 47% |
| Sensitivity JCA | 29% | 7% | 29% |
| Sensitivity LGD | 0% | 13% | 0% |
| Sensitivity HGD | 11% | 20% | 40% |
| Specificity normal GEJ | 100% | 100% | 100% |
| Specificity for "non-dysplastic BE"- excluding SSBE | 100% | 95% | 100% |
| Specificity for all BE without dysplasia (including SSBE and non-dysplastic BE) | 100% | 97% | 97% |

Table 7 shows the performance of selected combinations of the methylated DNA markers (Up3, Up10, Up27, Up35-1, Up35-2) for detection of different sample types in the esophageal brushings samples presented in Table 6. Samples are scored as methylated if any member of the marker combination panel scores the sample as methylated. Results are presented when the individual markers are considered methylated if greater than or equal to 1% of all DNA sequence reads are classified as methylated, or if greater than or equal to 10% of all DNA sequence reads are classified as methylated.

TABLE 7A

| Cut-off for positivity (e.i. sample is positive if more than this % of reads are methylated at the given number of CpGs) | Category | Up3 and Up35-1 | Up3 and Up35-2 | Up3 and Up10 | Up3 and Up27 | Up35-1 and Up35-2 | Up35-1 and Up10 | Up35-1 and Up27 | Up35-2 and Up10 | Up35-2 and Up27 | Up10 and Up27 | Up3, Up35-1, Up35-2 |
|---|---|---|---|---|---|---|---|---|---|---|---|---|
| 1% | Sensitivity EAC | 63% | 60% | 57% | 56% | 61% | 71% | 67% | 71% | 63% | 58% | 63% |
| 1% | Sensitivity JCA | 43% | 21% | 50% | 29% | 43% | 57% | 50% | 50% | 56% | 43% | 45% |
| 1% | Sensitivity LGD | 58% | 58% | 14% | 25% | 33% | 29% | 38% | 29% | 25% | 14% | 38% |
| 1% | Sensitivity HGD | 78% | 78% | 78% | 67% | 56% | 78% | 67% | 67% | 60% | 33% | 78% |
| 1% | Specificity normal GEJ | 98% | 98% | 97% | 98% | 98% | 97% | 98% | 97% | 98% | 98% | 98% |
| 1% | Specificity for non-dysplastic BE | 95% | 95% | 95% | 90% | 100% | 100% | 95% | 100% | 95% | 95% | 95% |
| 1% | Specificity all BE without dysplasia(Including SSBE, and non-dysplastic BE) | 84% | 94% | 97% | 91% | 85% | 85% | 82% | 94% | 91% | 94% | 84% |

TABLE 7A-continued

| Cut-off for positivity (e.i. sample is positive if more than this % of reads are methylated at the given number of CpGs) | Category | Up3 and Up35-1 | Up3 and Up35-2 | Up3 and Up10 | Up3 and Up27 | Up35-1 and Up35-2 | Up35-1 and Up10 | Up35-1 and Up27 | Up35-2 and Up10 | Up35-2 and Up27 | Up10 and Up27 | Up3, Up35-1, Up35-2 |
|---|---|---|---|---|---|---|---|---|---|---|---|---|
| 10% | Sensitivity EAC | 56% | 48% | 38% | 38% | 57% | 67% | 65% | 58% | 55% | 42% | 63% |
| 10% | Sensitivity JCA | 59% | 7% | 29% | 14% | 29% | 43% | 36% | 29% | 14% | 36% | 29% |
| 10% | Sensitivity LGD | 38% | 38% | 0% | 25% | 38% | 29% | 38% | 29% | 25% | 14% | 38% |
| 10% | Sensitivity HGD | 67% | 44% | 33% | 44% | 56% | 67% | 67% | 44% | 50% | 22% | 78% |

TABLE 7B

| Cut-off for positivity (e.i. sample is positive if more than this % of reads are methylated at the given number of CpGs) | Category | Up3, Up35-1, Up10 | Up3, Up35-1, Up27 | Up3, Up35-2, Up10 | Up3, Up35-2, Up27 | Up3, Up10, Up27 | Up35-1, Up10, Up27 | Up35-2, Up10, up27 | Up3, Up35-1, Up35-2, Up10 | Up3, Up35-1, Up35-2, Up27 | Up3, Up35-1, Up35-2, Up10 Up27 | Up3, Up35-2, Up10 Up27 | Up3, Up35-1, Up10 Up27 | All 5 markers together |
|---|---|---|---|---|---|---|---|---|---|---|---|---|---|---|
| 1% | Sensitivity EAC | 72% | 69% | 70% | 67% | 64% | 77% | 75% | 72% | 69% | 74% | 74% | 77% | 77% |
| 1% | Sensitivity JCA | 57% | 50% | 50% | 36% | 50% | 57% | 50% | 57% | 50% | 50% | 50% | 57% | 57% |
| 1% | Sensitivity LGD | 29% | 38% | 29% | 38% | 14% | 29% | 29% | 29% | 36% | 29% | 29% | 29% | 29% |
| 1% | Sensitivity HGD | 89% | 78% | 89% | 73% | 78% | 89% | 78% | 89% | 78% | 89% | 89% | 89% | 89% |
| 1% | Specificity normal GEJ | 97% | 98% | 97% | 98% | 97% | 97% | 97% | 97% | 98% | 97% | 97% | 97% | 97% |
| 1% | Specificity for non-dyspl BE | 95% | 90% | 95% | 90% | 90% | 95% | 95% | 95% | 90% | 90% | 90% | 90% | 90% |
| 1% | Specificity all BE without dysplasia(Including SSBE, and non-dysplastic BE) | 84% | 81% | 94% | 91% | 91% | 82% | 91% | 84% | 81% | 91% | 91% | 81% | 81% |
| 10% | Sensitivity EAC | 66% | 65% | 57% | 56% | 49% | 71% | 63% | 66% | 65% | 62% | 62% | 70% | 70% |
| 10% | Sensitivity JCA | 43% | 36% | 29% | 14% | 36% | 50% | 36% | 43% | 36% | 36% | 36% | 50% | 50% |
| 10% | Sensitivity LGD | 29% | 38% | 29% | 38% | 14% | 29% | 29% | 29% | 38% | 29% | 29% | 29% | 29% |
| 10% | Sensitivity HGD | 67% | 78% | 44% | 56% | 44% | 78% | 56% | 67% | 78% | 56% | 56% | 78% | 78% |

Table 8 shows the performance of selected combinations of methylated DNA markers (Up3, Up10, Up27, Up35-1, Up35-2) plus testing for mutations in TP53 (p53) for detection of different sample types in the esophageal brushings samples presented in Tables 6 and 7. Samples are scored as detected if any member of the marker combination panel scores the sample as methylated or if analysis for TP53 mutations scores the sample as TP53 mutant. Shown is the performance of the marker panel in which samples are scored as detected if any methylation marker is detected as methylated at greater than or equal to 1% of DNA reads, or if TP53 is detected as mutant at greater than or equal to 3% or at greater than or equal to 10% of the DNA sequence reads. Also shown is the performance of the marker panel in which samples are scored as detected if any methylation marker is detected as methylated at greater than or equal to 10% of DNA reads, or if TP53 is detected as mutant at greater than or equal to 3% or at greater than or equal to 10% of the DNA sequence reads. Marker combination with greater than 90% specificity in all BE without dysplasia are preferred yellow. Marker combinations that additionally show superior sensitivity for EAC are further preferred. Particularly preferred marker combinations are: Up35-2 methylation plus TP53 mutation; Up35-2 methylation plus Up3 methylation plus TP53 mutation; Up10 methylation plus Up3 methylation plus TP53 mutation; Up35-2 methylation plus Up10 methylation plus TP53 mutation; Up10 methylation plus Up27 methylation plus TP53 mutation; Up35-2 methylation plus Up3 methylation plus Up10 methylation plus TP53 mutation.

TABLE 8A

| Methyl cut-off (samples are positive if more than this % of reads are methylated at the required number of CpGs) | P53 cut-off | Category | Up-3 and p53 | Up35-1 and p53 | Up35-2 and p53 | Up10 and p53 | Up27 and p53 | Up3 Up35-2 and p53 | Up3 and Up10 and p53 | Up3 and Up27 and p53 |
|---|---|---|---|---|---|---|---|---|---|---|
| 1% | 1% | Sensitivity EAC | 81% | 84% | 86% | 75% | 80% | 88% | 85% | 85% |
| 1% | 1% | Sensitivity JCA | 50% | 64% | 50% | 57% | 57% | 50% | 57% | 57% |
| 1% | 1% | Sensitivity LGD | 25% | 38% | 25% | 14% | 13% | 38% | 14% | 25% |
| 1% | 1% | Sensitivity HGD | 78% | 78% | 70% | 33% | 50% | 89% | 78% | 78% |
| 1% | 1% | Specificity normal GEJ | 98% | 98% | 98% | 98% | 100% | 98% | 97% | 98% |
| 1% | 1% | Specificity for non-dysplastic BE | 95% | 100% | 100% | 100% | 95% | 95% | 95% | 90% |
| 1% | 1% | Specificity all BE without dysplasia (Including SSBE, and non-dysplastic BE) | 94% | 82% | 91% | 97% | 91% | 91% | 94% | 88% |
| 1% | 3% | Sensitivity EAC | 77% | 82% | 84% | 73% | 78% | 85% | 83% | 83% |
| 1% | 3% | Sensitivity JCA | 50% | 64% | 50% | 57% | 57% | 50% | 57% | 57% |
| 1% | 3% | Sensitivity LGD | 25% | 38% | 25% | 14% | 13% | 38% | 14% | 25% |
| 1% | 3% | Sensitivity HGD | 78% | 78% | 70% | 33% | 50% | 89% | 78% | 78% |
| 10% | 3% | Sensitivity EAC | 69% | 82% | 80% | 71% | 71% | 79% | 79% | 75% |
| 10% | 3% | Sensitivity JCA | 50% | 57% | 50% | 57% | 50% | 50% | 57% | 50% |
| 10% | 3% | Sensitivity LGD | 25% | 38% | 25% | 14% | 13% | 38% | 14% | 25% |
| 10% | 3% | Sensitivity HGD | 44% | 78% | 60% | 33% | 50% | 56% | 44% | 56% |
| 10% | 10% | Sensitivity EAC | 60% | 73% | 69% | 60% | 65% | 71% | 70% | 69% |
| 10% | 10% | Sensitivity JCA | 29% | 43% | 29% | 43% | 29% | 29% | 43% | 29% |
| 10% | 10% | Sensitivity LGD | 13% | 38% | 25% | 0% | 13% | 38% | 0% | 25% |
| 10% | 10% | Sensitivity HGD | 44% | 78% | 60% | 33% | 50% | 56% | 44% | 56% |

TABLE 8B

| Methyl cut-off (samples are positive if more than this % of reads are methylated at the required number of CpGs) | P53 cut-off | Category | Up35-2 and Up10 and p53 | Up35-2 and Up27 and p53 | Up10 and Up27 and p53 | Up3, Up35-2, Up10 and p53 | Up3, Up35-2, Up27 and p53 | Up3, Up10, Up27 and p53 | Up35-2, Up10, Up27 and p53 | Up35-1, Up35-2, Up10 Up27 and p53 | Up3, Up35-2, Up10 Up27 and p53 |
|---|---|---|---|---|---|---|---|---|---|---|---|
| 1% | 1% | Sensitivity EAC | 92% | 90% | 85% | 91% | 92% | 87% | 94% | 94% | 94% |
| 1% | 1% | Sensitivity JCA | 57% | 57% | 57% | 57% | 57% | 57% | 57% | 57% | 57% |
| 1% | 1% | Sensitivity LGD | 29% | 25% | 14% | 29% | 38% | 14% | 29% | 29% | 29% |
| 1% | 1% | Sensitivity HGD | 67% | 80% | 44% | 89% | 89% | 78% | 78% | 89% | 89% |
| 1% | 1% | Specificity normal GEJ | 97% | 98% | 98% | 97% | 98% | 97% | 97% | 97% | 97% |
| 1% | 1% | Specificity for non-dysplastic BE | 100% | 95% | 95% | 95% | 90% | 90% | 95% | 90% | 90% |
| 1% | 1% | Specificity all BE without dysplasia (Including SSBE, and non-dysplastic BE) | 91% | 88% | 91% | 91% | 88% | 88% | 88% | 88% | 88% |
| 1% | 3% | Sensitivity EAC | 90% | 88% | 83% | 89% | 90% | 85% | 92% | 91% | 91% |
| 1% | 3% | Sensitivity JCA | 57% | 57% | 57% | 57% | 57% | 57% | 57% | 57% | 57% |
| 1% | 3% | Sensitivity LGD | 29% | 25% | 14% | 29% | 38% | 14% | 29% | 29% | 29% |
| 1% | 3% | Sensitivity HGD | 67% | 80% | 44% | 89% | 89% | 78% | 78% | 89% | 89% |
| 10% | 3% | Sensitivity EAC | 85% | 86% | 77% | 85% | 85% | 81% | 88% | 87% | 87% |
| 10% | 3% | Sensitivity JCA | 57% | 50% | 57% | 57% | 50% | 57% | 57% | 57% | 57% |
| 10% | 3% | Sensitivity LGD | 29% | 25% | 14% | 29% | 38% | 14% | 29% | 29% | 29% |
| 10% | 3% | Sensitivity HGD | 56% | 70% | 44% | 56% | 67% | 56% | 67% | 67% | 67% |
| 10% | 10% | Sensitivity EAC | 77% | 80% | 71% | 77% | 79% | 74% | 81% | 81% | 81% |
| 10% | 10% | Sensitivity JCA | 43% | 29% | 43% | 43% | 29% | 43% | 43% | 43% | 43% |
| 10% | 10% | Sensitivity LGD | 29% | 25% | 14% | 29% | 38% | 14% | 29% | 29% | 26% |
| 10% | 10% | Sensitivity HGD | 56% | 70% | 44% | 56% | 67% | 56% | 67% | 67% | 67% |

Example 4: Analysis of Esophageal Cancer Informative Loci in Formalin Fixed Paraffin Embedded Tissues Additional studies were performed on DNAs extracted from formalin fixed paraffin embedded (FFPE) tissue samples of the stomach and esophagus that capture different diagnostic categories other than Barrett's with high grade dysplasia and esophageal adenocarcinoma. Bisulfite converted DNAs from each sample were amplified with bisulfite specific methylation indifferent primers corresponding to selected amplicons and the amplicons were then analyzed by bisulfite sequencing to determine methylation status on the parental DNA templates.

Table 9 summarizes the side by side comparison of 8 methylated DNA markers in FFPE tissue samples of the stomach and esophagus that capture different diagnostic categories other than Barrett's with high grade dysplasia and esophageal adenocarcinoma. Intestinal metaplasia is abbreviated as IM. Table 9 denotes for each marker the number of methylated cytosine bases required to be detected on a DNA sequence read to classify that read as methylated. Samples are detected as methylated if greater than or equal to 1% of DNA sequence reads are classified as methylated.

TABLE 9A

| Marker<br>CpG cut-off<br>Value (% positive samples or total number of samples sequenced) | VIM<br>6+ | | SqBE5<br>13+ | | SqBE Up7<br>23+ | | SqBE11-2<br>5+ | |
|---|---|---|---|---|---|---|---|---|
| | % positive | Total number | % positive | Total number | % positive | Total number | % positive | Total number |
| BE (IM) | 90% | 30 | 50% | 12 | 50% | 16 | 83% | 30 |
| GEJ/Cardia with IM | 82% | 11 | 0% | 5 | 33% | 6 | 100% | 11 |
| GEJ/Cardia without IM | 0% | 58 | 0% | 33 | 2% | 47 | 31% | 58 |
| columnar mucosa without IM taken from patients with concurrent IM at the same endoscopy | 30% | 10 | 0% | 4 | 20% | 5 | 30% | 10 |
| Normal Distal Esophagus-Squamous | 9% | 23 | 8% | 13 | 0% | 16 | 13% | 23 |
| Squamous Mucosa with REFLUX Esophagus | 0% | 10 | 0% | 6 | 0% | 5 | 0% | 10 |
| Eosinophilic Eosphagitis | 0% | 15 | 0% | 5 | 0% | 11 | 0% | 15 |
| Gastic Mucosa with IM | 22% | 9 | 0% | 2 | 20% | 5 | 44% | 9 |
| Gastric Fundic Mucosa without IM | 0% | 24 | 0% | 14 | 5% | 21 | 8% | 24 |
| *Helicobactor Pylori* Gastritis without IM | 8% | 13 | 22% | 9 | 13% | 8 | 69% | 13 |

TABLE 9B

| Marker<br>CpG cut-off<br>Value (% positive samples or total number of samples sequenced) | SqBE14-2<br>20+ | | SqBE16<br>14+ | | SqBE17<br>17+ | | SqBE18<br>16+ | |
|---|---|---|---|---|---|---|---|---|
| | % positive | Total number | % positive | Total number | % positive | Total number | % positive | Total number |
| BE (IM) | 50% | 16 | 50% | 26 | 69% | 26 | 86% | 29 |
| GEJ/Cardia with IM | 22% | 9 | 18% | 11 | 73% | 11 | 70% | 10 |
| GEJ/Cardia without IM | 2% | 41 | 2% | 55 | 7% | 55 | 0% | 57 |
| columnar mucosa without IM taken from patients with concurrent IM at the same endoscopy | 0% | 5 | 11% | 9 | 11% | 9 | 11% | 9 |
| Normal Distal Esophagus-Squamous | 10% | 20 | 5% | 22 | 4% | 23 | 4% | 23 |
| Squamous Mucosa with REFLUX Esophagus | 17% | 6 | 0% | 8 | 0% | 9 | 0% | 10 |
| Eosinophilic Eosphagitis | 0% | 8 | 0% | 12 | 8% | 13 | 0% | 12 |
| Gastic Mucosa with IM | 0% | 5 | 0% | 7 | 25% | 8 | 14% | 7 |

TABLE 9B-continued

| Marker CpG cut-off Value (% positive samples or total number of samples sequenced) | SqBE14-2 20+ | | SqBE16 14+ | | SqBE17 17+ | | SqBE18 16+ | |
|---|---|---|---|---|---|---|---|---|
| | % positive | Total number | % positive | Total number | % positive | Total number | % positive | Total number |
| Gastric Fundic Mucosa without IM | 0% | 14 | 0% | 24 | 0% | 24 | 8% | 24 |
| *Helicobactor Pylori* Gastritis without IM | 14% | 7 | 8% | 13 | 46% | 13 | 15% | 13 |

Table 10 summarizes the side by side comparison of 8 methylated DNA markers in FFPE tissue samples of the stomach and esophagus that capture different diagnostic categories other than Barrett's with high grade dysplasia and esophageal adenocarcinoma. Intestinal metaplasia is abbreviated as IM. Table 10 denotes for each marker the number of methylated cytosine bases required to be detected on a DNA sequence read to classify that read as methylated. Samples are detected as methylated if greater than or equal to 10% of DNA sequence reads are classified as methylated.

TABLE 10A

| Marker CpG cut-off Value (% positive samples or total number of samples sequenced) | VIM 6+ | | SqBE5 13+ | | SqBE Up7 23+ | | SqBE11-2 5+ | |
|---|---|---|---|---|---|---|---|---|
| | % positive | Total number | % positive | Total number | % positive | Total number | % positive | Total number |
| BE (IM) | 87% | 30 | 50% | 12 | 44% | 16 | 70% | 30 |
| GEJ/Cardia with IM | 82% | 11 | 0% | 5 | 33% | 6 | 91% | 11 |
| GEJ/Cardia without IM | 0% | 58 | 0% | 33 | 2% | 47 | 16% | 58 |
| columnar mucosa without IM taken from patients with concurrent IM at the same endoscopy | 0% | 10 | 0% | 4 | 0% | 5 | 10% | 10 |
| Normal Distal Esophagus-Squamous | 9% | 23 | 8% | 13 | 0% | 16 | 13% | 23 |
| Squamous Mucosa with REFLUX Esophagus | 0% | 10 | 0% | 6 | 0% | 5 | 0% | 10 |
| Eosinophilic Eosphagitis | 0% | 15 | 0% | 5 | 0% | 11 | 0% | 15 |
| Gastic Mucosa with IM | 11% | 9 | 0% | 2 | 20% | 5 | 22% | 9 |
| Gastric Fundic Mucosa without IM | 0% | 24 | 0% | 14 | 5% | 21 | 4% | 24 |
| *Helicobactor Pylori* Gastritis without IM | 8% | 13 | 22% | 9 | 13% | 8 | 46% | 13 |

TABLE 10B

| Marker CpG cut-off Value (% positive samples or total number of samples sequenced) | SqBE14-2 20+ | | SqBE16 14+ | | SqBE17 17+ | | SqBE18 16+ | |
|---|---|---|---|---|---|---|---|---|
| | % positive | Total number | % positive | Total number | % positive | Total number | % positive | Total number |
| BE (IM) | 50% | 16 | 42% | 26 | 62% | 26 | 76% | 29 |
| GEJ/Cardia with IM | 22% | 9 | 18% | 11 | 64% | 11 | 70% | 10 |
| GEJ/Cardia without IM | 2% | 43 | 2% | 55 | 0% | 55 | 0% | 57 |
| columnar mucosa without IM taken from patients with concurrent IM at the same endoscopy | 0% | 5 | 0% | 9 | 11% | 9 | 11% | 9 |
| Normal Distal Esophagus-Squamous | 10% | 20 | 5% | 22 | 4% | 23 | 4% | 23 |

TABLE 10B-continued

| Marker CpG cut-off Value (% positive samples or total number of samples sequenced) | SqBE14-2 20+ | | SqBE16 14+ | | SqBE17 17+ | | SqBE18 16+ | |
|---|---|---|---|---|---|---|---|---|
| | % positive | Total number | % positive | Total number | % positive | Total number | % positive | Total number |
| Squamous Mucosa with REFLUX Esophagus | 17% | 6 | 0% | 8 | 0% | 9 | 0% | 10 |
| Eosinophilic Eosphagitis | 0% | 8 | 0% | 12 | 0% | 13 | 0% | 12 |
| Gastic Mucosa with IM | 0% | 5 | 0% | 7 | 13% | 8 | 14% | 7 |
| Gastric Fundic Mucosa without IM | 0% | 14 | 0% | 24 | 0% | 24 | 0% | 24 |
| *Helicobactor Pylori* Gastritis without IM | 14% | 7 | 8% | 13 | 46% | 13 | 8% | 13 |

Table 11 summarizes performance of different panels comprised of combinations of methylated DNA markers in FFPE tissue samples of the stomach and esophagus that capture different diagnostic categories other than Barrett's with high grade dysplasia and esophageal adenocarcinoma. Intestinal metaplasia is abbreviated as IM. Tables 9 and 10 denote for each marker the number of methylated cytosine bases required to be detected on a DNA sequence read to classify that read as methylated. Samples are detected as methylated if greater than or equal to 1% of DNA sequence reads are classified as methylated for any member of the marker panel.

TABLE 11A

| Marker combinations | VIM SqBE5 | VIM SqBE7 | VIM SqBE16 | VIM SqBE17 | VIM SqBE18 | SqBE5 SqBE7 | SqBE5 SqBE16 |
|---|---|---|---|---|---|---|---|
| BE (IM) | 92% | 88% | 92% | 88% | 97% | 71% | 70% |
| GEJ/Cardia with IM | 60% | 83% | 82% | 91% | 80% | 50% | 0% |
| GE/Cardia without IM | 0% | 2% | 2% | 7% | 0% | 3% | 3% |
| columnar mucosa without IM taken from patients with concurrent IM at the same endoscopy | 25% | 40% | 33% | 33% | 33% | 25% | 0% |
| Normal Distal Esophagus-Squamous | 8% | 6% | 9% | 9% | 9% | 8% | 8% |
| Squamous Mucosa with REFLUX Esophagus | 0% | 0% | 0% | 0% | 0% | 0% | 0% |
| Eosinophilic Eosphagitis | 0% | 0% | 0% | 8% | 0% | 0% | 0% |
| Gastic Mucosa with IM | 0% | 40% | 14% | 38% | 43% | 0% | 0% |
| Gastric Fundic Mucosa without IM | 0% | 5% | 0% | 0% | 8% | 7% | 0% |
| *Helicobactor Pylori* Gastritis without IM | 33% | 13% | 15% | 46% | 15% | 29% | 22% |

TABLE 11B

| Marker combinations | SqBE5 SqBE17 | SqBE5 SqBE18 | SqBE7 SqBE16 | SqBE7 SqBE17 | SqBE7 SqBE18 | SqBE16 SqBE17 | SqBE16 SqBE18 |
|---|---|---|---|---|---|---|---|
| BE (IM) | 80% | 91% | 57% | 79% | 94% | 78% | 92% |
| GEJ/Cardia with IM | 80% | 40% | 33% | 50% | 83% | 73% | 70% |
| GEJ/Cardia without IM | 9% | 0% | 2% | 9% | 2% | 8% | 2% |
| columnar mucosa without IM taken from patients with concurrent IM at the same endoscopy | 25% | 0% | 40% | 20% | 20% | 22% | 22% |
| Normal Distal Esophagus-Squamous | 8% | 8% | 6% | 0% | 6% | 9% | 5% |
| Squamous Mucosa with REFLUX Esophagus | 0% | 0% | 0% | 0% | 0% | 0% | 0% |
| Eosinophilic Eosphagitis | 20% | 0% | 0% | 10% | 0% | 10% | 0% |
| Gastic Mucosa with IM | 50% | 0% | 25% | 40% | 20% | 33% | 17% |
| Gastric Fundic Mucosa without IM | 0% | 7% | 5% | 5% | 5% | 0% | 8% |
| Helicobactor Pylori Gastritis without IM | 44% | 44% | 25% | 50% | 25% | 46% | 23% |

Table 12 summarizes performance of different panels comprised of combinations of methylated DNA markers in FFPE tissue samples of the stomach and esophagus that capture different diagnostic categories other than Barrett's with high grade dysplasia and esophageal adenocarcinoma. Intestinal metaplasia is abbreviated as IM. Tables 9 and 10 denote for each marker the number of methylated cytosine bases required to be detected on a DNA sequence read to classify that read as methylated. Samples are detected as methylated if greater than or equal to 10% of DNA sequence reads are classified as methylated for any member of the marker panel.

TABLE 12A

| Marker combinations | VIM SqBE5 | VIM SqBE7 | VIM SqBE16 | VIM SqBE17 | VIM SqBE18 | SqBE5 SqBE7 | SqBE5 SqBE16 |
|---|---|---|---|---|---|---|---|
| BE (IM) | 92% | 81% | 88% | 85% | 90% | 71% | 60% |
| GEJ/Cardia with IM | 60% | 83% | 82% | 91% | 80% | 50% | 0% |
| GEJ / Cardia without MI | 0% | 2% | 2% | 0% | 0% | 3% | 3% |
| columnar mucosa without IM taken from patients with concurrent IM at the same endoscopy | 0% | 0% | 0% | 11% | 11% | 0% | 0% |
| Normal Distal Esophagus-Squamous | 8% | 6% | 9% | 9% | 9% | 8% | 8% |
| Squamous Mucosa with REFLUX Esophagus | 0% | 0% | 0% | 0% | 0% | 0% | 0% |
| Eosinophilic Eosphagitis | 0% | 0% | 0% | 0% | 0% | 0% | 0% |
| Gastic Mucosa with IM | 0% | 20% | 14% | 13% | 29% | 0% | 0% |
| Gastric Fundic Mucosa without 1M | 0% | 5% | 0% | 0% | 0% | 7% | 0% |
| *Helicobactor Pylori* Gastritis without IM | 33% | 13% | 15% | 46% | 15% | 29% | 22% |

TABLE 12B

| Marker combinations | SqBE5 SqBE17 | SqBE5 SqBE18 | SqBE7 SqBE16 | SqBE7 SqBE17 | SqBE7 SqBE18 | SqBE16 SqBE17 | SqBE16 SqBE18 |
|---|---|---|---|---|---|---|---|
| BE (IM) | 70% | 91% | 57% | 71% | 81% | 74% | 81% |
| GEJ/Cardia with IM | 80% | 40% | 33% | 50% | 83% | 64% | 70% |
| GEJ/Cardia without FM | 0% | 0% | 2% | 2% | 2% | 2% | 2% |
| columnar mucosa without IM taken from patients with concurrent IM at the same endoscopy | 25% | 0% | 0% | 20% | 0% | 11% | 11% |
| Normal Distal Esophagus-Squamous | 8% | 8% | 6% | 0% | 6% | 9% | 5% |
| Squamous Mucosa with REFLUX Esophagus | 0% | 0% | 0% | 0% | 0% | 0% | 0% |
| Eosinophilic Eosphagitis | 0% | 0% | 0% | 0% | 0% | 0% | 0% |
| Gastic Mucosa with IM | 0% | 0% | 25% | 20% | 20% | 17% | 17% |
| Gastric Fundic Mucosa without IM | 0% | 0% | 5% | 5% | 5% | 0% | 0% |
| *Helicobactor Pylori* Gastritis without IM | 44% | 33% | 25% | 50% | 25% | 46% | 15% |

METHODOLOGIES

Somatic mutations in TP53 were detected using the following method. TP53 exons 2-11 were amplified using a multiplexed series of primer pairs covering all coding sequences and splice junctions. The primers contained additional 5' end sequences that were then used for secondary amplification that introduced barcode sequences and Illumina 15 and 17 sequences into the final PCR products. PCR products were mixed, purified and analyzed on an Illumina MiSeq instrument. Data analysis was performed using CLCBio software (Qiagen) and VariantStudio software (Illumina).

SEQUENCE LISTING (16212 sequences)

SEQ ID NO: 1 - DNA, 1017 bp, Homo sapiens
cggcgaccccggcccccgcaaggtggggcggcgagcaggagccggggccaggccaggggctcgagctcccgttcgaggggcggggaaggcgggtgacgtgagccgggccgggcgggcggagttgggaccggctccgggaggcgggggcgagcgcgcggagaggcagacgcgaggagggaggcggctgagcagcgcgggcggctctgcggcgggcgcggtgggcgcgggcggcggggccccgggatccccgcgcgcctcctccgcgcggcgccgccgccgcgcgtccccacgccccgcgctccacggcgccctcgccccgcgcgcctctcgtgcccgcctcctgccagtctccgggccgcggccgtctgcagagcgagcgctcagacggagcccccgggcaacttgagtggcgccgatcggcggcggagcctctggcagagccccccgacccggcagcgcggaggggactcgcgtccgtccgcgtcgcgtcaccccaaaccctaagcagcgccgccccatcggcgcggagctccggctggaggcaagagccgcgcgccgggagacacgcaccgtgagcggcagcgccgccggcctccctcctcgccgccccggagggcgaagccgcggctccccagccctttgctgcgccgcgacagcgccggaacacgccccgcctcgctgccgccttcgctgtgccgccggcggagggggccgcgagccccgcgccccggccggaggatgtgcgcccccgcgggccgcccagcctgagccatgcgccccaacggcggcggcgcgccggccggcatggagccccgcgcggccgcgctctgactcgctgtgcgccccgcggccggcgggcggcgggaggcggcggaccgagagccggagaccggcgccgcgggacggaagcgagcgggcgcgggcgccgcgcagatggcctgggcgagccaggtctgaggccccgctccccgaaacgtgaccatgtggattcaacagcttttaggactcaggtgagcg

SEQ ID NO: 2 - DNA, 166 bp, Homo sapiens
cgctcggagcgcgggcggggtcagcttgggcagccgcgggtcgctgctgcgtcggaagtctccgtcgccagggagccccttgggcgccaggtcctgggcccctgggcgaagtcgacgccagaacatgcttggccccgcactcagctcaccgcaccctcagcgcgcg

SEQ ID NO: 3 - DNA, 2 bp, Homo sapiens
cg

SEQ ID NO: 4 - DNA, 2 bp, Homo sapiens
cg

SEQ ID NO: 5 - DNA, 2 bp, Homo sapiens
cg

SEQ ID NO: 6 - DNA, 2 bp, Homo sapiens
cg

SEQ ID NO: 7 - DNA, 2 bp, Homo sapiens
cg

SEQ ID NO: 8 - DNA, 2 bp, Homo sapiens
cg

SEQ ID NO: 9 - DNA, 14 bp, Homo sapiens
cgcgtctcagcgcg

SEQ ID NO: 10 - DNA, 2 bp, Homo sapiens
cg

SEQ ID NO: 11 - DNA, 2 bp, Homo sapiens
cg

SEQ ID NO: 12 - DNA, 2 bp, Homo sapiens
cg

SEQ ID NO: 13 - DNA, 125 bp, Homo sapiens
cggctccacttacctgctccgaagagtggccccagctctgcgcctcttcctgcgaccccacacacagggacagccccaggcacagccccagcagcaggagcatggcggggcgagggcgcgggacg

SEQ ID NO: 14 - DNA, 2 bp, Homo sapiens
cg

SEQ ID NO: 15 - DNA, 131 bp, Homo sapiens
cggggtgtgaagtggcggcgggcagaggggctcgcaggggctgggatccgcgtgcccctctctgcctcggtgcggagcacgatgtgcccgggcgggggcgaggacgtccgggaggggctgggctgcgcacg

SEQ ID NO: 16 - DNA, 94 bp, Homo sapiens
cgggcctgtcctcggctccgctcggagggtgtgcgggttcccgctccgctggccccgcttgcccaccacggcgcgcccaaacccacgcggcccg

SEQ ID NO: 17 - DNA, 2 bp, Homo sapiens
cg

SEQ ID NO: 18 - DNA, 2 bp, Homo sapiens
cg

SEQ ID NO: 19 - DNA, 27 bp, Homo sapiens
cgcgatggggaggggaatacttgcgcg

SEQ ID NO: 20 - DNA, 164 bp, Homo sapiens
cgagattagaggggaaatccgaaaaagcaagcccctgcggcagcagccaggaaacactcgccaggaactggctgcgaccccaactccagcggtccgaagccctagcctccccacccccaccgcggcagagccgccttcgcagacacctcccgaggagaatcgcg

SEQ ID NO: 21 - DNA, 2 bp, Homo sapiens
cg

SEQ ID NO: 22 - DNA, 2 bp, Homo sapiens
cg

SEQ ID NO: 23 - DNA, 68 bp, Homo sapiens
cgctgggcccgccgaggtcggggctttcccatgggagggaggtggctgcggcggaattttcagatgcg

SEQ ID NO: 24 - DNA, 508 bp, Homo sapiens
cggcggcagcgggagcccgagcgctgcgcgcccaccatggccgcccagggagagcccggctacctggcggcgcagtcggaccccggctccaacagcgagcgcagcaccgactccccagtgcccggctccgaggacgacttggtcgccggggcgaccctgcacagcccggagtggagcgaggagcgcttccgcgtggacaggaagaaacttgaggccatgttacaaggtaggcatccctcgtgttctcggactctccgactgagcctctaactccttttcggacatccccaccgcgcgctccggcgcccgctactccagcctacggccggccggtttagctccaggcccgctcccccgcggagccggaggacacccagggactggagacttcgcgggactccccacccttccacgcctctcagatttccaggcgctgggggccctgtgcgaacttgactggcttcagaaaagccgaaggccgagtttgtactggcgcgcccaagttgcg

SEQ ID NO: 25 - DNA, 2 bp, Homo sapiens
cg

SEQ ID NO: 26 - DNA, 2 bp, Homo sapiens
cg

SEQ ID NO: 27 - DNA, 2 bp, Homo sapiens
cg

SEQ ID NO: 28 - DNA, 2 bp, Homo sapiens
cg

SEQ ID NO: 29 - DNA, 4 bp, Homo sapiens
cgcg

SEQ ID NO: 30 - DNA, 2 bp, Homo sapiens
cg

SEQ ID NO: 31 - DNA, 2 bp, Homo sapiens
cg

SEQ ID NO: 32 - DNA, 9 bp, Homo sapiens
cgtgcagcg

SEQ ID NO: 33 - DNA, 2 bp, Homo sapiens
cg

SEQ ID NO: 34 - DNA, 2 bp, Homo sapiens
cg

SEQ ID NO: 35 - DNA, 396 bp, Homo sapiens
cgaggacgaggaggaagaggaggaggaagaagaagaagaggaagaggaggaggaggaggaggaggacgcgtctaggctgagatggttcgcgtggatattgctactcattctaagactgctgcctccgccgccgccgccgccgccgctgctgccgccgccgccgccgccaccatttgccatagctagcaacgggcagccggcgcaggggctcgggggagctcctcccgccgccagcgccaccccaaacacccatcaacagccatattgctgctactgctgccgccgccgccgccgccgcggagcgcgggaggggggcggggaggcgcctgggctcggggcgctgtgcgcgacctggcggggtgcgccgagatatatacagcgagccgccgccgcccg

SEQ ID NO: 36 - DNA, 2 bp, Homo sapiens
cg

SEQ ID NO: 37 - DNA, 70 bp, Homo sapiens
cgggccgccatttgtctacttgtcccatccaggacatctccctaaataatctctaagtggaaaaatcacg

SEQ ID NO: 38 - DNA, 2 bp, Homo sapiens
cg

SEQ ID NO: 39 - DNA, 68 bp, Homo sapiens
cgcgggggacgcggggcgcggcgcgctgagcgcgggtgccgaggctggagggcgcggccgggctcccg

SEQ ID NO: 40 - DNA, 88 bp, Homo sapiens
cgagggtcggctcgctcctggggacccgcggatgtcgcgagggggcgccgcgccactgaaggctgggacgggggcggtgcgcggggcg

SEQ ID NO: 41 - DNA, 2 bp, Homo sapiens
cg

SEQ ID NO: 42 - DNA, 2 bp, Homo sapiens
cg

SEQ ID NO: 43 - DNA, 87 bp, Homo sapiens
cgagttgctccgtttcctcattttgggggcgaagaagggtcggggagtgggggaaagcgggaggcgccgcggcctgggaggcccccg

SEQ ID NO: 44 - DNA, 45 bp, Homo sapiens
cgagcttctgcgctgcctctgtcgtcggagcccgggtttgccacg

SEQ ID NO: 45 - DNA, 2 bp, Homo sapiens
cg

SEQ ID NO: 46 - DNA, 173 bp, Homo sapiens
cggttggaattctcttaagcattgccctgagtctattttcaaatgaaagggggaaaaacccaaaccagattagaatctgaaacagctgaaacagctatcgatttccagcttgctttcaagtctggcagagactgtgaaagtcctaacttctccgcgatgtcagccacggcccg

SEQ ID NO: 47 - DNA, 2 bp, Homo sapiens
cg

SEQ ID NO: 48 - DNA, 48 bp, Homo sapiens
cgaagacgagacgcagagctccaactgcagccagagacaaaggccccg

SEQ ID NO: 49 - DNA, 2 bp, Homo sapiens
cg

SEQ ID NO: 50 - DNA, 2 bp, Homo sapiens
cg

SEQ ID NO: 51 - DNA, 36 bp, Homo sapiens
cgaccgtggcgccagcttcccgccccctctgccccg

SEQ ID NO: 52 - DNA, 2 bp, Homo sapiens
cg

SEQ ID NO: 53 - DNA, 2 bp, Homo sapiens
cg

SEQ ID NO: 54 - DNA, 2 bp, Homo sapiens
cg

SEQ ID NO: 55 - DNA, 2 bp, Homo sapiens
cg

SEQ ID NO: 56 - DNA, 2 bp, Homo sapiens
cg

SEQ ID NO: 57 - DNA, 97 bp, Homo sapiens
cgcttgcaaggacgggagtcggggagggtgtagggcgagtttaaaggacgggcagagcaagccccgggaagaggcaggggttttccctcccgggtcg

SEQ ID NO: 58 - DNA, 2 bp, Homo sapiens
cg

SEQ ID NO: 59 - DNA, 2 bp, Homo sapiens
cg

SEQ ID NO: 60 - DNA, 67 bp, Homo sapiens
cgccagactctcacagtccttcacacgccactcccactgcctcagggaaccacaagcacaggcatcg

SEQ ID NO: 61 - DNA, 2 bp, Homo sapiens
cg

SEQ ID NO: 62 - DNA, 29 bp, Homo sapiens
cgacagggcagagggtcagcagtcacccg

SEQ ID NO: 63 - DNA, 49 bp, Homo sapiens
cggccgagcctaagtggctgaagcgcggacgaggatgcgcggggcctcg

SEQ ID NO: 64 - DNA, 188 bp, Homo sapiens
cgggagctcgaagtcgcctcgagcgggggtgggcggtgagcggacccccgggtgttgaccaggtgtttggtggtagagcagggaaggggggaacggacgtcgaccctagggatccctcacccgctcacgctccttggcgttggccacacgccgccgctccagcaccaactggaggttttcagtggacg

SEQ ID NO: 65 - DNA, 4 bp, Homo sapiens
cgcg

SEQ ID NO: 66 - DNA, 4 bp, Homo sapiens
cgcg

SEQ ID NO: 67 - DNA, 113 bp, Homo sapiens
cggccgtgggcggctgcggcgcggccgcggcgaggggcgagcggggctggtctcgccgctcgggcgagagcatccctttgggggccaaccctgcggctccgccttcacccgcg

SEQ ID NO: 68 - DNA, 208 bp, Homo sapiens
cggcggatggagacgggagggaggctgcgaggtcgctcgaggagagactaaggctctagaaacggagaagcgggcgctctgcgggaggcggcggcgctgccgctggccgtcaagggcgggaagtgttctgggactctcattaggggccgcgagcctcgagcgtcaaattcccgcggcgtccgcctagcgcgctgctgtggcgggcgcg

SEQ ID NO: 69 - DNA, 96 bp, Homo sapiens
cggcccgcccgcccctcagcagccctggggtgcccggggcggccctgcaagcgggagagagcggcgaggcggcggcgccgagtgcggggggatgcg

SEQ ID NO: 70 - DNA, 236 bp, Homo sapiens
cggtgagtacccgccgtggggaagggtcctggggacccactggaggccgcggcccgcagcagccaggggccgagccacggccacggacgccctggtgtcccggtccgtgccgggcctccaggcggaggaggcgtccgctgggctcagatccccgactccagccccggttccccggcgcctgggctgcgcggagtccctgtcccgcgtcccggacccctacgcgcagcctccacgcg

SEQ ID NO: 71 - DNA, 211 bp, Homo sapiens
cgcccccagccgtgtcctggctgcgcagctggaaaggttgagcagctcactgctgtccctctgttcggccttggacacatcgcctgaactcctgggcgcctctgctgttaagtgggggacagcactatttactggggaggaaaactccaggaatgtggaccctggggccacgcaggggttgggaagtgaagggcagggaacgcgggcggcg

SEQ ID NO: 72 - DNA, 193 bp, Homo sapiens
cgcgcgccgaagctgtgacggtttactaagcagagacttgcgaggcacacagagagggaatgaggcggaaccgttcgggggctcgttgacactgcagagcctcccgcagcatcgctgccttaaatcccgcctttccaggcgtgcgcgcacagcgagccagaggaggctccgtcccgacctggggtcccccgcg

SEQ ID NO: 73 - DNA, 4 bp, Homo sapiens
cgcg

SEQ ID NO: 74 - DNA, 199 bp, Homo sapiens
cgagcaggaggatctaacgaatccagcttgtggacatgccctaatttccatttccgcctcctccaggtctgttcaggtgaggatgatgggagggaaaagcggtgtacagccgtaacattggcaccctgcaagagccgccggggcactgacacagagggacaccgcattggagatgcggtgtctacggagatttattgcg

SEQ ID NO: 75 - DNA, 87 bp, Homo sapiens
cggctagcagaggcggcgcctggtcttggatgctgcagcggagacgccaaggagactgaatgcagggagcgaggcgtagcggccgcg

SEQ ID NO: 76 - DNA, 68 bp, Homo sapiens
cgcgcgagagtgcccagctgggaaatgcagctccgaattaacatcgtatgtttcataatcagtttacg

SEQ ID NO: 77 - DNA, 61 bp, Homo sapiens
cgcccctggcattcagggaatggtttgcaaatctcaatgcaccacagactagttttcaccg

SEQ ID NO: 78 - DNA, 40 bp, Homo sapiens
cgggtgctttgccgctgccgcttctgctgccgccgatccg

SEQ ID NO: 79 - DNA, 647 bp, Homo sapiens
cgagcggcgaggcgagggcgagcgcgccgaggaagggcgggagaggcgcggagcttggccgcgccgcgctgcgccgagcgccgggctctccccgcgagctccccgggcccgcgcgcgcgccccccactgcccccgccccccgcgcggcgcgtgccccccaccccccgccgcgcgccctcgcacccgcccggctccacgcggcgcgcgcctgccctggcggcagcggcggcggcggcggcgcgtcctcccccgaacgccgtctccagggctgctggctgcgctctccattgttccgcggctgctgcccggggtgggcggcgaggcgggggggaggtgtcggcttggccgccggggagggcttaccgctcgggcggaccctcactgcgagagcgatgcgggcccaggcgcggcgcgcgggggctgcagggcgcctagcactgggggttgccggcgcgcgggggcctcctcctggctcccaggcactcgctgctgctgggcgcccctcgcatcctcggttactatggatatctcgctcctccgccgccccctccgcgcactccgggaggccgccggggcggtagcagcggcgcggctccgcgggtgcccaggtgaccggctcggcagcggcagagcagtggcagcagccg

SEQ ID NO: 80 - DNA, 327 bp, Homo sapiens
cgcggaggagggtcgggctgactgccgccgctgagctgtccccggacgggagcgcctgtccacggcactcaccccctccagcggtggaaatgtggagaagtaagtgggaggcggtgtcgggaactgactcctcttaaaacggtcggcgccgctgctctgaaatgggcggctaagtgcttgtgggactaagggcggcctcagagatgcccggaaaatcgctgccacggccagagtgcggcgcagacgcggcagagttggaggtgtccgcggtgcaggctgctgcccacgccgctcaggccaggtgctgagggctcagcccgcgcctcg

SEQ ID NO: 81 - DNA, 2 bp, Homo sapiens
cg

SEQ ID NO: 82 - DNA, 324 bp, Homo sapiens
cgcagctgctgcagccgctgcggctgccgccatctggcaggaggcatagggcatgggtgagggaggctgcggtagcggccacgagttgttgaggaagccagactgcaggtacttggggggcgccaggtagccgtagccgtcggccccggcgcccgccacgccgcacccgcctgcggcgcctccggccccgaagagccccttgccgggctggaagtgcgcgggcggcggccggaagggcctcttcatgcggcggcggcgccggtagttgcccttctcgaacatgtcttcgcaggccgggtccagcgtccagtagttgcccttgcg

SEQ ID NO: 83 - DNA, 77 bp, Homo sapiens
cggcgcagcggcgggaacccgaggccgagcgccgcggcggcagcgctagaagcgcacccatcgggcacggcgaggcg

SEQ ID NO: 84 - DNA, 158 bp, Homo sapiens
cgccctggattcccgaagtcagttccctgcgcagcggaccagagaggtccacccgcggacgtcaactcaacccctgggcggggtccgggggctgagcagaaggcgaggtctggggagtacggacaactttgagggctgtctgtgccggggtgggagcg

SEQ ID NO: 85 - DNA, 79 bp, Homo sapiens
cgctcctaaaaattaaataaatcaataagagaatcaattaataggcagcgctgcgaccgccaggagcgcggagcgcgcg

SEQ ID NO: 86 - DNA, 137 bp, Homo sapiens
cgtctcctctgacccccaaggtcagaaagatttattacttccttcgagagggcgcagccacagacccactagagagggcgggcagggtgtcggaagccagagaacggcgctccgcgtcctcccaccgctccagggcg

SEQ ID NO: 87 - DNA, 112 bp, Homo sapiens
cgcgggctatgcactgctgctggtgctcactatgctcaacctcctggactacaagtggcacaaggagccgctgcagcagtgcaaccccgatgggccgctgggtgccgcagcg

SEQ ID NO: 88 - DNA, 2 bp, Homo sapiens
cg

SEQ ID NO: 89 - DNA, 2 bp, Homo sapiens
cg

SEQ ID NO: 90 - DNA, 282 bp, Homo sapiens
cgtgggcagggcgccgcagcctgcgcagccccgaggaccccgcgtcgctctcccgagccagggttctcaggagcgggccgcgcaggagacgttagagggggttgttagcggctgttgggagaacgggtcacggaaacagtcccttccaaagccggggccatcgtggggtgggcgagtccgccctcccaggccgggggcgcggaccagaggggacgtgtgcagacggccgcggtcagccccacctcgcccgggcggagacgcacagctggagctggagggccg

SEQ ID NO: 91 - DNA, 81 bp, Homo sapiens
cggctgccaactcgcccaacttgctgcgcgggtggccgctcagagccgcgggcttgcggggcgccccccgccgccgcgccg

SEQ ID NO: 92 - DNA, 53 bp, Homo sapiens
cggccgtggagaccctaaccgagctcacgctggcgcaaaaggcaaaagccgcg

SEQ ID NO: 93 - DNA, 40 bp, Homo sapiens
cgcgccgagggggcgccagcggggacgtgagctggcgccg

SEQ ID NO: 94 - DNA, 206 bp, Homo sapiens
cggcagcctgagcgccccggatggcccgcggcggggcggcctgcaagagcgacgcgcggctgctgctggggcgggacgcgctgcggccggcgcccgccctgctggcccccgccgtgctgctgggcgccgcgctcggcctcggcctcggcctttggcttggctgccgcgcgggccgccagcgcacgcgacaccaggtgggtcggccg

SEQ ID NO: 95 - DNA, 38 bp, Homo sapiens
cgagggcacggcggccgccgccccgcgcagcagcagcg

SEQ ID NO: 96 - DNA, 5 bp, Homo sapiens
cggcg

SEQ ID NO: 97 - DNA, 25 bp, Homo sapiens
cgagcgaatgcaacgcgtacacacg

SEQ ID NO: 98 - DNA, 79 bp, Homo sapiens
cgcctctctctttttttaaaaaaaaaatttaaacaattcccaaataatatttaataggaaagaagaaggaaaaggagcg

SEQ ID NO: 99 - DNA, 33 bp, Homo sapiens
cgagggcaacggccgaggcgccacgcggggccg

SEQ ID NO: 100 - DNA, 132 bp, Homo sapiens
cgcaggccaggcggtcgtgggccgagctggccatgaccacctccccgcgggcgtcctgcttgggcgagtgctctccgtagcgcccgcactccgtcttctccgtgtgcagctccgcgccgccgccgcccgccg

SEQ ID NO: 101 - DNA, 32 bp, Homo sapiens
cgccctcggggcagaggagggggtgccaggcg

SEQ ID NO: 102 - DNA, 2 bp, Homo sapiens
cg

SEQ ID NO: 103 - DNA, 2 bp, Homo sapiens
cg

SEQ ID NO: 104 - DNA, 20 bp, Homo sapiens
cggcgccgctggcatactcg

SEQ ID NO: 105 - DNA, 85 bp, Homo sapiens
cggcgggcgcaggggcagggcatgactgacgcgccctctgcctgcgcttatgtgagagaaagcggccgagggagggagcgtgccg

SEQ ID NO: 106 - DNA, 230 bp, Homo sapiens
cgcaggggccgagaaagtggcggagaggcggtggccgaggcccaggggcgagcgcgggctgagctggtccctgctgcgttcacgagcgacacccaccccttcgctgcggacgccccgcgggcgccaggctgggggccctgcgaccgacccctcccgcccccgaggtaccgccgggcccgcctggcaggcagcgcgtcccgcgagctggagggccgagtttcgcggggccg

SEQ ID NO: 107 - DNA, 84 bp, Homo sapiens
cgcaagagctggtcaaaatgccctcaggtgcgtgggggcttcggggccttagttggagcccgacaccctgagactggcggcccg

SEQ ID NO: 108 - DNA, 42 bp, Homo sapiens
cgcgcgagcttttccgtttggctgagtcaaaaagggatcgcg

SEQ ID NO: 109 - DNA, 45 bp, Homo sapiens
cggacgactctttctaccctttcgaggacgaggaggagcacggcg

SEQ ID NO: 110 - DNA, 26 bp, Homo sapiens
cgcgggacaagggatgctggcgggcg

SEQ ID NO: 111 - DNA, 50 bp, Homo sapiens
cgaggctcctcccgcggcgcgcggcagcctcagcctccacctaaacctcg

SEQ ID NO: 112 - DNA, 56 bp, Homo sapiens
cgctggcccacccgcgtgcacgcccaccccccacgcgcgtccctggctcagaagcg

SEQ ID NO: 113 - DNA, 44 bp, Homo sapiens
cgagcgtgtgcgcgcgcgaggggagcgcgtgcgcggtgaggacg

SEQ ID NO: 114 - DNA, 2 bp, Homo sapiens
cg

SEQ ID NO: 115 - DNA, 9 bp, Homo sapiens
cggaaggcg

SEQ ID NO: 116 - DNA, 58 bp, Homo sapiens
cgcccgcctacccgccaggcaggcggtggtgtcgatccacttgagcagctgccccgcg

SEQ ID NO: 117 - DNA, 151 bp, Homo sapiens
cgcactggcttcccccgctcccgcccgcacgaaagccctgcccgacgtctgcagtcagcatcgcccgcactgcctagggagggtttgcgccgagacccagtggccgagtgagccacagagtcgctggtcctggggacgctgtcttctaccg

SEQ ID NO: 118 - DNA, 17 bp, Homo sapiens
cggtcctggggagtccg

SEQ ID NO: 119 - DNA, 70 bp, Homo sapiens
cgcagaggggccagcaattccatgggtggtggggccctccatccctggacgcagcggggagcagcgggcg

SEQ ID NO: 120 - DNA, 59 bp, Homo sapiens
cggcgcccagcgcccaagcgctaacccgctgaaagtttctcagcgaaatctcagggacg

SEQ ID NO: 121 - DNA, 25 bp, Homo sapiens
cggctcggatagaggttacccagcg

SEQ ID NO: 122 - DNA, 57 bp, Homo sapiens
cgtcttccgctacctgacaccagccaggcagcccccagggccagagcgtcagcgccg

SEQ ID NO: 123 - DNA, 111 bp, Homo sapiens
cgttcagggttggggctcggtgggaacctccccgtgcccgaagggacgaccccgtcagagagtcccccgacccttgcacctaccgtccttggcaggacgtggagctgctcg

SEQ ID NO: 124 - DNA, 211 bp, Homo sapiens
cgctactgtcgtcgttggcgctttgcttctggaacctcccagcaagatggcactcactgtctgttcccttccgattagcacccccagccgcgctccctcctccccgggatacgtattagtcacatactgtggggagaagatgggctatgtaaatgtaagtcaacgcgctttcccagccacctttgcataatgcaacaggaacagcgacccg

SEQ ID NO: 125 - DNA, 75 bp, Homo sapiens
cgctcctactactctttcaaacactgcagcaagttgcagcaaggcgggcaaataccgacagcgcgcgtgggggcg

SEQ ID NO: 126 - DNA, 2 bp, Homo sapiens
cg

SEQ ID NO: 127 - DNA, 66 bp, Homo sapiens
cggccacctgtcctccgccctcggggcgccgcccagcttcgcgccaggcgccttctccagcgcccg

SEQ ID NO: 128 - DNA, 2 bp, Homo sapiens
cg

SEQ ID NO: 129 - DNA, 163 bp, Homo sapiens
cgcgcgctcctcggcgggtcggcgggtccggaagctccgctgcccgggccgggtccccaagcccgcagccgctttgactaaaataggcatcgcgacggcggcggcaggcggcggcagccagggctggggccgcaccgcgcacgcgcatgcgcccgccgccccg

SEQ ID NO: 130 - DNA, 99 bp, Homo sapiens
cgcttctgccctggagcgcggtcgggagtaaaatcgcaggagtgggagggtagcgagccagctggattccgagccgcggagcgcgctggctttgctccg

SEQ ID NO: 131 - DNA, 96 bp, Homo sapiens
cgcgcctccgcaggcggcactgcccgcggcgcggcgtgtgcaccgagcgagtgaaggtatgtgtggcgggcgcggctggagctgccgccgccgccg

SEQ ID NO: 132 - DNA, 4 bp, Homo sapiens
cgcg

SEQ ID NO: 133 - DNA, 16 bp, Homo sapiens
cggcgagattggcacg

SEQ ID NO: 134 - DNA, 2 bp, Homo sapiens
cg

SEQ ID NO: 135 - DNA, 141 bp, Homo sapiens
cgcggctgatggctgacgcgctgcgcggctgcgtgcctgccttccacggcgtggtggagcgcgacggcgaaagctacctgcagctgcaggacctgctcgatggcttcgacggaccttgtgtgctcgactgcaaaatgggcg

SEQ ID NO: 136 - DNA, 2 bp, Homo sapiens
cg

SEQ ID NO: 137 - DNA, 37 bp, Homo sapiens
cgttcccaaccaaccgcacaaaacccgcaacacctcg

SEQ ID NO: 138 - DNA, 52 bp, Homo sapiens
cgggtcggggcacttggcgccctgtgtgggtggcgggagcggggacgcctcg

SEQ ID NO: 139 - DNA, 2 bp, Homo sapiens
cg

SEQ ID NO: 140 - DNA, 7 bp, Homo sapiens
cggagcg

SEQ ID NO: 141 - DNA, 2 bp, Homo sapiens
cg

SEQ ID NO: 142 - DNA, 4 bp, Homo sapiens
cgcg

SEQ ID NO: 143 - DNA, 17 bp, Homo sapiens
cgagttggggcgggacg

SEQ ID NO: 144 - DNA, 136 bp, Homo sapiens
cgcgagtcccctgacgcggggaccagttatgaatcgggggtgtgtgtttgcctccagagacctggcaaggtgcggagccctccagaagtgcggtcaagcggcagcggagacggcgagccaggaacctccccccgcg

SEQ ID NO: 145 - DNA, 31 bp, Homo sapiens
cgcgcccagcgccccgctcactccctggccg

SEQ ID NO: 146 - DNA, 25 bp, Homo sapiens
cgtgcaccctgaggtctggttggcg

SEQ ID NO: 147 - DNA, 12 bp, Homo sapiens
cgttgacgagcg

SEQ ID NO: 148 - DNA, 6 bp, Homo sapiens
cgtacg

SEQ ID NO: 149 - DNA, 199 bp, Homo sapiens
cgcgcccgcggccgcggccgctgcatggcgctgagatggcgggggcgccgcgcggcggaggcggcggcggaggcggcgcgggcgagcccgggggcgccgagcgggcggccgggacaagccgccggcgcgggctccgggcgtgcgacgaggagttcgcttgcccagagctggaggcgctgttccgcggctacacgctgcg

SEQ ID NO: 150 - DNA, 91 bp, Homo sapiens
cggccccgggtgcagggtggcgggcccggcggcgcgcgtccccctccccctcctggcggcccgcacgtgtcgcccgcgccgcgcccccacg

SEQ ID NO: 151 - DNA, 108 bp, Homo sapiens
cgcgtctccactgttccatctcctccgttcctggagttcctcggtgactctactatagcttctgttatcctgtgacctgcaggtactgggagatccatagggaggacg

SEQ ID NO: 152 - DNA, 13 bp, Homo sapiens
cgcaccgatttcg

SEQ ID NO: 153 - DNA, 176 bp, Homo sapiens
cggcccgctgggcaaggcgtccgagaaagcgcctggcgggaggaggtgcgcggctttctgctccaggcggcccgggtgcccgctttatgcggggcgagcgtccggccgacccccgccggggcggagcctgaggggtggctgattcatgcacggggactgtcaccccgccgcccccg

SEQ ID NO: 154 - DNA, 2 bp, Homo sapiens
cg

SEQ ID NO: 155 - DNA, 157 bp, Homo sapiens
cgagaagttccgcgggagacggcggctcccaaagttactttgggccgcgggagcgcgggaccggggctgcgggcgccgagagcgcgtcgtctgccgcctccgtgcgccgccgccgcctctgcgcgacgcccctcggccaggcctgggaaagcgcccg

SEQ ID NO: 156 - DNA, 66 bp, Homo sapiens
cgcgaaccgctaggggccctcgcgctcccttcccacccaggccccctgtccctcccgccgcggccg

SEQ ID NO: 157 - DNA, 498 bp, Homo sapiens
cgccgccgcgccgaccggccgcgcccccgggaccccctgggccggccgcgcccccggccccctctcccgccgcgcctgtgcgcacgcgcagacgccgcaagctctacgagctgcacgcggccggcgccccgccccccccgccgcccggccacgcccccgcgcccgagtcgccgcggcccggaagcggaagcggaagcggccccggcctcgcccctgcgcgctcgcccggccccgcggccgacggccccatcgacctgagcaagaagccgcggcgcccgctccccggagccccggcaccggcgctggccgactaccacgagtgcacggcctgccgcgtgagcttccacagcctcgaggcctacctggcgcacaagaagtactcgtgccccgctgcgccaccgcccggcgcgctcggcctgcccgccgccgcctgcccctactgccccccgaacggcccggtgcgcggggacctgctggagcatttccgcctggcgcacg

SEQ ID NO: 158 - DNA, 27 bp, Homo sapiens
cgcgggtccgaacgcccttcgcgctcg

SEQ ID NO: 159 - DNA, 2 bp, Homo sapiens
cg

SEQ ID NO: 160 - DNA, 2 bp, Homo sapiens
cg

SEQ ID NO: 161 - DNA, 16 bp, Homo sapiens
cgtcgcctgcctcgcg

SEQ ID NO: 162 - DNA, 53 bp, Homo sapiens
cgcggagggcgccgaatcagagcctgcggggcttgacagcttctcttgcggcg

SEQ ID NO: 163 - DNA, 4 bp, Homo sapiens
cgcg

SEQ ID NO: 164 - DNA, 2 bp, Homo sapiens
cg

SEQ ID NO: 165 - DNA, 2 bp, Homo sapiens
cg

SEQ ID NO: 166 - DNA, 2 bp, Homo sapiens
cg

SEQ ID NO: 167 - DNA, 14 bp, Homo sapiens
cgtgtccacctacg

SEQ ID NO: 168 - DNA, 186 bp, Homo sapiens
cggcgggaaggcctgggtgttcacagatagagctggagttccccggtgggtggcacagacaattagctggggctgcctcacatgtaatctaattacaggggaaacaggctcaaacaccgggtgataagcagcgcaactgtttcgggtgactctgtaatttttcctccattaattttctccataacg

SEQ ID NO: 169 - DNA, 79 bp, Homo sapiens
cggggtacgctcgccctcggcggggcccctcgctccgctgtgggagtggcagtgggtgtcggggtggagaaagtacgcg

SEQ ID NO: 170 - DNA, 49 bp, Homo sapiens
cgccgcgtccgcgccgcgctccctgcaggcaacgggagacgcccccgcg

SEQ ID NO: 171 - DNA, 17 bp, Homo sapiens
cggatgaaccgttcgcg

SEQ ID NO: 172 - DNA, 2 bp, Homo sapiens
cg

SEQ ID NO: 173 - DNA, 9 bp, Homo sapiens
cgggccacg

SEQ ID NO: 174 - DNA, 2 bp, Homo sapiens
cg

SEQ ID NO: 175 - DNA, 165 bp, Homo sapiens
cgggaacgctgcagtttggttgagcgtgacttttaggctctgtgaggaaaagtcgagcgcgccacatcgaggcgctagccgtttattctaccacaaggtaaaagattcatgctgtcctagttaccctaaagctgggagatacactgcacttcctaccagaccccg

SEQ ID NO: 176 - DNA, 14 bp, Homo sapiens
cgcgcgggtcagcg

SEQ ID NO: 177 - DNA, 2 bp, Homo sapiens
cg

SEQ ID NO: 178 - DNA, 2 bp, Homo sapiens
cg

SEQ ID NO: 179 - DNA, 97 bp, Homo sapiens
cgtgtgcccagggccagcagcacgcacaagtgccagcgcacggccgccgcgcccatgctcaatgcgggccccgctgggcgtgcgggcgtgcggggcg

SEQ ID NO: 180 - DNA, 2 bp, Homo sapiens
cg

SEQ ID NO: 181 - DNA, 98 bp, Homo sapiens
cgcggatcgcgcgctcccgccgctctgcccctaaacttctgccgtagctccctttcaagccagcgaatttattccttaaaaccagaaactgaacctcg

SEQ ID NO: 182 - DNA, 69 bp, Homo sapiens
cggaggggcggaggaggtgctggcggcggcactgagcggcggcggcgcagggcgcgcgggccttccgcg

SEQ ID NO: 183 - DNA, 2 bp, Homo sapiens
cg

SEQ ID NO: 184 - DNA, 2 bp, Homo sapiens
cg

SEQ ID NO: 185 - DNA, 2 bp, Homo sapiens
cg

SEQ ID NO: 186 - DNA, 2 bp, Homo sapiens
cg

SEQ ID NO: 187 - DNA, 103 bp, Homo sapiens
cggccccaggacggcagggaccgcgatggagcggcttcgggggcggccgggggacggcgcggtggcggtcggccagcccgctcctccgggggcggcgggcgcg

SEQ ID NO: 188 - DNA, 2 bp, Homo sapiens
cg

SEQ ID NO: 189 - DNA, 21 bp, Homo sapiens
cggctctcggcggcggcggcg

SEQ ID NO: 190 - DNA, 148 bp, Homo sapiens
cggcgcctcaaaggggaggaccctgcggcgcgggtaagaggcggcgggagcgcgcggcccgggagtgtggctgcagtgcgccgggacaccagggctccgcgctccgcactcaagaggctcccgcgtcccaacccctcgcgcccgcgcg

SEQ ID NO: 191 - DNA, 2 bp, Homo sapiens
cg

SEQ ID NO: 192 - DNA, 2 bp, Homo sapiens
cg

SEQ ID NO: 193 - DNA, 26 bp, Homo sapiens
cgccgagaggcagcgcgtgatggccg

SEQ ID NO: 194 - DNA, 119 bp, Homo sapiens
cgcacgcccaagtgcgcgcgctgccgcaaccatggcgtcctgtcctggctcaagggccacaagcgttactgccgcttcaaggactgcacctgcgagaagtgcatcctcatcatcgagcg

SEQ ID NO: 195 - DNA, 66 bp, Homo sapiens
cggcccgacctttcccgcccagcctgggtcagaggaagccgaaagcggcctcagcaaggtgaggcg

SEQ ID NO: 196 - DNA, 60 bp, Homo sapiens
cgagcgaagtcgtcgtgtctgggcagaaggcgctccaggaggcgcgaggccccagccgcg

SEQ ID NO: 197 - DNA, 2 bp, Homo sapiens
cg

SEQ ID NO: 198 - DNA, 124 bp, Homo sapiens
cgctcggagcgggacctgcttgctccagtgcacgccgcggagcgaaccatcgggctggcgggggtggaggggtgcaggcgtgggggctgcgggccgctcgggccttgggcttctcctgccgccg

SEQ ID NO: 199 - DNA, 2 bp, Homo sapiens
cg

SEQ ID NO: 200 - DNA, 156 bp, Homo sapiens
cggggcaccgcggcgctcgccgccgcctccccgcaggtgatcatcctcctgcaggtgtcctcgggtctcaggtggctgcgtgtctgcgccatggttgacattctgggcgagcggcacctggtgacctgtaagggcgcgacggtggaggccgaggcg

SEQ ID NO: 201 - DNA, 2 bp, Homo sapiens
cg

SEQ ID NO: 202 - DNA, 91 bp, Homo sapiens
cgcgcgccgccgaaaccttgcctccgccgccgctcaccgacaggctgtggagaaggtcatcgaccgatgtcaccgagtcattcctgaagcg

SEQ ID NO: 203 - DNA, 2 bp, Homo sapiens
cg

SEQ ID NO: 204 - DNA, 2 bp, Homo sapiens
cg

SEQ ID NO: 205 - DNA, 89 bp, Homo sapiens
cgttactcgcgtgccagcagttgggcgctccgacctctcagaccgcgtgagcccagcaaagcggttaggcgcgcgcctgcagctcggcg

SEQ ID NO: 206 - DNA, 13 bp, Homo sapiens
cgtctttaatccg

SEQ ID NO: 207 - DNA, 2 bp, Homo sapiens
cg

SEQ ID NO: 208 - DNA, 47 bp, Homo sapiens
cgagcgccagaccccagcaacaaaaggccaggcgaggccacatcgcg

SEQ ID NO: 209 - DNA, 2 bp, Homo sapiens
cg

SEQ ID NO: 210 - DNA, 2 bp, Homo sapiens
cg

SEQ ID NO: 211 - DNA, 159 bp, Homo sapiens
cgatgcccgcggcgtgaaagcgcccgcggcgggcgccgacctctgtcctagtctcctgctccccccgccccgcttgtcccgtgcccttgtgaccctggctttggcgccgtcgcccaggcgccccgcaatgtagctgcccctgcgcctcggcgggaggcg

SEQ ID NO: 212 - DNA, 2 bp, Homo sapiens
cg

SEQ ID NO: 213 - DNA, 2 bp, Homo sapiens
cg

SEQ ID NO: 214 - DNA, 2 bp, Homo sapiens
cg

SEQ ID NO: 215 - DNA, 78 bp, Homo sapiens
cgggcgccgaggcttgggctttagccgtggcgctcgcctcggcgcagtggggagccgcgggcgtcggagaagcggccg

SEQ ID NO: 216 - DNA, 2 bp, Homo sapiens
cg

SEQ ID NO: 217 - DNA, 48 bp, Homo sapiens
cgcggaggagtttcgcacccgaccgtgcacagcgaccgagttggcgcg

SEQ ID NO: 218 - DNA, 2 bp, Homo sapiens
cg

SEQ ID NO: 219 - DNA, 2 bp, Homo sapiens
cg

SEQ ID NO: 220 - DNA, 2 bp, Homo sapiens
cg

SEQ ID NO: 221 - DNA, 157 bp, Homo sapiens
cgcttctatagttttgctttgacagctaaggaaaaaatctgccaaaaaccagaggcgctgctgagtgttggcgtgggaatgctagtttagtcagagccttgctctgggccatttaaataaaaacagacatgttggtggcaaatgccagttgaacacg

SEQ ID NO: 222 - DNA, 2 bp, Homo sapiens
cg

SEQ ID NO: 223 - DNA, 82 bp, Homo sapiens
cgcgcgccagtttcccgccccgtggaagcgcccctctcccgacttcggctgatccccgctcgccgccctccccgcgggtgcg

SEQ ID NO: 224 - DNA, 23 bp, Homo sapiens
cgcctggccgcctcacctggccg

SEQ ID NO: 225 - DNA, 38 bp, Homo sapiens
cgagttcccgcgcgtctacgagcagctttgcgagttcg

SEQ ID NO: 226 - DNA, 2 bp, Homo sapiens
gg

SEQ ID NO: 227 - DNA, 165 bp, Homo sapiens
cgtgccctcctccagcgagcgcagcgagttgttcctgaagtccaggtagaccaggtcgccgtagaagatgaagaagtcctcggggatccgctggatgcggttgccggccaccagcagcttgcgcacgtccagggggaaagggtctggcacgctgggcagcccgcg

SEQ ID NO: 228 - DNA, 2 bp, Homo sapiens
cg

SEQ ID NO: 229 - DNA, 2 bp, Homo sapiens
cg

SEQ ID NO: 230 - DNA, 2 bp, Homo sapiens
cg

SEQ ID NO: 231 - DNA, 23 bp, Homo sapiens
cggtgtccgggggccgcctgtcg

SEQ ID NO: 232 - DNA, 2 bp, Homo sapiens
cg

SEQ ID NO: 233 - DNA, 66 bp, Homo sapiens
cggccgtggcgggctccctggggcggcagctctaggcgcgggcgcgcagcagccccgaaggcgccg

SEQ ID NO: 234 - DNA, 43 bp, Homo sapiens
cgaacaaaaagagtccaggccgcgcgggcgggctgcgcgcccg

SEQ ID NO: 235 - DNA, 2 bp, Homo sapiens
cg

SEQ ID NO: 236 - DNA, 62 bp, Homo sapiens
cgcccagatgcggcggcggcgacggctccagctgcgcctcgtggccatcctcgtgcagcgcg

SEQ ID NO: 237 - DNA, 2 bp, Homo sapiens
cg

SEQ ID NO: 238 - DNA, 138 bp, Homo sapiens
cgaaagattcgaaactccaaaagctccactgcgtgcctctgggaggggagggggcgcgccaggaaaggagtggaaaaaagtgggcgaggaggagcgttgaaaatttcctgacaagtagtttccgtgcgcccgagagcg

SEQ ID NO: 239 - DNA, 2 bp, Homo sapiens
cg

SEQ ID NO: 240 - DNA, 2 bp, Homo sapiens
cg

SEQ ID NO: 241 - DNA, 2 bp, Homo sapiens
cg

SEQ ID NO: 242 - DNA, 2 bp, Homo sapiens
cg

SEQ ID NO: 243 - DNA, 187 bp, Homo sapiens
cggcagaagtgggaggtacacgaggagttactggaaacggcgcttctgtggaggagccgggggggatggggagtagagggagggggccctgttgcctcagcgccccgaggtcgtggagcggcagcagctgcagccggagcagcaccagcaacagcaacagcgagcgggacggagttaggaccgctcg

SEQ ID NO: 244 - DNA, 2 bp, Homo sapiens
cg

SEQ ID NO: 245 - DNA, 2 bp, Homo sapiens
cg

SEQ ID NO: 246 - DNA, 110 bp, Homo sapiens
cgcggcgtgcagctcggcggatgctgccaggtcaggcgactccgccgcccctggagcgcgagcgcgcttcagcttgtagcgatgattctggaaccagatcttgacctgcg

SEQ ID NO: 247 - DNA, 4 bp, Homo sapiens
cgcg

SEQ ID NO: 248 - DNA, 189 bp, Homo sapiens
cgggaggctctgcccgctcggtggctgccgcggcctcctccgcgctgctctccacgcctggcttattatgcacgaggcaggcaatttgccttcctccccggggacccatctcggagacaagaaggtagtttgttctctgtaatggcttctgctggagtgcggcggggcccaggcgcgagcgggggcacg

SEQ ID NO: 249 - DNA, 42 bp, Homo sapiens
cgctgaaggtgggtggaacgagggcgcttgagtgcactcgcg

SEQ ID NO: 250 - DNA, 33 bp, Homo sapiens
cgcgcgggggcttcaggcactttgcgctccacg

SEQ ID NO: 251 - DNA, 15 bp, Homo sapiens
cgcgccagccgaacg

SEQ ID NO: 252 - DNA, 51 bp, Homo sapiens
cgctgggacagagctgcctgctggagctgccgcagatcgccgtggtgggcg

SEQ ID NO: 253 - DNA, 2 bp, Homo sapiens
cg

SEQ ID NO: 254 - DNA, 268 bp, Homo sapiens
cggagcgcgcagcccgtctctgaataagaagtgagtacaatggcgtgtttgtaaaaaaaagcttcaagtccgtctttttcaaaaaacattttgaatgctgcatgcctcatgcttcccagcgcctcgcgggagagacccggctatagagcaggaggtgagaccccccctccggtacccccacccctctggccgcacgctctcctgccccagccttttctgggaggactgcaaatgccccctctcagcaagcggccgtttcccatcttcg

SEQ ID NO: 255 - DNA, 2 bp, Homo sapiens
cg

SEQ ID NO: 256 - DNA, 33 bp, Homo sapiens
cggagcccccaggagcagtcagaccgatcaccg

SEQ ID NO: 257 - DNA, 23 bp, Homo sapiens
cgcccactagcccgagactttcg

SEQ ID NO: 258 - DNA, 40 bp, Homo sapiens
cgccccgacccgacgcctccccgcccgaccaggtgcctcg

SEQ ID NO: 259 - DNA, 10 bp, Homo sapiens
cgcggctccg

SEQ ID NO: 260 - DNA, 181 bp, Homo sapiens
cggctgctgaccgcccctcccgcgctcgccagggcccctgccccgcgtcagccaccgcgcgccttccccctgcccatgccgcagcccccgtggcttttgttctggactcgggatgccaggttgagacacgtcctgcaaacctctggcagaaatgggcgcaagggggtggatttcgttttcg

SEQ ID NO: 261 - DNA, 195 bp, Homo sapiens
cgacctaggacgtcggcgcctgccaggatcccctcgcctgccccccgcgccccgcgcgcgctcatgccaccaccacggggagggtgcatgcggcaggtgcctggccgaggcccccgggagcgagtcgcccttacgtgctccagcttgtctttcctccgaagccagacgctggcgctgtagtcctgctgcttgacg

SEQ ID NO: 262 - DNA, 2 bp, Homo sapiens
cg

SEQ ID NO: 263 - DNA, 358 bp, Homo sapiens
cggcgtccgagtgaccctgtctagcctcgttctgcgctcctgcaaaccacgttgctgcgctaactacaaacctggccaacatgtctttgtaaccctatcatttaaaaacgcttccaggcacctggccgctgccagatcaggttcgcgggcccggaggaggtcctcccacctgcccccgccagccccggggaccgtgcgcggcctccgtgtggcccccgcccacgaggtccctcgggcaggaaccgccgcgcgacctctgttcagcggccgcgtcctggccacgggcgacccctgtcgggaaccctgttcccggctaagctgcgttcccgcattccggtggctctcacccgagctcgcg

SEQ ID NO: 264 - DNA, 13 bp, Homo sapiens
cgcagttgtggcg

SEQ ID NO: 265 - DNA, 2 bp, Homo sapiens
cg

SEQ ID NO: 266 - DNA, 2 bp, Homo sapiens
cg

SEQ ID NO: 267 - DNA, 95 bp, Homo sapiens
cgcgcggggtcacctgaaggttggggcgcggaagctcaactccgtgctgattgggctccaagttttctgcgccctcgcctcgtcccgagtgcccg

SEQ ID NO: 268 - DNA, 45 bp, Homo sapiens
cggcagcaggttggagcgcaccgtgcgcgtcctgccctctcggcg

SEQ ID NO: 269 - DNA, 104 bp, Homo sapiens
cggctgagtcggagcccacgcggcgcgcgcctcccgcgaggaacttttcggcttgtaggctgcttgtcactctcgctttccgacgcgcctccccctggctcgcg

SEQ ID NO: 270 - DNA, 87 bp, Homo sapiens
cgctttcgcccccgctgacactttgcaaagccgcggcggcagcggcggggaccacgctgcggtgcaccaccttccgccaccctcccg

SEQ ID NO: 271 - DNA, 62 bp, Homo sapiens
cgacagtttgcgagcctcggctgcaagtggcctctcctccccgcggttgttgttcagtgtcg

SEQ ID NO: 272 - DNA, 2 bp, Homo sapiens
cg

SEQ ID NO: 273 - DNA, 2 bp, Homo sapiens
cg

SEQ ID NO: 274 - DNA, 2 bp, Homo sapiens
cg

SEQ ID NO: 275 - DNA, 2 bp, Homo sapiens
cg

SEQ ID NO: 276 - DNA, 2 bp, Homo sapiens
cg

SEQ ID NO: 277 - DNA, 2 bp, Homo sapiens
cg

SEQ ID NO: 278 - DNA, 2 bp, Homo sapiens
cg

SEQ ID NO: 279 - DNA, 2 bp, Homo sapiens
cg

SEQ ID NO: 280 - DNA, 145 bp, Homo sapiens
cgccggtttgctggcgacctggcgcatctgcccgcgcgccctggtctcagctgtcgcaggttcctcctgcacccacttccagtcttcaaagccagtgcagtcagcaccgtccacctggagccccaatcctctcctgcgattcccg

SEQ ID NO: 281 - DNA, 2 bp, Homo sapiens
cg

SEQ ID NO: 282 - DNA, 19 bp, Homo sapiens
cgcccaccgccaggagccg

SEQ ID NO: 283 - DNA, 35 bp, Homo sapiens
cggcggcggcggcggccccattagcggagcctccg

SEQ ID NO: 284 - DNA, 2 bp, Homo sapiens
cg

SEQ ID NO: 285 - DNA, 2 bp, Homo sapiens
cg

SEQ ID NO: 286 - DNA, 36 bp, Homo sapiens
cgagctggcgctggtccgctggctgcaggagagccg

SEQ ID NO: 287 - DNA, 2 bp, Homo sapiens
cg

SEQ ID NO: 288 - DNA, 42 bp, Homo sapiens
cggctgagccttcgcctgcctaatcccatttgccattgtacg

SEQ ID NO: 289 - DNA, 2 bp, Homo sapiens
cg

SEQ ID NO: 290 - DNA, 2 bp, Homo sapiens
cg

SEQ ID NO: 291 - DNA, 18 bp, Homo sapiens
cgcgcagcgcccgcgccg

SEQ ID NO: 292 - DNA, 2 bp, Homo sapiens
cg

SEQ ID NO: 293 - DNA, 2 bp, Homo sapiens
cg

SEQ ID NO: 294 - DNA, 2 bp, Homo sapiens
cg

SEQ ID NO: 295 - DNA, 118 bp, Homo sapiens
cgtgccagaccccggctccgcgacccaggtgagtgccgccaccgccgcctggagggacctaagggccctgggctgggacttggggccgcaccggggcctgaggcagaacagcgacgcg

SEQ ID NO: 296 - DNA, 22 bp, Homo sapiens
cgaaccgcgggcggcgcggacg

SEQ ID NO: 297 - DNA, 2 bp, Homo sapiens
cg

SEQ ID NO: 298 - DNA, 2 bp, Homo sapiens
cg

SEQ ID NO: 299 - DNA, 2 bp, Homo sapiens
cg

SEQ ID NO: 300 - DNA, 2 bp, Homo sapiens
cg

SEQ ID NO: 301 - DNA, 31 bp, Homo sapiens
cgacaagagctcggtgctgagatgtgttacg

SEQ ID NO: 302 - DNA, 2 bp, Homo sapiens
cg

SEQ ID NO: 303 - DNA, 2 bp, Homo sapiens
cg

SEQ ID NO: 304 - DNA, 2 bp, Homo sapiens
cg

SEQ ID NO: 305 - DNA, 2 bp, Homo sapiens
cg

SEQ ID NO: 306 - DNA, 2 bp, Homo sapiens
cg

SEQ ID NO: 307 - DNA, 2 bp, Homo sapiens
cg

SEQ ID NO: 308 - DNA, 2 bp, Homo sapiens
cg

SEQ ID NO: 309 - DNA, 2 bp, Homo sapiens
cg

SEQ ID NO: 310 - DNA, 2 bp, Homo sapiens
cg

SEQ ID NO: 311 - DNA, 69 bp, Homo sapiens
cgctaggggcggccagcggccgtttggctggcgtgtcggcggcgctcggggagggcgggccggggggcg

SEQ ID NO: 312 - DNA, 415 bp, Homo sapiens
cgcctcttctcttggcccgactggctctggtttccttcacgttcccagcctccaaattggcgtccgccccatggctcgtgtaggacgctaaaagcacggtaaatcccagggcgatctccagcagacgccctcgacgcatgatgccgagccgccaccggctcccgccgcctcttgccgcgcccggggctcggtctgcggccgccgctgcgccctgaagcgcaccgcgccgccggggtcccgctatcccgccgcccgtcccccgggccgggctcctcccgccttctccaggcgctgctcccacttcaggcggcccctgccagctgcaacacagagacaaatccccgaggcggggagactttcagggcatcgggatgctgaagcctcgcggtccccattcccaagcccaacccgtgcg

SEQ ID NO: 313 - DNA, 2 bp, Homo sapiens
cg

SEQ ID NO: 314 - DNA, 2 bp, Homo sapiens
cg

SEQ ID NO: 315 - DNA, 2 bp, Homo sapiens
cg

SEQ ID NO: 316 - DNA, 2 bp, Homo sapiens
cg

SEQ ID NO: 317 - DNA, 2 bp, Homo sapiens
cg

SEQ ID NO: 318 - DNA, 62 bp, Homo sapiens
cgcgcccgccgctagctcgcacagcgcctcgcacactcccgcacgcgcttgaaatgcgcacg

SEQ ID NO: 319 - DNA, 2 bp, Homo sapiens
cg

SEQ ID NO: 320 - DNA, 2 bp, Homo sapiens
cg

SEQ ID NO: 321 - DNA, 2 bp, Homo sapiens
cg

SEQ ID NO: 322 - DNA, 2 bp, Homo sapiens
cg

SEQ ID NO: 323 - DNA, 20 bp, Homo sapiens
cgcaaacgcaaaagcctccg

SEQ ID NO: 324 - DNA, 69 bp, Homo sapiens
cgccccctggggcccctggctgccgagtcccgctaaggcaaagacgccagcaagcgaggaagcgcagcg

SEQ ID NO: 325 - DNA, 2 bp, Homo sapiens
cg

SEQ ID NO: 326 - DNA, 318 bp, Homo sapiens
cgtcccgcggtagtgtcagttccctggggaccaggaagggcgactcttgcctgggagtcagtgcttgggccgtcgggtccgggtaagcgctgggggtttggctcgagaagatgcggataggtggcctagggcgccgcggatctccgccctctgcgggcaccgggagcccagggtcgaggcgcgccgccccgaggggccccttctcctaacaatgcgcccggaatggagtccgcgccctgacagcgcgggtcagcccgaaaccgcccagaatccgcttcgatgagtgggtgagccgctctgggagtctgccgcgtctcg

SEQ ID NO: 327 - DNA, 27 bp, Homo sapiens
cgtggtggctccccgagcggaggcgcg

SEQ ID NO: 328 - DNA, 2 bp, Homo sapiens
cg

SEQ ID NO: 329 - DNA, 13 bp, Homo sapiens
cgagctccccgcg

SEQ ID NO: 330 - DNA, 189 bp, Homo sapiens
cggtgacgatgtgcagagccttctggcacagactgttcactccgtcctccttgtggaaactcatcgtttggcttttctttcgttttctctttttttcccagttagccgtcttttcctcttcccgtacctctaacccctctggcgccctaagccatagtccgcccgcggtgactttggctggagattgcg

SEQ ID NO: 331 - DNA, 2 bp, Homo sapiens
cg

SEQ ID NO: 332 - DNA, 2 bp, Homo sapiens
cg

SEQ ID NO: 333 - DNA, 13 bp, Homo sapiens
cgggggctgagcg

SEQ ID NO: 334 - DNA, 51 bp, Homo sapiens
cggcgtgtgccgtgcgtggggtggggtgcgggctgggcggcctcgccttcg

SEQ ID NO: 335 - DNA, 289 bp, Homo sapiens
cgcccgcccgcaccccgcttccttcggcccttccttcaaatcccaaacgcaccgccgtgctccaaagaaggtgtccacgtcgcccccagaccccggagcgccccctctccacccccgggacttcccaggtcgctcactcctcccgccccccgcccagatctgagagggaccgaaaacacacccccgactcgggcagccagggccgaaactgtcaagaggagaaaaggtaaagcggaaggagggtggccataaacagatttttttgccccttcttaaaaggacactgccg

SEQ ID NO: 336 - DNA, 2 bp, Homo sapiens
cg

SEQ ID NO: 337 - DNA, 165 bp, Homo sapiens
cggacttgtccccgcagccgttgcggacctcccggtcgtcatggcgactgtgaaatgtggggtggggcgcatgcgttggaagccattcgcgcgggcagtccctgagtgtcccctcacgtgctccccagcgcgagcagcacccccgcctctgcgcttcccagagcg

SEQ ID NO: 338 - DNA, 21 bp, Homo sapiens
cgccgcccctgcaccacttcg

SEQ ID NO: 339 - DNA, 2 bp, Homo sapiens
cg

SEQ ID NO: 340 - DNA, 2 bp, Homo sapiens
cg

SEQ ID NO: 341 - DNA, 2 bp, Homo sapiens
cg

SEQ ID NO: 342 - DNA, 159 bp, Homo sapiens
cggctgcgctggccgcactgtccctctacaacatgagcagcgccggcggcgaccgcctgggccgcggcaagtcggcccgctgcggcctcaccttctccgtgggccgcgtgtatcgctggatggtggacagccgcgtggcgctgcgcatccacgagcacg

SEQ ID NO: 343 - DNA, 2 bp, Homo sapiens
cg

SEQ ID NO: 344 - DNA, 129 bp, Homo sapiens
cggggggcggaattcagagaggtaaagtgacccgcccccaaatcgcaataccaggaggacagcagggctagatggaatctttcggttcacagtccccgacctcgggcaagtgccccactcgggcgcacg

SEQ ID NO: 345 - DNA, 2 bp, Homo sapiens
cg

SEQ ID NO: 346 - DNA, 120 bp, Homo sapiens
cgctggagatggcgagctccgagactccctctatcttctgttttcagagcaactctatggtaccaaaaaaaaaaaaaaaaaaaaaaaaaaaaaaaaaaaaaaaaaaagaaggagaaggcg

SEQ ID NO: 347 - DNA, 2 bp, Homo sapiens
cg

SEQ ID NO: 348 - DNA, 171 bp, Homo sapiens
cgcggacgctgacgatctcctccacgtccgacaagtcctcgttctcgtcgtatcgctggcggtcaatcgggcgctgcgaggacccaaaccagagagcccgggacattattgtgggggctggaggtcgcctctcaacctgggcccagcactaacaggtgcagcagccgagcg

SEQ ID NO: 349 - DNA, 2 bp, Homo sapiens
cg

SEQ ID NO: 350 - DNA, 2 bp, Homo sapiens
cg

SEQ ID NO: 351 - DNA, 2 bp, Homo sapiens
cg

SEQ ID NO: 352 - DNA, 64 bp, Homo sapiens
cggcaggtgagcggcgcggctgcaggtgagcagcagcctcggctcgcgcgcccagctttccccg

SEQ ID NO: 353 - DNA, 2 bp, Homo sapiens
cg

SEQ ID NO: 354 - DNA, 2 bp, Homo sapiens
cg

SEQ ID NO: 355 - DNA, 2 bp, Homo sapiens
cg

SEQ ID NO: 356 - DNA, 2 bp, Homo sapiens
cg

SEQ ID NO: 357 - DNA, 16 bp, Homo sapiens
cgctccgcagggctcg

SEQ ID NO: 358 - DNA, 2 bp, Homo sapiens
cg

SEQ ID NO: 359 - DNA, 2 bp, Homo sapiens
cg

SEQ ID NO: 360 - DNA, 2 bp, Homo sapiens
cg

SEQ ID NO: 361 - DNA, 18 bp, Homo sapiens
cgcattccctcggccgcg

SEQ ID NO: 362 - DNA, 118 bp, Homo sapiens
cgggcggatgggggtcaccgaggcggctcgtctccaggcgcacacttcgcacatctctttgctaagtgaaggggccaaaatgcacagatgggggagtctacccaggaacagaggcgcg

SEQ ID NO: 363 - DNA, 2 bp, Homo sapiens
cg

SEQ ID NO: 364 - DNA, 2 bp, Homo sapiens
cg

SEQ ID NO: 365 - DNA, 2 bp, Homo sapiens
cg

SEQ ID NO: 366 - DNA, 2 bp, Homo sapiens
cg

SEQ ID NO: 367 - DNA, 2 bp, Homo sapiens
cg

SEQ ID NO: 368 - DNA, 22 bp, Homo sapiens
cgcgccgccccagaggagtccg

SEQ ID NO: 369 - DNA, 112 bp, Homo sapiens
cgggagcgcacgagtgtgtgtgtgtgtgtgtgtgttcgcggtgtgcccgcggctcggtgcacacgcgcgcgggttgtaaagtcaggagctgcgggagcgcctccctgcctcg

SEQ ID NO: 370 - DNA, 109 bp, Homo sapiens
cgctctgcctgggctgggcccacttacgttctgggtggggctcaggaactgcgtgcgggcgtagcgggtgagcatgctgatgatgaccacctggccccactcctccacg

SEQ ID NO: 371 - DNA, 2 bp, Homo sapiens
cg

SEQ ID NO: 372 - DNA, 2 bp, Homo sapiens
cg

SEQ ID NO: 373 - DNA, 2 bp, Homo sapiens
cg

SEQ ID NO: 374 - DNA, 431 bp, Homo sapiens
cgagggggctctgggaccgagcggcctcgcagcggcgacagaaatacatattttacgaaaaagaaaaaaaaaaaaacgagtcgcgcgaacccgtcaagtcagatgtgcgcggcttgaagcggaggaggctctgacgtcagccccacctcgcgcagcccggcctggccgcagactcgccggtcactcgccggcggctcaggccgggaggggccaggacagtcccggccgcgcggtggacggaggggccattcctccgggcgttagcaaataaattccatccgagtcaatatcgcccagcgaacggtgtttctctttagtcacccgagaacgagaggcacttttaattagaaattaattaatgagcagctgctccttcccgccccactgtaatcattcgtctcaattacaaatgagacctatgaaaggacacg

SEQ ID NO: 375 - DNA, 2 bp, Homo sapiens
cg

SEQ ID NO: 376 - DNA, 40 bp, Homo sapiens
cgccgcgccccgctgtagctccgctggagagatggggacg

SEQ ID NO: 377 - DNA, 2 bp, Homo sapiens
cg

SEQ ID NO: 378 - DNA, 22 bp, Homo sapiens
cgccagcaggttcagggccacg

SEQ ID NO: 379 - DNA, 2 bp, Homo sapiens
cg

SEQ ID NO: 380 - DNA, 47 bp, Homo sapiens
cgggcatcttgcattgcacgcagtacatgctgtggttctccagctcg

SEQ ID NO: 381 - DNA, 24 bp, Homo sapiens
cgccgttgggggacttctggcacg

SEQ ID NO: 382 - DNA, 2 bp, Homo sapiens
cg

SEQ ID NO: 383 - DNA, 45 bp, Homo sapiens
cgggactccaggcccacccagcaagctaattggctgaggccctcg

SEQ ID NO: 384 - DNA, 2 bp, Homo sapiens
cg

SEQ ID NO: 385 - DNA, 258 bp, Homo sapiens
cgaagcggcgggagtcggtgcagcctcaacttctactgcgtgtcccaggtcgccaaccagctttgctcgcgtgccgttggcccggaggctgccgcgccagtctctgcgtgcgcctgagcgcgctggagcatttgcgaggccagggctgccgacggcgagaggatactttgaggaacacggtgcttcagtcccgcccccgctctccgcccgagctggaggttggggcgcgctgagccgcagcgcctggacaagtgcgcg

SEQ ID NO: 386 - DNA, 45 bp, Homo sapiens
cgccctggcggctccgagggacctgggctcgggcttgcggtcgcg

SEQ ID NO: 387 - DNA, 7 bp, Homo sapiens
cgcggcg

SEQ ID NO: 388 - DNA, 4 bp, Homo sapiens
cgcg

SEQ ID NO: 389 - DNA, 67 bp, Homo sapiens
cggggcgccaacagctcaggacttgggttgcaggctggttcttgcaccaaccagcggggcggcctcg

SEQ ID NO: 390 - DNA, 43 bp, Homo sapiens
cggctgacccgcagcggcagcggcagcagcgaggactcgagcg

SEQ ID NO: 391 - DNA, 2 bp, Homo sapiens
cg

SEQ ID NO: 392 - DNA, 2 bp, Homo sapiens
cg

SEQ ID NO: 393 - DNA, 113 bp, Homo sapiens
cgtgtgtttagctgaattcagtatatttttctcgcacttctcgcttttttttttttctttctgaatctgctcttctgctttgcgggcccctaatctctcccgaatctcgggcg

SEQ ID NO: 394 - DNA, 4 bp, Homo sapiens
cgcg

SEQ ID NO: 395 - DNA, 2 bp, Homo sapiens
cg

SEQ ID NO: 396 - DNA, 84 bp, Homo sapiens
cgctgcgcgccgcctccgcggagccgagcggcggtggctgcggaagcgactggggctgcgcggacaccagcgccccagagcccg

SEQ ID NO: 397 - DNA, 2 bp, Homo sapiens
cg

SEQ ID NO: 398 - DNA, 48 bp, Homo sapiens
cgcgcttcatcttgtagcggtggttctggaaccagatcttgacctgcg

SEQ ID NO: 399 - DNA, 228 bp, Homo sapiens
cgggccgcgcgcttacctgcgtcctcgtcgtcgaaggagttcatgcacgggaagtagatggcgagcgcctcgaaggaggcggacagactgaggcggctctgcgagcgctccatgcccgcgccggcgccgggcgcctcggccgcggcggcggcggcggcggcgggcggcttgggcagcttggccgccccattcttgacgcggagtacggcgcgcggcgtggtggcggcg

SEQ ID NO: 400 - DNA, 47 bp, Homo sapiens
cgcaccttggccgtaacaagcgcgctccacgccgccacgcaccagcg

SEQ ID NO: 401 - DNA, 185 bp, Homo sapiens
cgcgcagggggcgggctctacctccccctcgcccccgcttcggttttaagccgcggaggcgcccggtgggacctcgctgctgtccaatcaggggggaccgggtgagctcctcttcctggagccgggctccaccagcgccgcaggctcacaggccgggggtgggggctctggaccgaggggcggcg

SEQ ID NO: 402 - DNA, 216 bp, Homo sapiens
cgggggcgctaatcccgggagcaggaggccgggctccagccgccgggccttgcgcgcctgcttcttgcggcgcggccggtacttgtagttggggtggtcgcgcaagtgctgcacgcgcagccgttcggcttcctccacgaagggccgcttctccgccgcgttcagctccttccacgctttgcctgcgggccgtgggcgccagtgagtggaacgccg

SEQ ID NO: 403 - DNA, 344 bp, Homo sapiens
cgtggtcccgtgtcccggggcgcgctccagctccggcaccactagctcctcgtcctcctcggaggggcgcccgagtgcgtccgacacggccagtagcgccgcggcgagcagcagcagcgtgggtactggcccaaagctccgagaccccggagcccgctccgcgttccccatgtcgctgcccagcttgcgccttccgaacccctcgggcacagctcgctgcattggagccccaggagacaccgctcgtagcagcgcacggagcgagggacctttagttcgggtcgggagagcaaagcctcgttggcctgctctggattgttaaaattaacaatttctattattcg

SEQ ID NO: 404 - DNA, 28 bp, Homo sapiens
cgttctgtttggcagccaggccgagacg

SEQ ID NO: 405 - DNA, 124 bp, Homo sapiens
cgtggggcgctggacttaccgagaggttagcgccgccgtcgggggagggcgtgtcccgcacgtgtgtgtccgcgcgtgtccgcgcccgcgtgtgccagcgcgcgtgccttggccgtgcgcgccg

SEQ ID NO: 406 - DNA, 80 bp, Homo sapiens
cgcccgccagggtcacgaagagcgcaacgaacgccagcagcacggcgctcacggtgagcgcccgcgccgcctgcacctcg

SEQ ID NO: 407 - DNA, 62 bp, Homo sapiens
cggacaggccccgcagtgagcaggtaagggtcgccccgccgcggctgcccctccacgcctcg

SEQ ID NO: 408 - DNA, 165 bp, Homo sapiens
cgaccgtatgcgccgatttgtcgctgggcgtccgtttcctcttgctggggctgggcgcggcctcggagcctggcggcggtggtgagggcgcacggccagctgcagcggcgctgtgcttgccgtggatccaggacaccttaggcttggtggcggggtcaggtggcg

SEQ ID NO: 409 - DNA, 43 bp, Homo sapiens
cgtccctgtgcttctggtggttccggcgcttcctcggagcgcg

SEQ ID NO: 410 - DNA, 86 bp, Homo sapiens
cgccgccgccttcgccgggagccaagcccgccgggccggcccggtcccaggtgggcagctcggcttgcagctggttggaggtggcg

SEQ ID NO: 411 - DNA, 23 bp, Homo sapiens
cgagcccgtgggataagggggcg

SEQ ID NO: 412 - DNA, 2 bp, Homo sapiens
cg

SEQ ID NO: 413 - DNA, 99 bp, Homo sapiens
cgcggccatgcaattggtggatttttttaaaccgttttggaggggggagcgcggcgttgggggcgggagagcgctcctggctgtgagctgctcctgccg

SEQ ID NO: 414 - DNA, 73 bp, Homo sapiens
cgtggaactcgtgagccccacgcaacgcctccctgccgcccagggtgggctcctagaagcacagaaatggtcg

SEQ ID NO: 415 - DNA, 2 bp, Homo sapiens
cg

SEQ ID NO: 416 - DNA, 52 bp, Homo sapiens
cggggcgggcagggaccgagtcaggagagagcgggcgggggtcctgggagcg

SEQ ID NO: 417 - DNA, 50 bp, Homo sapiens
cgcgagcaggagggcgcactccatggtcaggtgcggacgcggcggctgcg

SEQ ID NO: 418 - DNA, 50 bp, Homo sapiens
cgggtcggggcatcacaggcgcgggaatccacgtgtggactctgcgttcg

SEQ ID NO: 419 - DNA, 2 bp, Homo sapiens
cg

SEQ ID NO: 420 - DNA, 2 bp, Homo sapiens
cg

SEQ ID NO: 421 - DNA, 52 bp, Homo sapiens
cggggtagcgcaggagcaggcaggggctcgcggctcgcgtgggccccaggcg

SEQ ID NO: 422 - DNA, 2 bp, Homo sapiens
cg

SEQ ID NO: 423 - DNA, 2 bp, Homo sapiens
cg

SEQ ID NO: 424 - DNA, 2 bp, Homo sapiens
cg

SEQ ID NO: 425 - DNA, 138 bp, Homo sapiens
cgagtggcagcagcaggagcggggtgacgaacaagatcacgaaggacttgaacttggagacatagctcagcgccgaggccatcgcgcgggagggagactggcgggcgagacgagtgaggggcagctagaggcgccgcg

SEQ ID NO: 426 - DNA, 2 bp, Homo sapiens
cg

SEQ ID NO: 427 - DNA, 2 bp, Homo sapiens
cg

SEQ ID NO: 428 - DNA, 2 bp, Homo sapiens
cg

SEQ ID NO: 429 - DNA, 1017 bp, Homo sapiens
cgctcacctgagtcctaaaagctgttgaatccacatggtcacgtttcggggagcggggcctcagacctggctcgcccaggccatctgcgcggcgcccgcgcccgctcgcttccgtcccgcggcgccggtctccggctctcggtccgccgcctcccgccgcccgccggccgcggggcgcacagcgagtcagagcgcggccgcgcggggctccatgccggccggcgcgccgccgccgttggggcgcatggctcaggctgggcggcccgcgggggcgcacatcctccggccggggcgcggggctcgcggccccctccgccggcggcacagcgaaggcggcagcgaggcggggcgtgttccggcgctgtcgcggcgcagcaaagggctggggagccgcggcttcgccctccggggcggcgaggagggaggccggcggcgctgccgctcacggtgcgtgtctcccggcgcgcggctcttgcctccagccggagctccgcgccgatggggcggcgctgcttagggtttggggtgacgcgacgcggacggacgcgagtcccctccgcgctgccgggtcggggggctctgccagaggctccgccgccgatcggcgccactcaagttgcccgggggctccgtctgagcgctcgctctgcagacggccgcggcccggagactggcaggaggcgggcacgagaggcgcgcggggcgagggcgccgtggagcgcggggcgtggggacgcgcggcggcggcgccgcgcggaggaggcgcgcggggatcccggggccccgccgcccgcgcccaccgcgcccgccgcagagccgcccgcgctgctcagccgcctccctcctcgcgtctgcctctccgcgcgctcgcccccgcctcccggagccggtcccaactccgcccgcccggcccggctcacgtcacccgccttccccgcccctcgaacgggagctcgagcccctggcctggccccggctcctgctcgccgccccaccttgcgggggccggggtcgccg

SEQ ID NO: 430 - DNA, 166 bp, Homo sapiens
cgcgcgctgagggtgcggtgagctgagtgcggggccaagcatgttctggcgtcgacttcgcccaggggcccaggacctggcgcccaaggggctccctggcgacggagacttccgacgcagcagcgacccgcggctgcccaagctgaccccgcccgcgctccgagcg

SEQ ID NO: 431 - DNA, 2 bp, Homo sapiens
cg

SEQ ID NO: 432 - DNA, 2 bp, Homo sapiens
cg

SEQ ID NO: 433 - DNA, 2 bp, Homo sapiens
cg

SEQ ID NO: 434 - DNA, 2 bp, Homo sapiens
cg

SEQ ID NO: 435 - DNA, 2 bp, Homo sapiens
cg

SEQ ID NO: 436 - DNA, 2 bp, Homo sapiens
cg

SEQ ID NO: 437 - DNA, 14 bp, Homo sapiens
cgcgctgagacgcg

SEQ ID NO: 438 - DNA, 2 bp, Homo sapiens
cg

SEQ ID NO: 439 - DNA, 2 bp, Homo sapiens
cg

SEQ ID NO: 440 - DNA, 2 bp, Homo sapiens
cg

SEQ ID NO: 441 - DNA, 125 bp, Homo sapiens
cgtcccgcgccctcgccccgccatgctcctgctgctggggctgtgcctggggctgtccctgtgtgtggggtcgcaggaagaggcgcagagctggggccactcttcggagcaggtaagtggagccg

SEQ ID NO: 442 - DNA, 2 bp, Homo sapiens
cg

SEQ ID NO: 443 - DNA, 131 bp, Homo sapiens
cgtgcgcagcccagcccctcccggacgtcctcgcccccgcccgggcacatcgtgctccgcaccgaggcagagaggggcacgcggatcccagcccctgcgagcccctctgcccgccgccacttcacaccccg

SEQ ID NO: 444 - DNA, 94 bp, Homo sapiens
cgggccgcgtgggtttgggcgcgccgtggtgggcaagcggggccagcggagcgggaacccgcacaccctccgagcggagccgaggacaggcccg

SEQ ID NO: 445 - DNA, 2 bp, Homo sapiens
cg

SEQ ID NO: 446 - DNA, 2 bp, Homo sapiens
cg

SEQ ID NO: 447 - DNA, 27 bp, Homo sapiens
cgcgcaagtattcccctccccatcgcg

SEQ ID NO: 448 - DNA, 164 bp, Homo sapiens
cgcgattctcctcgggaggtgtctgcgaaggcggctctgccgcggtgggggtggggaggctagggcttcggaccgctggagttggggtcgcagccagttcctggcgagtgtttcctggctgctgccgcaggggcttgctttttcggatttcccctctaatctcg

SEQ ID NO: 449 - DNA, 2 bp, Homo sapiens
cg

SEQ ID NO: 450 - DNA, 2 bp, Homo sapiens
cg

SEQ ID NO: 451 - DNA, 68 bp, Homo sapiens
cgcatctgaaaattccgccgcagccacctccctcccatgggaaagccccgacctcggcgggcccagcg

SEQ ID NO: 452 - DNA, 508 bp, Homo sapiens
cgcaacttgggcgcgccagtacaaactcggccttcggcttttctgaagccagtcaagttcgcacagggcccccagcgcctggaaatctgagaggcgtggaagggtggggagtcccgcgaagtctccagtccctgggtgtcctccggctccgcgggggagcgggcctggagctaaaccggccggccgtaggctggagtagcgggcgccggagcgcgcggtggggatgtccgaaaaggagttagaggctcagtcggagagtccgagaacacgagggatgcctaccttgtaacatggcctcaagtttcttcctgtccacgcggaagcgctcctcgctccactccgggctgtgcagggtcgccccggcgaccaagtcgtcctcggagccgggcactggggagtcggtgctgcgctcgctgttggagccggggtccgactgcgccgccaggtagccgggctctccctgggcggccatggtgggcgcgcagcgctcgggctcccgctgccgccg

SEQ ID NO: 453 - DNA, 2 bp, Homo sapiens
cg

SEQ ID NO: 454 - DNA, 2 bp, Homo sapiens
cg

SEQ ID NO: 455 - DNA, 2 bp, Homo sapiens
cg

SEQ ID NO: 456 - DNA, 2 bp, Homo sapiens
cg

SEQ ID NO: 457 - DNA, 4 bp, Homo sapiens
cgcg

SEQ ID NO: 458 - DNA, 2 bp, Homo sapiens
cg

SEQ ID NO: 459 - DNA, 2 bp, Homo sapiens
cg

SEQ ID NO: 460 - DNA, 9 bp, Homo sapiens
cgctgcacg

SEQ ID NO: 461 - DNA, 2 bp, Homo sapiens
cg

SEQ ID NO: 462 - DNA, 2 bp, Homo sapiens
cg

SEQ ID NO: 463 - DNA, 396 bp, Homo sapiens
cgggcggcggcggctcgctgtatatatctcggcgcaccccgccaggtcgcgcacagcgccccgagcccaggcgcctccccgcccccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcg

SEQ ID NO: 464 - DNA, 2 bp, Homo sapiens
cg

SEQ ID NO: 465 - DNA, 70 bp, Homo sapiens
cgtgatttttccacttagagattatttagggagatgtcctggatgggacaagtagacaaatggcggcccg

SEQ ID NO: 466 - DNA, 2 bp, Homo sapiens
cg

SEQ ID NO: 467 - DNA, 68 bp, Homo sapiens
cgggagcccggccgcgccctccagcctcggcacccgcgctcagcgcgccgcgccccgcgtcccccgcg

SEQ ID NO: 468 - DNA, 88 bp, Homo sapiens
cgccccgcgcaccgcccccgtcccagccttcagtggcgcggcgccccctcgcgacatccgcgggtccccaggagcgagccgaccctcg

SEQ ID NO: 469 - DNA, 2 bp, Homo sapiens
cg

SEQ ID NO: 470 - DNA, 2 bp, Homo sapiens
cg

SEQ ID NO: 471 - DNA, 87 bp, Homo sapiens
cgggggcctcccaggccgcggcgcctcccgctttcccccactccccgacccttcttcgcccccaaaatgaggaaacggagcaactcg

SEQ ID NO: 472 - DNA, 45 bp, Homo sapiens
cgtggcaaacccgggctccgacgacagaggcagcgcagaagctcg

SEQ ID NO: 473 - DNA, 2 bp, Homo sapiens
cg

SEQ ID NO: 474 - DNA, 173 bp, Homo sapiens
cgggccgtggctgacatcgcggagaagttaggactttcacagtctctgccagacttgaaagcaagctggaaatcgatagctgtttcagctgtttcagattctaatctggtttgggtttttccccctttcatttgaaaatagactcagggcaatgcttaagagaattccaaccg

SEQ ID NO: 475 - DNA, 2 bp, Homo sapiens
cg

SEQ ID NO: 476 - DNA, 48 bp, Homo sapiens
cggggcctttgtctctggctgcagttggagctctgcgtctcgtcttcg

SEQ ID NO: 477 - DNA, 2 bp, Homo sapiens
cg

SEQ ID NO: 478 - DNA, 2 bp, Homo sapiens
cg

SEQ ID NO: 479 - DNA, 36 bp, Homo sapiens
cggggcagagggggcgggaagctggcgccacggtcg

SEQ ID NO: 480 - DNA, 2 bp, Homo sapiens
cg

SEQ ID NO: 481 - DNA, 2 bp, Homo sapiens
cg

SEQ ID NO: 482 - DNA, 2 bp, Homo sapiens
cg

SEQ ID NO: 483 - DNA, 2 bp, Homo sapiens
cg

SEQ ID NO: 484 - DNA, 2 bp, Homo sapiens
cg

SEQ ID NO: 485 - DNA, 97 bp, Homo sapiens
cgacccgggagggaaaacccctgcctcttcccggggcttgctctgcccgtcctttaaactcgccctacaccctccccgactcccgtccttgcaagcg

SEQ ID NO: 486 - DNA, 2 bp, Homo sapiens
cg

SEQ ID NO: 487 - DNA, 2 bp, Homo sapiens
cg

SEQ ID NO: 488 - DNA, 67 bp, Homo sapiens
cgatgcctgtgcttgtggttccctgaggcagtgggagtggcgtgtgaaggactgtgagagtctggcg

SEQ ID NO: 489 - DNA, 2 bp, Homo sapiens
cg

SEQ ID NO: 490 - DNA, 29 bp, Homo sapiens
cgggtgactgctgaccctctgccctgtcg

SEQ ID NO: 491 - DNA, 49 bp, Homo sapiens
cgaggccccgcgcatcctcgtccgcgcttcagccacttaggctcggccg

SEQ ID NO: 492 - DNA, 188 bp, Homo sapiens
cgtccactgaaaacctccagttggtgctggagcggcggcgtgtggccaacgccaaggagcgtgagcgggtgagggatccctagggtcgacgtccgttccccccttccctgctctaccaccaaacacctggtcaacacccgggggtccgctcaccgcccacccccgctcgaggcgacttcgagctcccg

SEQ ID NO: 493 - DNA, 4 bp, Homo sapiens
cgcg

SEQ ID NO: 494 - DNA, 4 bp, Homo sapiens
cgcg

SEQ ID NO: 495 - DNA, 113 bp, Homo sapiens
cgcgggtgaaggcggagccgcagggttggcccccaaagggatgctctcgcccgagcggcgagaccagccccgctcgcccctcgccgcggccgcgccgcagccgcccacggccg

SEQ ID NO: 496 - DNA, 208 bp, Homo sapiens
cgcgcccgccacagcagcgcgctaggcggacgccgcgggaatttgacgctcgaggctcgcggcccctaatgagagtcccagaacacttcccgcccttgacggccagcggcagcgccgccgcctcccgcagagcgcccgcttctccgtttctagagccttagtctctcctcgagcgacctcgcagcctccctcccgtctccatccgccg

SEQ ID NO: 497 - DNA, 96 bp, Homo sapiens
cgcatccccccgcactcggcgccgccgcctcgccgctctctcccgcttgcagggccgccccgggcaccccagggctgctgaggggcgggcgggccg

SEQ ID NO: 498 - DNA, 236 bp, Homo sapiens
cgcgtggaggctgcgcgtaggggtccgggacgcgggacagggactccgcgcagcccaggcgccggggaaccggggctggagtcggggatctgagcccagcggacgcctcctccgcctggaggcccggcacggaccgggacaccagggcgtccgtggccgtggctcggcccctggctgctgcgggccgcggcctccagtgggtccccaggacccttccccacggcgggtactcaccg

SEQ ID NO: 499 - DNA, 211 bp, Homo sapiens
cgccgcccgcgttccctgcccttcacttcccaacccctgcgtggccccagggtccacattcctggagttttcctccccagtaaatagtgctgtcccccacttaacagcagaggcgcccaggagttcaggcgatgtgtccaaggccgaacagagggacagcagtgagctgctcaacctttccagctgcgcagccaggacacggctgggggcg

SEQ ID NO: 500 - DNA, 193 bp, Homo sapiens
cgcgggggaccccaggtcgggacggagcctcctctggctcgctgtgcgcgcacgcctggaaaggcgggatttaaggcagcgatgctgcgggaggctctgcagtgtcaacgagcccccgaacggttccgcctcattccctctctgtgtgcctcgcaagtctctgcttagtaaaccgtcacagcttcggcgcgcg

SEQ ID NO: 501 - DNA, 4 bp, Homo sapiens
cgcg

SEQ ID NO: 502 - DNA, 199 bp, Homo sapiens
cgcaataaatctccgtagacaccgcatctccaatgcggtgtccctctgtgtcagtgccccggcggctcttgcagggtgccaatgttacggctgtacaccgcttttccctcccatcatcctcacctgaacagacctggaggaggcggaaatggaaattagggcatgtccacaagctggattcgttagatcctcctgctcg

SEQ ID NO: 503 - DNA, 87 bp, Homo sapiens
cgcggccgctacgcctcgctccctgcattcagtctccttggcgtctccgctgcagcatccaagaccaggcgccgcctctgctagccg

SEQ ID NO: 504 - DNA, 68 bp, Homo sapiens
cgtaaactgattatgaaacatacgatgttaattcggagctgcatttcccagctgggcactctcgcgcg

SEQ ID NO: 505 - DNA, 61 bp, Homo sapiens
cggtgaaaactagtctgtggtgcattgagatttgcaaaccattccctgaatgccaggggcg

SEQ ID NO: 506 - DNA, 40 bp, Homo sapiens
cggatcggcggcagcagaagcggcagcggcaaagcacccg

SEQ ID NO: 507 - DNA, 647 bp, Homo sapiens
cggctgctgccactgctctgccgctgccgagccggtcacctgggcacccgcggagccgcgccgctgctaccgccccggcggcctcccggagtgcgcggagggggcggcggaggagcgagatatccatagtaaccgaggatgcgaggggcgcccagcagcagcgagtgcctgggagccaggaggaggcccccgcgcgccggcaacccccagtgctaggcgccctgcagcccccgcgcgccgcgcctgggcccgcatcgctctcgcagtgagggtccgcccgagcggtaagccctccccggcggccaagccgacacctcccccccgcctcgccgcccaccccgggcagcagccgcggaacaatggagagcgcagccagcagccctggagacggcgttcgggggaggacgcgccgccgccgccgccgctgccgccagggcaggcgcgcgccgcgtggagccgggcgggtgcgagggcgcgcggcggggggtggggggcacgcgccgcgcggggggcgggggcagtggggggcgcgcgcgcgggcccggggagctcgcggggagagcccggcgctcggcgcagcgcggcgcggccaagctccgcgcctctcccgcccttcctcggcgcgctcgccctcgcctcgccgctcg

SEQ ID NO: 508 - DNA, 327 bp, Homo sapiens
cgaggcgcgggctgagccctcagcacctggcctgagcggcgtgggcagcagcctgcaccgcggacacctccaactctgccgcgtctgcgccgcactctggccgtggcagcgattttccgggcatctctgaggccgcccttagtcccacaagcacttagccgcccatttcagagcagcggcgccgaccgttttaagaggagtcagttcccgacaccgcctcccacttacttctccacatttccaccgctggagggggtgagtgccgtggacaggcgctcccgtccggggacagctcagcggcggcagtcagcccgaccctcctccgcg

SEQ ID NO: 509 - DNA, 2 bp, Homo sapiens
cg

SEQ ID NO: 510 - DNA, 324 bp, Homo sapiens
cgcaagggcaactactggacgctggacccggcctgcgaagacatgttcgagaagggcaactaccggcgccgccgccgcatgaagaggcccttccggccgccgcccgcgcacttccagcccggcaaggggctcttcggggccggaggcgccgcaggcgggtgcggcgtggcgggcgccggggccgacggctacggctacctggcgccccccaagtacctgcagtctggcttcctcaacaactcgtggccgctaccgcagcctccctcacccatgccctatgcctcctgccagatggcggcagccgcagcggctgcagcagctgcg

SEQ ID NO: 511 - DNA, 77 bp, Homo sapiens
cgcctcgccgtgcccgatgggtgcgcttctagcgctgccgccgcggcgctcggcctcgggttcccgccgctgcgccg

SEQ ID NO: 512 - DNA, 158 bp, Homo sapiens
cgctcccaccccggcacagacagccctcaaagttgtccgtactccccagacctcgccttctgctcagcccccggaccccgcccaggggttgagttgacgtccgcgggtggacctctctggtccgctgcgcagggaactgacttcgggaatccagggcg

SEQ ID NO: 513 - DNA, 79 bp, Homo sapiens
cgcgcgctccgcgctcctggcggtcgcagcgctgcctattaattgattctcttattgatttatttaatttttaggagcg

SEQ ID NO: 514 - DNA, 137 bp, Homo sapiens
cgccctggagcggtgggaggacgcggagcgccgttctctggcttccgacaccctgcccgccctctctagtgggtctgtggctgcgccctctcgaaggaagtaataaatctttctgaccttgggggtcagaggagacg

SEQ ID NO: 515 - DNA, 112 bp, Homo sapiens
cgctgcggcacccagcggcccatcggggttgcactgctgcagcggctccttgtgccacttgtagtccaggaggttgagcatagtgagcaccagcagcagtgcatagcccgcg

SEQ ID NO: 516 - DNA, 2 bp, Homo sapiens
cg

SEQ ID NO: 517 - DNA, 2 bp, Homo sapiens
cg

SEQ ID NO: 518 - DNA, 282 bp, Homo sapiens
cggccctccagctccagctgtgcgtctccgcccgggcgaggtggggctgaccgcggccgtctgcacacgtcccctctggtccgcgcccccggcctgggagggcggactcgcccaccccacgatggccccggctttggaagggactgtttccgtgacccgttctcccaacagccgctaacaaccccctctaacgtctcctgcgcggcccgctcctgagaaccctggctcgggagagcgacgcggggtcctcggggctgcgcaggctgcggcgccctgcccacg

SEQ ID NO: 519 - DNA, 81 bp, Homo sapiens
cggcgcggcggcggggggcgccccgcaagcccgcggctctgagcggccacccgcgcagcaagttgggcgagttggcagccg

SEQ ID NO: 520 - DNA, 53 bp, Homo sapiens
cgcggcttttgccttttgcgccagcgtgagctcggttagggtctccacggccg

SEQ ID NO: 521 - DNA, 40 bp, Homo sapiens
cggcgccagctcacgtccccgctggcgccccctcggcgcg

SEQ ID NO: 522 - DNA, 206 bp, Homo sapiens
cggccgacccacctggtgtcgcgtgcgctggcggcccgcgcggcagccaagccaaaggccgaggccgaggccgagcgcggcgcccagcagcacggcgggggccagcagggcgggcgccggccgcagcgcgtcccgccccagcagcagccgcgcgtcgctcttgcaggccgccccgccgcgggccatccggggcgctcaggctgccg

SEQ ID NO: 523 - DNA, 38 bp, Homo sapiens
cgctgctgctgcgcggggcggcggccgccgtgccctcg

SEQ ID NO: 524 - DNA, 5 bp, Homo sapiens
cgccg

SEQ ID NO: 525 - DNA, 25 bp, Homo sapiens
cgtgtgtacgcgttgcattcgctcg

SEQ ID NO: 526 - DNA, 79 bp, Homo sapiens
cgctccttttccttcttctttcctattaaatattatttgggaattgtttaaattttttttttaaaaaaagagagaggcg

SEQ ID NO: 527 - DNA, 33 bp, Homo sapiens
cggccccgcgtggcgcctcggccgttgccctcg

SEQ ID NO: 528 - DNA, 132 bp, Homo sapiens
cggcgggcggcggcggcgcggagctgcacacggagaagacggagtgcgggcgctacggagagcactcgcccaagcaggacgcccgcggggaggtggtcatggccagctcggcccacgaccgcctggcctgcg

SEQ ID NO: 529 - DNA, 32 bp, Homo sapiens
cgcctggcaccccctcctctgccccgagggcg

SEQ ID NO: 530 - DNA, 2 bp, Homo sapiens
cg

SEQ ID NO: 531 - DNA, 2 bp, Homo sapiens
cg

SEQ ID NO: 532 - DNA, 20 bp, Homo sapiens
cgagtatgccagcggcgccg

SEQ ID NO: 533 - DNA, 85 bp, Homo sapiens
cggcacgctccctccctcggccgctttctctcacataagcgcaggcagagggcgcgtcagtcatgccctgcccctgcgcccgccg

SEQ ID NO: 534 - DNA, 230 bp, Homo sapiens
cggccccgcgaaactcggccctccagctcgcgggacgcgctgcctgccaggcgggcccggcggtacctcgggggcgggaggggtcggtcgcagggcccccagcctggcgcccgcggggcgtccgcagcgaaggggtgggtgtcgctcgtgaacgcagcagggaccagctcagcccgcgctcgcccctgggcctcggccaccgcctctccgccactttctcggcccctgcg

SEQ ID NO: 535 - DNA, 84 bp, Homo sapiens
cgggccgccagtctcagggtgtcgggctccaactaaggccccgaagcccccacgcacctgagggcattttgaccagctcttgcg

SEQ ID NO: 536 - DNA, 42 bp, Homo sapiens
cgcgatccctttttgactcagccaaacggaaaagctcgcgcg

SEQ ID NO: 537 - DNA, 45 bp, Homo sapiens
cgccgtgctcctcctcgtcctcgaaagggtagaaagagtcgtccg

SEQ ID NO: 538 - DNA, 26 bp, Homo sapiens
cgcccgccagcatcccttgtcccgcg

SEQ ID NO: 539 - DNA, 50 bp, Homo sapiens
cgaggtttaggtggaggctgaggctgccgcgcgccgcgggaggagcctcg

SEQ ID NO: 540 - DNA, 56 bp, Homo sapiens
cgcttctgagccagggacgcgcgtggggggtgggcgtgcacgcgggtgggccagcg

SEQ ID NO: 541 - DNA, 44 bp, Homo sapiens
cgtcctcaccgcgcacgcgctcccctcgcgcgcgcacacgctcg

SEQ ID NO: 542 - DNA, 2 bp, Homo sapiens
cg

SEQ ID NO: 543 - DNA, 9 bp, Homo sapiens
cgccttccg

SEQ ID NO: 544 - DNA, 58 bp, Homo sapiens
cgcggggcagctgctcaagtggatcgacaccaccgcctgcctggcgggtaggcgggcg

SEQ ID NO: 545 - DNA, 151 bp, Homo sapiens
cggtagaagacagcgtccccaggaccagcgactctgtggctcactcggccactgggtctcggcgcaaaccctccctaggcagtgcgggcgatgctgactgcagacgtcgggcagggctttcgtgcgggcgggagcgggggaagccagtgcg

SEQ ID NO: 546 - DNA, 17 bp, Homo sapiens
cggactccccaggaccg

SEQ ID NO: 547 - DNA, 70 bp, Homo sapiens
cgcccgctgctccccgctgcgtccagggatggagggccccaccacccatggaattgctggcccctctgcg

SEQ ID NO: 548 - DNA, 59 bp, Homo sapiens
cgtccctgagatttcgctgagaaactttcagcgggttagcgcttgggcgctgggcgccg

SEQ ID NO: 549 - DNA, 25 bp, Homo sapiens
cgctgggtaacctctatccgagccg

SEQ ID NO: 550 - DNA, 57 bp, Homo sapiens
cggcgctgacgctctggccctgggggctgcctggctggtgtcaggtagcggaagacg

SEQ ID NO: 551 - DNA, 111 bp, Homo sapiens
cgagcagctccacgtcctgccaaggacggtaggtgcaagggtcgggggactctctgacggggtcgtcccttcgggcacggggaggttcccaccgagccccaaccctgaacg

SEQ ID NO: 552 - DNA, 211 bp, Homo sapiens
cgggtcgctgttcctgttgcattatgcaaaggtggctgggaaagcgcgttgacttacatttacatagcccatcttctccccacagtatgtgactaatacgtatcccggggaggagggagcgcggctgggggtgctaatcggaagggaacagacagtgagtgccatcttgctgggaggttccagaagcaaagcgccaacgacgacagtagcg

SEQ ID NO: 553 - DNA, 75 bp, Homo sapiens
cgcccccacgcgcgctgtcggtatttgcccgccttgctgcaacttgctgcagtgtttgaaagagtagtaggagcg

SEQ ID NO: 554 - DNA, 2 bp, Homo sapiens
cg

SEQ ID NO: 555 - DNA, 66 bp, Homo sapiens
cgggcgctggagaaggcgcctggcgcgaagctgggcggcgccccgagggcggaggacaggtggccg

SEQ ID NO: 556 - DNA, 2 bp, Homo sapiens
cg

SEQ ID NO: 557 - DNA, 163 bp, Homo sapiens
cggggcggcgggcgcatgcgcgtgcgcggtgcggccccagccctggctgccgccgcctgccgccgccgtcgcgatgcctattttagtcaaagcggctgcgggcttggggacccggcccgggcagcggagcttccggacccgccgacccgccgaggagcgcgcg

SEQ ID NO: 558 - DNA, 99 bp, Homo sapiens
cggagcaaagccagcgcgctccgcggctcggaatccagctggctcgctaccctcccactcctgcgattttactcccgaccgcgctccagggcagaagcg

SEQ ID NO: 559 - DNA, 96 bp, Homo sapiens
cggcggcggcggcagctccagccgcgcccgccacacataccttcactcgctcggtgcacacgccgcgccgcgggcagtgccgcctgcggaggcgcg

SEQ ID NO: 560 - DNA, 4 bp, Homo sapiens
cgcg

SEQ ID NO: 561 - DNA, 16 bp, Homo sapiens
cgtgccaatctcgccg

SEQ ID NO: 562 - DNA, 2 bp, Homo sapiens
cg

SEQ ID NO: 563 - DNA, 141 bp, Homo sapiens
cgcccattttgcagtcgagcacacaaggtccgtcgaagccatcgagcaggtcctgcagctgcaggtagctttcgccgtcgcgctccaccacgccgtggaaggcaggcacgcagccgcgcagcgcgtcagccatcagccgcg

SEQ ID NO: 564 - DNA, 2 bp, Homo sapiens
cg

SEQ ID NO: 565 - DNA, 37 bp, Homo sapiens
cgaggtgttgcgggttttgtgcggttggttgggaacg

SEQ ID NO: 566 - DNA, 52 bp, Homo sapiens
cgaggcgtccccgctcccgccacccacacagggcgccaagtgccccgacccg

SEQ ID NO: 567 - DNA, 2 bp, Homo sapiens
cg

SEQ ID NO: 568 - DNA, 7 bp, Homo sapiens
cgctccg

SEQ ID NO: 569 - DNA, 2 bp, Homo sapiens
cg

SEQ ID NO: 570 - DNA, 4 bp, Homo sapiens
cgcg

SEQ ID NO: 571 - DNA, 17 bp, Homo sapiens
cgtcccgccccaactcg

SEQ ID NO: 572 - DNA, 136 bp, Homo sapiens
cgcggggggaggttcctggctcgccgtctccgctgccgcttgaccgcacttctggagggctccgcaccttgccaggtctctggaggcaaacacacacccccgattcataactggtccccgcgtcaggggactcgcg

SEQ ID NO: 573 - DNA, 31 bp, Homo sapiens
cggccagggagtgagcggggcgctgggcgcg

SEQ ID NO: 574 - DNA, 25 bp, Homo sapiens
cgccaaccagacctcagggtgcacg

SEQ ID NO: 575 - DNA, 12 bp, Homo sapiens
cgctcgtcaacg

SEQ ID NO: 576 - DNA, 6 bp, Homo sapiens
cgtacg

SEQ ID NO: 577 - DNA, 199 bp, Homo sapiens
cgcagcgtgtagccgcggaacagcgcctccagctctgggcaagcgaactcctcgtcgcacgcccggagcccgcgccggcggcttgtcccggccgcccgctcggcgcccccgggctcgcccgcgccgcctccgccgccgcctccgccgcgcggcgcccccgccatctcagcgccatgcagcggccgcggccgcgggcgcg

SEQ ID NO: 578 - DNA, 91 bp, Homo sapiens
cgtgggggcgcggcgcgggcgacacgtgcgggccgccaggagggggagggggacgcgcgccgccgggcccgccaccctgcacccggggccg

SEQ ID NO: 579 - DNA, 108 bp, Homo sapiens
cgtcctccctatggatctcccagtacctgcaggtcacaggataacagaagctatagtagagtcaccgaggaactccaggaacggaggagatggaacagtggagacgcg

SEQ ID NO: 580 - DNA, 13 bp, Homo sapiens
cgaaatcggtgcg

SEQ ID NO: 581 - DNA, 176 bp, Homo sapiens
cgggggcggcggggtgacagtccccgtgcatgaatcagccacccctcaggctccgccccggcgggggtcggccggacgctcgccccgcataaagcgggcacccgggccgcctggagcagaaagccgcgcacctcctcccgccaggcgctttctcggacgccttgcccagcgggccg

SEQ ID NO: 582 - DNA, 2 bp, Homo sapiens
cg

SEQ ID NO: 583 - DNA, 157 bp, Homo sapiens
cgggcgctttcccaggcctggccgaggggcgtcgcgcagaggcggcggcggcgcacggaggcggcagacgacgcgctctcggcgcccgcagccccggtcccgcgctcccgcggcccaaagtaactttgggagccgccgtctcccgcggaacttctcg

SEQ ID NO: 584 - DNA, 66 bp, Homo sapiens
cggccgcggcgggagggacagggggcctgggtgggaagggagcgcgagggcccctagcggttcgcg

SEQ ID NO: 585 - DNA, 498 bp, Homo sapiens
cgtgcgccaggcggaaatgctccagcaggtccccgcgcaccgggccgttcggggggcagtaggggcaggcggcggcgggcaggccgagcgcgccgggcggtggcgcagcggggcacgagtacttcttgtgcgccaggtaggcctcgaggctgtggaagctcacgcggcaggccgtgcactcgtggtagtcggccagcgccggtgccggggctccggggagcgggcgccgcggcttcttgctcaggtcgatggggccgtcggccgcggggccgggcgagcgcgcaggggcgaggccggggccgcttccgcttccgcttccgggccgcggcgactcgggcgcgggggcgtggccgggcggcggggggggcggggcgccggccgcgtgcagctcgtagagcttgcggcgtctgcgcgtgcgcacaggcgcggcgggagagggggccgggggcgcggccggcccagggggtcccgggggcgcggccggtcggcgcggcggcg

SEQ ID NO: 586 - DNA, 27 bp, Homo sapiens
cgagcgcgaagggcgttcggacccgcg

SEQ ID NO: 587 - DNA, 2 bp, Homo sapiens
cg

SEQ ID NO: 588 - DNA, 2 bp, Homo sapiens
cg

SEQ ID NO: 589 - DNA, 16 bp, Homo sapiens
cgcgaggcaggcgacg

SEQ ID NO: 590 - DNA, 53 bp, Homo sapiens
cgccgcaagagaagctgtcaagccccgcaggctctgattcggcgccctccgcg

SEQ ID NO: 591 - DNA, 4 bp, Homo sapiens
cgcg

SEQ ID NO: 592 - DNA, 2 bp, Homo sapiens
cg

SEQ ID NO: 593 - DNA, 2 bp, Homo sapiens
cg

SEQ ID NO: 594 - DNA, 2 bp, Homo sapiens
cg

SEQ ID NO: 595 - DNA, 14 bp, Homo sapiens
cgtaggtggacacg

SEQ ID NO: 596 - DNA, 186 bp, Homo sapiens
cgttatggagaaaattaatggaggaaaaattacagagtcacccgaaacagttgcgctgcttatcacccggtgtttgagcctgtttcccctgtaattagattacatgtgaggcagccccagctaattgtctgtgccacccaccggggaactccagctctatctgtgaacacccaggccttcccgccg

SEQ ID NO: 597 - DNA, 79 bp, Homo sapiens
cgcgtactttctccaccccgacacccactgccactcccacagcggagcgaggggccccgccgagggcgagcgtaccccg

SEQ ID NO: 598 - DNA, 49 bp, Homo sapiens
cgcgggggcgtctcccgttgcctgcagggagcgcggcgcggacgcggcg

SEQ ID NO: 599 - DNA, 17 bp, Homo sapiens
cgcgaacggttcatccg

SEQ ID NO: 600 - DNA, 2 bp, Homo sapiens
cg

SEQ ID NO: 601 - DNA, 9 bp, Homo sapiens
cgtggcccg

SEQ ID NO: 602 - DNA, 2 bp, Homo sapiens
cg

SEQ ID NO: 603 - DNA, 165 bp, Homo sapiens
cggggtctggtaggaagtgcagtgtatctcccagctttagggtaactaggacagcatgaatcttttaccttgtggtagaataaacggctagcgcctcgatgtggcgcgctcgacttttcctcacagagcctaaaagtcacgctcaaccaaactgcagcgttcccg

SEQ ID NO: 604 - DNA, 14 bp, Homo sapiens
cgctgacccgcgcg

SEQ ID NO: 605 - DNA, 2 bp, Homo sapiens
cg

SEQ ID NO: 606 - DNA, 2 bp, Homo sapiens
cg

SEQ ID NO: 607 - DNA, 97 bp, Homo sapiens
cgccccgcacgcccgcacgcccagcggggcccgcattgagcatgggcgcggcggccgtgcgctggcacttgtgcgtgctgctggccctgggcacacg

SEQ ID NO: 608 - DNA, 2 bp, Homo sapiens
cg

SEQ ID NO: 609 - DNA, 98 bp, Homo sapiens
cgaggttcagtttctggttttaaggaataaattcgctggcttgaaagggagctacggcagaagtttaggggcagagcggcgggagcgcgcgatccgcg

SEQ ID NO: 610 - DNA, 69 bp, Homo sapiens
cgcggaaggcccgcgcgccctgcgccgccgccgctcagtgccgccgccagcacctcctccgcccctccg

SEQ ID NO: 611 - DNA, 2 bp, Homo sapiens
cg

SEQ ID NO: 612 - DNA, 2 bp, Homo sapiens
cg

SEQ ID NO: 613 - DNA, 2 bp, Homo sapiens
cg

SEQ ID NO: 614 - DNA, 2 bp, Homo sapiens
cg

SEQ ID NO: 615 - DNA, 103 bp, Homo sapiens
cgcgcccgccgcccccggaggagcgggctggccgaccgccaccgcgccgtcccccggccgcccccgaagccgctccatcgcggtccctgccgtcctggggccg

SEQ ID NO: 616 - DNA, 2 bp, Homo sapiens
cg

SEQ ID NO: 617 - DNA, 21 bp, Homo sapiens
cgccgccgccgccgagagccg

SEQ ID NO: 618 - DNA, 148 bp, Homo sapiens
cgcgcgggcgcgaggggttgggacgcgggagcctcttgagtgcggagcgcggagccctggtgtcccggcgcactgcagccacactcccgggccgcgcgctcccgccgcctcttacccgcgccgcagggtcctcccctttgaggcgccg

SEQ ID NO: 619 - DNA, 2 bp, Homo sapiens
cg

SEQ ID NO: 620 - DNA, 2 bp, Homo sapiens
cg

SEQ ID NO: 621 - DNA, 26 bp, Homo sapiens
cggccatcacgcgctgcctctcggcg

SEQ ID NO: 622 - DNA, 119 bp, Homo sapiens
cgctcgatgatgaggatgcacttctcgcaggtgcagtccttgaagcggcagtaacgcttgtggcccttgagccaggacaggacgccatggttgcggcagcgcgcgcacttgggcgtgcg

SEQ ID NO: 623 - DNA, 66 bp, Homo sapiens
cgcctcaccttgctgaggccgctttcggcttcctctgacccaggctgggcgggaaaggtcgggccg

SEQ ID NO: 624 - DNA, 60 bp, Homo sapiens
cgcggctggggcctcgcgcctcctggagcgccttctgcccagacacgacgacttcgctcg

SEQ ID NO: 625 - DNA, 2 bp, Homo sapiens
cg

SEQ ID NO: 626 - DNA, 124 bp, Homo sapiens
cggcggcaggagaagcccaaggcccgagcggcccgcagcccccacgcctgcacccctccacccccgccagcccgatggttcgctccgcggcgtgcactggagcaagcaggtcccgctccgagcg

SEQ ID NO: 627 - DNA, 2 bp, Homo sapiens
cg

SEQ ID NO: 628 - DNA, 156 bp, Homo sapiens
cgcctcggcctccaccgtcgcgcccttacaggtcaccaggtgccgctcgcccagaatgtcaaccatggcgcagacacgcagccacctgagacccgaggacacctgcaggaggatgatcacctgcggggaggcggcggcgagcgccgcggtgccccg

SEQ ID NO: 629 - DNA, 2 bp, Homo sapiens
cg

SEQ ID NO: 630 - DNA, 91 bp, Homo sapiens
cgcttcaggaatgactcggtgacatcggtcgatgaccttctccacagcctgtcggtgagcggcggcggaggcaaggtttcggcggcgcgcg

SEQ ID NO: 631 - DNA, 2 bp, Homo sapiens
cg

SEQ ID NO: 632 - DNA, 2 bp, Homo sapiens
cg

SEQ ID NO: 633 - DNA, 89 bp, Homo sapiens
cgccgagctgcaggcgcgcgcctaaccgctttgctgggctcacgcggtctgagaggtcggagcgcccaactgctggcacgcgagtaacg

SEQ ID NO: 634 - DNA, 13 bp, Homo sapiens
cggattaaagacg

SEQ ID NO: 635 - DNA, 2 bp, Homo sapiens
cg

SEQ ID NO: 636 - DNA, 47 bp, Homo sapiens
cgcgatgtggcctcgcctggccttttgttgctggggtctggcgctcg

SEQ ID NO: 637 - DNA, 2 bp, Homo sapiens
cg

SEQ ID NO: 638 - DNA, 2 bp, Homo sapiens
cg

SEQ ID NO: 639 - DNA, 159 bp, Homo sapiens
cgcctcccgccgaggcgcaggggcagctacattgcggggcgcctgggcgacggcgccaaagccagggtcacaagggcacgggacaagcggggcggggggagcaggagactaggacagaggtcggcgcccgccgcgggcgctttcacgccgcgggcatcg

SEQ ID NO: 640 - DNA, 2 bp, Homo sapiens
cg

SEQ ID NO: 641 - DNA, 2 bp, Homo sapiens
cg

SEQ ID NO: 642 - DNA, 2 bp, Homo sapiens
cg

SEQ ID NO: 643 - DNA, 78 bp, Homo sapiens
cggccgcttctccgacgcccgcggctccccactgcgccgaggcgagcgccacggctaaagcccaagcctcggcgcccg

SEQ ID NO: 644 - DNA, 2 bp, Homo sapiens
cg

SEQ ID NO: 645 - DNA, 48 bp, Homo sapiens
cgcgccaactcggtcgctgtgcacggtcgggtgcgaaactcctccgcg

SEQ ID NO: 646 - DNA, 2 bp, Homo sapiens
cg

SEQ ID NO: 647 - DNA, 2 bp, Homo sapiens
cg

SEQ ID NO: 648 - DNA, 2 bp, Homo sapiens
cg

SEQ ID NO: 649 - DNA, 157 bp, Homo sapiens
cgtgttcaactggcatttgccaccaacatgtctgtttttatttaaatggcccagagcaaggctctgactaaactagcattcccacgccaacactcagcagcgcctctggtttttggcagattttttccttagctgtcaaagcaaaactatagaagcg

SEQ ID NO: 650 - DNA, 2 bp, Homo sapiens
cg

SEQ ID NO: 651 - DNA, 82 bp, Homo sapiens
cgcacccgcggggagggcggcgagcggggatcagccgaagtcgggagaggggcgcttccacggggcgggaaactggcgcgcg

SEQ ID NO: 652 - DNA, 23 bp, Homo sapiens
cggccaggtgaggcggccaggcg

SEQ ID NO: 653 - DNA, 38 bp, Homo sapiens
cgaactcgcaaagctgctcgtagacgcgcgggaactcg

SEQ ID NO: 654 - DNA, 2 bp, Homo sapiens
cc

SEQ ID NO: 655 - DNA, 165 bp, Homo sapiens
cgcgggctgcccagcgtgccagaccctttccccctggacgtgcgcaagctgctggtggccggcaaccgcatccagcggatccccgaggacttcttcatcttctacggcgacctggtctacctggacttcaggaacaactcgctgcgctcgctggaggagggcacg

SEQ ID NO: 656 - DNA, 2 bp, Homo sapiens
cg

SEQ ID NO: 657 - DNA, 2 bp, Homo sapiens
cg

SEQ ID NO: 658 - DNA, 2 bp, Homo sapiens
cg

SEQ ID NO: 659 - DNA, 23 bp, Homo sapiens
cgacaggcggcccccggacaccg

SEQ ID NO: 660 - DNA, 2 bp, Homo sapiens
cg

SEQ ID NO: 661 - DNA, 66 bp, Homo sapiens
cggcgccttcggggctgctgcgcgcccgcgcctagagctgccgccccagggagcccgccacggccg

SEQ ID NO: 662 - DNA, 43 bp, Homo sapiens
cgggcgcgcagcccgcccgcgcggcctggactctttttgttcg

SEQ ID NO: 663 - DNA, 2 bp, Homo sapiens
cg

SEQ ID NO: 664 - DNA, 62 bp, Homo sapiens
cgcgctgcacgaggatggccacgaggcgcagctggagccgtcgccgccgccgcatctgggcg

SEQ ID NO: 665 - DNA, 2 bp, Homo sapiens
cg

SEQ ID NO: 666 - DNA, 138 bp, Homo sapiens
cgctctcgggcgcacggaaactacttgtcaggaaattttcaacgctcctcctcgcccacttttttccactcctttcctggcgcgccccctcccctcccagaggcacgcagtggagcttttggagtttcgaatctttcg

SEQ ID NO: 667 - DNA, 2 bp, Homo sapiens
cg

SEQ ID NO: 668 - DNA, 2 bp, Homo sapiens
cg

SEQ ID NO: 669 - DNA, 2 bp, Homo sapiens
cg

SEQ ID NO: 670 - DNA, 2 bp, Homo sapiens
cg

SEQ ID NO: 671 - DNA, 187 bp, Homo sapiens
cgagcggtcctaactccgtcccgctcgctgttgctgttgctggtgctgctccggctgcagctgctgccgctccacgacctcggggcgctgaggcaacagggccccctccctctactccccatcccccccggctcctccacagaagcgccgtttccagtaactcctcgtgtacctcccacttctgccg

SEQ ID NO: 672 - DNA, 2 bp, Homo sapiens
cg

SEQ ID NO: 673 - DNA, 2 bp, Homo sapiens
cg

SEQ ID NO: 674 - DNA, 110 bp, Homo sapiens
cgcaggtcaagatctggttccagaatcatcgctacaagctgaagcgcgctcgcgctccaggggcggcggagtcgcctgacctggcagcatccgccgagctgcacgccgcg

SEQ ID NO: 675 - DNA, 4 bp, Homo sapiens
cgcg

SEQ ID NO: 676 - DNA, 189 bp, Homo sapiens
cgtgcccccgctcgcgcctgggccccgccgcactccagcagaagccattacagagaacaaactaccttcttgtctccgagatgggtccccggggaggaaggcaaattgcctgcctcgtgcataataagccaggcgtggagagcagcgcggaggaggccgcggcagccaccgagcgggcagagcctcccg

SEQ ID NO: 677 - DNA, 42 bp, Homo sapiens
cgcgagtgcactcaagcgccctcgttccacccaccttcagcg

SEQ ID NO: 678 - DNA, 33 bp, Homo sapiens
cgtggagcgcaaagtgcctgaagcccccgcgcg

SEQ ID NO: 679 - DNA, 15 bp, Homo sapiens
cgttcggctggcgcg

SEQ ID NO: 680 - DNA, 51 bp, Homo sapiens
cgcccaccacggcgatctgcggcagctccagcaggcagctctgtcccagcg

SEQ ID NO: 681 - DNA, 2 bp, Homo sapiens
cg

SEQ ID NO: 682 - DNA, 268 bp, Homo sapiens
cgaagatgggaaacggccgcttgctgagagggggcatttgcagtcctcccagaaaaggctggggcaggagagcgtgcggccagaggggtgggggtaccggagggggggtctcacctcctgctctatagccgggtctctcccgcgaggcgctgggaagcatgaggcatgcagcattcaaaatgttttttgaaaaagacggacttgaagcttttttttacaaacacgccattgtactcacttcttattcagagacgggctgcgcgctccg

SEQ ID NO: 683 - DNA, 2 bp, Homo sapiens
cg

SEQ ID NO: 684 - DNA, 33 bp, Homo sapiens
cggtgatcggtctgactgctcctgggggctccg

SEQ ID NO: 685 - DNA, 23 bp, Homo sapiens
cgaaagtctcgggctagtgggcg

SEQ ID NO: 686 - DNA, 40 bp, Homo sapiens
cgaggcacctggtcgggcggggaggcgtcgggtcggggcg

SEQ ID NO: 687 - DNA, 10 bp, Homo sapiens
cggagccgcg

SEQ ID NO: 688 - DNA, 181 bp, Homo sapiens
cgaaaacgaaatccacccccttgcgcccatttctgccagaggtttgcaggacgtgtctcaacctggcatcccgagtccagaacaaaagccacgggggctgcggcatgggcagggggaaggcgcgcggtggctgacgcggggcaggggccctggcgagcgcgggaggggcggtcagcagccg

SEQ ID NO: 689 - DNA, 195 bp, Homo sapiens
cgtcaagcagcaggactacagcgccagcgtctggcttcggaggaaagacaagctggagcacgtaagggcgactcgctcccgggggcctcggccaggcacctgccgcatgcaccctccccgtggtggtggcatgagcgcgcgcggggcgcggggggcaggcgaggggatcctggcaggcgccgacgtcctaggtcg

SEQ ID NO: 690 - DNA, 2 bp, Homo sapiens
cg

SEQ ID NO: 691 - DNA, 358 bp, Homo sapiens
cgcgagctcgggtgagagccaccggaatgcgggaacgcagcttagccgggaacagggttcccgacaggggtcgcccgtggccaggacgcggccgctgaacagaggtcgcgcggcggttcctgcccgagggacctcgtgggcgggggccacacggaggccgcgcacggtccccggggctggcgggggcaggtgggaggacctcctccgggcccgcgaacctgatctggcagcggccaggtgcctggaagcgtttttaaatgatagggttacaaagacatgttggccaggtttgtagttagcgcagcaacgtggtttgcaggagcgcagaacgaggctagacagggtcactcggacgccg

SEQ ID NO: 692 - DNA, 13 bp, Homo sapiens
cgccacaactgcg

SEQ ID NO: 693 - DNA, 2 bp, Homo sapiens
cg

SEQ ID NO: 694 - DNA, 2 bp, Homo sapiens
cg

SEQ ID NO: 695 - DNA, 95 bp, Homo sapiens
cgggcactcgggacgaggcgagggcgcagaaaacttggagcccaatcagcacggagttgagcttccgcgccccaaccttcaggtgaccccgcgcg

SEQ ID NO: 696 - DNA, 45 bp, Homo sapiens
cgccgagagggcaggacgcgcacggtgcgctccaacctgctgccg

SEQ ID NO: 697 - DNA, 104 bp, Homo sapiens
cgcgagccagggggaggcgcgtcggaaagcgagagtgacaagcagcctacaagccgaaaagttcctcgcgggaggcgcgcgccgcgtgggctccgactcagccg

SEQ ID NO: 698 - DNA, 87 bp, Homo sapiens
cgggagggtggcggaaggtggtgcaccgcagcgtggtccccgccgctgccgccgcggctttgcaaagtgtcagcgggggcgaaagcg

SEQ ID NO: 699 - DNA, 62 bp, Homo sapiens
cgacactgaacaacaaccgcggggaggagaggccacttgcagccgaggctcgcaaactgtcg

SEQ ID NO: 700 - DNA, 2 bp, Homo sapiens
cg

SEQ ID NO: 701 - DNA, 2 bp, Homo sapiens
cg

SEQ ID NO: 702 - DNA, 2 bp, Homo sapiens
cg

SEQ ID NO: 703 - DNA, 2 bp, Homo sapiens
cg

SEQ ID NO: 704 - DNA, 2 bp, Homo sapiens
cg

SEQ ID NO: 705 - DNA, 2 bp, Homo sapiens
cg

SEQ ID NO: 706 - DNA, 2 bp, Homo sapiens
cg

SEQ ID NO: 707 - DNA, 2 bp, Homo sapiens
cg

SEQ ID NO: 708 - DNA, 145 bp, Homo sapiens
cgggaatcgcaggagaggattggggctccaggtggacggtgctgactgcactggctttgaagactggaagtgggtgcaggaggaacctgcgacagctgagaccagggcgcgcgggcagatgcgccaggtcgccagcaaaccggcg

SEQ ID NO: 709 - DNA, 2 bp, Homo sapiens
cg

SEQ ID NO: 710 - DNA, 19 bp, Homo sapiens
cggctcctggcggtgggcg

SEQ ID NO: 711 - DNA, 35 bp, Homo sapiens
cggaggctccgctaatggggccgccgccgccgccg

SEQ ID NO: 712 - DNA, 2 bp, Homo sapiens
cg

SEQ ID NO: 713 - DNA, 2 bp, Homo sapiens
cg

SEQ ID NO: 714 - DNA, 36 bp, Homo sapiens
cggctctcctgcagccagcggaccagcgccagctcg

SEQ ID NO: 715 - DNA, 2 bp, Homo sapiens
cg

SEQ ID NO: 716 - DNA, 42 bp, Homo sapiens
cgtacaatggcaaatgggattaggcaggcgaaggctcagccg

SEQ ID NO: 717 - DNA, 2 bp, Homo sapiens
cg

SEQ ID NO: 718 - DNA, 2 bp, Homo sapiens
cg

SEQ ID NO: 719 - DNA, 18 bp, Homo sapiens
cggcgcgggcgctgcgcg

SEQ ID NO: 720 - DNA, 2 bp, Homo sapiens
cg

SEQ ID NO: 721 - DNA, 2 bp, Homo sapiens
cg

SEQ ID NO: 722 - DNA, 2 bp, Homo sapiens
cg

SEQ ID NO: 723 - DNA, 118 bp, Homo sapiens
cgcgtcgctgttctgcctcaggccccggtgcggccccaagtcccagcccagggcccttaggtccctccaggcggcggtggcggcactcacctgggtcgcggagccggggtctggcacg

SEQ ID NO: 724 - DNA, 22 bp, Homo sapiens
cgtccgcgccgcccgcggttcg

SEQ ID NO: 725 - DNA, 2 bp, Homo sapiens
cg

SEQ ID NO: 726 - DNA, 2 bp, Homo sapiens
cg

SEQ ID NO: 727 - DNA, 2 bp, Homo sapiens
cg

SEQ ID NO: 728 - DNA, 2 bp, Homo sapiens
cg

SEQ ID NO: 729 - DNA, 31 bp, Homo sapiens
cgtaacacatctcagcaccgagctcttgtcg

SEQ ID NO: 730 - DNA, 2 bp, Homo sapiens
cg

SEQ ID NO: 731 - DNA, 2 bp, Homo sapiens
cg

SEQ ID NO: 732 - DNA, 2 bp, Homo sapiens
cg

SEQ ID NO: 733 - DNA, 2 bp, Homo sapiens
cg

SEQ ID NO: 734 - DNA, 2 bp, Homo sapiens
cg

SEQ ID NO: 735 - DNA, 2 bp, Homo sapiens
cg

SEQ ID NO: 736 - DNA, 2 bp, Homo sapiens
cg

SEQ ID NO: 737 - DNA, 2 bp, Homo sapiens
cg

SEQ ID NO: 738 - DNA, 2 bp, Homo sapiens
cg

SEQ ID NO: 739 - DNA, 69 bp, Homo sapiens
cgccccccggcccgccctccccgagcgccgccgacacgccagccaaacggccgctggccgcccctagcg

SEQ ID NO: 740 - DNA, 415 bp, Homo sapiens
cgcacgggttgggcttgggaatggggaccgcgaggcttcagcatcccgatgccctgaaagtctccccgcctcggggatttgtctctgtgttgcagctggcaggggccgcctgaagtgggagcagcgcctggagaaggcgggaggagcccggcccgggggacgggcggcgggatagcgggaccccggcggcgcggtgcgcttcagggcgcagcggcggccgcagaccgagccccgggcgcggcaagaggcggcgggagccggtggcggctcggcatcatgcgtcgagggcgtctgctggagatcgccctgggatttaccgtgcttttagcgtcctacacgagccatggggcggacgccaatttggaggctgggaacgtgaaggaaaccagagccagtcgggccaagagaagaggcg

SEQ ID NO: 741 - DNA, 2 bp, Homo sapiens
cg

SEQ ID NO: 742 - DNA, 2 bp, Homo sapiens
cg

SEQ ID NO: 743 - DNA, 2 bp, Homo sapiens
cg

SEQ ID NO: 744 - DNA, 2 bp, Homo sapiens
cg

SEQ ID NO: 745 - DNA, 2 bp, Homo sapiens
cg

SEQ ID NO: 746 - DNA, 62 bp, Homo sapiens
cgtgcgcatttcaagcgcgtgcgggagtgtgcgaggcgctgtgcgagctagcggcgggcgcg

SEQ ID NO: 747 - DNA, 2 bp, Homo sapiens
cg

SEQ ID NO: 748 - DNA, 2 bp, Homo sapiens
cg

SEQ ID NO: 749 - DNA, 2 bp, Homo sapiens
cg

SEQ ID NO: 750 - DNA, 2 bp, Homo sapiens
cg

SEQ ID NO: 751 - DNA, 20 bp, Homo sapiens
cggaggcttttgcgtttgcg

SEQ ID NO: 752 - DNA, 69 bp, Homo sapiens
cgctgcgcttcctcgcttgctggcgtctttgccttagcgggactcggcagccaggggccccagggggcg

SEQ ID NO: 753 - DNA, 2 bp, Homo sapiens
cg

SEQ ID NO: 754 - DNA, 318 bp, Homo sapiens
cgagacgcggcagactcccagagcggctcacccactcatcgaagcggattctgggcggtttcgggctgacccgcgctgtcagggcgcggactccattccgggcgcattgttaggagaaggggcccctcggggcggcgcgcctcgaccctgggctcccggtgcccgcagagggcggagatccgcggcgccctaggccacctatccgcatcttctcgagccaaacccccagcgcttacccggacccgacggcccaagcactgactcccaggcaagagtcgcccttcctggtccccagggaactgacactaccgcgggacg

SEQ ID NO: 755 - DNA, 27 bp, Homo sapiens
cgcgcctccgctcggggagccaccacg

SEQ ID NO: 756 - DNA, 2 bp, Homo sapiens
cg

SEQ ID NO: 757 - DNA, 13 bp, Homo sapiens
cgcggggagctcg

SEQ ID NO: 758 - DNA, 189 bp, Homo sapiens
cgcaatctccagccaaagtcaccgcgggcggactatggcttagggcgccagaggggttagaggtacgggaagaggaaaagacggctaactgggaaaaaaagagaaaacgaaagaaaagccaaacgatgagtttccacaaggaggacggagtgaacagtctgtgccagaaggctctgcacatcgtcaccg

SEQ ID NO: 759 - DNA, 2 bp, Homo sapiens
cg

SEQ ID NO: 760 - DNA, 2 bp, Homo sapiens
cg

SEQ ID NO: 761 - DNA, 13 bp, Homo sapiens
cgctcagcccccg

SEQ ID NO: 762 - DNA, 51 bp, Homo sapiens
cgaaggcgaggccgcccagcccgcaccccaccccacgcacggcacacgccg

SEQ ID NO: 763 - DNA, 289 bp, Homo sapiens
cggcagtgtccttttaagaaggggcaaaaaaatctgtttatggccaccctccttccgctttaccttttctcctcttgacagtttcggccctggctgcccgagtcgggggtgtgttttcggtccctctcagatctgggcggggggcgggaggagtgagcgacctgggaagtcccgggggtggagagggggcgctccggggtctgggggcgacgtggacaccttctttggagcacggcggtgcgtttgggatttgaaggaagggccgaaggaagcggggtgcgggcgggcg

SEQ ID NO: 764 - DNA, 2 bp, Homo sapiens
cg

SEQ ID NO: 765 - DNA, 165 bp, Homo sapiens
cgctctgggaagcgcagaggcgggggtgctgctcgcgctggggagcacgtgaggggacactcagggactgcccgcgcgaatggcttccaacgcatgcgccccaccccacatttcacagtcgccatgacgaccgggaggtccgcaacggctgcggggacaagtccg

SEQ ID NO: 766 - DNA, 21 bp, Homo sapiens
cgaagtggtgcaggggcggcg

SEQ ID NO: 767 - DNA, 2 bp, Homo sapiens
cg

SEQ ID NO: 768 - DNA, 2 bp, Homo sapiens
cg

SEQ ID NO: 769 - DNA, 2 bp, Homo sapiens
cg

SEQ ID NO: 770 - DNA, 159 bp, Homo sapiens
cgtgctcgtggatgcgcagcgccacgcggctgtccaccatccagcgatacacgcggcccacggagaaggtgaggccgcagcgggccgacttgccgcggcccaggcggtcgccgccggcgctgctcatgttgtagagggacagtgcggccagcgcagccg

SEQ ID NO: 771 - DNA, 2 bp, Homo sapiens
cg

SEQ ID NO: 772 - DNA, 129 bp, Homo sapiens
cgtgcgcccgagtggggcacttgcccgaggtcggggactgtgaaccgaaagattccatctagccctgctgtcctcctggtattgcgatttgggggcgggtcactttacctctctgaattccgccccccg

SEQ ID NO: 773 - DNA, 2 bp, Homo sapiens
cg

SEQ ID NO: 774 - DNA, 120 bp, Homo sapiens
cgccttctccttctttttttttttttttttttttttttttttttttttttttttttggtaccatagagttgctctgaaaacagaagatagagggagtctcggagctcgccatctccagcg

SEQ ID NO: 775 - DNA, 2 bp, Homo sapiens
cg

SEQ ID NO: 776 - DNA, 171 bp, Homo sapiens
cgctcggctgctgcacctgttagtgctgggcccaggttgagaggcgacctccagcccccacaataatgtcccgggctctctggtttgggtcctcgcagcgcccgattgaccgccagcgatacgacgagaacgaggacttgtcggacgtggaggagatcgtcagcgtccgcg

SEQ ID NO: 777 - DNA, 2 bp, Homo sapiens
cg

SEQ ID NO: 778 - DNA, 2 bp, Homo sapiens
cg

SEQ ID NO: 779 - DNA, 2 bp, Homo sapiens
cg

SEQ ID NO: 780 - DNA, 64 bp, Homo sapiens
cggggaaagctgggcgcgcgagccgaggctgctgctcacctgcagccgcgccgctcacctgccg

SEQ ID NO: 781 - DNA, 2 bp, Homo sapiens
cg

SEQ ID NO: 782 - DNA, 2 bp, Homo sapiens
cg

SEQ ID NO: 783 - DNA, 2 bp, Homo sapiens
cg

SEQ ID NO: 784 - DNA, 2 bp, Homo sapiens
cg

SEQ ID NO: 785 - DNA, 16 bp, Homo sapiens
cgagccctgcggagcg

SEQ ID NO: 786 - DNA, 2 bp, Homo sapiens
cg

SEQ ID NO: 787 - DNA, 2 bp, Homo sapiens
cg

SEQ ID NO: 788 - DNA, 2 bp, Homo sapiens
cg

SEQ ID NO: 789 - DNA, 18 bp, Homo sapiens
cgcggccgagggaatgcg

SEQ ID NO: 790 - DNA, 118 bp, Homo sapiens
cgcgcctctgttcctgggtagactcccccatctgtgcattttggccccttcacttagcaaagagatgtgcgaagtgtgcgcctggagacgagccgcctcggtgacccccatccgcccg

SEQ ID NO: 791 - DNA, 2 bp, Homo sapiens
cg

SEQ ID NO: 792 - DNA, 2 bp, Homo sapiens
cg

SEQ ID NO: 793 - DNA, 2 bp, Homo sapiens
cg

SEQ ID NO: 794 - DNA, 2 bp, Homo sapiens
cg

SEQ ID NO: 795 - DNA, 2 bp, Homo sapiens
cg

SEQ ID NO: 796 - DNA, 22 bp, Homo sapiens
cggactcctctggggcggcgcg

SEQ ID NO: 797 - DNA, 112 bp, Homo sapiens
cgaggcagggaggcgctcccgcagctcctgactttacaacccgcgcgcgtgtgcaccgagccgcgggcacaccgcgaacacacacacacacacacacactcgtgcgctcccg

SEQ ID NO: 798 - DNA, 109 bp, Homo sapiens
cgtggaggagtggggccaggtggtcatcatcagcatgctcacccgctacgcccgcacgcagttcctgagccccacccagaacgtaagtgggcccagcccaggcagagcg

SEQ ID NO: 799 - DNA, 2 bp, Homo sapiens
cg

SEQ ID NO: 800 - DNA, 2 bp, Homo sapiens
cg

SEQ ID NO: 801 - DNA, 2 bp, Homo sapiens
cg

SEQ ID NO: 802 - DNA, 431 bp, Homo sapiens
cgtgtcctttcataggtctcatttgtaattgagacgaatgattacagtggggcgggaaggagcagctgctcattaattaatttctaattaaaagtgcctctcgttctcgggtgactaaagagaaacaccgttcgctgggcgatattgactcggatggaatttatttgctaacgcccggaggaatggcccctccgtccaccgcgcggccgggactgtcctggcccctcccggcctgagccgccggcgagtgaccggcgagtctgcggccaggccgggctgcgcgaggtggggctgacgtcagagcctcctccgcttcaagccgcgcacatctgacttgacgggttcgcgcgactcgtttttttttttttctttttcgtaaaatatgtatttctgtcgccgctgcgaggccgctcggtcccagagccccctcg

SEQ ID NO: 803 - DNA, 2 bp, Homo sapiens
cg

SEQ ID NO: 804 - DNA, 40 bp, Homo sapiens
cgtccccatctctccagcggagctacagcggggcgcggcg

SEQ ID NO: 805 - DNA, 2 bp, Homo sapiens
cg

SEQ ID NO: 806 - DNA, 22 bp, Homo sapiens
cgtggccctgaacctgctggcg

SEQ ID NO: 807 - DNA, 2 bp, Homo sapiens
cg

SEQ ID NO: 808 - DNA, 47 bp, Homo sapiens
cgagctggagaaccacagcatgtactgcgtgcaatgcaagatgcccg

SEQ ID NO: 809 - DNA, 24 bp, Homo sapiens
cgtgccagaagtcccccaacggcg

SEQ ID NO: 810 - DNA, 2 bp, Homo sapiens
cg

SEQ ID NO: 811 - DNA, 45 bp, Homo sapiens
cgagggcctcagccaattagcttgctgggtgggcctggagtcccg

SEQ ID NO: 812 - DNA, 2 bp, Homo sapiens
cg

SEQ ID NO: 813 - DNA, 258 bp, Homo sapiens
cgcgcacttgtccaggcgctgcggctcagcgcgccccaacctccagctcgggcggagagcgggggcgggactgaagcaccgtgttcctcaaagtatcctctcgccgtcggcagccctggcctcgcaaatgctccagcgcgctcaggcgcacgcagagactggcgcggcagcctccgggccaacggcacgcgagcaaagctggttggcgacctgggacacgcagtagaagttgaggctgcaccgactcccgccgcttcg

SEQ ID NO: 814 - DNA, 45 bp, Homo sapiens
cgcgaccgcaagcccgagcccaggtccctcggagccgccagggcg

SEQ ID NO: 815 - DNA, 7 bp, Homo sapiens
cgccgcg

SEQ ID NO: 816 - DNA, 4 bp, Homo sapiens
cgcg

SEQ ID NO: 817 - DNA, 67 bp, Homo sapiens
cgaggccgccccgctggttggtgcaagaaccagcctgcaacccaagtcctgagctgttggcgccccg

SEQ ID NO: 818 - DNA, 43 bp, Homo sapiens
cgctcgagtcctcgctgctgccgctgccgctgcgggtcagccg

SEQ ID NO: 819 - DNA, 2 bp, Homo sapiens
cg

SEQ ID NO: 820 - DNA, 2 bp, Homo sapiens
cg

SEQ ID NO: 821 - DNA, 113 bp, Homo sapiens
cgcccgagattcgggagagattaggggcccgcaaagcagaagagcagattcagaaagaaaaaaaaaaaagcgagaagtgcgagaaaaatatactgaattcagctaaacacacg

SEQ ID NO: 822 - DNA, 4 bp, Homo sapiens
cgcg

SEQ ID NO: 823 - DNA, 2 bp, Homo sapiens
cg

SEQ ID NO: 824 - DNA, 84 bp, Homo sapiens
cgggctctggggcgctggtgtccgcgcagccccagtcgcttccgcagccaccgccgctcggctccgcggaggcggcgcgcagcg

SEQ ID NO: 825 - DNA, 2 bp, Homo sapiens
cg

SEQ ID NO: 826 - DNA, 48 bp, Homo sapiens
cgcaggtcaagatctggttccagaaccaccgctacaagatgaagcgcg

SEQ ID NO: 827 - DNA, 228 bp, Homo sapiens
cgccgccaccacgccgcgcgccgtactccgcgtcaagaatggggcggccaagctgcccaagccgcccgccgccgccgccgccgccgcggccgaggcgcccggcgccggcgcgggcatggagcgctcgcagagccgcctcagtctgtccgcctccttcgaggcgctcgccatctacttcccgtgcatgaactccttcgacgacgaggacgcaggtaagcgcgcggcccg

SEQ ID NO: 828 - DNA, 47 bp, Homo sapiens
cgctggtgcgtggcggcgtggagcgcgcttgttacggccaaggtgcg

SEQ ID NO: 829 - DNA, 185 bp, Homo sapiens
cgccgcccctcggtccagagcccccacccccggcctgtgagcctgcggcgctggtggagcccggctccaggaagaggagctcacccggtcccccctgattggacagcagcgaggtcccaccgggcgcctccgcggcttaaaaccgaagcgggggcgagggggaggtagagcccgccccctgcgcg

SEQ ID NO: 830 - DNA, 216 bp, Homo sapiens
cggcgttccactcactggcgcccacggcccgcaggcaaagcgtggaaggagctgaacgcggcggagaagcggcccttcgtggaggaagccgaacggctgcgcgtgcagcacttgcgcgaccaccccaactacaagtaccggccgcgccgcaagaagcaggcgcgcaaggcccggcggctggagcccggcctcctgctcccgggattagcgcccccg

SEQ ID NO: 831 - DNA, 344 bp, Homo sapiens
cgaataatagaaattgttaattttaacaatccagagcaggccaacgaggctttgctctcccgacccgaactaaaggtccctcgctccgtgcgctgctacgagcggtgtctcctggggctccaatgcagcgagctgtgcccgaggggttcggaaggcgcaagctgggcagcgacatggggaacgcggagcgggctccggggtctcggagctttgggccagtacccacgctgctgctgctcgccgcggcgctactggccgtgtcggacgcactcgggcgcccctccgaggaggacgaggagctagtggtgccggagctggagcgcgccccgggacacgggaccacg

SEQ ID NO: 832 - DNA, 28 bp, Homo sapiens
cgtctcggcctggctgccaaacagaacg

SEQ ID NO: 833 - DNA, 124 bp, Homo sapiens
cggcgcgcacggccaaggcacgcgcgctggcacacgcgggcgcggacacgcgcggacacacacgtgcgggacacgccctcccccgacggcggcgctaacctctcggtaagtccagcgccccacg

SEQ ID NO: 834 - DNA, 80 bp, Homo sapiens
cgaggtgcaggcggcgcgggcgctcaccgtgagcgccgtgctgctggcgttcgttgcgctcttcgtgaccctggcgggcg

SEQ ID NO: 835 - DNA, 62 bp, Homo sapiens
cgaggcgtggaggggcagccgcggcggggcgacccttacctgctcactgcggggcctgtccg

SEQ ID NO: 836 - DNA, 165 bp, Homo sapiens
cgccacctgaccccgccaccaagcctaaggtgtcctggatccacggcaagcacagcgccgctgcagctggccgtgcgccctcaccaccgccgccaggctccgaggccgcgcccagccccagcaagaggaaacggacgcccagcgacaaatcggcgcatacggtcg

SEQ ID NO: 837 - DNA, 43 bp, Homo sapiens
cgcgctccgaggaagcgccggaaccaccagaagcacagggacg

SEQ ID NO: 838 - DNA, 86 bp, Homo sapiens
cgccacctccaaccagctgcaagccgagctgcccacctgggaccgggccggcccggcgggcttggctcccggcgaaggcggcggcg

SEQ ID NO: 839 - DNA, 23 bp, Homo sapiens
cgcccccttatcccacgggctcg

SEQ ID NO: 840 - DNA, 2 bp, Homo sapiens
cg

SEQ ID NO: 841 - DNA, 99 bp, Homo sapiens
cggcaggagcagctcacagccaggagcgctctcccgcccccaacgccgcgctcccccctccaaaacggtttaaaaaaatccaccaattgcatggccgcg

SEQ ID NO: 842 - DNA, 73 bp, Homo sapiens
cgaccatttctgtgcttctaggagcccaccctgggcggcagggaggcgttgcgtggggctcacgagttccacg

SEQ ID NO: 843 - DNA, 2 bp, Homo sapiens
cg

SEQ ID NO: 844 - DNA, 52 bp, Homo sapiens
cgctcccaggacccccgcccgctctctcctgactcggtccctgcccgccccg

SEQ ID NO: 845 - DNA, 50 bp, Homo sapiens
cgcagccgccgcgtccgcacctgaccatggagtgcgccctcctgctcgcg

SEQ ID NO: 846 - DNA, 50 bp, Homo sapiens
cgaacgcagagtccacacgtggattcccgcgcctgtgatgccccgacccg

SEQ ID NO: 847 - DNA, 2 bp, Homo sapiens
cg

SEQ ID NO: 848 - DNA, 2 bp, Homo sapiens
cg

SEQ ID NO: 849 - DNA, 52 bp, Homo sapiens
cgcctggggcccacgcgagccgcgagcccctgcctgctcctgcgctaccccg

SEQ ID NO: 850 - DNA, 2 bp, Homo sapiens
cg

SEQ ID NO: 851 - DNA, 2 bp, Homo sapiens
cg

SEQ ID NO: 852 - DNA, 2 bp, Homo sapiens
cg

SEQ ID NO: 853 - DNA, 138 bp, Homo sapiens
cgcggcgcctctagctgcccctcactcgtctcgcccgccagtctccctcccgcgcgatggcctcggcgctgagctatgtctccaagttcaagtccttcgtgatcttgttcgtcaccccgctcctgctgctgccactcg

SEQ ID NO: 854 - DNA, 2 bp, Homo sapiens
cg

SEQ ID NO: 855 - DNA, 2 bp, Homo sapiens
cg

SEQ ID NO: 856 - DNA, 2 bp, Homo sapiens
cg

SEQ ID NO: 857 - DNA, 1017 bp, Artificial Sequence
  Description of Artificial Sequence: Synthetic polynucleotide
yggygatttyggttttygtaaggtggggyggygagtaggagtyggggttaggttaggggttygagttttygttygaggggyggggaaggygggtgaygtgagtygggtygggygggyggagttgggatyggtttygggaggygggggygagygygyggagaggtagaygygaggagggaggyggttgagtagygygggyggttttgyggygggygyggtgggygygggyggyggggtttygggattttygygygtttttttygygyggygtygtygtygygygtttttaygtttygygttttayggygttttygtttygygygtttttygtgttygttttttgttagttttygggtygyggtygtttgtagagygagygtttagayggagttttygggtaatttgagtggygtygatyggyggyggagtttttggtagagtttttygattyggtagygyggaggggattygygttygttygygtygygttattttaaattttaagtagygtygttttatyggygyggagtttyggttggaggtaagagtygygygtygggagataygtatygtgagyggtagygtygtyggttttttttttygtygtttyggagggygaagtygyggttttttagttttttgttgygtygygatagygtyggaataygtttygtttygttgtygttttygttgtgtygtyggyggagggggtygygagtttygygtttyggtyggaggatgtgygttttygygggtygtttagtttgagttatgygttttaayggyggyggygygtyggtyggtatggagtttygygyggtygygttttgattygttgtgygtttygyggtyggygggyggygggaggyggyggatygagagtyggagatyggygtygygggayggaagygagygggygygggygtygygtagatggtttgggygagttaggtttgaggtttygtttttygaaaygtgattatgtggatttaatagtttttaggatttaggtgagyg

SEQ ID NO: 858 - DNA, 166 bp, Artificial Sequence
  Description of Artificial Sequence: Synthetic polynucleotide
ygttyggagygygggyggggttagtttgggtagtygygggtygttgttgygtyggaagttttygtygttagggagttttttgggygttaggttttgggtttttgggygaagtygaygttagaatatgtttggtttygtatttagtttatygtatttttagygygyg

SEQ ID NO: 859 - DNA, 2 bp, Artificial Sequence
  Description of Artificial Sequence: Synthetic oligonucleotide
yg

SEQ ID NO: 860 - DNA, 2 bp, Artificial Sequence
  Description of Artificial Sequence: Synthetic oligonucleotide
yg

SEQ ID NO: 861 - DNA, 2 bp, Artificial Sequence
  Description of Artificial Sequence: Synthetic oligonucleotide
yg

SEQ ID NO: 862 - DNA, 2 bp, Artificial Sequence
  Description of Artificial Sequence: Synthetic oligonucleotide
yg

SEQ ID NO: 863 - DNA, 2 bp, Artificial Sequence
  Description of Artificial Sequence: Synthetic oligonucleotide
yg

SEQ ID NO: 864 - DNA, 2 bp, Artificial Sequence
  Description of Artificial Sequence: Synthetic oligonucleotide
yg

SEQ ID NO: 865 - DNA, 14 bp, Artificial Sequence
  Description of Artificial Sequence: Synthetic oligonucleotide
ygygttttagygyg

SEQ ID NO: 866 - DNA, 2 bp, Artificial Sequence
  Description of Artificial Sequence: Synthetic oligonucleotide
yg

SEQ ID NO: 867 - DNA, 2 bp, Artificial Sequence
  Description of Artificial Sequence: Synthetic oligonucleotide
yg

SEQ ID NO: 868 - DNA, 2 bp, Artificial Sequence
  Description of Artificial Sequence: Synthetic oligonucleotide
yg

SEQ ID NO: 869 - DNA, 125 bp, Artificial Sequence
  Description of Artificial Sequence: Synthetic polynucleotide
yggttttatttatttgtttygaagagtggttttagttttgygtttttttttgygattttatatatagggatagttttaggtatagttttagtagtaggagtatggyggggygagggygygggayg

SEQ ID NO: 870 - DNA, 2 bp, Artificial Sequence
  Description of Artificial Sequence: Synthetic oligonucleotide
yg

SEQ ID NO: 871 - DNA, 131 bp, Artificial Sequence
  Description of Artificial Sequence: Synthetic polynucleotide
yggggtgtgaagtggyggygggtagaggggttygtaggggttgggattygygtgtttttttttgtttyggtgyggagtaygatgtgttygggygggggygaggaygttygggaggggttgggttgygtayg

SEQ ID NO: 872 - DNA, 94 bp, Artificial Sequence
  Description of Artificial Sequence: Synthetic oligonucleotide
ygggtttgttttyggtttygttyggagggtgtgygggttttygtttygttggtttygtttgtttattayggygygtttaaatttaygyggttyg

SEQ ID NO: 873 - DNA, 2 bp, Artificial Sequence
  Description of Artificial Sequence: Synthetic oligonucleotide
yg

SEQ ID NO: 874 - DNA, 2 bp, Artificial Sequence
  Description of Artificial Sequence: Synthetic oligonucleotide
yg

SEQ ID NO: 875 - DNA, 27 bp, Artificial Sequence
  Description of Artificial Sequence: Synthetic oligonucleotide
ygygatggggaggggaatatttgygyg

SEQ ID NO: 876 - DNA, 164 bp, Artificial Sequence
  Description of Artificial Sequence: Synthetic polynucleotide
ygagattagaggggaaattygaaaaagtaagtttttgyggtagtagttaggaaatattygttaggaattggttgygattttaattttagyggttygaagttttagtttttttatttttatygyggtagagtygttttygtagatatttttygaggagaatygyg

SEQ ID NO: 877 - DNA, 2 bp, Artificial Sequence
  Description of Artificial Sequence: Synthetic oligonucleotide
yg

SEQ ID NO: 878 - DNA, 2 bp, Artificial Sequence
  Description of Artificial Sequence: Synthetic oligonucleotide
yg

SEQ ID NO: 879 - DNA, 68 bp, Artificial Sequence
  Description of Artificial Sequence: Synthetic oligonucleotide
ygttgggttygtygaggtyggggtttttttatgggagggaggtggttgyggyggaatttttagatgyg

SEQ ID NO: 880 - DNA, 508 bp, Artificial Sequence
  Description of Artificial Sequence: Synthetic polynucleotide
yggyggtagygggagttygagygttgygygtttattatggtygtttagggagagttyggttatttggyggygtagtyggatttyggttttaatagygagygtagtatygattttttagtgttyggtttygaggaygatttggtygtyggggygattttgtatagttyggagtggagygaggagygttttygygtggataggaagaaatttgaggttatgttataaggtaggtatttttygtgttttyggatttttygattgagtttttaattttttttyggatatttttatygygygtttyggygttygttattttagtttayggtyggtyggtttagttttaggttygttttttygyggagtyggaggatatttagggattggagatttygygggattttttatttttttaygttttttagatttttaggygttgggggttttgtgygaatttgattggttttagaaaagtygaaggtygagtttgtattggygygtttaagttgyg

SEQ ID NO: 881 - DNA, 2 bp, Artificial Sequence
  Description of Artificial Sequence: Synthetic oligonucleotide
yg

SEQ ID NO: 882 - DNA, 2 bp, Artificial Sequence
  Description of Artificial Sequence: Synthetic oligonucleotide
yg

SEQ ID NO: 883 - DNA, 2 bp, Artificial Sequence
  Description of Artificial Sequence: Synthetic oligonucleotide
yg

SEQ ID NO: 884 - DNA, 2 bp, Artificial Sequence
  Description of Artificial Sequence: Synthetic oligonucleotide
yg

SEQ ID NO: 885 - DNA, 4 bp, Artificial Sequence
  Description of Artificial Sequence: Synthetic oligonucleotide
ygyg

SEQ ID NO: 886 - DNA, 2 bp, Artificial Sequence
  Description of Artificial Sequence: Synthetic oligonucleotide
yg

SEQ ID NO: 887 - DNA, 2 bp, Artificial Sequence
  Description of Artificial Sequence: Synthetic oligonucleotide
yg

SEQ ID NO: 888 - DNA, 9 bp, Artificial Sequence
  Description of Artificial Sequence: Synthetic oligonucleotide
ygtgtagyg

SEQ ID NO: 889 - DNA, 2 bp, Artificial Sequence
  Description of Artificial Sequence: Synthetic oligonucleotide
yg

SEQ ID NO: 890 - DNA, 2 bp, Artificial Sequence
  Description of Artificial Sequence: Synthetic oligonucleotide
yg

SEQ ID NO: 891 - DNA, 396 bp, Artificial Sequence
  Description of Artificial Sequence: Synthetic polynucleotide
tgaggaygaggaggaagaggaggaggaagaagaagaagaggaagaggaggaggaggaggaggaggaygygtttaggttgagatggttygygtggatattgttatttattttaagattgttgttttygtygtygtygtygtygtygttgttgtygtygtygtygtygttattatttgttatagttagtaaygggtagtyggygtaggggttygggggagtttttttygtygttagygttattttaaatatttattaatagttatattgttgttattgttgtygtygtygtygtygtygtggagygygggaggggggyggggaggygtttgggttyggggygttgtgygygatttggyggggtgygtygagatatatatagygagtygtygtygttyg

SEQ ID NO: 892 - DNA, 2 bp, Artificial Sequence
  Description of Artificial Sequence: Synthetic oligonucleotide
yg

SEQ ID NO: 893 - DNA, 70 bp, Artificial Sequence
  Description of Artificial Sequence: Synthetic oligonucleotide
ygggtygttatttgtttatttgttttatttaggatatttttttaaataatttttaagtggaaaaattayg

SEQ ID NO: 894 - DNA, 2 bp, Artificial Sequence
  Description of Artificial Sequence: Synthetic oligonucleotide
yg

SEQ ID NO: 895 - DNA, 68 bp, Artificial Sequence
  Description of Artificial Sequence: Synthetic oligonucleotide
ygygggggaygyggggygyggygygttgagygygggtgtygaggttggagggygyggtygggttttyg

SEQ ID NO: 896 - DNA, 88 bp, Artificial Sequence
  Description of Artificial Sequence: Synthetic oligonucleotide
ygagggtyggttygtttttggggattygyggatgtygygagggggygtygygttattgaaggttgggaygggggyggtgygyggggyg

SEQ ID NO: 897 - DNA, 2 bp, Artificial Sequence
  Description of Artificial Sequence: Synthetic oligonucleotide
yg

SEQ ID NO: 898 - DNA, 2 bp, Artificial Sequence
  Description of Artificial Sequence: Synthetic oligonucleotide
yg

SEQ ID NO: 899 - DNA, 87 bp, Artificial Sequence
  Description of Artificial Sequence: Synthetic oligonucleotide
ygagttgtttygtttttttattttgggggygaagaagggtyggggagtgggggaaagygggaggygtygyggtttgggaggttttyg

SEQ ID NO: 900 - DNA, 45 bp, Artificial Sequence
  Description of Artificial Sequence: Synthetic oligonucleotide
ygagtttttgygttgtttttgtygtyggagttygggtttgttayg

SEQ ID NO: 901 - DNA, 2 bp, Artificial Sequence
  Description of Artificial Sequence: Synthetic oligonucleotide
yg

SEQ ID NO: 902 - DNA, 173 bp, Artificial Sequence
  Description of Artificial Sequence: Synthetic polynucleotide
yggttggaatttttttaagtattgttttgagtttatttttaaatgaaagggggaaaaatttaaattagattagaatttgaaatagttgaaatagttatygatttttagtttgtttttaagtttggtagagattgtgaaagttttaattttttygygatgttagttayggttyg

SEQ ID NO: 903 - DNA, 2 bp, Artificial Sequence
  Description of Artificial Sequence: Synthetic oligonucleotide
yg

SEQ ID NO: 904 - DNA, 48 bp, Artificial Sequence
  Description of Artificial Sequence: Synthetic oligonucleotide
ygaagaygagaygtagagttttaattgtagttagagataaaggtttyg

SEQ ID NO: 905 - DNA, 2 bp, Artificial Sequence
  Description of Artificial Sequence: Synthetic oligonucleotide
yg

SEQ ID NO: 906 - DNA, 2 bp, Artificial Sequence
  Description of Artificial Sequence: Synthetic oligonucleotide
yg

SEQ ID NO: 907 - DNA, 36 bp, Artificial Sequence
  Description of Artificial Sequence: Synthetic oligonucleotide
ygatygtggygttagtttttygttttttttgtttyg

SEQ ID NO: 908 - DNA, 2 bp, Artificial Sequence
  Description of Artificial Sequence: Synthetic oligonucleotide
yg

SEQ ID NO: 909 - DNA, 2 bp, Artificial Sequence
  Description of Artificial Sequence: Synthetic oligonucleotide
yg

SEQ ID NO: 910 - DNA, 2 bp, Artificial Sequence
  Description of Artificial Sequence: Synthetic oligonucleotide
yg

SEQ ID NO: 911 - DNA, 2 bp, Artificial Sequence
  Description of Artificial Sequence: Synthetic oligonucleotide
yg

SEQ ID NO: 912 - DNA, 2 bp, Artificial Sequence
  Description of Artificial Sequence: Synthetic oligonucleotide
yg

SEQ ID NO: 913 - DNA, 97 bp, Artificial Sequence
  Description of Artificial Sequence: Synthetic oligonucleotide
ygtttgtaaggaygggagtyggggagggtgtagggygagtttaaaggaygggtagagtaagtttygggaagaggtaggggttttttttttygggtyg

SEQ ID NO: 914 - DNA, 2 bp, Artificial Sequence
  Description of Artificial Sequence: Synthetic oligonucleotide
yg

SEQ ID NO: 915 - DNA, 2 bp, Artificial Sequence
  Description of Artificial Sequence: Synthetic oligonucleotide
yg

SEQ ID NO: 916 - DNA, 67 bp, Artificial Sequence
  Description of Artificial Sequence: Synthetic oligonucleotide
ygttagatttttatagttttttataygttatttttattgttttagggaattataagtataggtatyg

SEQ ID NO: 917 - DNA, 2 bp, Artificial Sequence
  Description of Artificial Sequence: Synthetic oligonucleotide
yg

SEQ ID NO: 918 - DNA, 29 bp, Artificial Sequence
  Description of Artificial Sequence: Synthetic oligonucleotide
ygatagggtagagggttagtagttattyg

SEQ ID NO: 919 - DNA, 49 bp, Artificial Sequence
  Description of Artificial Sequence: Synthetic oligonucleotide
yggtygagtttaagtggttgaagygyggaygaggatgygyggggtttyg

SEQ ID NO: 920 - DNA, 188 bp, Artificial Sequence
  Description of Artificial Sequence: Synthetic polynucleotide
ygggagttygaagtygtttygagygggggtgggyggtgagyggattttygggtgttgattaggtgtttggtggtagagtagggaaggggggaayggaygtygattttagggattttttattygtttaygttttttggygttggttataygtygtygttttagtattaattggaggtttttagtggayg

SEQ ID NO: 921 - DNA, 4 bp, Artificial Sequence
  Description of Artificial Sequence: Synthetic oligonucleotide
ygyg

SEQ ID NO: 922 - DNA, 4 bp, Artificial Sequence
  Description of Artificial Sequence: Synthetic oligonucleotide
ygyg

SEQ ID NO: 923 - DNA, 113 bp, Artificial Sequence
  Description of Artificial Sequence: Synthetic polynucleotide
yggtygtgggyggttgyggygyggtygyggygaggggygagyggggttggtttygtygttygggygagagtatttttttgggggttaattttgyggtttygtttttattygyg

SEQ ID NO: 924 - DNA, 208 bp, Artificial Sequence
  Description of Artificial Sequence: Synthetic polynucleotide
yggyggatggagaygggagggaggttgygaggtygttygaggagagattaaggttttagaaayggagaagygggygttttgygggaggyggyggygttgtygttggtygttaagggygggaagtgttttgggatttttattaggggtygygagtttygagygttaaattttygyggygttygtttagygygttgttgtggygggygyg

SEQ ID NO: 925 - DNA, 96 bp, Artificial Sequence
  Description of Artificial Sequence: Synthetic oligonucleotide
yggttygttygttttttagtagttttggggtgttyggggyggttttgtaagygggagagagyggygaggyggyggygtygagtgyggggggatgyg

SEQ ID NO: 926 - DNA, 236 bp, Artificial Sequence
  Description of Artificial Sequence: Synthetic polynucleotide
yggtgagtattygtygtggggaagggttttggggatttattggaggtygyggttygtagtagttaggggtygagttayggttayggaygttttggtgtttyggttygtgtygggtttttaggyggaggaggygttygttgggtttagattttygattttagtttyggtttttyggygtttgggttgygyggagtttttgtttygygtttyggatttttaygygtagtttttaygyg

SEQ ID NO: 927 - DNA, 211 bp, Artificial Sequence
  Description of Artificial Sequence: Synthetic polynucleotide
ygtttttagtygtgttttggttgygtagttggaaaggttgagtagtttattgttgtttttttgttyggttttggatatatygtttgaatttttgggygtttttgttgttaagtgggggatagtattatttattggggaggaaaattttaggaatgtggattttggggttaygtaggggttgggaagtgaagggtagggaaygygggyggyg

SEQ ID NO: 928 - DNA, 193 bp, Artificial Sequence
  Description of Artificial Sequence: Synthetic polynucleotide
ygygygtygaagttgtgayggtttattaagtagagatttgygaggtatatagagagggaatgaggyggaatygttygggggttygttgatattgtagagtttttygtagtatygttgttttaaatttygtttttttaggygtgygygtatagygagttagaggaggtttygtttygatttggggtttttygyg

SEQ ID NO: 929 - DNA, 4 bp, Artificial Sequence
  Description of Artificial Sequence: Synthetic oligonucleotide
ygyg

SEQ ID NO: 930 - DNA, 199 bp, Artificial Sequence
  Description of Artificial Sequence: Synthetic polynucleotide
ygagtaggaggatttaaygaatttagtttgtggatatgttttaatttttattttygttttttttaggtttgtttaggtgaggatgatgggagggaaaagyggtgtatagtygtaatattggtattttgtaagagtygtyggggtattgatatagagggatatygtattggagatgyggtgtttayggagatttattgyg

SEQ ID NO: 931 - DNA, 87 bp, Artificial Sequence
  Description of Artificial Sequence: Synthetic oligonucleotide
yggttagtagaggyggygtttggttttggatgttgtagyggagaygttaaggagattgaatgtagggagygaggygtagyggtygyg

SEQ ID NO: 932 - DNA, 68 bp, Artificial Sequence
  Description of Artificial Sequence: Synthetic oligonucleotide
ygygygagagtgtttagttgggaaatgtagtttygaattaatatygtatgttttataattagtttayg

SEQ ID NO: 933 - DNA, 61 bp, Artificial Sequence
  Description of Artificial Sequence: Synthetic oligonucleotide
ygtttttggtatttagggaatggtttgtaaattttaatgtattatagattagtttttatyg

SEQ ID NO: 934 - DNA, 40 bp, Artificial Sequence
  Description of Artificial Sequence: Synthetic oligonucleotide
ygggtgttttgtygttgtygtttttgttgtygtygattyg

SEQ ID NO: 935 - DNA, 647 bp, Artificial Sequence
  Description of Artificial Sequence: Synthetic polynucleotide
ygagyggygaggygagggygagygygtygaggaagggygggagaggygyggagtttggtygygtygygttgygtygagygtygggtttttttygygagtttttygggttygygygygygttttttattgttttygtttttygygyggygygtgttttttatttttygtygygygttttygtattygttyggttttaygyggygygygtttgttttggyggtagyggyggyggyggyggygygttttttttygaaygtygtttttagggttgttggttgygttttttattgtttygyggttgttgttyggggtgggyggygaggygggggggaggtgtyggtttggtygtyggggagggtttatygttygggyggatttttattgygagagygatgygggtttaggygyggygygygggggttgtagggygtttagtattgggggttgtyggygygygggggtttttttttggtttttaggtattygttgttgttgggygtttttygtattttyggttattatggatatttygttttttygtygtttttttygygtatttygggaggtygtyggggyggtagtagyggygyggtttygygggtgtttaggtgatyggttyggtagyggtagagtagtggtagtagtyg

SEQ ID NO: 936 - DNA, 327 bp, Artificial Sequence
  Description of Artificial Sequence: Synthetic polynucleotide
ygyggaggagggtygggttgattgtygtygttgagttgttttyggaygggagygtttgtttayggtatttattttttttagyggtggaaatgtggagaagtaagtgggaggyggtgtygggaattgattttttttaaaayggtyggygtygttgttttgaaatgggyggttaagtgtttgtgggattaagggyggttttagagatgttyggaaaatygttgttayggttagagtgyggygtagaygyggtagagttggaggtgttygyggtgtaggttgttgtttaygtygtttaggttaggtgttgagggtttagttygygtttyg

SEQ ID NO: 937 - DNA, 2 bp, Artificial Sequence
  Description of Artificial Sequence: Synthetic oligonucleotide
yg

SEQ ID NO: 938 - DNA, 324 bp, Artificial Sequence
  Description of Artificial Sequence: Synthetic polynucleotide
ygtagttgttgtagtygttgyggttgtygttatttggtaggaggtatagggtatgggtgagggaggttgyggtagyggttaygagttgttgaggaagttagattgtaggtatttggggggygttaggtagtygtagtygtyggtttyggygttygttaygtygtattygtttgyggygttttyggtttygaagagttttttgtygggttggaagtgygygggyggyggtyggaagggtttttttatgyggyggyggygtyggtagttgtttttttygaatatgttttygtaggtygggtttagygtttagtagttgtttttgyg

SEQ ID NO: 939 - DNA, 77 bp, Artificial Sequence
  Description of Artificial Sequence: Synthetic oligonucleotide
yggygtagyggygggaattygaggtygagygtygyggyggtagygttagaagygtatttatygggtayggygaggyg

SEQ ID NO: 940 - DNA, 158 bp, Artificial Sequence
  Description of Artificial Sequence: Synthetic polynucleotide
ygttttggattttygaagttagttttttgygtagyggattagagaggtttattygyggaygttaatttaatttttgggyggggttygggggttgagtagaaggygaggtttggggagtayggataattttgagggttgtttgtgtyggggtgggagyg

SEQ ID NO: 941 - DNA, 79 bp, Artificial Sequence
  Description of Artificial Sequence: Synthetic oligonucleotide
ygtttttaaaaattaaataaattaataagagaattaattaataggtagygttgygatygttaggagygyggagygygyg

SEQ ID NO: 942 - DNA, 137 bp, Artificial Sequence
  Description of Artificial Sequence: Synthetic polynucleotide
ygttttttttgatttttaaggttagaaagatttattatttttttygagagggygtagttatagatttattagagagggygggtagggtgtyggaagttagagaayggygtttygygtttttttatygttttagggyg

SEQ ID NO: 943 - DNA, 112 bp, Artificial Sequence
  Description of Artificial Sequence: Synthetic polynucleotide
ygygggttatgtattgttgttggtgtttattatgtttaattttttggattataagtggtataaggagtygttgtagtagtgtaatttygatgggtygttgggtgtygtagyg

SEQ ID NO: 944 - DNA, 2 bp, Artificial Sequence
  Description of Artificial Sequence: Synthetic oligonucleotide
yg

SEQ ID NO: 945 - DNA, 2 bp, Artificial Sequence
  Description of Artificial Sequence: Synthetic oligonucleotide
yg

SEQ ID NO: 946 - DNA, 282 bp, Artificial Sequence
  Description of Artificial Sequence: Synthetic polynucleotide
ygtgggtagggygtygtagtttgygtagtttygaggatttygygtygttttttygagttagggtttttaggagygggtygygtaggagaygttagagggggttgttagyggttgttgggagaaygggttayggaaatagttttttttaaagtyggggttatygtggggtgggygagttygtttttttaggtygggggygyggattagaggggaygtgtgtagayggtygyggttagttttatttygttygggyggagaygtatagttggagttggagggtyg

SEQ ID NO: 947 - DNA, 81 bp, Artificial Sequence
  Description of Artificial Sequence: Synthetic oligonucleotide
yggttgttaattygtttaatttgttgygygggtggtygtttagagtygygggtttgyggggygtttttygtygtygygtyg

SEQ ID NO: 948 - DNA, 53 bp, Artificial Sequence
  Description of Artificial Sequence: Synthetic oligonucleotide
yggtygtggagattttaatygagtttaygttggygtaaaaggtaaaagtygyg

SEQ ID NO: 949 - DNA, 40 bp, Artificial Sequence
  Description of Artificial Sequence: Synthetic oligonucleotide
ygygtygagggggygttagyggggaygtgagttggygtyg

SEQ ID NO: 950 - DNA, 206 bp, Artificial Sequence
  Description of Artificial Sequence: Synthetic polynucleotide
yggtagtttgagygtttyggatggttygyggyggggyggtttgtaagagygaygygyggttgttgttggggygggaygygttgyggtyggygttygttttgttggttttygtygtgttgttgggygtygygttyggtttyggtttyggtttttggtttggttgtygygygggtygttagygtaygygatattaggtgggtyggtyg

SEQ ID NO: 951 - DNA, 38 bp, Artificial Sequence
  Description of Artificial Sequence: Synthetic oligonucleotide
ygagggtayggyggtygtygtttygygtagtagtagyg

SEQ ID NO: 952 - DNA, 5 bp, Artificial Sequence
  Description of Artificial Sequence: Synthetic oligonucleotide
yggyg

SEQ ID NO: 953 - DNA, 25 bp, Artificial Sequence
  Description of Artificial Sequence: Synthetic oligonucleotide
ygagygaatgtaaygygtatatayg

SEQ ID NO: 954 - DNA, 79 bp, Artificial Sequence
  Description of Artificial Sequence: Synthetic oligonucleotide
ygtttttttttttttttaaaaaaaaaatttaaataatttttaaataatatttaataggaaagaagaaggaaaaggagyg

SEQ ID NO: 955 - DNA, 33 bp, Artificial Sequence
  Description of Artificial Sequence: Synthetic oligonucleotide
ygagggtaayggtygaggygttaygyggggtyg

SEQ ID NO: 956 - DNA, 132 bp, Artificial Sequence
  Description of Artificial Sequence: Synthetic polynucleotide
ygtaggttaggyggtygtgggtygagttggttatgattattttttygygggygttttgtttgggygagtgtttttygtagygttygtatttygtttttttygtgtgtagtttygygtygtygtygttygtyg

SEQ ID NO: 957 - DNA, 32 bp, Artificial Sequence
  Description of Artificial Sequence: Synthetic oligonucleotide
ygttttyggggtagaggagggggtgttaggyg

SEQ ID NO: 958 - DNA, 2 bp, Artificial Sequence
  Description of Artificial Sequence: Synthetic oligonucleotide
yg

SEQ ID NO: 959 - DNA, 2 bp, Artificial Sequence
  Description of Artificial Sequence: Synthetic oligonucleotide
yg

SEQ ID NO: 960 - DNA, 20 bp, Artificial Sequence
  Description of Artificial Sequence: Synthetic oligonucleotide
yggygtygttggtatattyg

SEQ ID NO: 961 - DNA, 85 bp, Artificial Sequence
  Description of Artificial Sequence: Synthetic oligonucleotide
yggygggygtaggggtagggtatgattgaygygttttttgtttgygtttatgtgagagaaagyggtygagggagggagygtgtyg

SEQ ID NO: 962 - DNA, 230 bp, Artificial Sequence
  Description of Artificial Sequence: Synthetic polynucleotide
ygtaggggtygagaaagtggyggagaggyggtggtygaggtttaggggygagygygggttgagttggtttttgttgygtttaygagygatatttattttttygttgyggaygtttygygggygttaggttgggggttttgygatygatttttttygttttygaggtatygtygggttygtttggtaggtagygygtttygygagttggagggtygagtttygyggggtyg

SEQ ID NO: 963 - DNA, 84 bp, Artificial Sequence
  Description of Artificial Sequence: Synthetic oligonucleotide
ygtaagagttggttaaaatgtttttaggtgygtgggggtttyggggttttagttggagttygatattttgagattggyggttyg

SEQ ID NO: 964 - DNA, 42 bp, Artificial Sequence
  Description of Artificial Sequence: Synthetic oligonucleotide
ygygygagttttttygtttggttgagttaaaaagggatygyg

SEQ ID NO: 965 - DNA, 45 bp, Artificial Sequence
  Description of Artificial Sequence: Synthetic oligonucleotide
yggaygattttttttattttttygaggaygaggaggagtayggyg

SEQ ID NO: 966 - DNA, 26 bp, Artificial Sequence
  Description of Artificial Sequence: Synthetic oligonucleotide
ygygggataagggatgttggygggyg

SEQ ID NO: 967 - DNA, 50 bp, Artificial Sequence
  Description of Artificial Sequence: Synthetic oligonucleotide
ygaggtttttttygyggygygyggtagttttagtttttatttaaatttyg

SEQ ID NO: 968 - DNA, 56 bp, Artificial Sequence
  Description of Artificial Sequence: Synthetic oligonucleotide
ygttggtttattygygtgtaygtttattttttaygygygtttttggtttagaagyg

SEQ ID NO: 969 - DNA, 44 bp, Artificial Sequence
  Description of Artificial Sequence: Synthetic oligonucleotide
ygagygtgtgygygygygaggggagygygtgygyggtgaggayg

SEQ ID NO: 970 - DNA, 2 bp, Artificial Sequence
  Description of Artificial Sequence: Synthetic oligonucleotide
yg

SEQ ID NO: 971 - DNA, 9 bp, Artificial Sequence
  Description of Artificial Sequence: Synthetic oligonucleotide
yggaaggyg

SEQ ID NO: 972 - DNA, 58 bp, Artificial Sequence
  Description of Artificial Sequence: Synthetic oligonucleotide
ygttygtttattygttaggtaggyggtggtgtygatttatttgagtagttgtttygyg

SEQ ID NO: 973 - DNA, 151 bp, Artificial Sequence
  Description of Artificial Sequence: Synthetic polynucleotide
ygtattggtttttttygttttygttygtaygaaagttttgttygaygtttgtagttagtatygttygtattgtttagggagggtttgygtygagatttagtggtygagtgagttatagagtygttggttttggggaygttgttttttatyg

SEQ ID NO: 974 - DNA, 17 bp, Artificial Sequence
  Description of Artificial Sequence: Synthetic oligonucleotide
yggttttggggagttyg

SEQ ID NO: 975 - DNA, 70 bp, Artificial Sequence
  Description of Artificial Sequence: Synthetic oligonucleotide
ygtagaggggttagtaattttatgggtggtggggttttttatttttggaygtagyggggagtagygggyg

SEQ ID NO: 976 - DNA, 59 bp, Artificial Sequence
  Description of Artificial Sequence: Synthetic oligonucleotide
yggygtttagygtttaagygttaattygttgaaagttttttagygaaattttagggayg

SEQ ID NO: 977 - DNA, 25 bp, Artificial Sequence
  Description of Artificial Sequence: Synthetic oligonucleotide
yggttyggatagaggttatttagyg

SEQ ID NO: 978 - DNA, 57 bp, Artificial Sequence
  Description of Artificial Sequence: Synthetic oligonucleotide
ygtttttygttatttgatattagttaggtagtttttagggttagagygttagygtyg

SEQ ID NO: 979 - DNA, 111 bp, Artificial Sequence
  Description of Artificial Sequence: Synthetic polynucleotide
ygtttagggttggggttyggtgggaattttttygtgttygaagggaygatttygttagagagtttttygatttttgtatttatygtttttggtaggaygtggagttgttyg

SEQ ID NO: 980 - DNA, 211 bp, Artificial Sequence
  Description of Artificial Sequence: Synthetic polynucleotide
ygttattgtygtygttggygttttgtttttggaattttttagtaagatggtatttattgtttgttttttttygattagtatttttagtygygttttttttttttygggataygtattagttatatattgtggggagaagatgggttatgtaaatgtaagttaaygygtttttttagttatttttgtataatgtaataggaatagygattyg

SEQ ID NO: 981 - DNA, 75 bp, Artificial Sequence
  Description of Artificial Sequence: Synthetic oligonucleotide
ygtttttattatttttttaaatattgtagtaagttgtagtaaggygggtaaatatygatagygygygtgggggyg

SEQ ID NO: 982 - DNA, 2 bp, Artificial Sequence
  Description of Artificial Sequence: Synthetic oligonucleotide
yg

SEQ ID NO: 983 - DNA, 66 bp, Artificial Sequence
  Description of Artificial Sequence: Synthetic oligonucleotide
yggttatttgtttttygttttyggggygtygtttagtttygygttaggygttttttttagygttyg

SEQ ID NO: 984 - DNA, 2 bp, Artificial Sequence
  Description of Artificial Sequence: Synthetic oligonucleotide
yg

SEQ ID NO: 985 - DNA, 163 bp, Artificial Sequence
  Description of Artificial Sequence: Synthetic polynucleotide
ygygygtttttyggygggtyggygggttyggaagtttygttgttygggtygggtttttaagttygtagtygttttgattaaaataggtatygygayggyggyggtaggyggyggtagttagggttggggtygtatygygtaygygtatgygttygtygtttyg

SEQ ID NO: 986 - DNA, 99 bp, Artificial Sequence
  Description of Artificial Sequence: Synthetic oligonucleotide
ygtttttgttttggagygyggtygggagtaaaatygtaggagtgggagggtagygagttagttggatttygagtygyggagygygttggttttgtttyg

SEQ ID NO: 987 - DNA, 96 bp, Artificial Sequence
  Description of Artificial Sequence: Synthetic oligonucleotide
ygygttttygtaggyggtattgttygyggygyggygtgtgtatygagygagtgaaggtatgtgtggygggygyggttggagttgtygtygtygtyg

SEQ ID NO: 988 - DNA, 4 bp, Artificial Sequence
  Description of Artificial Sequence: Synthetic oligonucleotide
ygyg

SEQ ID NO: 989 - DNA, 16 bp, Artificial Sequence
  Description of Artificial Sequence: Synthetic oligonucleotide
yggygagattggtayg

SEQ ID NO: 990 - DNA, 2 bp, Artificial Sequence
  Description of Artificial Sequence: Synthetic oligonucleotide
yg

SEQ ID NO: 991 - DNA, 141 bp, Artificial Sequence
  Description of Artificial Sequence: Synthetic polynucleotide
ygyggttgatggttgaygygttgygyggttgygtgtttgttttttayggygtggtggagygygayggygaaagttatttgtagttgtaggatttgttygatggtttygayggattttgtgtgttygattgtaaaatgggyg

SEQ ID NO: 992 - DNA, 2 bp, Artificial Sequence
  Description of Artificial Sequence: Synthetic oligonucleotide
yg

SEQ ID NO: 993 - DNA, 37 bp, Artificial Sequence
  Description of Artificial Sequence: Synthetic oligonucleotide
ygtttttaattaatygtataaaattygtaatatttyg

SEQ ID NO: 994 - DNA, 52 bp, Artificial Sequence
  Description of Artificial Sequence: Synthetic oligonucleotide
ygggtyggggtatttggygttttgtgtgggtggygggagyggggaygtttyg

SEQ ID NO: 995 - DNA, 2 bp, Artificial Sequence
  Description of Artificial Sequence: Synthetic oligonucleotide
yg

SEQ ID NO: 996 - DNA, 7 bp, Artificial Sequence
  Description of Artificial Sequence: Synthetic oligonucleotide
yggagyg

SEQ ID NO: 997 - DNA, 2 bp, Artificial Sequence
  Description of Artificial Sequence: Synthetic oligonucleotide
yg

SEQ ID NO: 998 - DNA, 4 bp, Artificial Sequence
  Description of Artificial Sequence: Synthetic oligonucleotide
ygyg

SEQ ID NO: 999 - DNA, 17 bp, Artificial Sequence
  Description of Artificial Sequence: Synthetic oligonucleotide
ygagttggggygggayg

SEQ ID NO: 1000 - DNA, 136 bp, Artificial Sequence
  Description of Artificial Sequence: Synthetic polynucleotide
ygygagttttttgaygyggggattagttatgaatygggggtgtgtgtttgtttttagagatttggtaaggtgyggagttttttagaagtgyggttaagyggtagyggagayggygagttaggaattttttttygyg

SEQ ID NO: 1001 - DNA, 31 bp, Artificial Sequence
  Description of Artificial Sequence: Synthetic oligonucleotide
ygygtttagygtttygtttattttttggtyg

SEQ ID NO: 1002 - DNA, 25 bp, Artificial Sequence
  Description of Artificial Sequence: Synthetic oligonucleotide
ygtgtattttgaggtttggttggyg

SEQ ID NO: 1003 - DNA, 12 bp, Artificial Sequence
  Description of Artificial Sequence: Synthetic oligonucleotide
ygttgaygagyg

SEQ ID NO: 1004 - DNA, 6 bp, Artificial Sequence
  Description of Artificial Sequence: Synthetic oligonucleotide
ygtayg

SEQ ID NO: 1005 - DNA, 199 bp, Artificial Sequence
  Description of Artificial Sequence: Synthetic polynucleotide
ygygttygyggtygyggtygttgtatggygttgagatggygggggygtygygyggyggaggyggyggyggaggyggygygggygagttygggggygtygagygggyggtygggataagtygtyggygygggtttygggygtgygaygaggagttygtttgtttagagttggaggygttgtttygyggttataygttgyg

SEQ ID NO: 1006 - DNA, 91 bp, Artificial Sequence
  Description of Artificial Sequence: Synthetic oligonucleotide
yggtttygggtgtagggtggygggttyggyggygygygttttttttttttttttggyggttygtaygtgtygttygygtygygtttttayg

SEQ ID NO: 1007 - DNA, 108 bp, Artificial Sequence
  Description of Artificial Sequence: Synthetic polynucleotide
ygygtttttattgttttatttttttygtttttggagtttttyggtgattttattatagtttttgttattttgtgatttgtaggtattgggagatttatagggaggayg

SEQ ID NO: 1008 - DNA, 13 bp, Artificial Sequence
  Description of Artificial Sequence: Synthetic oligonucleotide
ygtatygatttyg

SEQ ID NO: 1009 - DNA, 176 bp, Artificial Sequence
  Description of Artificial Sequence: Synthetic polynucleotide
yggttygttgggtaaggygttygagaaagygtttggygggaggaggtgygyggttttttgttttaggyggttygggtgttygttttatgyggggygagygttyggtygattttygtyggggyggagtttgaggggtggttgatttatgtayggggattgttatttygtygttttyg

SEQ ID NO: 1010 - DNA, 2 bp, Artificial Sequence
  Description of Artificial Sequence: Synthetic oligonucleotide
yg

SEQ ID NO: 1011 - DNA, 157 bp, Artificial Sequence
  Description of Artificial Sequence: Synthetic polynucleotide
ygagaagtttygygggagayggyggtttttaaagttattttgggtygygggagygygggatyggggttgygggygtygagagygygtygtttgtygttttygtgygtygtygtygtttttgygygaygtttttyggttaggtttgggaaagygttyg

SEQ ID NO: 1012 - DNA, 66 bp, Artificial Sequence
  Description of Artificial Sequence: Synthetic oligonucleotide
ygygaatygttaggggttttygygttttttttttatttaggttttttgtttttttygtygyggtyg

SEQ ID NO: 1013 - DNA, 498 bp, Artificial Sequence
  Description of Artificial Sequence: Synthetic polynucleotide
ygtygtygygtygatyggtygygttttygggattttttgggtyggtygygttttyggttttttttttygtygygtttgtgygtaygygtagaygtygtaagttttaygagttgtaygyggtyggygtttygtttttttygtygttyggttaygttttygygttygagtygtygyggttyggaagyggaagyggaagyggtttyggtttygtttttgygygttygttyggtttygyggtygayggttttatygatttgagtaagaagtygyggygttygtttttyggagtttyggtatyggygttggtygattattaygagtgtayggtttgtygygtgagtttttatagtttygaggtttatttggygtataagaagtattygtgtttygttgygttatygttyggygygttyggtttgttygtygtygtttgtttttattgtttttygaayggttyggtgygyggggatttgttggagtattttygtttggygtayg

SEQ ID NO: 1014 - DNA, 27 bp, Artificial Sequence
  Description of Artificial Sequence: Synthetic oligonucleotide
ygygggttygaaygtttttygygtttg

SEQ ID NO: 1015 - DNA, 2 bp, Artificial Sequence
  Description of Artificial Sequence: Synthetic oligonucleotide
yg

SEQ ID NO: 1016 - DNA, 2 bp, Artificial Sequence
  Description of Artificial Sequence: Synthetic oligonucleotide
yg

SEQ ID NO: 1017 - DNA, 16 bp, Artificial Sequence
  Description of Artificial Sequence: Synthetic oligonucleotide
ygtygtttgtttygyg

SEQ ID NO: 1018 - DNA, 53 bp, Artificial Sequence
  Description of Artificial Sequence: Synthetic oligonucleotide
ygyggagggygtygaattagagtttgyggggtttgatagttttttttgyggyg

SEQ ID NO: 1019 - DNA, 4 bp, Artificial Sequence
  Description of Artificial Sequence: Synthetic oligonucleotide
ygyg

SEQ ID NO: 1020 - DNA, 2 bp, Artificial Sequence
  Description of Artificial Sequence: Synthetic oligonucleotide
yg

SEQ ID NO: 1021 - DNA, 2 bp, Artificial Sequence
  Description of Artificial Sequence: Synthetic oligonucleotide
yg

SEQ ID NO: 1022 - DNA, 2 bp, Artificial Sequence
  Description of Artificial Sequence: Synthetic oligonucleotide
yg

SEQ ID NO: 1023 - DNA, 14 bp, Artificial Sequence
  Description of Artificial Sequence: Synthetic oligonucleotide
ygtgtttatttayg

SEQ ID NO: 1024 - DNA, 186 bp, Artificial Sequence
  Description of Artificial Sequence: Synthetic polynucleotide
yggygggaaggtttgggtgtttatagatagagttggagtttttyggtgggtggtatagataattagttggggttgttttatatgtaatttaattataggggaaataggtttaaatatygggtgataagtagygtaattgtttygggtgattttgtaattttttttttattaattttttttataayg

SEQ ID NO: 1025 - DNA, 79 bp, Artificial Sequence
  Description of Artificial Sequence: Synthetic oligonucleotide
yggggtaygttygttttyggyggggtttttygtttygttgtgggagtggtagtgggtgtyggggtggagaaagtaygyg

SEQ ID NO: 1026 - DNA, 49 bp, Artificial Sequence
  Description of Artificial Sequence: Synthetic oligonucleotide
ygtygygttygygtygygttttttgtaggtaaygggagaygttttygyg

SEQ ID NO: 1027 - DNA, 17 bp, Artificial Sequence
  Description of Artificial Sequence: Synthetic oligonucleotide
yggatgaatygttygyg

SEQ ID NO: 1028 - DNA, 2 bp, Artificial Sequence
  Description of Artificial Sequence: Synthetic oligonucleotide
yg

SEQ ID NO: 1029 - DNA, 9 bp, Artificial Sequence
  Description of Artificial Sequence: Synthetic oligonucleotide
ygggttayg

SEQ ID NO: 1030 - DNA, 2 bp, Artificial Sequence
  Description of Artificial Sequence: Synthetic oligonucleotide
yg

SEQ ID NO: 1031 - DNA, 165 bp, Artificial Sequence
  Description of Artificial Sequence: Synthetic polynucleotide
ygggaaygttgtagtttggttgagygtgatttttaggttttgtgaggaaaagtygagygygttatatygaggygttagtygtttattttattataaggtaaaagatttatgttgttttagttattttaaagttgggagatatattgtattttttattagatttyg

SEQ ID NO: 1032 - DNA, 14 bp, Artificial Sequence
  Description of Artificial Sequence: Synthetic oligonucleotide
ygygygggttagyg

SEQ ID NO: 1033 - DNA, 2 bp, Artificial Sequence
  Description of Artificial Sequence: Synthetic oligonucleotide
yg

SEQ ID NO: 1034 - DNA, 2 bp, Artificial Sequence
  Description of Artificial Sequence: Synthetic oligonucleotide
yg

SEQ ID NO: 1035 - DNA, 97 bp, Artificial Sequence
  Description of Artificial Sequence: Synthetic oligonucleotide
ygtgtgtttagggttagtagtaygtataagtgttagygtayggtygtygygtttatgtttaatgygggtttygttgggygtgygggygtgyggggyg

SEQ ID NO: 1036 - DNA, 2 bp, Artificial Sequence
  Description of Artificial Sequence: Synthetic oligonucleotide
yg

SEQ ID NO: 1037 - DNA, 98 bp, Artificial Sequence
  Description of Artificial Sequence: Synthetic oligonucleotide
ygyggatygygygttttygtygttttgtttttaaatttttgtygtagtttttttttaagttagygaatttattttttaaaattagaaattgaatttyg

SEQ ID NO: 1038 - DNA, 69 bp, Artificial Sequence
  Description of Artificial Sequence: Synthetic oligonucleotide
yggaggggyggaggaggtgttggyggyggtattgagyggyggyggygtagggygygygggtttttygyg

SEQ ID NO: 1039 - DNA, 2 bp, Artificial Sequence
  Description of Artificial Sequence: Synthetic oligonucleotide
yg

SEQ ID NO: 1040 - DNA, 2 bp, Artificial Sequence
  Description of Artificial Sequence: Synthetic oligonucleotide
yg

SEQ ID NO: 1041 - DNA, 2 bp, Artificial Sequence
  Description of Artificial Sequence: Synthetic oligonucleotide
yg

SEQ ID NO: 1042 - DNA, 2 bp, Artificial Sequence
  Description of Artificial Sequence: Synthetic oligonucleotide
yg

SEQ ID NO: 1043 - DNA, 103 bp, Artificial Sequence
  Description of Artificial Sequence: Synthetic polynucleotide
yggttttaggayggtagggatygygatggagyggtttygggggyggtygggggayggygyggtggyggtyggttagttygttttttygggggyggygggygyg

SEQ ID NO: 1044 - DNA, 2 bp, Artificial Sequence
  Description of Artificial Sequence: Synthetic oligonucleotide
yg

SEQ ID NO: 1045 - DNA, 21 bp, Artificial Sequence
  Description of Artificial Sequence: Synthetic oligonucleotide
yggtttttggyggyggyggyg

SEQ ID NO: 1046 - DNA, 148 bp, Artificial Sequence
  Description of Artificial Sequence: Synthetic polynucleotide
yggygttttaaaggggaggattttgyggygygggtaagaggyggygggagygygyggttygggagtgtggttgtagtgygtygggatattagggtttygygtttygtatttaagaggttttygygttttaatttttygygttygygyg

SEQ ID NO: 1047 - DNA, 2 bp, Artificial Sequence
  Description of Artificial Sequence: Synthetic oligonucleotide
yg

SEQ ID NO: 1048 - DNA, 2 bp, Artificial Sequence
  Description of Artificial Sequence: Synthetic oligonucleotide
yg

SEQ ID NO: 1049 - DNA, 26 bp, Artificial Sequence
  Description of Artificial Sequence: Synthetic oligonucleotide
ygtygagaggtagygygtgatggtyg

SEQ ID NO: 1050 - DNA, 119 bp, Artificial Sequence
  Description of Artificial Sequence: Synthetic polynucleotide
ygtaygtttaagtgygygygttgtygtaattatggygttttgttttggtttaagggttataagygttattgtygttttaaggattgtatttgygagaagtgtatttttattatygagyg

SEQ ID NO: 1051 - DNA, 66 bp, Artificial Sequence
  Description of Artificial Sequence: Synthetic oligonucleotide
yggttygatttttttygtttagtttgggttagaggaagtygaaagyggttttagtaaggtgaggyg

SEQ ID NO: 1052 - DNA, 60 bp, Artificial Sequence
  Description of Artificial Sequence: Synthetic oligonucleotide
ygagygaagtygtygtgtttgggtagaaggygttttaggaggygygaggttttagtygyg

SEQ ID NO: 1053 - DNA, 2 bp, Artificial Sequence
  Description of Artificial Sequence: Synthetic oligonucleotide
yg

SEQ ID NO: 1054 - DNA, 124 bp, Artificial Sequence
  Description of Artificial Sequence: Synthetic polynucleotide
ygttyggagygggatttgtttgttttagtgtaygtygyggagygaattatygggttggygggggtggaggggtgtaggygtgggggttgygggtygttygggttttgggttttttttgtygtyg

SEQ ID NO: 1055 - DNA, 2 bp, Artificial Sequence
  Description of Artificial Sequence: Synthetic oligonucleotide
yg

SEQ ID NO: 1056 - DNA, 156 bp, Artificial Sequence
  Description of Artificial Sequence: Synthetic polynucleotide
yggggtatygyggygttygtygtygttttttygtaggtgattatttttttgtaggtgttttygggttttaggtggttgygtgtttgygttatggttgatattttgggygagyggtatttggtgatttgtaagggygygayggtggaggtygaggyg

SEQ ID NO: 1057 - DNA, 2 bp, Artificial Sequence
  Description of Artificial Sequence: Synthetic oligonucleotide
yg

SEQ ID NO: 1058 - DNA, 91 bp, Artificial Sequence
  Description of Artificial Sequence: Synthetic oligonucleotide
ygygygtygtygaaattttgttttygtygtygtttatygataggttgtggagaaggttatygatygatgttatygagttatttttgaagyg

SEQ ID NO: 1059 - DNA, 2 bp, Artificial Sequence
  Description of Artificial Sequence: Synthetic oligonucleotide
yg

SEQ ID NO: 1060 - DNA, 2 bp, Artificial Sequence
  Description of Artificial Sequence: Synthetic oligonucleotide
yg

SEQ ID NO: 1061 - DNA, 89 bp, Artificial Sequence
  Description of Artificial Sequence: Synthetic oligonucleotide
ygttattygygtgttagtagttgggygtttygattttttagatygygtgagtttagtaaagyggttaggygygygtttgtagttyggyg

SEQ ID NO: 1062 - DNA, 13 bp, Artificial Sequence
  Description of Artificial Sequence: Synthetic oligonucleotide
ygtttttaattyg

SEQ ID NO: 1063 - DNA, 2 bp, Artificial Sequence
  Description of Artificial Sequence: Synthetic oligonucleotide
yg

SEQ ID NO: 1064 - DNA, 47 bp, Artificial Sequence
  Description of Artificial Sequence: Synthetic oligonucleotide
ygagygttagattttagtaataaaaggttaggygaggttatatygyg

SEQ ID NO: 1065 - DNA, 2 bp, Artificial Sequence
  Description of Artificial Sequence: Synthetic oligonucleotide
yg

SEQ ID NO: 1066 - DNA, 2 bp, Artificial Sequence
  Description of Artificial Sequence: Synthetic oligonucleotide
yg

SEQ ID NO: 1067 - DNA, 159 bp, Artificial Sequence
  Description of Artificial Sequence: Synthetic polynucleotide
ygatgttygyggygtgaaagygttygyggygggygtygatttttgttttagttttttgtttttttygtttygtttgtttygtgtttttgtgattttggttttggygtygtygtttaggygtttygtaatgtagttgtttttgygtttyggygggaggyg

SEQ ID NO: 1068 - DNA, 2 bp, Artificial Sequence
  Description of Artificial Sequence: Synthetic oligonucleotide
yg

SEQ ID NO: 1069 - DNA, 2 bp, Artificial Sequence
  Description of Artificial Sequence: Synthetic oligonucleotide
yg

SEQ ID NO: 1070 - DNA, 2 bp, Artificial Sequence
  Description of Artificial Sequence: Synthetic oligonucleotide
yg

SEQ ID NO: 1071 - DNA, 78 bp, Artificial Sequence
  Description of Artificial Sequence: Synthetic oligonucleotide
ygggygtygaggtttgggttttagtygtggygttygtttyggygtagtggggagtygygggygtyggagaagyggtyg

SEQ ID NO: 1072 - DNA, 2 bp, Artificial Sequence
  Description of Artificial Sequence: Synthetic oligonucleotide
yg

SEQ ID NO: 1073 - DNA, 48 bp, Artificial Sequence
  Description of Artificial Sequence: Synthetic oligonucleotide
ygyggaggagtttygtattygatygtgtatagygatygagttggygyg

SEQ ID NO: 1074 - DNA, 2 bp, Artificial Sequence
  Description of Artificial Sequence: Synthetic oligonucleotide
yg

SEQ ID NO: 1075 - DNA, 2 bp, Artificial Sequence
  Description of Artificial Sequence: Synthetic oligonucleotide
yg

SEQ ID NO: 1076 - DNA, 2 bp, Artificial Sequence
  Description of Artificial Sequence: Synthetic oligonucleotide
yg

SEQ ID NO: 1077 - DNA, 157 bp, Artificial Sequence
  Description of Artificial Sequence: Synthetic polynucleotide
ygtttttatagttttgttttgatagttaaggaaaaaatttgttaaaaattagaggygttgttgagtgttggygtgggaatgttagtttagttagagttttgttttgggttatttaaataaaaatagatatgttggtggtaaatgttagttgaatayg

SEQ ID NO: 1078 - DNA, 2 bp, Artificial Sequence
  Description of Artificial Sequence: Synthetic oligonucleotide
yg

SEQ ID NO: 1079 - DNA, 82 bp, Artificial Sequence
  Description of Artificial Sequence: Synthetic oligonucleotide
ygygygttagtttttygtttygtggaagygtttttttttygatttyggttgattttygttygtygtttttttygygggtgyg

SEQ ID NO: 1080 - DNA, 23 bp, Artificial Sequence
  Description of Artificial Sequence: Synthetic oligonucleotide
ygtttggtygttttatttggtyg

SEQ ID NO: 1081 - DNA, 38 bp, Artificial Sequence
  Description of Artificial Sequence: Synthetic oligonucleotide
ygagttttygygygtttaygagtagttttgygagttyg

SEQ ID NO: 1082 - DNA, 2 bp, Artificial Sequence
  Description of Artificial Sequence: Synthetic oligonucleotide
gg

SEQ ID NO: 1083 - DNA, 165 bp, Artificial Sequence
  Description of Artificial Sequence: Synthetic polynucleotide
ygtgtttttttttagygagygtagygagttgtttttgaagtttaggtagattaggtygtygtagaagatgaagaagttttyggggattygttggatgyggttgtyggttattagtagtttgygtaygtttagggggaaagggtttggtaygttgggtagttygyg

SEQ ID NO: 1084 - DNA, 2 bp, Artificial Sequence
  Description of Artificial Sequence: Synthetic oligonucleotide
yg

SEQ ID NO: 1085 - DNA, 2 bp, Artificial Sequence
  Description of Artificial Sequence: Synthetic oligonucleotide
yg

SEQ ID NO: 1086 - DNA, 2 bp, Artificial Sequence
  Description of Artificial Sequence: Synthetic oligonucleotide
yg

SEQ ID NO: 1087 - DNA, 23 bp, Artificial Sequence
  Description of Artificial Sequence: Synthetic oligonucleotide
yggtgttygggggtygtttgtyg

SEQ ID NO: 1088 - DNA, 2 bp, Artificial Sequence
  Description of Artificial Sequence: Synthetic oligonucleotide
yg

SEQ ID NO: 1089 - DNA, 66 bp, Artificial Sequence
  Description of Artificial Sequence: Synthetic oligonucleotide
yggtygtggygggttttttggggyggtagttttaggygygggygygtagtagtttygaaggygtyg

SEQ ID NO: 1090 - DNA, 43 bp, Artificial Sequence
  Description of Artificial Sequence: Synthetic oligonucleotide
ygaataaaaagagtttaggtygygygggygggttgygygttyg

SEQ ID NO: 1091 - DNA, 2 bp, Artificial Sequence
  Description of Artificial Sequence: Synthetic oligonucleotide
yg

SEQ ID NO: 1092 - DNA, 62 bp, Artificial Sequence
  Description of Artificial Sequence: Synthetic oligonucleotide
ygtttagatgyggyggyggygayggttttagttgygtttygtggttattttygtgtagygyg

SEQ ID NO: 1093 - DNA, 2 bp, Artificial Sequence
  Description of Artificial Sequence: Synthetic oligonucleotide
yg

SEQ ID NO: 1094 - DNA, 138 bp, Artificial Sequence
  Description of Artificial Sequence: Synthetic polynucleotide
ygaaagattygaaattttaaaagttttattgygtgtttttgggaggggagggggygygttaggaaaggagtggaaaaaagtgggygaggaggagygttgaaaattttttgataagtagttttygtgygttygagagyg

SEQ ID NO: 1095 - DNA, 2 bp, Artificial Sequence
  Description of Artificial Sequence: Synthetic oligonucleotide
yg

SEQ ID NO: 1096 - DNA, 2 bp, Artificial Sequence
  Description of Artificial Sequence: Synthetic oligonucleotide
yg

SEQ ID NO: 1097 - DNA, 2 bp, Artificial Sequence
  Description of Artificial Sequence: Synthetic oligonucleotide
yg

SEQ ID NO: 1098 - DNA, 2 bp, Artificial Sequence
  Description of Artificial Sequence: Synthetic oligonucleotide
yg

SEQ ID NO: 1099 - DNA, 187 bp, Artificial Sequence
  Description of Artificial Sequence: Synthetic polynucleotide
yggtagaagtgggaggtataygaggagttattggaaayggygtttttgtggaggagtygggggggatggggagtagagggagggggttttgttgttttagygtttygaggtygtggagyggtagtagttgtagtyggagtagtattagtaatagtaatagtgagygggayggagttaggatygttyg

SEQ ID NO: 1100 - DNA, 2 bp, Artificial Sequence
  Description of Artificial Sequence: Synthetic oligonucleotide
yg

SEQ ID NO: 1101 - DNA, 2 bp, Artificial Sequence
  Description of Artificial Sequence: Synthetic oligonucleotide
yg

SEQ ID NO: 1102 - DNA, 110 bp, Artificial Sequence
  Description of Artificial Sequence: Synthetic polynucleotide
ygyggygtgtagttyggyggatgttgttaggttaggygatttygtygtttttggagygygagygygttttagtttgtagygatgattttggaattagattttgatttgyg

SEQ ID NO: 1103 - DNA, 4 bp, Artificial Sequence
  Description of Artificial Sequence: Synthetic oligonucleotide
ygyg

SEQ ID NO: 1104 - DNA, 189 bp, Artificial Sequence
  Description of Artificial Sequence: Synthetic polynucleotide
ygggaggttttgttygttyggtggttgtygyggtttttttygygttgttttttaygtttggtttattatgtaygaggtaggtaatttgttttttttttyggggatttatttyggagataagaaggtagtttgttttttgtaatggtttttgttggagtgyggyggggtttaggygygagygggggtayg

SEQ ID NO: 1105 - DNA, 42 bp, Artificial Sequence
  Description of Artificial Sequence: Synthetic oligonucleotide
ygttgaaggtgggtggaaygagggygtttgagtgtattygyg

SEQ ID NO: 1106 - DNA, 33 bp, Artificial Sequence
  Description of Artificial Sequence: Synthetic oligonucleotide
ygygygggggttttaggtattttgygttttayg

SEQ ID NO: 1107 - DNA, 15 bp, Artificial Sequence
  Description of Artificial Sequence: Synthetic oligonucleotide
ygygttagtygaayg

SEQ ID NO: 1108 - DNA, 51 bp, Artificial Sequence
  Description of Artificial Sequence: Synthetic oligonucleotide
ygttgggatagagttgtttgttggagttgtygtagatygtygtggtgggyg

SEQ ID NO: 1109 - DNA, 2 bp, Artificial Sequence
  Description of Artificial Sequence: Synthetic oligonucleotide
yg

SEQ ID NO: 1110 - DNA, 268 bp, Artificial Sequence
  Description of Artificial Sequence: Synthetic polynucleotide
yggagygygtagttygtttttgaataagaagtgagtataatggygtgtttgtaaaaaaaagttttaagttygttttttttaaaaaatattttgaatgttgtatgttttatgttttttagygtttygygggagagattyggttatagagtaggaggtgagatttttttttyggtatttttatttttttggtygtaygtttttttgttttagttttttttgggaggattgtaaatgtttttttttagtaagyggtygttttttattttyg

SEQ ID NO: 1111 - DNA, 2 bp, Artificial Sequence
  Description of Artificial Sequence: Synthetic oligonucleotide
yg

SEQ ID NO: 1112 - DNA, 33 bp, Artificial Sequence
  Description of Artificial Sequence: Synthetic oligonucleotide
yggagtttttaggagtagttagatygattatyg

SEQ ID NO: 1113 - DNA, 23 bp, Artificial Sequence
  Description of Artificial Sequence: Synthetic oligonucleotide
ygtttattagttygagattttyg

SEQ ID NO: 1114 - DNA, 40 bp, Artificial Sequence
  Description of Artificial Sequence: Synthetic oligonucleotide
ygtttygattygaygttttttygttygattaggtgtttyg

SEQ ID NO: 1115 - DNA, 10 bp, Artificial Sequence
  Description of Artificial Sequence: Synthetic oligonucleotide
ygyggtttyg

SEQ ID NO: 1116 - DNA, 181 bp, Artificial Sequence
  Description of Artificial Sequence: Synthetic polynucleotide
yggttgttgatygtttttttygygttygttagggtttttgtttygygttagttatygygygttttttttttgtttatgtygtagttttygtggtttttgttttggattygggatgttaggttgagataygttttgtaaatttttggtagaaatgggygtaagggggtggatttygttttyg

SEQ ID NO: 1117 - DNA, 195 bp, Artificial Sequence
  Description of Artificial Sequence: Synthetic polynucleotide
ygatttaggaygtyggygtttgttaggattttttygtttgtttttygygtttygygygygtttatgttattattayggggagggtgtatgyggtaggtgtttggtygaggttttygggagygagtygtttttaygtgttttagtttgtttttttttygaagttagaygttggygttgtagttttgttgtttgayg

SEQ ID NO: 1118 - DNA, 2 bp, Artificial Sequence
  Description of Artificial Sequence: Synthetic oligonucleotide
yg

SEQ ID NO: 1119 - DNA, 358 bp, Artificial Sequence
  Description of Artificial Sequence: Synthetic polynucleotide
yggygttygagtgattttgtttagtttygttttgygtttttgtaaattaygttgttgygttaattataaatttggttaatatgtttttgtaattttattatttaaaaaygtttttaggtatttggtygttgttagattaggttygygggttyggaggaggtttttttatttgttttygttagtttyggggatygtgygyggttttygtgtggttttygtttaygaggtttttygggtaggaatygtygygygatttttgtttagyggtygygttttggttaygggygatttttgtygggaattttgttttyggttaagttgygttttygtatttyggtggtttttattygagttygyg

SEQ ID NO: 1120 - DNA, 13 bp, Artificial Sequence
  Description of Artificial Sequence: Synthetic oligonucleotide
ygtagttgtggyg

SEQ ID NO: 1121 - DNA, 2 bp, Artificial Sequence
  Description of Artificial Sequence: Synthetic oligonucleotide
yg

SEQ ID NO: 1122 - DNA, 2 bp, Artificial Sequence
  Description of Artificial Sequence: Synthetic oligonucleotide
yg

SEQ ID NO: 1123 - DNA, 95 bp, Artificial Sequence
  Description of Artificial Sequence: Synthetic oligonucleotide
ygtgyggggttatttgaaggttggggygyggaagtttaatttygtgttgattgggttttaagttttttgygttttygtttygtttygagtgttyg

SEQ ID NO: 1124 - DNA, 45 bp, Artificial Sequence
  Description of Artificial Sequence: Synthetic oligonucleotide
yggtagtaggttggagygtatygtgygygttttgttttttyggyg

SEQ ID NO: 1125 - DNA, 104 bp, Artificial Sequence
  Description of Artificial Sequence: Synthetic polynucleotide
yggttgagtyggagtttaygyggygygygtttttygygaggaatttttyggtttgtaggttgtttgttattttygtttttygaygygtttttttttggttygyg

SEQ ID NO: 1126 - DNA, 87 bp, Artificial Sequence
  Description of Artificial Sequence: Synthetic oligonucleotide
ygttttygttttygttgatattttgtaaagtygyggyggtagyggyggggattaygttgyggtgtattatttttygttattttttyg

SEQ ID NO: 1127 - DNA, 62 bp, Artificial Sequence
  Description of Artificial Sequence: Synthetic oligonucleotide
ygatagtttgygagtttyggttgtaagtggtttttttttttygyggttgttgtttagtgtyg

SEQ ID NO: 1128 - DNA, 2 bp, Artificial Sequence
  Description of Artificial Sequence: Synthetic oligonucleotide
yg

SEQ ID NO: 1129 - DNA, 2 bp, Artificial Sequence
  Description of Artificial Sequence: Synthetic oligonucleotide
yg

SEQ ID NO: 1130 - DNA, 2 bp, Artificial Sequence
  Description of Artificial Sequence: Synthetic oligonucleotide
yg

SEQ ID NO: 1131 - DNA, 2 bp, Artificial Sequence
  Description of Artificial Sequence: Synthetic oligonucleotide
yg

SEQ ID NO: 1132 - DNA, 2 bp, Artificial Sequence
  Description of Artificial Sequence: Synthetic oligonucleotide
yg

SEQ ID NO: 1133 - DNA, 2 bp, Artificial Sequence
  Description of Artificial Sequence: Synthetic oligonucleotide
yg

SEQ ID NO: 1134 - DNA, 2 bp, Artificial Sequence
  Description of Artificial Sequence: Synthetic oligonucleotide
yg

SEQ ID NO: 1135 - DNA, 2 bp, Artificial Sequence
  Description of Artificial Sequence: Synthetic oligonucleotide
yg

SEQ ID NO: 1136 - DNA, 145 bp, Artificial Sequence
  Description of Artificial Sequence: Synthetic polynucleotide
ygtyggtttgttggygatttggygtatttgttygygygttttggttttagttgtygtaggttttttttgtatttatttttagtttttaaagttagtgtagttagtatygtttatttggagttttaatttttttttgygattttyg

SEQ ID NO: 1137 - DNA, 2 bp, Artificial Sequence
  Description of Artificial Sequence: Synthetic oligonucleotide
yg

SEQ ID NO: 1138 - DNA, 19 bp, Artificial Sequence
  Description of Artificial Sequence: Synthetic oligonucleotide
ygtttatygttaggagtyg

SEQ ID NO: 1139 - DNA, 35 bp, Artificial Sequence
  Description of Artificial Sequence: Synthetic oligonucleotide
yggyggyggyggyggttttattagyggagttttyg

SEQ ID NO: 1140 - DNA, 2 bp, Artificial Sequence
  Description of Artificial Sequence: Synthetic oligonucleotide
yg

SEQ ID NO: 1141 - DNA, 2 bp, Artificial Sequence
  Description of Artificial Sequence: Synthetic oligonucleotide
yg

SEQ ID NO: 1142 - DNA, 36 bp, Artificial Sequence
  Description of Artificial Sequence: Synthetic oligonucleotide
ygagttggygttggttygttggttgtaggagagtyg

SEQ ID NO: 1143 - DNA, 2 bp, Artificial Sequence
  Description of Artificial Sequence: Synthetic oligonucleotide
yg

SEQ ID NO: 1144 - DNA, 42 bp, Artificial Sequence
  Description of Artificial Sequence: Synthetic oligonucleotide
yggttgagttttygtttgtttaattttatttgttattgtayg

SEQ ID NO: 1145 - DNA, 2 bp, Artificial Sequence
  Description of Artificial Sequence: Synthetic oligonucleotide
yg

SEQ ID NO: 1146 - DNA, 2 bp, Artificial Sequence
  Description of Artificial Sequence: Synthetic oligonucleotide
yg

SEQ ID NO: 1147 - DNA, 18 bp, Artificial Sequence
  Description of Artificial Sequence: Synthetic oligonucleotide
ygygtagygttygygtyg

SEQ ID NO: 1148 - DNA, 2 bp, Artificial Sequence
  Description of Artificial Sequence: Synthetic oligonucleotide
yg

SEQ ID NO: 1149 - DNA, 2 bp, Artificial Sequence
  Description of Artificial Sequence: Synthetic oligonucleotide
yg

SEQ ID NO: 1150 - DNA, 2 bp, Artificial Sequence
  Description of Artificial Sequence: Synthetic oligonucleotide
yg

SEQ ID NO: 1151 - DNA, 118 bp, Artificial Sequence
  Description of Artificial Sequence: Synthetic polynucleotide
ygtgttagatttyggtttygygatttaggtgagtgtygttatygtygtttggagggatttaagggttttgggttgggatttggggtygtatyggggtttgaggtagaatagygaygyg

SEQ ID NO: 1152 - DNA, 22 bp, Artificial Sequence
  Description of Artificial Sequence: Synthetic oligonucleotide
ygaatygygggyggygyggayg

SEQ ID NO: 1153 - DNA, 2 bp, Artificial Sequence
  Description of Artificial Sequence: Synthetic oligonucleotide
yg

SEQ ID NO: 1154 - DNA, 2 bp, Artificial Sequence
  Description of Artificial Sequence: Synthetic oligonucleotide
yg

SEQ ID NO: 1155 - DNA, 2 bp, Artificial Sequence
  Description of Artificial Sequence: Synthetic oligonucleotide
yg

SEQ ID NO: 1156 - DNA, 2 bp, Artificial Sequence
  Description of Artificial Sequence: Synthetic oligonucleotide
yg

SEQ ID NO: 1157 - DNA, 31 bp, Artificial Sequence
  Description of Artificial Sequence: Synthetic oligonucleotide
ygataagagttyggtgttgagatgtgttayg

SEQ ID NO: 1158 - DNA, 2 bp, Artificial Sequence
  Description of Artificial Sequence: Synthetic oligonucleotide
yg

SEQ ID NO: 1159 - DNA, 2 bp, Artificial Sequence
  Description of Artificial Sequence: Synthetic oligonucleotide
yg

SEQ ID NO: 1160 - DNA, 2 bp, Artificial Sequence
  Description of Artificial Sequence: Synthetic oligonucleotide
yg

SEQ ID NO: 1161 - DNA, 2 bp, Artificial Sequence
  Description of Artificial Sequence: Synthetic oligonucleotide
yg

SEQ ID NO: 1162 - DNA, 2 bp, Artificial Sequence
  Description of Artificial Sequence: Synthetic oligonucleotide
yg

SEQ ID NO: 1163 - DNA, 2 bp, Artificial Sequence
  Description of Artificial Sequence: Synthetic oligonucleotide
yg

SEQ ID NO: 1164 - DNA, 2 bp, Artificial Sequence
  Description of Artificial Sequence: Synthetic oligonucleotide
yg

SEQ ID NO: 1165 - DNA, 2 bp, Artificial Sequence
  Description of Artificial Sequence: Synthetic oligonucleotide
yg

SEQ ID NO: 1166 - DNA, 2 bp, Artificial Sequence
  Description of Artificial Sequence: Synthetic oligonucleotide
yg

SEQ ID NO: 1167 - DNA, 69 bp, Artificial Sequence
  Description of Artificial Sequence: Synthetic oligonucleotide
ygttaggggyggttagyggtygtttggttggygtgtyggyggygttyggggagggygggtyggggggyg

SEQ ID NO: 1168 - DNA, 415 bp, Artificial Sequence
  Description of Artificial Sequence: Synthetic polynucleotide
ygtttttttttttggttygattggttttggttttttttaygtttttagtttttaaattggygttygttttatggttygtgtaggaygttaaaagtayggtaaattttagggygatttttagtagaygttttygaygtatgatgtygagtygttatyggttttygtygttttttgtygygttyggggttyggtttgyggtygtygttgygttttgaagygtatygygtygtyggggtttygttatttygtygttygtttttygggtygggtttttttygttttttttaggygttgtttttattttaggyggtttttgttagttgtaatatagagataaattttygaggyggggagatttttagggtatygggatgttgaagtttygyggtttttatttttaagtttaattygtgyg

SEQ ID NO: 1169 - DNA, 2 bp, Artificial Sequence
  Description of Artificial Sequence: Synthetic oligonucleotide
yg

SEQ ID NO: 1170 - DNA, 2 bp, Artificial Sequence
  Description of Artificial Sequence: Synthetic oligonucleotide
yg

SEQ ID NO: 1171 - DNA, 2 bp, Artificial Sequence
  Description of Artificial Sequence: Synthetic oligonucleotide
yg

SEQ ID NO: 1172 - DNA, 2 bp, Artificial Sequence
  Description of Artificial Sequence: Synthetic oligonucleotide
yg

SEQ ID NO: 1173 - DNA, 2 bp, Artificial Sequence
  Description of Artificial Sequence: Synthetic oligonucleotide
yg

SEQ ID NO: 1174 - DNA, 62 bp, Artificial Sequence
  Description of Artificial Sequence: Synthetic oligonucleotide
ygygttygtygttagttygtatagygtttygtatattttygtaygygtttgaaatgygtayg

SEQ ID NO: 1175 - DNA, 2 bp, Artificial Sequence
  Description of Artificial Sequence: Synthetic oligonucleotide
yg

SEQ ID NO: 1176 - DNA, 2 bp, Artificial Sequence
  Description of Artificial Sequence: Synthetic oligonucleotide
yg

SEQ ID NO: 1177 - DNA, 2 bp, Artificial Sequence
  Description of Artificial Sequence: Synthetic oligonucleotide
yg

SEQ ID NO: 1178 - DNA, 2 bp, Artificial Sequence
  Description of Artificial Sequence: Synthetic oligonucleotide
yg

SEQ ID NO: 1179 - DNA, 20 bp, Artificial Sequence
  Description of Artificial Sequence: Synthetic oligonucleotide
ygtaaaygtaaaagttttyg

SEQ ID NO: 1180 - DNA, 69 bp, Artificial Sequence
  Description of Artificial Sequence: Synthetic oligonucleotide
ygttttttggggtttttggttgtygagtttygttaaggtaaagaygttagtaagygaggaagygtagyg

SEQ ID NO: 1181 - DNA, 2 bp, Artificial Sequence
  Description of Artificial Sequence: Synthetic oligonucleotide
yg

SEQ ID NO: 1182 - DNA, 318 bp, Artificial Sequence
  Description of Artificial Sequence: Synthetic polynucleotide
ygtttygyggtagtgttagttttttggggattaggaagggygatttttgtttgggagttagtgtttgggtygtygggttygggtaagygttgggggtttggttygagaagatgyggataggtggtttagggygtygyggattttygttttttgygggtatygggagtttagggtygaggygygtygtttygaggggtttttttttttaataatgygttyggaatggagttygygttttgatagygygggttagttygaaatygtttagaattygtttygatgagtgggtgagtygttttgggagtttgtygygtttyg

SEQ ID NO: 1183 - DNA, 27 bp, Artificial Sequence
  Description of Artificial Sequence: Synthetic oligonucleotide
ygtggtggtttttygagyggaggygyg

SEQ ID NO: 1184 - DNA, 2 bp, Artificial Sequence
  Description of Artificial Sequence: Synthetic oligonucleotide
yg

SEQ ID NO: 1185 - DNA, 13 bp, Artificial Sequence
  Description of Artificial Sequence: Synthetic oligonucleotide
ygagtttttygyg

SEQ ID NO: 1186 - DNA, 189 bp, Artificial Sequence
  Description of Artificial Sequence: Synthetic polynucleotide
yggtgaygatgtgtagagttttttggtatagattgtttatttygttttttttgtggaaatttatygtttggtttttttttygtttttttttttttttttagttagtygttttttttttttttygtatttttaatttttttggygttttaagttatagttygttygyggtgattttggttggagattgyg

SEQ ID NO: 1187 - DNA, 2 bp, Artificial Sequence
  Description of Artificial Sequence: Synthetic oligonucleotide
yg

SEQ ID NO: 1188 - DNA, 2 bp, Artificial Sequence
  Description of Artificial Sequence: Synthetic oligonucleotide
yg

SEQ ID NO: 1189 - DNA, 13 bp, Artificial Sequence
  Description of Artificial Sequence: Synthetic oligonucleotide
ygggggttgagyg

SEQ ID NO: 1190 - DNA, 51 bp, Artificial Sequence
  Description of Artificial Sequence: Synthetic oligonucleotide
yggygtgtgtygtgygtggggtggggtgygggttgggyggtttygttttyg

SEQ ID NO: 1191 - DNA, 289 bp, Artificial Sequence
  Description of Artificial Sequence: Synthetic polynucleotide
ygttygttygtatttygtttttttyggttttttttttaaattttaaaygtatygtygtgttttaaagaaggtgtttaygtygtttttagatttyggagygttttttttttattttygggattttttaggtygtttatttttttygtttttygtttagatttgagagggatygaaaatatattttygattygggtagttagggtygaaattgttaagaggagaaaaggtaaagyggaaggagggtggttataaatagatttttttgtttttttttaaaaggatattgtyg

SEQ ID NO: 1192 - DNA, 2 bp, Artificial Sequence
  Description of Artificial Sequence: Synthetic oligonucleotide
yg

SEQ ID NO: 1193 - DNA, 165 bp, Artificial Sequence
  Description of Artificial Sequence: Synthetic polynucleotide
yggatttgttttygtagtygttgyggatttttyggtygttatggygattgtgaaatgtggggtggggygtatgygttggaagttattygygygggtagtttttgagtgtttttttaygtgttttttagygygagtagtattttygtttttgygttttttagagyg

SEQ ID NO: 1194 - DNA, 21 bp, Artificial Sequence
  Description of Artificial Sequence: Synthetic oligonucleotide
ygtygtttttgtattatttyg

SEQ ID NO: 1195 - DNA, 2 bp, Artificial Sequence
  Description of Artificial Sequence: Synthetic oligonucleotide
yg

SEQ ID NO: 1196 - DNA, 2 bp, Artificial Sequence
  Description of Artificial Sequence: Synthetic oligonucleotide
yg

SEQ ID NO: 1197 - DNA, 2 bp, Artificial Sequence
  Description of Artificial Sequence: Synthetic oligonucleotide
yg

SEQ ID NO: 1198 - DNA, 159 bp, Artificial Sequence
  Description of Artificial Sequence: Synthetic polynucleotide
yggttgygttggtygtattgtttttttataatatgagtagygtyggyggygatygtttgggtygyggtaagtyggttygttgyggttttatttttttygtgggtygygtgtatygttggatggtggatagtygygtggygttgygtatttaygagtayg

SEQ ID NO: 1199 - DNA, 2 bp, Artificial Sequence
  Description of Artificial Sequence: Synthetic oligonucleotide
yg

SEQ ID NO: 1200 - DNA, 129 bp, Artificial Sequence
  Description of Artificial Sequence: Synthetic polynucleotide
yggggggyggaatttagagaggtaaagtgattygtttttaaatygtaatattaggaggatagtagggttagatggaatttttyggtttatagttttygatttygggtaagtgttttattygggygtayg

SEQ ID NO: 1201 - DNA, 2 bp, Artificial Sequence
  Description of Artificial Sequence: Synthetic oligonucleotide
yg

SEQ ID NO: 1202 - DNA, 120 bp, Artificial Sequence
  Description of Artificial Sequence: Synthetic polynucleotide
ygttggagatggygagtttygagattttttttattttttgtttttagagtaattttatggtattaaaaaaaaaaaaaaaaaaaaaaaaaaaaaaaaaaaaaaaaaaagaaggagaaggyg

SEQ ID NO: 1203 - DNA, 2 bp, Artificial Sequence
  Description of Artificial Sequence: Synthetic oligonucleotide
yg

SEQ ID NO: 1204 - DNA, 171 bp, Artificial Sequence
  Description of Artificial Sequence: Synthetic polynucleotide
ygyggaygttgaygattttttttaygttygataagttttygttttygtygtatygttggyggttaatygggygttgygaggatttaaattagagagttygggatattattgtgggggttggaggtygttttttaatttgggtttagtattaataggtgtagtagtygagyg

SEQ ID NO: 1205 - DNA, 2 bp, Artificial Sequence
  Description of Artificial Sequence: Synthetic oligonucleotide
yg

SEQ ID NO: 1206 - DNA, 2 bp, Artificial Sequence
  Description of Artificial Sequence: Synthetic oligonucleotide
yg

SEQ ID NO: 1207 - DNA, 2 bp, Artificial Sequence
  Description of Artificial Sequence: Synthetic oligonucleotide
yg

SEQ ID NO: 1208 - DNA, 64 bp, Artificial Sequence
  Description of Artificial Sequence: Synthetic oligonucleotide
yggtaggtgagyggygyggttgtaggtgagtagtagtttyggttygygygtttagtttttttyg

SEQ ID NO: 1209 - DNA, 2 bp, Artificial Sequence
  Description of Artificial Sequence: Synthetic oligonucleotide
yg

SEQ ID NO: 1210 - DNA, 2 bp, Artificial Sequence
  Description of Artificial Sequence: Synthetic oligonucleotide
yg

SEQ ID NO: 1211 - DNA, 2 bp, Artificial Sequence
  Description of Artificial Sequence: Synthetic oligonucleotide
yg

SEQ ID NO: 1212 - DNA, 2 bp, Artificial Sequence
  Description of Artificial Sequence: Synthetic oligonucleotide
yg

SEQ ID NO: 1213 - DNA, 16 bp, Artificial Sequence
  Description of Artificial Sequence: Synthetic oligonucleotide
ygtttygtagggttyg

SEQ ID NO: 1214 - DNA, 2 bp, Artificial Sequence
  Description of Artificial Sequence: Synthetic oligonucleotide
yg

SEQ ID NO: 1215 - DNA, 2 bp, Artificial Sequence
  Description of Artificial Sequence: Synthetic oligonucleotide
yg

SEQ ID NO: 1216 - DNA, 2 bp, Artificial Sequence
  Description of Artificial Sequence: Synthetic oligonucleotide
yg

SEQ ID NO: 1217 - DNA, 18 bp, Artificial Sequence
  Description of Artificial Sequence: Synthetic oligonucleotide
ygtattttttyggtygyg

SEQ ID NO: 1218 - DNA, 118 bp, Artificial Sequence
  Description of Artificial Sequence: Synthetic polynucleotide
ygggyggatgggggttatygaggyggttygtttttaggygtatatttygtatatttttttgttaagtgaaggggttaaaatgtatagatgggggagtttatttaggaatagaggygyg

SEQ ID NO: 1219 - DNA, 2 bp, Artificial Sequence
  Description of Artificial Sequence: Synthetic oligonucleotide
yg

SEQ ID NO: 1220 - DNA, 2 bp, Artificial Sequence
  Description of Artificial Sequence: Synthetic oligonucleotide
yg

SEQ ID NO: 1221 - DNA, 2 bp, Artificial Sequence
  Description of Artificial Sequence: Synthetic oligonucleotide
yg

SEQ ID NO: 1222 - DNA, 2 bp, Artificial Sequence
  Description of Artificial Sequence: Synthetic oligonucleotide
yg

SEQ ID NO: 1223 - DNA, 2 bp, Artificial Sequence
  Description of Artificial Sequence: Synthetic oligonucleotide
yg

SEQ ID NO: 1224 - DNA, 22 bp, Artificial Sequence
  Description of Artificial Sequence: Synthetic oligonucleotide
ygygtygttttagaggagttyg

SEQ ID NO: 1225 - DNA, 112 bp, Artificial Sequence
  Description of Artificial Sequence: Synthetic polynucleotide
ygggagygtaygagtgtgtgtgtgtgtgtgtgtgttygyggtgtgttygyggttyggtgtataygygygygggttgtaaagttaggagttgygggagygtttttttgtttyg

SEQ ID NO: 1226 - DNA, 109 bp, Artificial Sequence
  Description of Artificial Sequence: Synthetic polynucleotide
ygttttgtttgggttgggtttatttaygttttgggtggggtttaggaattgygtgygggygtagygggtgagtatgttgatgatgattatttggttttatttttttayg

SEQ ID NO: 1227 - DNA, 2 bp, Artificial Sequence
  Description of Artificial Sequence: Synthetic oligonucleotide
yg

SEQ ID NO: 1228 - DNA, 2 bp, Artificial Sequence
  Description of Artificial Sequence: Synthetic oligonucleotide
yg

SEQ ID NO: 1229 - DNA, 2 bp, Artificial Sequence
  Description of Artificial Sequence: Synthetic oligonucleotide
yg

SEQ ID NO: 1230 - DNA, 431 bp, Artificial Sequence
  Description of Artificial Sequence: Synthetic polynucleotide
ygagggggttttgggatygagyggtttygtagyggygatagaaatatatattttaygaaaaagaaaaaaaaaaaaaygagtygygygaattygttaagttagatgtgygyggtttgaagyggaggaggttttgaygttagttttatttygygtagttyggtttggtygtagattygtyggttattygtyggyggtttaggtygggaggggttaggatagtttyggtygygyggtggayggaggggttattttttygggygttagtaaataaattttattygagttaatatygtttagygaayggtgtttttttttagttattygagaaygagaggtatttttaattagaaattaattaatgagtagttgttttttttygttttattgtaattattygttttaattataaatgagatttatgaaaggatayg

SEQ ID NO: 1231 - DNA, 2 bp, Artificial Sequence
  Description of Artificial Sequence: Synthetic oligonucleotide
yg

SEQ ID NO: 1232 - DNA, 40 bp, Artificial Sequence
  Description of Artificial Sequence: Synthetic oligonucleotide
ygtygygtttygttgtagtttygttggagagatggggayg

SEQ ID NO: 1233 - DNA, 2 bp, Artificial Sequence
  Description of Artificial Sequence: Synthetic oligonucleotide
yg

SEQ ID NO: 1234 - DNA, 22 bp, Artificial Sequence
  Description of Artificial Sequence: Synthetic oligonucleotide
ygttagtaggtttagggttayg

SEQ ID NO: 1235 - DNA, 2 bp, Artificial Sequence
  Description of Artificial Sequence: Synthetic oligonucleotide
yg

SEQ ID NO: 1236 - DNA, 47 bp, Artificial Sequence
  Description of Artificial Sequence: Synthetic oligonucleotide
ygggtattttgtattgtaygtagtatatgttgtggttttttagttyg

SEQ ID NO: 1237 - DNA, 24 bp, Artificial Sequence
  Description of Artificial Sequence: Synthetic oligonucleotide
ygtygttgggggatttttggtayg

SEQ ID NO: 1238 - DNA, 2 bp, Artificial Sequence
  Description of Artificial Sequence: Synthetic oligonucleotide
yg

SEQ ID NO: 1239 - DNA, 45 bp, Artificial Sequence
  Description of Artificial Sequence: Synthetic oligonucleotide
ygggattttaggtttatttagtaagttaattggttgaggttttyg

SEQ ID NO: 1240 - DNA, 2 bp, Artificial Sequence
  Description of Artificial Sequence: Synthetic oligonucleotide
yg

SEQ ID NO: 1241 - DNA, 258 bp, Artificial Sequence
  Description of Artificial Sequence: Synthetic polynucleotide
ygaagyggygggagtyggtgtagttttaatttttattgygtgttttaggtygttaattagttttgttygygtgtygttggttyggaggttgtygygttagtttttgygtgygtttgagygygttggagtatttgygaggttagggttgtygayggygagaggatattttgaggaatayggtgttttagtttygttttygtttttygttygagttggaggttggggygygttgagtygtagygtttggataagtgygyg

SEQ ID NO: 1242 - DNA, 45 bp, Artificial Sequence
  Description of Artificial Sequence: Synthetic oligonucleotide
ygttttggyggtttygagggatttgggttygggtttgyggtygyg

SEQ ID NO: 1243 - DNA, 7 bp, Artificial Sequence
  Description of Artificial Sequence: Synthetic oligonucleotide
ygyggyg

SEQ ID NO: 1244 - DNA, 4 bp, Artificial Sequence
  Description of Artificial Sequence: Synthetic oligonucleotide
ygyg

SEQ ID NO: 1245 - DNA, 67 bp, Artificial Sequence
  Description of Artificial Sequence: Synthetic oligonucleotide
yggggygttaatagtttaggatttgggttgtaggttggtttttgtattaattagyggggyggtttyg

SEQ ID NO: 1246 - DNA, 43 bp, Artificial Sequence
  Description of Artificial Sequence: Synthetic oligonucleotide
yggttgattygtagyggtagyggtagtagygaggattygagyg

SEQ ID NO: 1247 - DNA, 2 bp, Artificial Sequence
  Description of Artificial Sequence: Synthetic oligonucleotide
yg

SEQ ID NO: 1248 - DNA, 2 bp, Artificial Sequence
  Description of Artificial Sequence: Synthetic oligonucleotide
yg

SEQ ID NO: 1249 - DNA, 113 bp, Artificial Sequence
  Description of Artificial Sequence: Synthetic polynucleotide
ygtgtgtttagttgaatttagtatatttttttygtatttttygtttttttttttttttttttgaatttgtttttttgttttgygggtttttaatttttttygaatttygggyg

SEQ ID NO: 1250 - DNA, 4 bp, Artificial Sequence
  Description of Artificial Sequence: Synthetic oligonucleotide
ygyg

SEQ ID NO: 1251 - DNA, 2 bp, Artificial Sequence
  Description of Artificial Sequence: Synthetic oligonucleotide
yg

SEQ ID NO: 1252 - DNA, 84 bp, Artificial Sequence
  Description of Artificial Sequence: Synthetic oligonucleotide
ygttgygygtygttttygyggagtygagyggyggtggttgyggaagygattggggttgygyggatattagygttttagagttyg

SEQ ID NO: 1253 - DNA, 2 bp, Artificial Sequence
  Description of Artificial Sequence: Synthetic oligonucleotide
yg

SEQ ID NO: 1254 - DNA, 48 bp, Artificial Sequence
  Description of Artificial Sequence: Synthetic oligonucleotide
ygygttttattttgtagyggtggttttggaattagattttgatttgyg

SEQ ID NO: 1255 - DNA, 228 bp, Artificial Sequence
  Description of Artificial Sequence: Synthetic polynucleotide
ygggtygygygtttatttgygttttygtygtygaaggagtttatgtaygggaagtagatggygagygtttygaaggaggyggatagattgaggyggttttgygagygttttatgttygygtyggygtygggygtttyggtygyggyggyggyggyggyggygggyggtttgggtagtttggtygttttatttttgaygyggagtayggygygyggygtggtggyggyg

SEQ ID NO: 1256 - DNA, 47 bp, Artificial Sequence
  Description of Artificial Sequence: Synthetic oligonucleotide
ygtattttggtygtaataagygygttttaygtygttaygtattagyg

SEQ ID NO: 1257 - DNA, 185 bp, Artificial Sequence
  Description of Artificial Sequence: Synthetic polynucleotide
ygygtagggggygggttttatttttttttygttttygtttyggttttaagtygyggaggygttyggtgggatttygttgttgtttaattaggggggatygggtgagtttttttttttggagtygggttttattagygtygtaggtttataggtygggggtgggggttttggatygaggggyggyg

SEQ ID NO: 1258 - DNA, 216 bp, Artificial Sequence
  Description of Artificial Sequence: Synthetic polynucleotide
ygggggygttaatttygggagtaggaggtygggttttagtygtygggttttgygygtttgttttttgyggygyggtyggtatttgtagttggggtggtygygtaagtgttgtaygygtagtygttyggttttttttaygaagggtygttttttygtygygtttagttttttttaygttttgtttgygggtygtgggygttagtgagtggaaygtyg

SEQ ID NO: 1259 - DNA, 344 bp, Artificial Sequence
  Description of Artificial Sequence: Synthetic polynucleotide
ygtggtttygtgtttyggggygygttttagtttyggtattattagtttttygtttttttyggaggggygttygagtgygttygatayggttagtagygtygyggygagtagtagtagygtgggtattggtttaaagtttygagatttyggagttygtttygygttttttatgtygttgtttagtttgygtttttygaatttttygggtatagttygttgtattggagttttaggagatatygttygtagtagygtayggagygagggatttttagttygggtygggagagtaaagtttygttggtttgttttggattgttaaaattaataatttttattattyg

SEQ ID NO: 1260 - DNA, 28 bp, Artificial Sequence
  Description of Artificial Sequence: Synthetic oligonucleotide
ygttttgtttggtagttaggtygagayg

SEQ ID NO: 1261 - DNA, 124 bp, Artificial Sequence
  Description of Artificial Sequence: Synthetic polynucleotide
ygtggggygttggatttatygagaggttagygtygtygtygggggagggygtgtttygtaygtgtgtgttygygygtgttygygttygygtgtgttagygygygtgttttggtygtgygygtyg

SEQ ID NO: 1262 - DNA, 80 bp, Artificial Sequence
  Description of Artificial Sequence: Synthetic oligonucleotide
ygttygttagggttaygaagagygtaaygaaygttagtagtayggygtttayggtgagygttygygtygtttgtatttyg

SEQ ID NO: 1263 - DNA, 62 bp, Artificial Sequence
  Description of Artificial Sequence: Synthetic oligonucleotide
yggataggtttygtagtgagtaggtaagggtygtttygtygyggttgtttttttaygtttyg

SEQ ID NO: 1264 - DNA, 165 bp, Artificial Sequence
  Description of Artificial Sequence: Synthetic polynucleotide
ygatygtatgygtygatttgtygttgggygttygtttttttttgttggggttgggygyggtttyggagtttggyggyggtggtgagggygtayggttagttgtagyggygttgtgtttgtygtggatttaggatattttaggtttggtggyggggttaggtggyg

SEQ ID NO: 1265 - DNA, 43 bp, Artificial Sequence
  Description of Artificial Sequence: Synthetic oligonucleotide
ygtttttgtgtttttggtggtttyggygttttttyggagygyg

SEQ ID NO: 1266 - DNA, 86 bp, Artificial Sequence
  Description of Artificial Sequence: Synthetic oligonucleotide
ygtygtygttttygtygggagttaagttygtygggtyggttyggttttaggtgggtagttyggtttgtagttggttggaggtggyg

SEQ ID NO: 1267 - DNA, 23 bp, Artificial Sequence
  Description of Artificial Sequence: Synthetic oligonucleotide
ygagttygtgggataagggggyg

SEQ ID NO: 1268 - DNA, 2 bp, Artificial Sequence
  Description of Artificial Sequence: Synthetic oligonucleotide
yg

SEQ ID NO: 1269 - DNA, 99 bp, Artificial Sequence
  Description of Artificial Sequence: Synthetic oligonucleotide
ygyggttatgtaattggtggatttttttaaatygttttggaggggggagygyggygttgggggygggagagygtttttggttgtgagttgtttttgtyg

SEQ ID NO: 1270 - DNA, 73 bp, Artificial Sequence
  Description of Artificial Sequence: Synthetic oligonucleotide
ygtggaattygtgagttttaygtaaygtttttttgtygtttagggtgggtttttagaagtatagaaatggtyg

SEQ ID NO: 1271 - DNA, 2 bp, Artificial Sequence
  Description of Artificial Sequence: Synthetic oligonucleotide
yg

SEQ ID NO: 1272 - DNA, 52 bp, Artificial Sequence
  Description of Artificial Sequence: Synthetic oligonucleotide
yggggygggtagggatygagttaggagagagygggygggggttttgggagyg

SEQ ID NO: 1273 - DNA, 50 bp, Artificial Sequence
  Description of Artificial Sequence: Synthetic oligonucleotide
ygygagtaggagggygtattttatggttaggtgyggaygyggyggttgyg

SEQ ID NO: 1274 - DNA, 50 bp, Artificial Sequence
  Description of Artificial Sequence: Synthetic oligonucleotide
ygggtyggggtattataggygygggaatttaygtgtggattttgygttyg

SEQ ID NO: 1275 - DNA, 2 bp, Artificial Sequence
  Description of Artificial Sequence: Synthetic oligonucleotide
yg

SEQ ID NO: 1276 - DNA, 2 bp, Artificial Sequence
  Description of Artificial Sequence: Synthetic oligonucleotide
yg

SEQ ID NO: 1277 - DNA, 52 bp, Artificial Sequence
  Description of Artificial Sequence: Synthetic oligonucleotide
yggggtagygtaggagtaggtaggggttygyggttygygtgggttttaggyg

SEQ ID NO: 1278 - DNA, 2 bp, Artificial Sequence
  Description of Artificial Sequence: Synthetic oligonucleotide
yg

SEQ ID NO: 1279 - DNA, 2 bp, Artificial Sequence
  Description of Artificial Sequence: Synthetic oligonucleotide
yg

SEQ ID NO: 1280 - DNA, 2 bp, Artificial Sequence
  Description of Artificial Sequence: Synthetic oligonucleotide
yg

SEQ ID NO: 1281 - DNA, 138 bp, Artificial Sequence
  Description of Artificial Sequence: Synthetic polynucleotide
ygagtggtagtagtaggagyggggtgaygaataagattaygaaggatttgaatttggagatatagtttagygtygaggttatygygygggagggagattggygggygagaygagtgaggggtagttagaggygtygyg

SEQ ID NO: 1282 - DNA, 2 bp, Artificial Sequence
  Description of Artificial Sequence: Synthetic oligonucleotide
yg

SEQ ID NO: 1283 - DNA, 2 bp, Artificial Sequence
  Description of Artificial Sequence: Synthetic oligonucleotide
yg

SEQ ID NO: 1284 - DNA, 2 bp, Artificial Sequence
  Description of Artificial Sequence: Synthetic oligonucleotide
yg

SEQ ID NO: 1285 - DNA, 1017 bp, Artificial Sequence
  Description of Artificial Sequence: Synthetic polynucleotide
cggcgatttcggttttcgtaaggtggggcggcgagtaggagtcggggttaggttaggggttcgagttttcgttcgaggggcggggaaggcgggtgacgtgagtcgggtcgggcgggcggagttgggatcggtttcgggaggcgggggcgagcgcgcggagaggtagacgcgaggagggaggcggttgagtagcgcgggcggttttgcggcgggcgcggtgggcgcgggcggcggggtttcgggattttcgcgcgtttttttcgcgcggcgtcgtcgtcgcgcgtttttacgtttcgcgttttacggcgttttcgtttcgcgcgtttttcgtgttcgttttttgttagttttcgggtcgcggtcgtttgtagagcgagcgtttagacggagttttcgggtaatttgagtggcgtcgatcggcggcggagtttttggtagagtttttcgattcggtagcgcggaggggattcgcgttcgttcgcgtcgcgttattttaaattttaagtagcgtcgttttatcggcgcggagtttcggttggaggtaagagtcgcgcgtcgggagatacgtatcgtgagcggtagcgtcgtcggttttttttttcgtcgtttcggagggcgaagtcgcggttttttagttttttgttgcgtcgcgatagcgtcggaatacgtttcgtttcgttgtcgttttcgttgtgtcgtcggcggagggggtcgcgagtttcgcgtttcggtcggaggatgtgcgttttcgcgggtcgtttagtttgagttatgcgttttaacggcggcggcgcgtcggtcggtatggagtttcgcgcggtcgcgttttgattcgttgtgcgtttcgcggtcggcgggcggcgggaggcggcggatcgagagtcggagatcggcgtcgcgggacggaagcgagcgggcgcgggcgtcgcgtagatggtttgggcgagttaggtttgaggtttcgtttttcgaaacgtgattatgtggatttaatagtttttaggatttaggtgagcg

SEQ ID NO: 1286 - DNA, 166 bp, Artificial Sequence
  Description of Artificial Sequence: Synthetic polynucleotide
cgttcggagcgcgggcggggttagtttgggtagtcgcgggtcgttgttgcgtcggaagttttcgtcgttagggagttttttgggcgttaggttttgggtttttgggcgaagtcgacgttagaatatgtttggtttcgtatttagtttatcgtatttttagcgcgcg

SEQ ID NO: 1287 - DNA, 2 bp, Artificial Sequence
  Description of Artificial Sequence: Synthetic oligonucleotide
cg

SEQ ID NO: 1288 - DNA, 2 bp, Artificial Sequence
  Description of Artificial Sequence: Synthetic oligonucleotide
cg

SEQ ID NO: 1289 - DNA, 2 bp, Artificial Sequence
  Description of Artificial Sequence: Synthetic oligonucleotide
cg

SEQ ID NO: 1290 - DNA, 2 bp, Artificial Sequence
  Description of Artificial Sequence: Synthetic oligonucleotide
cg

SEQ ID NO: 1291 - DNA, 2 bp, Artificial Sequence
  Description of Artificial Sequence: Synthetic oligonucleotide
cg

SEQ ID NO: 1292 - DNA, 2 bp, Artificial Sequence
  Description of Artificial Sequence: Synthetic oligonucleotide
cg

SEQ ID NO: 1293 - DNA, 14 bp, Artificial Sequence
  Description of Artificial Sequence: Synthetic oligonucleotide
cgcgttttagcgcg

SEQ ID NO: 1294 - DNA, 2 bp, Artificial Sequence
  Description of Artificial Sequence: Synthetic oligonucleotide
cg

SEQ ID NO: 1295 - DNA, 2 bp, Artificial Sequence
  Description of Artificial Sequence: Synthetic oligonucleotide
cg

SEQ ID NO: 1296 - DNA, 2 bp, Artificial Sequence
  Description of Artificial Sequence: Synthetic oligonucleotide
cg

SEQ ID NO: 1297 - DNA, 125 bp, Artificial Sequence
  Description of Artificial Sequence: Synthetic polynucleotide
cggttttatttatttgtttcgaagagtggttttagttttgcgtttttttttgcgattttatatatagggatagttttaggtatagttttagtagtaggagtatggcggggcgagggcgcgggacg

SEQ ID NO: 1298 - DNA, 2 bp, Artificial Sequence
  Description of Artificial Sequence: Synthetic oligonucleotide
cg

SEQ ID NO: 1299 - DNA, 131 bp, Artificial Sequence
  Description of Artificial Sequence: Synthetic polynucleotide
cggggtgtgaagtggcggcgggtagaggggttcgtaggggttgggattcgcgtgtttttttttgtttcggtgcggagtacgatgtgttcgggcgggggcgaggacgttcgggaggggttgggttgcgtacg

SEQ ID NO: 1300 - DNA, 94 bp, Artificial Sequence
  Description of Artificial Sequence: Synthetic oligonucleotide
cgggtttgttttcggtttcgttcggagggtgtgcgggttttcgtttcgttggtttcgtttgtttattacggcgcgtttaaatttacgcggttcg

SEQ ID NO: 1301 - DNA, 2 bp, Artificial Sequence
  Description of Artificial Sequence: Synthetic oligonucleotide
cg

SEQ ID NO: 1302 - DNA, 2 bp, Artificial Sequence
  Description of Artificial Sequence: Synthetic oligonucleotide
cg

SEQ ID NO: 1303 - DNA, 27 bp, Artificial Sequence
  Description of Artificial Sequence: Synthetic oligonucleotide
cgcgatggggaggggaatatttgcgcg

SEQ ID NO: 1304 - DNA, 164 bp, Artificial Sequence
  Description of Artificial Sequence: Synthetic polynucleotide
cgagattagaggggaaattcgaaaaagtaagtttttgcggtagtagttaggaaatattcgttaggaattggttgcgattttaattttagcggttcgaagttttagtttttttatttttatcgcggtagagtcgttttcgtagatatttttcgaggagaatcgcg

SEQ ID NO: 1305 - DNA, 2 bp, Artificial Sequence
  Description of Artificial Sequence: Synthetic oligonucleotide
cg

SEQ ID NO: 1306 - DNA, 2 bp, Artificial Sequence
  Description of Artificial Sequence: Synthetic oligonucleotide
cg

SEQ ID NO: 1307 - DNA, 68 bp, Artificial Sequence
  Description of Artificial Sequence: Synthetic oligonucleotide
cgttgggttcgtcgaggtcggggtttttttatgggagggaggtggttgcggcggaatttttagatgcg

SEQ ID NO: 1308 - DNA, 508 bp, Artificial Sequence
  Description of Artificial Sequence: Synthetic polynucleotide
cggcggtagcgggagttcgagcgttgcgcgtttattatggtcgtttagggagagttcggttatttggcggcgtagtcggatttcggttttaatagcgagcgtagtatcgattttttagtgttcggtttcgaggacgatttggtcgtcggggcgattttgtatagttcggagtggagcgaggagcgttttcgcgtggataggaagaaatttgaggttatgttataaggtaggtatttttcgtgttttcggatttttcgattgagtttttaattttttttcggatatttttatcgcgcgtttcggcgttcgttattttagtttacggtcggtcggtttagttttaggttcgttttttcgcggagtcggaggatatttagggattggagatttcgcgggattttttatttttttacgttttttagatttttaggcgttgggggttttgtgcgaatttgattggttttagaaaagtcgaaggtcgagtttgtattggcgcgtttaagttgcg

SEQ ID NO: 1309 - DNA, 2 bp, Artificial Sequence
  Description of Artificial Sequence: Synthetic oligonucleotide
cg

SEQ ID NO: 1310 - DNA, 2 bp, Artificial Sequence
  Description of Artificial Sequence: Synthetic oligonucleotide
cg

SEQ ID NO: 1311 - DNA, 2 bp, Artificial Sequence
  Description of Artificial Sequence: Synthetic oligonucleotide
cg

SEQ ID NO: 1312 - DNA, 2 bp, Artificial Sequence
  Description of Artificial Sequence: Synthetic oligonucleotide
cg

SEQ ID NO: 1313 - DNA, 4 bp, Artificial Sequence
  Description of Artificial Sequence: Synthetic oligonucleotide
cgcg

SEQ ID NO: 1314 - DNA, 2 bp, Artificial Sequence
  Description of Artificial Sequence: Synthetic oligonucleotide
cg

SEQ ID NO: 1315 - DNA, 2 bp, Artificial Sequence
  Description of Artificial Sequence: Synthetic oligonucleotide
cg

SEQ ID NO: 1316 - DNA, 9 bp, Artificial Sequence
  Description of Artificial Sequence: Synthetic oligonucleotide
cgtgtagcg

SEQ ID NO: 1317 - DNA, 2 bp, Artificial Sequence
  Description of Artificial Sequence: Synthetic oligonucleotide
cg

SEQ ID NO: 1318 - DNA, 2 bp, Artificial Sequence
  Description of Artificial Sequence: Synthetic oligonucleotide
cg

SEQ ID NO: 1319 - DNA, 396 bp, Artificial Sequence
  Description of Artificial Sequence: Synthetic polynucleotide
tgaggacgaggaggaagaggaggaggaagaagaagaagaggaagaggaggaggaggaggaggaggacgcgtttaggttgagatggttcgcgtggatattgttatttattttaagattgttgttttcgtcgtcgtcgtcgtcgtcgttgttgtcgtcgtcgtcgtcgttattatttgttatagttagtaacgggtagtcggcgtaggggttcgggggagtttttttcgtcgttagcgttattttaaatatttattaatagttatattgttgttattgttgtcgtcgtcgtcgtcgtcgtggagcgcgggaggggggcggggaggcgtttgggttcggggcgttgtgcgcgatttggcggggtgcgtcgagatatatatagcgagtcgtcgtcgttcg

SEQ ID NO: 1320 - DNA, 2 bp, Artificial Sequence
  Description of Artificial Sequence: Synthetic oligonucleotide
cg

SEQ ID NO: 1321 - DNA, 70 bp, Artificial Sequence
  Description of Artificial Sequence: Synthetic oligonucleotide
cgggtcgttatttgtttatttgttttatttaggatatttttttaaataatttttaagtggaaaaattacg

SEQ ID NO: 1322 - DNA, 2 bp, Artificial Sequence
  Description of Artificial Sequence: Synthetic oligonucleotide
cg

SEQ ID NO: 1323 - DNA, 68 bp, Artificial Sequence
  Description of Artificial Sequence: Synthetic oligonucleotide
cgcgggggacgcggggcgcggcgcgttgagcgcgggtgtcgaggttggagggcgcggtcgggttttcg

SEQ ID NO: 1324 - DNA, 88 bp, Artificial Sequence
  Description of Artificial Sequence: Synthetic oligonucleotide
cgagggtcggttcgtttttggggattcgcggatgtcgcgagggggcgtcgcgttattgaaggttgggacgggggcggtgcgcggggcg

SEQ ID NO: 1325 - DNA, 2 bp, Artificial Sequence
  Description of Artificial Sequence: Synthetic oligonucleotide
cg

SEQ ID NO: 1326 - DNA, 2 bp, Artificial Sequence
  Description of Artificial Sequence: Synthetic oligonucleotide
cg

SEQ ID NO: 1327 - DNA, 87 bp, Artificial Sequence
  Description of Artificial Sequence: Synthetic oligonucleotide
cgagttgtttcgtttttttattttgggggcgaagaagggtcggggagtgggggaaagcgggaggcgtcgcggtttgggaggttttcg

SEQ ID NO: 1328 - DNA, 45 bp, Artificial Sequence
  Description of Artificial Sequence: Synthetic oligonucleotide
cgagtttttgcgttgtttttgtcgtcggagttcgggtttgttacg

SEQ ID NO: 1329 - DNA, 2 bp, Artificial Sequence
  Description of Artificial Sequence: Synthetic oligonucleotide
cg

SEQ ID NO: 1330 - DNA, 173 bp, Artificial Sequence
  Description of Artificial Sequence: Synthetic polynucleotide
cggttggaatttttttaagtattgttttgagtttatttttaaatgaaagggggaaaaatttaaattagattagaatttgaaatagttgaaatagttatcgatttttagtttgtttttaagtttggtagagattgtgaaagttttaattttttcgcgatgttagttacggttcg

SEQ ID NO: 1331 - DNA, 2 bp, Artificial Sequence
  Description of Artificial Sequence: Synthetic oligonucleotide
cg

SEQ ID NO: 1332 - DNA, 48 bp, Artificial Sequence
  Description of Artificial Sequence: Synthetic oligonucleotide
cgaagacgagacgtagagttttaattgtagttagagataaaggtttcg

SEQ ID NO: 1333 - DNA, 2 bp, Artificial Sequence
  Description of Artificial Sequence: Synthetic oligonucleotide
cg

SEQ ID NO: 1334 - DNA, 2 bp, Artificial Sequence
  Description of Artificial Sequence: Synthetic oligonucleotide
cg

SEQ ID NO: 1335 - DNA, 36 bp, Artificial Sequence
  Description of Artificial Sequence: Synthetic oligonucleotide
cgatcgtggcgttagtttttcgttttttttgtttcg

SEQ ID NO: 1336 - DNA, 2 bp, Artificial Sequence
  Description of Artificial Sequence: Synthetic oligonucleotide
cg

SEQ ID NO: 1337 - DNA, 2 bp, Artificial Sequence
  Description of Artificial Sequence: Synthetic oligonucleotide
cg

SEQ ID NO: 1338 - DNA, 2 bp, Artificial Sequence
  Description of Artificial Sequence: Synthetic oligonucleotide
cg

SEQ ID NO: 1339 - DNA, 2 bp, Artificial Sequence
  Description of Artificial Sequence: Synthetic oligonucleotide
cg

SEQ ID NO: 1340 - DNA, 2 bp, Artificial Sequence
  Description of Artificial Sequence: Synthetic oligonucleotide
cg

SEQ ID NO: 1341 - DNA, 97 bp, Artificial Sequence
  Description of Artificial Sequence: Synthetic oligonucleotide
cgtttgtaaggacgggagtcggggagggtgtagggcgagtttaaaggacgggtagagtaagtttcgggaagaggtaggggttttttttttcgggtcg

SEQ ID NO: 1342 - DNA, 2 bp, Artificial Sequence
  Description of Artificial Sequence: Synthetic oligonucleotide
cg

SEQ ID NO: 1343 - DNA, 2 bp, Artificial Sequence
  Description of Artificial Sequence: Synthetic oligonucleotide
cg

SEQ ID NO: 1344 - DNA, 67 bp, Artificial Sequence
  Description of Artificial Sequence: Synthetic oligonucleotide
cgttagatttttatagttttttatacgttatttttattgttttagggaattataagtataggtatcg

SEQ ID NO: 1345 - DNA, 2 bp, Artificial Sequence
  Description of Artificial Sequence: Synthetic oligonucleotide
cg

SEQ ID NO: 1346 - DNA, 29 bp, Artificial Sequence
  Description of Artificial Sequence: Synthetic oligonucleotide
cgatagggtagagggttagtagttattcg

SEQ ID NO: 1347 - DNA, 49 bp, Artificial Sequence
  Description of Artificial Sequence: Synthetic oligonucleotide
cggtcgagtttaagtggttgaagcgcggacgaggatgcgcggggtttcg

SEQ ID NO: 1348 - DNA, 188 bp, Artificial Sequence
  Description of Artificial Sequence: Synthetic polynucleotide
cgggagttcgaagtcgtttcgagcgggggtgggcggtgagcggattttcgggtgttgattaggtgtttggtggtagagtagggaaggggggaacggacgtcgattttagggattttttattcgtttacgttttttggcgttggttatacgtcgtcgttttagtattaattggaggtttttagtggacg

SEQ ID NO: 1349 - DNA, 4 bp, Artificial Sequence
  Description of Artificial Sequence: Synthetic oligonucleotide
cgcg

SEQ ID NO: 1350 - DNA, 4 bp, Artificial Sequence
  Description of Artificial Sequence: Synthetic oligonucleotide
cgcg

SEQ ID NO: 1351 - DNA, 113 bp, Artificial Sequence
  Description of Artificial Sequence: Synthetic polynucleotide
cggtcgtgggcggttgcggcgcggtcgcggcgaggggcgagcggggttggtttcgtcgttcgggcgagagtatttttttgggggttaattttgcggtttcgtttttattcgcg

SEQ ID NO: 1352 - DNA, 208 bp, Artificial Sequence
  Description of Artificial Sequence: Synthetic polynucleotide
cggcggatggagacgggagggaggttgcgaggtcgttcgaggagagattaaggttttagaaacggagaagcgggcgttttgcgggaggcggcggcgttgtcgttggtcgttaagggcgggaagtgttttgggatttttattaggggtcgcgagtttcgagcgttaaattttcgcggcgttcgtttagcgcgttgttgtggcgggcgcg

SEQ ID NO: 1353 - DNA, 96 bp, Artificial Sequence
  Description of Artificial Sequence: Synthetic oligonucleotide
cggttcgttcgttttttagtagttttggggtgttcggggcggttttgtaagcgggagagagcggcgaggcggcggcgtcgagtgcggggggatgcg

SEQ ID NO: 1354 - DNA, 236 bp, Artificial Sequence
  Description of Artificial Sequence: Synthetic polynucleotide
cggtgagtattcgtcgtggggaagggttttggggatttattggaggtcgcggttcgtagtagttaggggtcgagttacggttacggacgttttggtgtttcggttcgtgtcgggtttttaggcggaggaggcgttcgttgggtttagattttcgattttagtttcggtttttcggcgtttgggttgcgcggagtttttgtttcgcgtttcggatttttacgcgtagtttttacgcg

SEQ ID NO: 1355 - DNA, 211 bp, Artificial Sequence
  Description of Artificial Sequence: Synthetic polynucleotide
cgtttttagtcgtgttttggttgcgtagttggaaaggttgagtagtttattgttgtttttttgttcggttttggatatatcgtttgaatttttgggcgtttttgttgttaagtgggggatagtattatttattggggaggaaaattttaggaatgtggattttggggttacgtaggggttgggaagtgaagggtagggaacgcgggcggcg

SEQ ID NO: 1356 - DNA, 193 bp, Artificial Sequence
  Description of Artificial Sequence: Synthetic polynucleotide
cgcgcgtcgaagttgtgacggtttattaagtagagatttgcgaggtatatagagagggaatgaggcggaatcgttcgggggttcgttgatattgtagagtttttcgtagtatcgttgttttaaatttcgtttttttaggcgtgcgcgtatagcgagttagaggaggtttcgtttcgatttggggtttttcgcg

SEQ ID NO: 1357 - DNA, 4 bp, Artificial Sequence
  Description of Artificial Sequence: Synthetic oligonucleotide
cgcg

SEQ ID NO: 1358 - DNA, 199 bp, Artificial Sequence
  Description of Artificial Sequence: Synthetic polynucleotide
cgagtaggaggatttaacgaatttagtttgtggatatgttttaatttttattttcgttttttttaggtttgtttaggtgaggatgatgggagggaaaagcggtgtatagtcgtaatattggtattttgtaagagtcgtcggggtattgatatagagggatatcgtattggagatgcggtgtttacggagatttattgcg

SEQ ID NO: 1359 - DNA, 87 bp, Artificial Sequence
  Description of Artificial Sequence: Synthetic oligonucleotide
cggttagtagaggcggcgtttggttttggatgttgtagcggagacgttaaggagattgaatgtagggagcgaggcgtagcggtcgcg

SEQ ID NO: 1360 - DNA, 68 bp, Artificial Sequence
  Description of Artificial Sequence: Synthetic oligonucleotide
cgcgcgagagtgtttagttgggaaatgtagtttcgaattaatatcgtatgttttataattagtttacg

SEQ ID NO: 1361 - DNA, 61 bp, Artificial Sequence
  Description of Artificial Sequence: Synthetic oligonucleotide
cgtttttggtatttagggaatggtttgtaaattttaatgtattatagattagtttttatcg

SEQ ID NO: 1362 - DNA, 40 bp, Artificial Sequence
  Description of Artificial Sequence: Synthetic oligonucleotide
cgggtgttttgtcgttgtcgtttttgttgtcgtcgattcg

SEQ ID NO: 1363 - DNA, 647 bp, Artificial Sequence
  Description of Artificial Sequence: Synthetic polynucleotide
cgagcggcgaggcgagggcgagcgcgtcgaggaagggcgggagaggcgcggagtttggtcgcgtcgcgttgcgtcgagcgtcgggtttttttcgcgagtttttcgggttcgcgcgcgcgttttttattgttttcgtttttcgcgcggcgcgtgttttttatttttcgtcgcgcgttttcgtattcgttcggttttacgcggcgcgcgtttgttttggcggtagcggcggcggcggcggcgcgttttttttcgaacgtcgtttttagggttgttggttgcgttttttattgtttcgcggttgttgttcggggtgggcggcgaggcgggggggaggtgtcggtttggtcgtcggggagggtttatcgttcgggcggatttttattgcgagagcgatgcgggtttaggcgcggcgcgcgggggttgtagggcgtttagtattgggggttgtcggcgcgcgggggtttttttttggtttttaggtattcgttgttgttgggcgtttttcgtattttcggttattatggatatttcgttttttcgtcgtttttttcgcgtatttcgggaggtcgtcggggcggtagtagcggcgcggtttcgcgggtgtttaggtgatcggttcggtagcggtagagtagtggtagtagtcg

SEQ ID NO: 1364 - DNA, 327 bp, Artificial Sequence
  Description of Artificial Sequence: Synthetic polynucleotide
cgcggaggagggtcgggttgattgtcgtcgttgagttgttttcggacgggagcgtttgtttacggtatttattttttttagcggtggaaatgtggagaagtaagtgggaggcggtgtcgggaattgattttttttaaaacggtcggcgtcgttgttttgaaatgggcggttaagtgtttgtgggattaagggcggttttagagatgttcggaaaatcgttgttacggttagagtgcggcgtagacgcggtagagttggaggtgttcgcggtgtaggttgttgtttacgtcgtttaggttaggtgttgagggtttagttcgcgtttcg

SEQ ID NO: 1365 - DNA, 2 bp, Artificial Sequence
  Description of Artificial Sequence: Synthetic oligonucleotide
cg

SEQ ID NO: 1366 - DNA, 324 bp, Artificial Sequence
  Description of Artificial Sequence: Synthetic polynucleotide
cgtagttgttgtagtcgttgcggttgtcgttatttggtaggaggtatagggtatgggtgagggaggttgcggtagcggttacgagttgttgaggaagttagattgtaggtatttggggggcgttaggtagtcgtagtcgtcggtttcggcgttcgttacgtcgtattcgtttgcggcgttttcggtttcgaagagttttttgtcgggttggaagtgcgcgggcggcggtcggaagggtttttttatgcggcggcggcgtcggtagttgtttttttcgaatatgttttcgtaggtcgggtttagcgtttagtagttgtttttgcg

SEQ ID NO: 1367 - DNA, 77 bp, Artificial Sequence
  Description of Artificial Sequence: Synthetic oligonucleotide
cggcgtagcggcgggaattcgaggtcgagcgtcgcggcggtagcgttagaagcgtatttatcgggtacggcgaggcg

SEQ ID NO: 1368 - DNA, 158 bp, Artificial Sequence
  Description of Artificial Sequence: Synthetic polynucleotide
cgttttggattttcgaagttagttttttgcgtagcggattagagaggtttattcgcggacgttaatttaatttttgggcggggttcgggggttgagtagaaggcgaggtttggggagtacggataattttgagggttgtttgtgtcggggtgggagcg

SEQ ID NO: 1369 - DNA, 79 bp, Artificial Sequence
  Description of Artificial Sequence: Synthetic oligonucleotide
cgtttttaaaaattaaataaattaataagagaattaattaataggtagcgttgcgatcgttaggagcgcggagcgcgcg

SEQ ID NO: 1370 - DNA, 137 bp, Artificial Sequence
  Description of Artificial Sequence: Synthetic polynucleotide
cgttttttttgatttttaaggttagaaagatttattatttttttcgagagggcgtagttatagatttattagagagggcgggtagggtgtcggaagttagagaacggcgtttcgcgtttttttatcgttttagggcg

SEQ ID NO: 1371 - DNA, 112 bp, Artificial Sequence
  Description of Artificial Sequence: Synthetic polynucleotide
cgcgggttatgtattgttgttggtgtttattatgtttaattttttggattataagtggtataaggagtcgttgtagtagtgtaatttcgatgggtcgttgggtgtcgtagcg

SEQ ID NO: 1372 - DNA, 2 bp, Artificial Sequence
  Description of Artificial Sequence: Synthetic oligonucleotide
cg

SEQ ID NO: 1373 - DNA, 2 bp, Artificial Sequence
  Description of Artificial Sequence: Synthetic oligonucleotide
cg

SEQ ID NO: 1374 - DNA, 282 bp, Artificial Sequence
  Description of Artificial Sequence: Synthetic polynucleotide
cgtgggtagggcgtcgtagtttgcgtagtttcgaggatttcgcgtcgttttttcgagttagggtttttaggagcgggtcgcgtaggagacgttagagggggttgttagcggttgttgggagaacgggttacggaaatagttttttttaaagtcggggttatcgtggggtgggcgagttcgtttttttaggtcgggggcgcggattagaggggacgtgtgtagacggtcgcggttagttttatttcgttcgggcggagacgtatagttggagttggagggtcg

SEQ ID NO: 1375 - DNA, 81 bp, Artificial Sequence
  Description of Artificial Sequence: Synthetic oligonucleotide
cggttgttaattcgtttaatttgttgcgcgggtggtcgtttagagtcgcgggtttgcggggcgtttttcgtcgtcgcgtcg

SEQ ID NO: 1376 - DNA, 53 bp, Artificial Sequence
  Description of Artificial Sequence: Synthetic oligonucleotide
cggtcgtggagattttaatcgagtttacgttggcgtaaaaggtaaaagtcgcg

SEQ ID NO: 1377 - DNA, 40 bp, Artificial Sequence
  Description of Artificial Sequence: Synthetic oligonucleotide
cgcgtcgagggggcgttagcggggacgtgagttggcgtcg

SEQ ID NO: 1378 - DNA, 206 bp, Artificial Sequence
  Description of Artificial Sequence: Synthetic polynucleotide
cggtagtttgagcgtttcggatggttcgcggcggggcggtttgtaagagcgacgcgcggttgttgttggggcgggacgcgttgcggtcggcgttcgttttgttggttttcgtcgtgttgttgggcgtcgcgttcggtttcggtttcggtttttggtttggttgtcgcgcgggtcgttagcgtacgcgatattaggtgggtcggtcg

SEQ ID NO: 1379 - DNA, 38 bp, Artificial Sequence
  Description of Artificial Sequence: Synthetic oligonucleotide
cgagggtacggcggtcgtcgtttcgcgtagtagtagcg

SEQ ID NO: 1380 - DNA, 5 bp, Artificial Sequence
  Description of Artificial Sequence: Synthetic oligonucleotide
cggcg

SEQ ID NO: 1381 - DNA, 25 bp, Artificial Sequence
  Description of Artificial Sequence: Synthetic oligonucleotide
cgagcgaatgtaacgcgtatatacg

SEQ ID NO: 1382 - DNA, 79 bp, Artificial Sequence
  Description of Artificial Sequence: Synthetic oligonucleotide
cgtttttttttttttttaaaaaaaaaatttaaataatttttaaataatatttaataggaaagaagaaggaaaaggagcg

SEQ ID NO: 1383 - DNA, 33 bp, Artificial Sequence
  Description of Artificial Sequence: Synthetic oligonucleotide
cgagggtaacggtcgaggcgttacgcggggtcg

SEQ ID NO: 1384 - DNA, 132 bp, Artificial Sequence
  Description of Artificial Sequence: Synthetic polynucleotide
cgtaggttaggcggtcgtgggtcgagttggttatgattattttttcgcgggcgttttgtttgggcgagtgtttttcgtagcgttcgtatttcgtttttttcgtgtgtagtttcgcgtcgtcgtcgttcgtcg

SEQ ID NO: 1385 - DNA, 32 bp, Artificial Sequence
  Description of Artificial Sequence: Synthetic oligonucleotide
cgttttcggggtagaggagggggtgttaggcg

SEQ ID NO: 1386 - DNA, 2 bp, Artificial Sequence
  Description of Artificial Sequence: Synthetic oligonucleotide
cg

SEQ ID NO: 1387 - DNA, 2 bp, Artificial Sequence
  Description of Artificial Sequence: Synthetic oligonucleotide
cg

SEQ ID NO: 1388 - DNA, 20 bp, Artificial Sequence
  Description of Artificial Sequence: Synthetic oligonucleotide
cggcgtcgttggtatattcg

SEQ ID NO: 1389 - DNA, 85 bp, Artificial Sequence
  Description of Artificial Sequence: Synthetic oligonucleotide
cggcgggcgtaggggtagggtatgattgacgcgttttttgtttgcgtttatgtgagagaaagcggtcgagggagggagcgtgtcg

SEQ ID NO: 1390 - DNA, 230 bp, Artificial Sequence
  Description of Artificial Sequence: Synthetic polynucleotide
cgtaggggtcgagaaagtggcggagaggcggtggtcgaggtttaggggcgagcgcgggttgagttggtttttgttgcgtttacgagcgatatttattttttcgttgcggacgtttcgcgggcgttaggttgggggttttgcgatcgatttttttcgttttcgaggtatcgtcgggttcgtttggtaggtagcgcgtttcgcgagttggagggtcgagtttcgcggggtcg

SEQ ID NO: 1391 - DNA, 84 bp, Artificial Sequence
  Description of Artificial Sequence: Synthetic oligonucleotide
cgtaagagttggttaaaatgtttttaggtgcgtgggggtttcggggttttagttggagttcgatattttgagattggcggttcg

SEQ ID NO: 1392 - DNA, 42 bp, Artificial Sequence
  Description of Artificial Sequence: Synthetic oligonucleotide
cgcgcgagttttttcgtttggttgagttaaaaagggatcgcg

SEQ ID NO: 1393 - DNA, 45 bp, Artificial Sequence
  Description of Artificial Sequence: Synthetic oligonucleotide
cggacgattttttttattttttcgaggacgaggaggagtacggcg

SEQ ID NO: 1394 - DNA, 26 bp, Artificial Sequence
  Description of Artificial Sequence: Synthetic oligonucleotide
cgcgggataagggatgttggcgggcg

SEQ ID NO: 1395 - DNA, 50 bp, Artificial Sequence
  Description of Artificial Sequence: Synthetic oligonucleotide
cgaggtttttttcgcggcgcgcggtagttttagtttttatttaaatttcg

SEQ ID NO: 1396 - DNA, 56 bp, Artificial Sequence
  Description of Artificial Sequence: Synthetic oligonucleotide
cgttggtttattcgcgtgtacgtttattttttacgcgcgtttttggtttagaagcg

SEQ ID NO: 1397 - DNA, 44 bp, Artificial Sequence; identical to SEQ ID NO: 113
  Description of Artificial Sequence: Synthetic oligonucleotide

SEQ ID NO: 1398 - DNA, 2 bp, Artificial Sequence
  Description of Artificial Sequence: Synthetic oligonucleotide
cg

SEQ ID NO: 1399 - DNA, 9 bp, Artificial Sequence
  Description of Artificial Sequence: Synthetic oligonucleotide
cggaaggcg

SEQ ID NO: 1400 - DNA, 58 bp, Artificial Sequence
  Description of Artificial Sequence: Synthetic oligonucleotide
cgttcgtttattcgttaggtaggcggtggtgtcgatttatttgagtagttgtttcgcg

SEQ ID NO: 1401 - DNA, 151 bp, Artificial Sequence
  Description of Artificial Sequence: Synthetic polynucleotide
cgtattggtttttttcgttttcgttcgtacgaaagttttgttcgacgtttgtagttagtatcgttcgtattgtttagggagggtttgcgtcgagatttagtggtcgagtgagttatagagtcgttggttttggggacgttgttttttatcg

SEQ ID NO: 1402 - DNA, 17 bp, Artificial Sequence
  Description of Artificial Sequence: Synthetic oligonucleotide
cggttttggggagttcg

SEQ ID NO: 1403 - DNA, 70 bp, Artificial Sequence
  Description of Artificial Sequence: Synthetic oligonucleotide
cgtagaggggttagtaattttatgggtggtggggttttttatttttggacgtagcggggagtagcgggcg

SEQ ID NO: 1404 - DNA, 59 bp, Artificial Sequence
  Description of Artificial Sequence: Synthetic oligonucleotide
cggcgtttagcgtttaagcgttaattcgttgaaagttttttagcgaaattttagggacg

SEQ ID NO: 1405 - DNA, 25 bp, Artificial Sequence
  Description of Artificial Sequence: Synthetic oligonucleotide
cggttcggatagaggttatttagcg

SEQ ID NO: 1406 - DNA, 57 bp, Artificial Sequence
  Description of Artificial Sequence: Synthetic oligonucleotide
cgtttttcgttatttgatattagttaggtagtttttagggttagagcgttagcgtcg

SEQ ID NO: 1407 - DNA, 111 bp, Artificial Sequence
  Description of Artificial Sequence: Synthetic polynucleotide
cgtttagggttggggttcggtgggaattttttcgtgttcgaagggacgatttcgttagagagtttttcgatttttgtatttatcgtttttggtaggacgtggagttgttcg

SEQ ID NO: 1408 - DNA, 211 bp, Artificial Sequence
  Description of Artificial Sequence: Synthetic polynucleotide
cgttattgtcgtcgttggcgttttgtttttggaattttttagtaagatggtatttattgtttgttttttttcgattagtatttttagtcgcgttttttttttttcgggatacgtattagttatatattgtggggagaagatgggttatgtaaatgtaagttaacgcgtttttttagttatttttgtataatgtaataggaatagcgattcg

SEQ ID NO: 1409 - DNA, 75 bp, Artificial Sequence
  Description of Artificial Sequence: Synthetic oligonucleotide
cgtttttattatttttttaaatattgtagtaagttgtagtaaggcgggtaaatatcgatagcgcgcgtgggggcg

SEQ ID NO: 1410 - DNA, 2 bp, Artificial Sequence
  Description of Artificial Sequence: Synthetic oligonucleotide
cg

SEQ ID NO: 1411 - DNA, 66 bp, Artificial Sequence
  Description of Artificial Sequence: Synthetic oligonucleotide
cggttatttgtttttcgttttcggggcgtcgtttagtttcgcgttaggcgttttttttagcgttcg

SEQ ID NO: 1412 - DNA, 2 bp, Artificial Sequence
  Description of Artificial Sequence: Synthetic oligonucleotide
cg

SEQ ID NO: 1413 - DNA, 163 bp, Artificial Sequence
  Description of Artificial Sequence: Synthetic polynucleotide
cgcgcgtttttcggcgggtcggcgggttcggaagtttcgttgttcgggtcgggtttttaagttcgtagtcgttttgattaaaataggtatcgcgacggcggcggtaggcggcggtagttagggttggggtcgtatcgcgtacgcgtatgcgttcgtcgtttcg

SEQ ID NO: 1414 - DNA, 99 bp, Artificial Sequence
  Description of Artificial Sequence: Synthetic oligonucleotide
cgtttttgttttggagcgcggtcgggagtaaaatcgtaggagtgggagggtagcgagttagttggatttcgagtcgcggagcgcgttggttttgtttcg

SEQ ID NO: 1415 - DNA, 96 bp, Artificial Sequence
  Description of Artificial Sequence: Synthetic oligonucleotide
cgcgttttcgtaggcggtattgttcgcggcgcggcgtgtgtatcgagcgagtgaaggtatgtgtggcgggcgcggttggagttgtcgtcgtcgtcg

SEQ ID NO: 1416 - DNA, 4 bp, Artificial Sequence
  Description of Artificial Sequence: Synthetic oligonucleotide
cgcg

SEQ ID NO: 1417 - DNA, 16 bp, Artificial Sequence
  Description of Artificial Sequence: Synthetic oligonucleotide
cggcgagattggtacg

SEQ ID NO: 1418 - DNA, 2 bp, Artificial Sequence
  Description of Artificial Sequence: Synthetic oligonucleotide
cg

SEQ ID NO: 1419 - DNA, 141 bp, Artificial Sequence
  Description of Artificial Sequence: Synthetic polynucleotide
cgcggttgatggttgacgcgttgcgcggttgcgtgtttgttttttacggcgtggtggagcgcgacggcgaaagttatttgtagttgtaggatttgttcgatggtttcgacggattttgtgtgttcgattgtaaaatgggcg

SEQ ID NO: 1420 - DNA, 2 bp, Artificial Sequence
  Description of Artificial Sequence: Synthetic oligonucleotide
cg

SEQ ID NO: 1421 - DNA, 37 bp, Artificial Sequence
  Description of Artificial Sequence: Synthetic oligonucleotide
cgtttttaattaatcgtataaaattcgtaatatttcg

SEQ ID NO: 1422 - DNA, 52 bp, Artificial Sequence
  Description of Artificial Sequence: Synthetic oligonucleotide
cgggtcggggtatttggcgttttgtgtgggtggcgggagcggggacgtttcg

SEQ ID NO: 1423 - DNA, 2 bp, Artificial Sequence
  Description of Artificial Sequence: Synthetic oligonucleotide
cg

SEQ ID NO: 1424 - DNA, 7 bp, Artificial Sequence
  Description of Artificial Sequence: Synthetic oligonucleotide
cggagcg

SEQ ID NO: 1425 - DNA, 2 bp, Artificial Sequence
  Description of Artificial Sequence: Synthetic oligonucleotide
cg

SEQ ID NO: 1426 - DNA, 4 bp, Artificial Sequence
  Description of Artificial Sequence: Synthetic oligonucleotide
cgcg

SEQ ID NO: 1427 - DNA, 17 bp, Artificial Sequence
  Description of Artificial Sequence: Synthetic oligonucleotide
cgagttggggcgggacg

SEQ ID NO: 1428 - DNA, 136 bp, Artificial Sequence
  Description of Artificial Sequence: Synthetic polynucleotide
cgcgagttttttgacgcggggattagttatgaatcgggggtgtgtgtttgtttttagagatttggtaaggtgcggagttttttagaagtgcggttaagcggtagcggagacggcgagttaggaattttttttcgcg

SEQ ID NO: 1429 - DNA, 31 bp, Artificial Sequence
  Description of Artificial Sequence: Synthetic oligonucleotide
cgcgtttagcgtttcgtttattttttggtcg

SEQ ID NO: 1430 - DNA, 25 bp, Artificial Sequence
  Description of Artificial Sequence: Synthetic oligonucleotide
cgtgtattttgaggtttggttggcg

SEQ ID NO: 1431 - DNA, 12 bp, Artificial Sequence
  Description of Artificial Sequence: Synthetic oligonucleotide
cgttgacgagcg

SEQ ID NO: 1432 - DNA, 6 bp, Artificial Sequence
  Description of Artificial Sequence: Synthetic oligonucleotide
cgtacg

SEQ ID NO: 1433 - DNA, 199 bp, Artificial Sequence
  Description of Artificial Sequence: Synthetic polynucleotide
cgcgttcgcggtcgcggtcgttgtatggcgttgagatggcgggggcgtcgcgcggcggaggcggcggcggaggcggcgcgggcgagttcgggggcgtcgagcgggcggtcgggataagtcgtcggcgcgggtttcgggcgtgcgacgaggagttcgtttgtttagagttggaggcgttgtttcgcggttatacgttgcg

SEQ ID NO: 1434 - DNA, 91 bp, Artificial Sequence
  Description of Artificial Sequence: Synthetic oligonucleotide
cggtttcgggtgtagggtggcgggttcggcggcgcgcgttttttttttttttttggcggttcgtacgtgtcgttcgcgtcgcgtttttacg

SEQ ID NO: 1435 - DNA, 108 bp, Artificial Sequence
  Description of Artificial Sequence: Synthetic polynucleotide
cgcgtttttattgttttatttttttcgtttttggagtttttcggtgattttattatagtttttgttattttgtgatttgtaggtattgggagatttatagggaggacg

SEQ ID NO: 1436 - DNA, 13 bp, Artificial Sequence
  Description of Artificial Sequence: Synthetic oligonucleotide
cgtatcgatttcg

SEQ ID NO: 1437 - DNA, 176 bp, Artificial Sequence
  Description of Artificial Sequence: Synthetic polynucleotide
cggttcgttgggtaaggcgttcgagaaagcgtttggcgggaggaggtgcgcggttttttgttttaggcggttcgggtgttcgttttatgcggggcgagcgttcggtcgattttcgtcggggcggagtttgaggggtggttgatttatgtacggggattgttatttcgtcgttttcg

SEQ ID NO: 1438 - DNA, 2 bp, Artificial Sequence
  Description of Artificial Sequence: Synthetic oligonucleotide
cg

SEQ ID NO: 1439 - DNA, 157 bp, Artificial Sequence
  Description of Artificial Sequence: Synthetic polynucleotide
cgagaagtttcgcgggagacggcggtttttaaagttattttgggtcgcgggagcgcgggatcggggttgcgggcgtcgagagcgcgtcgtttgtcgttttcgtgcgtcgtcgtcgtttttgcgcgacgtttttcggttaggtttgggaaagcgttcg

SEQ ID NO: 1440 - DNA, 66 bp, Artificial Sequence
  Description of Artificial Sequence: Synthetic oligonucleotide
cgcgaatcgttaggggttttcgcgttttttttttatttaggttttttgtttttttcgtcgcggtcg

SEQ ID NO: 1441 - DNA, 498 bp, Artificial Sequence
  Description of Artificial Sequence: Synthetic polynucleotide
cgtcgtcgcgtcgatcggtcgcgttttcgggattttttgggtcggtcgcgttttcggttttttttttcgtcgcgtttgtgcgtacgcgtagacgtcgtaagttttacgagttgtacgcggtcggcgtttcgtttttttcgtcgttcggttacgttttcgcgttcgagtcgtcgcggttcggaagcggaagcggaagcggtttcggtttcgtttttgcgcgttcgttcggtttcgcggtcgacggttttatcgatttgagtaagaagtcgcggcgttcgtttttcggagtttcggtatcggcgttggtcgattattacgagtgtacggtttgtcgcgtgagtttttatagtttcgaggtttatttggcgtataagaagtattcgtgtttcgttgcgttatcgttcggcgcgttcggtttgttcgtcgtcgtttgtttttattgtttttcgaacggttcggtgcgcggggatttgttggagtattttcgtttggcgtacg

SEQ ID NO: 1442 - DNA, 27 bp, Artificial Sequence
  Description of Artificial Sequence: Synthetic oligonucleotide
cgcgggttcgaacgtttttcgcgtttg

SEQ ID NO: 1443 - DNA, 2 bp, Artificial Sequence
  Description of Artificial Sequence: Synthetic oligonucleotide
cg

SEQ ID NO: 1444 - DNA, 2 bp, Artificial Sequence
  Description of Artificial Sequence: Synthetic oligonucleotide
cg

SEQ ID NO: 1445 - DNA, 16 bp, Artificial Sequence
  Description of Artificial Sequence: Synthetic oligonucleotide
cgtcgtttgtttcgcg

SEQ ID NO: 1446 - DNA, 53 bp, Artificial Sequence
  Description of Artificial Sequence: Synthetic oligonucleotide
cgcggagggcgtcgaattagagtttgcggggtttgatagttttttttgcggcg

SEQ ID NO: 1447 - DNA, 4 bp, Artificial Sequence
  Description of Artificial Sequence: Synthetic oligonucleotide
cgcg

SEQ ID NO: 1448 - DNA, 2 bp, Artificial Sequence
  Description of Artificial Sequence: Synthetic oligonucleotide
cg

SEQ ID NO: 1449 - DNA, 2 bp, Artificial Sequence
  Description of Artificial Sequence: Synthetic oligonucleotide
cg

SEQ ID NO: 1450 - DNA, 2 bp, Artificial Sequence
  Description of Artificial Sequence: Synthetic oligonucleotide
cg

SEQ ID NO: 1451 - DNA, 14 bp, Artificial Sequence
  Description of Artificial Sequence: Synthetic oligonucleotide
cgtgtttatttacg

SEQ ID NO: 1452 - DNA, 186 bp, Artificial Sequence
  Description of Artificial Sequence: Synthetic polynucleotide
cggcgggaaggtttgggtgtttatagatagagttggagtttttcggtgggtggtatagataattagttggggttgttttatatgtaatttaattataggggaaataggtttaaatatcgggtgataagtagcgtaattgtttcgggtgattttgtaattttttttttattaattttttttataacg

SEQ ID NO: 1453 - DNA, 79 bp, Artificial Sequence
  Description of Artificial Sequence: Synthetic oligonucleotide
cggggtacgttcgttttcggcggggtttttcgtttcgttgtgggagtggtagtgggtgtcggggtggagaaagtacgcg

SEQ ID NO: 1454 - DNA, 49 bp, Artificial Sequence
  Description of Artificial Sequence: Synthetic oligonucleotide
cgtcgcgttcgcgtcgcgttttttgtaggtaacgggagacgttttcgcg

SEQ ID NO: 1455 - DNA, 17 bp, Artificial Sequence
  Description of Artificial Sequence: Synthetic oligonucleotide
cggatgaatcgttcgcg

SEQ ID NO: 1456 - DNA, 2 bp, Artificial Sequence
  Description of Artificial Sequence: Synthetic oligonucleotide
cg

SEQ ID NO: 1457 - DNA, 9 bp, Artificial Sequence
  Description of Artificial Sequence: Synthetic oligonucleotide
cgggttacg

SEQ ID NO: 1458 - DNA, 2 bp, Artificial Sequence
  Description of Artificial Sequence: Synthetic oligonucleotide
cg

SEQ ID NO: 1459 - DNA, 165 bp, Artificial Sequence
  Description of Artificial Sequence: Synthetic polynucleotide
cgggaacgttgtagtttggttgagcgtgatttttaggttttgtgaggaaaagtcgagcgcgttatatcgaggcgttagtcgtttattttattataaggtaaaagatttatgttgttttagttattttaaagttgggagatatattgtattttttattagatttcg

SEQ ID NO: 1460 - DNA, 14 bp, Artificial Sequence
  Description of Artificial Sequence: Synthetic oligonucleotide
cgcgcgggttagcg

SEQ ID NO: 1461 - DNA, 2 bp, Artificial Sequence
  Description of Artificial Sequence: Synthetic oligonucleotide
cg

SEQ ID NO: 1462 - DNA, 2 bp, Artificial Sequence
  Description of Artificial Sequence: Synthetic oligonucleotide
cg

SEQ ID NO: 1463 - DNA, 97 bp, Artificial Sequence
  Description of Artificial Sequence: Synthetic oligonucleotide
cgtgtgtttagggttagtagtacgtataagtgttagcgtacggtcgtcgcgtttatgtttaatgcgggtttcgttgggcgtgcgggcgtgcggggcg

SEQ ID NO: 1464 - DNA, 2 bp, Artificial Sequence
  Description of Artificial Sequence: Synthetic oligonucleotide
cg

SEQ ID NO: 1465 - DNA, 98 bp, Artificial Sequence
  Description of Artificial Sequence: Synthetic oligonucleotide
cgcggatcgcgcgttttcgtcgttttgtttttaaatttttgtcgtagtttttttttaagttagcgaatttattttttaaaattagaaattgaatttcg

SEQ ID NO: 1466 - DNA, 69 bp, Artificial Sequence
  Description of Artificial Sequence: Synthetic oligonucleotide
cggaggggcggaggaggtgttggcggcggtattgagcggcggcggcgtagggcgcgcgggtttttcgcg

SEQ ID NO: 1467 - DNA, 2 bp, Artificial Sequence
  Description of Artificial Sequence: Synthetic oligonucleotide
cg

SEQ ID NO: 1468 - DNA, 2 bp, Artificial Sequence
  Description of Artificial Sequence: Synthetic oligonucleotide
cg

SEQ ID NO: 1469 - DNA, 2 bp, Artificial Sequence
  Description of Artificial Sequence: Synthetic oligonucleotide
cg

SEQ ID NO: 1470 - DNA, 2 bp, Artificial Sequence
  Description of Artificial Sequence: Synthetic oligonucleotide
cg

SEQ ID NO: 1471 - DNA, 103 bp, Artificial Sequence
  Description of Artificial Sequence: Synthetic polynucleotide
cggttttaggacggtagggatcgcgatggagcggtttcgggggcggtcgggggacggcgcggtggcggtcggttagttcgttttttcgggggcggcgggcgcg

SEQ ID NO: 1472 - DNA, 2 bp, Artificial Sequence
  Description of Artificial Sequence: Synthetic oligonucleotide
cg

SEQ ID NO: 1473 - DNA, 21 bp, Artificial Sequence
  Description of Artificial Sequence: Synthetic oligonucleotide
cggtttttggcggcggcggcg

SEQ ID NO: 1474 - DNA, 148 bp, Artificial Sequence
  Description of Artificial Sequence: Synthetic polynucleotide
cggcgttttaaaggggaggattttgcggcgcgggtaagaggcggcgggagcgcgcggttcgggagtgtggttgtagtgcgtcgggatattagggtttcgcgtttcgtatttaagaggttttcgcgttttaatttttcgcgttcgcgcg

SEQ ID NO: 1475 - DNA, 2 bp, Artificial Sequence
  Description of Artificial Sequence: Synthetic oligonucleotide
cg

SEQ ID NO: 1476 - DNA, 2 bp, Artificial Sequence
  Description of Artificial Sequence: Synthetic oligonucleotide
cg

SEQ ID NO: 1477 - DNA, 26 bp, Artificial Sequence
  Description of Artificial Sequence: Synthetic oligonucleotide
cgtcgagaggtagcgcgtgatggtcg

SEQ ID NO: 1478 - DNA, 119 bp, Artificial Sequence
  Description of Artificial Sequence: Synthetic polynucleotide
cgtacgtttaagtgcgcgcgttgtcgtaattatggcgttttgttttggtttaagggttataagcgttattgtcgttttaaggattgtatttgcgagaagtgtatttttattatcgagcg

SEQ ID NO: 1479 - DNA, 66 bp, Artificial Sequence
  Description of Artificial Sequence: Synthetic oligonucleotide
cggttcgatttttttcgtttagtttgggttagaggaagtcgaaagcggttttagtaaggtgaggcg

SEQ ID NO: 1480 - DNA, 60 bp, Artificial Sequence
  Description of Artificial Sequence: Synthetic oligonucleotide
cgagcgaagtcgtcgtgtttgggtagaaggcgttttaggaggcgcgaggttttagtcgcg

SEQ ID NO: 1481 - DNA, 2 bp, Artificial Sequence
  Description of Artificial Sequence: Synthetic oligonucleotide
cg

SEQ ID NO: 1482 - DNA, 124 bp, Artificial Sequence
  Description of Artificial Sequence: Synthetic polynucleotide
cgttcggagcgggatttgtttgttttagtgtacgtcgcggagcgaattatcgggttggcgggggtggaggggtgtaggcgtgggggttgcgggtcgttcgggttttgggttttttttgtcgtcg

SEQ ID NO: 1483 - DNA, 2 bp, Artificial Sequence
  Description of Artificial Sequence: Synthetic oligonucleotide
cg

SEQ ID NO: 1484 - DNA, 156 bp, Artificial Sequence
  Description of Artificial Sequence: Synthetic polynucleotide
cggggtatcgcggcgttcgtcgtcgttttttcgtaggtgattatttttttgtaggtgttttcgggttttaggtggttgcgtgtttgcgttatggttgatattttgggcgagcggtatttggtgatttgtaagggcgcgacggtggaggtcgaggcg

SEQ ID NO: 1485 - DNA, 2 bp, Artificial Sequence
  Description of Artificial Sequence: Synthetic oligonucleotide
cg

SEQ ID NO: 1486 - DNA, 91 bp, Artificial Sequence
  Description of Artificial Sequence: Synthetic oligonucleotide
cgcgcgtcgtcgaaattttgttttcgtcgtcgtttatcgataggttgtggagaaggttatcgatcgatgttatcgagttatttttgaagcg

SEQ ID NO: 1487 - DNA, 2 bp, Artificial Sequence
  Description of Artificial Sequence: Synthetic oligonucleotide
cg

SEQ ID NO: 1488 - DNA, 2 bp, Artificial Sequence
  Description of Artificial Sequence: Synthetic oligonucleotide
cg

SEQ ID NO: 1489 - DNA, 89 bp, Artificial Sequence
  Description of Artificial Sequence: Synthetic oligonucleotide
cgttattcgcgtgttagtagttgggcgtttcgattttttagatcgcgtgagtttagtaaagcggttaggcgcgcgtttgtagttcggcg

SEQ ID NO: 1490 - DNA, 13 bp, Artificial Sequence
  Description of Artificial Sequence: Synthetic oligonucleotide
cgtttttaattcg

SEQ ID NO: 1491 - DNA, 2 bp, Artificial Sequence
  Description of Artificial Sequence: Synthetic oligonucleotide
cg

SEQ ID NO: 1492 - DNA, 47 bp, Artificial Sequence
  Description of Artificial Sequence: Synthetic oligonucleotide
cgagcgttagattttagtaataaaaggttaggcgaggttatatcgcg

SEQ ID NO: 1493 - DNA, 2 bp, Artificial Sequence
  Description of Artificial Sequence: Synthetic oligonucleotide
cg

SEQ ID NO: 1494 - DNA, 2 bp, Artificial Sequence
  Description of Artificial Sequence: Synthetic oligonucleotide
cg

SEQ ID NO: 1495 - DNA, 159 bp, Artificial Sequence
  Description of Artificial Sequence: Synthetic polynucleotide
cgatgttcgcggcgtgaaagcgttcgcggcgggcgtcgatttttgttttagttttttgtttttttcgtttcgtttgtttcgtgtttttgtgattttggttttggcgtcgtcgtttaggcgtttcgtaatgtagttgtttttgcgtttcggcgggaggcg

SEQ ID NO: 1496 - DNA, 2 bp, Artificial Sequence
  Description of Artificial Sequence: Synthetic oligonucleotide
cg

SEQ ID NO: 1497 - DNA, 2 bp, Artificial Sequence
  Description of Artificial Sequence: Synthetic oligonucleotide
cg

SEQ ID NO: 1498 - DNA, 2 bp, Artificial Sequence
  Description of Artificial Sequence: Synthetic oligonucleotide
cg

SEQ ID NO: 1499 - DNA, 78 bp, Artificial Sequence
  Description of Artificial Sequence: Synthetic oligonucleotide
cgggcgtcgaggtttgggttttagtcgtggcgttcgtttcggcgtagtggggagtcgcgggcgtcggagaagcggtcg

SEQ ID NO: 1500 - DNA, 2 bp, Artificial Sequence
  Description of Artificial Sequence: Synthetic oligonucleotide
cg

SEQ ID NO: 1501 - DNA, 48 bp, Artificial Sequence
  Description of Artificial Sequence: Synthetic oligonucleotide
cgcggaggagtttcgtattcgatcgtgtatagcgatcgagttggcgcg

SEQ ID NO: 1502 - DNA, 2 bp, Artificial Sequence
  Description of Artificial Sequence: Synthetic oligonucleotide
cg

SEQ ID NO: 1503 - DNA, 2 bp, Artificial Sequence
  Description of Artificial Sequence: Synthetic oligonucleotide
cg

SEQ ID NO: 1504 - DNA, 2 bp, Artificial Sequence
  Description of Artificial Sequence: Synthetic oligonucleotide
cg

SEQ ID NO: 1505 - DNA, 157 bp, Artificial Sequence
  Description of Artificial Sequence: Synthetic polynucleotide
cgtttttatagttttgttttgatagttaaggaaaaaatttgttaaaaattagaggcgttgttgagtgttggcgtgggaatgttagtttagttagagttttgttttgggttatttaaataaaaatagatatgttggtggtaaatgttagttgaatacg

SEQ ID NO: 1506 - DNA, 2 bp, Artificial Sequence
  Description of Artificial Sequence: Synthetic oligonucleotide
cg

SEQ ID NO: 1507 - DNA, 82 bp, Artificial Sequence
  Description of Artificial Sequence: Synthetic oligonucleotide
cgcgcgttagtttttcgtttcgtggaagcgtttttttttcgatttcggttgattttcgttcgtcgtttttttcgcgggtgcg

SEQ ID NO: 1508 - DNA, 23 bp, Artificial Sequence
  Description of Artificial Sequence: Synthetic oligonucleotide
cgtttggtcgttttatttggtcg

SEQ ID NO: 1509 - DNA, 38 bp, Artificial Sequence
  Description of Artificial Sequence: Synthetic oligonucleotide
cgagttttcgcgcgtttacgagtagttttgcgagttcg

SEQ ID NO: 1510 - DNA, 2 bp, Artificial Sequence
  Description of Artificial Sequence: Synthetic oligonucleotide
gg

SEQ ID NO: 1511 - DNA, 165 bp, Artificial Sequence
  Description of Artificial Sequence: Synthetic polynucleotide
cgtgtttttttttagcgagcgtagcgagttgtttttgaagtttaggtagattaggtcgtcgtagaagatgaagaagttttcggggattcgttggatgcggttgtcggttattagtagtttgcgtacgtttagggggaaagggtttggtacgttgggtagttcgcg

SEQ ID NO: 1512 - DNA, 2 bp, Artificial Sequence
  Description of Artificial Sequence: Synthetic oligonucleotide
cg

SEQ ID NO: 1513 - DNA, 2 bp, Artificial Sequence
  Description of Artificial Sequence: Synthetic oligonucleotide
cg

SEQ ID NO: 1514 - DNA, 2 bp, Artificial Sequence
  Description of Artificial Sequence: Synthetic oligonucleotide
cg

SEQ ID NO: 1515 - DNA, 23 bp, Artificial Sequence
  Description of Artificial Sequence: Synthetic oligonucleotide
cggtgttcgggggtcgtttgtcg

SEQ ID NO: 1516 - DNA, 2 bp, Artificial Sequence
  Description of Artificial Sequence: Synthetic oligonucleotide
cg

SEQ ID NO: 1517 - DNA, 66 bp, Artificial Sequence
  Description of Artificial Sequence: Synthetic oligonucleotide
cggtcgtggcgggttttttggggcggtagttttaggcgcgggcgcgtagtagtttcgaaggcgtcg

SEQ ID NO: 1518 - DNA, 43 bp, Artificial Sequence
  Description of Artificial Sequence: Synthetic oligonucleotide
cgaataaaaagagtttaggtcgcgcgggcgggttgcgcgttcg

SEQ ID NO: 1519 - DNA, 2 bp, Artificial Sequence
  Description of Artificial Sequence: Synthetic oligonucleotide
cg

SEQ ID NO: 1520 - DNA, 62 bp, Artificial Sequence
  Description of Artificial Sequence: Synthetic oligonucleotide
cgtttagatgcggcggcggcgacggttttagttgcgtttcgtggttattttcgtgtagcgcg

SEQ ID NO: 1521 - DNA, 2 bp, Artificial Sequence
  Description of Artificial Sequence: Synthetic oligonucleotide
cg

SEQ ID NO: 1522 - DNA, 138 bp, Artificial Sequence
  Description of Artificial Sequence: Synthetic polynucleotide
cgaaagattcgaaattttaaaagttttattgcgtgtttttgggaggggagggggcgcgttaggaaaggagtggaaaaaagtgggcgaggaggagcgttgaaaattttttgataagtagttttcgtgcgttcgagagcg

SEQ ID NO: 1523 - DNA, 2 bp, Artificial Sequence
  Description of Artificial Sequence: Synthetic oligonucleotide
cg

SEQ ID NO: 1524 - DNA, 2 bp, Artificial Sequence
  Description of Artificial Sequence: Synthetic oligonucleotide
cg

SEQ ID NO: 1525 - DNA, 2 bp, Artificial Sequence
  Description of Artificial Sequence: Synthetic oligonucleotide
cg

SEQ ID NO: 1526 - DNA, 2 bp, Artificial Sequence
  Description of Artificial Sequence: Synthetic oligonucleotide
cg

SEQ ID NO: 1527 - DNA, 187 bp, Artificial Sequence
  Description of Artificial Sequence: Synthetic polynucleotide
cggtagaagtgggaggtatacgaggagttattggaaacggcgtttttgtggaggagtcgggggggatggggagtagagggagggggttttgttgttttagcgtttcgaggtcgtggagcggtagtagttgtagtcggagtagtattagtaatagtaatagtgagcgggacggagttaggatcgttcg

SEQ ID NO: 1528 - DNA, 2 bp, Artificial Sequence
  Description of Artificial Sequence: Synthetic oligonucleotide
cg

SEQ ID NO: 1529 - DNA, 2 bp, Artificial Sequence
  Description of Artificial Sequence: Synthetic oligonucleotide
cg

SEQ ID NO: 1530 - DNA, 110 bp, Artificial Sequence
  Description of Artificial Sequence: Synthetic polynucleotide
cgcggcgtgtagttcggcggatgttgttaggttaggcgatttcgtcgtttttggagcgcgagcgcgttttagtttgtagcgatgattttggaattagattttgatttgcg

SEQ ID NO: 1531 - DNA, 4 bp, Artificial Sequence
  Description of Artificial Sequence: Synthetic oligonucleotide
cgcg

SEQ ID NO: 1532 - DNA, 189 bp, Artificial Sequence
  Description of Artificial Sequence: Synthetic polynucleotide
cgggaggttttgttcgttcggtggttgtcgcggtttttttcgcgttgttttttacgtttggtttattatgtacgaggtaggtaatttgttttttttttcggggatttatttcggagataagaaggtagtttgttttttgtaatggtttttgttggagtgcggcggggtttaggcgcgagcgggggtacg

SEQ ID NO: 1533 - DNA, 42 bp, Artificial Sequence
  Description of Artificial Sequence: Synthetic oligonucleotide
cgttgaaggtgggtggaacgagggcgtttgagtgtattcgcg

SEQ ID NO: 1534 - DNA, 33 bp, Artificial Sequence
  Description of Artificial Sequence: Synthetic oligonucleotide
cgcgcgggggttttaggtattttgcgttttacg

SEQ ID NO: 1535 - DNA, 15 bp, Artificial Sequence
  Description of Artificial Sequence: Synthetic oligonucleotide
cgcgttagtcgaacg

SEQ ID NO: 1536 - DNA, 51 bp, Artificial Sequence
  Description of Artificial Sequence: Synthetic oligonucleotide
cgttgggatagagttgtttgttggagttgtcgtagatcgtcgtggtgggcg

SEQ ID NO: 1537 - DNA, 2 bp, Artificial Sequence
  Description of Artificial Sequence: Synthetic oligonucleotide
cg

SEQ ID NO: 1538 - DNA, 268 bp, Artificial Sequence
  Description of Artificial Sequence: Synthetic polynucleotide
cggagcgcgtagttcgtttttgaataagaagtgagtataatggcgtgtttgtaaaaaaaagttttaagttcgttttttttaaaaaatattttgaatgttgtatgttttatgttttttagcgtttcgcgggagagattcggttatagagtaggaggtgagatttttttttcggtatttttatttttttggtcgtacgtttttttgttttagttttttttgggaggattgtaaatgtttttttttagtaagcggtcgttttttattttcg

SEQ ID NO: 1539 - DNA, 2 bp, Artificial Sequence
  Description of Artificial Sequence: Synthetic oligonucleotide
cg

SEQ ID NO: 1540 - DNA, 33 bp, Artificial Sequence
  Description of Artificial Sequence: Synthetic oligonucleotide
cggagtttttaggagtagttagatcgattatcg

SEQ ID NO: 1541 - DNA, 23 bp, Artificial Sequence
  Description of Artificial Sequence: Synthetic oligonucleotide
cgtttattagttcgagattttcg

SEQ ID NO: 1542 - DNA, 40 bp, Artificial Sequence
  Description of Artificial Sequence: Synthetic oligonucleotide
cgtttcgattcgacgttttttcgttcgattaggtgtttcg

SEQ ID NO: 1543 - DNA, 10 bp, Artificial Sequence
  Description of Artificial Sequence: Synthetic oligonucleotide
cgcggtttcg

SEQ ID NO: 1544 - DNA, 181 bp, Artificial Sequence
  Description of Artificial Sequence: Synthetic polynucleotide
cggttgttgatcgtttttttcgcgttcgttagggtttttgtttcgcgttagttatcgcgcgttttttttttgtttatgtcgtagttttcgtggtttttgttttggattcgggatgttaggttgagatacgttttgtaaatttttggtagaaatgggcgtaagggggtggatttcgttttcg

SEQ ID NO: 1545 - DNA, 195 bp, Artificial Sequence
  Description of Artificial Sequence: Synthetic polynucleotide
cgatttaggacgtcggcgtttgttaggattttttcgtttgtttttcgcgtttcgcgcgcgtttatgttattattacggggagggtgtatgcggtaggtgtttggtcgaggttttcgggagcgagtcgtttttacgtgttttagtttgtttttttttcgaagttagacgttggcgttgtagttttgttgtttgacg

SEQ ID NO: 1546 - DNA, 2 bp, Artificial Sequence
  Description of Artificial Sequence: Synthetic oligonucleotide
cg

SEQ ID NO: 1547 - DNA, 358 bp, Artificial Sequence
  Description of Artificial Sequence: Synthetic polynucleotide
cggcgttcgagtgattttgtttagtttcgttttgcgtttttgtaaattacgttgttgcgttaattataaatttggttaatatgtttttgtaattttattatttaaaaacgtttttaggtatttggtcgttgttagattaggttcgcgggttcggaggaggtttttttatttgttttcgttagtttcggggatcgtgcgcggttttcgtgtggttttcgtttacgaggtttttcgggtaggaatcgtcgcgcgatttttgtttagcggtcgcgttttggttacgggcgatttttgtcgggaattttgttttcggttaagttgcgttttcgtatttcggtggtttttattcgagttcgcg

SEQ ID NO: 1548 - DNA, 13 bp, Artificial Sequence
  Description of Artificial Sequence: Synthetic oligonucleotide
cgtagttgtggcg

SEQ ID NO: 1549 - DNA, 2 bp, Artificial Sequence
  Description of Artificial Sequence: Synthetic oligonucleotide
cg

SEQ ID NO: 1550 - DNA, 2 bp, Artificial Sequence
  Description of Artificial Sequence: Synthetic oligonucleotide
cg

SEQ ID NO: 1551 - DNA, 95 bp, Artificial Sequence
  Description of Artificial Sequence: Synthetic oligonucleotide
cgtgcggggttatttgaaggttggggcgcggaagtttaatttcgtgttgattgggttttaagttttttgcgttttcgtttcgtttcgagtgttcg

SEQ ID NO: 1552 - DNA, 45 bp, Artificial Sequence
  Description of Artificial Sequence: Synthetic oligonucleotide
cggtagtaggttggagcgtatcgtgcgcgttttgttttttcggcg

SEQ ID NO: 1553 - DNA, 104 bp, Artificial Sequence
  Description of Artificial Sequence: Synthetic polynucleotide
cggttgagtcggagtttacgcggcgcgcgtttttcgcgaggaatttttcggtttgtaggttgtttgttattttcgtttttcgacgcgtttttttttggttcgcg

SEQ ID NO: 1554 - DNA, 87 bp, Artificial Sequence
  Description of Artificial Sequence: Synthetic oligonucleotide
cgttttcgttttcgttgatattttgtaaagtcgcggcggtagcggcggggattacgttgcggtgtattatttttcgttattttttcg

SEQ ID NO: 1555 - DNA, 62 bp, Artificial Sequence
  Description of Artificial Sequence: Synthetic oligonucleotide
cgatagtttgcgagtttcggttgtaagtggtttttttttttcgcggttgttgtttagtgtcg

SEQ ID NO: 1556 - DNA, 2 bp, Artificial Sequence
  Description of Artificial Sequence: Synthetic oligonucleotide
cg

SEQ ID NO: 1557 - DNA, 2 bp, Artificial Sequence
  Description of Artificial Sequence: Synthetic oligonucleotide
cg

SEQ ID NO: 1558 - DNA, 2 bp, Artificial Sequence
  Description of Artificial Sequence: Synthetic oligonucleotide
cg

SEQ ID NO: 1559 - DNA, 2 bp, Artificial Sequence
  Description of Artificial Sequence: Synthetic oligonucleotide
cg

SEQ ID NO: 1560 - DNA, 2 bp, Artificial Sequence
  Description of Artificial Sequence: Synthetic oligonucleotide
cg

SEQ ID NO: 1561 - DNA, 2 bp, Artificial Sequence
  Description of Artificial Sequence: Synthetic oligonucleotide
cg

SEQ ID NO: 1562 - DNA, 2 bp, Artificial Sequence
  Description of Artificial Sequence: Synthetic oligonucleotide
cg

SEQ ID NO: 1563 - DNA, 2 bp, Artificial Sequence
  Description of Artificial Sequence: Synthetic oligonucleotide
cg

SEQ ID NO: 1564 - DNA, 145 bp, Artificial Sequence
  Description of Artificial Sequence: Synthetic polynucleotide
cgtcggtttgttggcgatttggcgtatttgttcgcgcgttttggttttagttgtcgtaggttttttttgtatttatttttagtttttaaagttagtgtagttagtatcgtttatttggagttttaatttttttttgcgattttcg

SEQ ID NO: 1565 - DNA, 2 bp, Artificial Sequence
  Description of Artificial Sequence: Synthetic oligonucleotide
cg

SEQ ID NO: 1566 - DNA, 19 bp, Artificial Sequence
  Description of Artificial Sequence: Synthetic oligonucleotide
cgtttatcgttaggagtcg

SEQ ID NO: 1567 - DNA, 35 bp, Artificial Sequence
  Description of Artificial Sequence: Synthetic oligonucleotide
cggcggcggcggcggttttattagcggagttttcg

SEQ ID NO: 1568 - DNA, 2 bp, Artificial Sequence
  Description of Artificial Sequence: Synthetic oligonucleotide
cg

SEQ ID NO: 1569 - DNA, 2 bp, Artificial Sequence
  Description of Artificial Sequence: Synthetic oligonucleotide
cg

SEQ ID NO: 1570 - DNA, 36 bp, Artificial Sequence
  Description of Artificial Sequence: Synthetic oligonucleotide
cgagttggcgttggttcgttggttgtaggagagtcg

SEQ ID NO: 1571 - DNA, 2 bp, Artificial Sequence
  Description of Artificial Sequence: Synthetic oligonucleotide
cg

SEQ ID NO: 1572 - DNA, 42 bp, Artificial Sequence
  Description of Artificial Sequence: Synthetic oligonucleotide
cggttgagttttcgtttgtttaattttatttgttattgtacg

SEQ ID NO: 1573 - DNA, 2 bp, Artificial Sequence
  Description of Artificial Sequence: Synthetic oligonucleotide
cg

SEQ ID NO: 1574 - DNA, 2 bp, Artificial Sequence
  Description of Artificial Sequence: Synthetic oligonucleotide
cg

SEQ ID NO: 1575 - DNA, 18 bp, Artificial Sequence
  Description of Artificial Sequence: Synthetic oligonucleotide
cgcgtagcgttcgcgtcg

SEQ ID NO: 1576 - DNA, 2 bp, Artificial Sequence
  Description of Artificial Sequence: Synthetic oligonucleotide
cg

SEQ ID NO: 1577 - DNA, 2 bp, Artificial Sequence
  Description of Artificial Sequence: Synthetic oligonucleotide
cg

SEQ ID NO: 1578 - DNA, 2 bp, Artificial Sequence
  Description of Artificial Sequence: Synthetic oligonucleotide
cg

SEQ ID NO: 1579 - DNA, 118 bp, Artificial Sequence
  Description of Artificial Sequence: Synthetic polynucleotide
cgtgttagatttcggtttcgcgatttaggtgagtgtcgttatcgtcgtttggagggatttaagggttttgggttgggatttggggtcgtatcggggtttgaggtagaatagcgacgcg

SEQ ID NO: 1580 - DNA, 22 bp, Artificial Sequence
  Description of Artificial Sequence: Synthetic oligonucleotide
cgaatcgcgggcggcgcggacg

SEQ ID NO: 1581 - DNA, 2 bp, Artificial Sequence
  Description of Artificial Sequence: Synthetic oligonucleotide
cg

SEQ ID NO: 1582 - DNA, 2 bp, Artificial Sequence
  Description of Artificial Sequence: Synthetic oligonucleotide
cg

SEQ ID NO: 1583 - DNA, 2 bp, Artificial Sequence
  Description of Artificial Sequence: Synthetic oligonucleotide
cg

SEQ ID NO: 1584 - DNA, 2 bp, Artificial Sequence
  Description of Artificial Sequence: Synthetic oligonucleotide
cg

SEQ ID NO: 1585 - DNA, 31 bp, Artificial Sequence
  Description of Artificial Sequence: Synthetic oligonucleotide
cgataagagttcggtgttgagatgtgttacg

SEQ ID NO: 1586 - DNA, 2 bp, Artificial Sequence
  Description of Artificial Sequence: Synthetic oligonucleotide
cg

SEQ ID NO: 1587 - DNA, 2 bp, Artificial Sequence
  Description of Artificial Sequence: Synthetic oligonucleotide
cg

SEQ ID NO: 1588 - DNA, 2 bp, Artificial Sequence
  Description of Artificial Sequence: Synthetic oligonucleotide
cg

SEQ ID NO: 1589 - DNA, 2 bp, Artificial Sequence
  Description of Artificial Sequence: Synthetic oligonucleotide
cg

SEQ ID NO: 1590 - DNA, 2 bp, Artificial Sequence
  Description of Artificial Sequence: Synthetic oligonucleotide
cg

SEQ ID NO: 1591 - DNA, 2 bp, Artificial Sequence
  Description of Artificial Sequence: Synthetic oligonucleotide
cg

SEQ ID NO: 1592 - DNA, 2 bp, Artificial Sequence
  Description of Artificial Sequence: Synthetic oligonucleotide
cg

SEQ ID NO: 1593 - DNA, 2 bp, Artificial Sequence
  Description of Artificial Sequence: Synthetic oligonucleotide
cg

SEQ ID NO: 1594 - DNA, 2 bp, Artificial Sequence
  Description of Artificial Sequence: Synthetic oligonucleotide
cg

SEQ ID NO: 1595 - DNA, 69 bp, Artificial Sequence
  Description of Artificial Sequence: Synthetic oligonucleotide
cgttaggggcggttagcggtcgtttggttggcgtgtcggcggcgttcggggagggcgggtcggggggcg

SEQ ID NO: 1596 - DNA, 415 bp, Artificial Sequence
  Description of Artificial Sequence: Synthetic polynucleotide
cgtttttttttttggttcgattggttttggttttttttacgtttttagtttttaaattggcgttcgttttatggttcgtgtaggacgttaaaagtacggtaaattttagggcgatttttagtagacgttttcgacgtatgatgtcgagtcgttatcggttttcgtcgttttttgtcgcgttcggggttcggtttgcggtcgtcgttgcgttttgaagcgtatcgcgtcgtcggggtttcgttatttcgtcgttcgtttttcgggtcgggtttttttcgttttttttaggcgttgtttttattttaggcggtttttgttagttgtaatatagagataaattttcgaggcggggagatttttagggtatcgggatgttgaagtttcgcggtttttatttttaagtttaattcgtgcg

SEQ ID NO: 1597 - DNA, 2 bp, Artificial Sequence
  Description of Artificial Sequence: Synthetic oligonucleotide
cg

SEQ ID NO: 1598 - DNA, 2 bp, Artificial Sequence
  Description of Artificial Sequence: Synthetic oligonucleotide
cg

SEQ ID NO: 1599 - DNA, 2 bp, Artificial Sequence
  Description of Artificial Sequence: Synthetic oligonucleotide
cg

SEQ ID NO: 1600 - DNA, 2 bp, Artificial Sequence
  Description of Artificial Sequence: Synthetic oligonucleotide
cg

SEQ ID NO: 1601 - DNA, 2 bp, Artificial Sequence
  Description of Artificial Sequence: Synthetic oligonucleotide
cg

SEQ ID NO: 1602 - DNA, 62 bp, Artificial Sequence
  Description of Artificial Sequence: Synthetic oligonucleotide
cgcgttcgtcgttagttcgtatagcgtttcgtatattttcgtacgcgtttgaaatgcgtacg

SEQ ID NO: 1603 - DNA, 2 bp, Artificial Sequence
  Description of Artificial Sequence: Synthetic oligonucleotide
cg

SEQ ID NO: 1604 - DNA, 2 bp, Artificial Sequence
  Description of Artificial Sequence: Synthetic oligonucleotide
cg

SEQ ID NO: 1605 - DNA, 2 bp, Artificial Sequence
  Description of Artificial Sequence: Synthetic oligonucleotide
cg

SEQ ID NO: 1606 - DNA, 2 bp, Artificial Sequence
  Description of Artificial Sequence: Synthetic oligonucleotide
cg

SEQ ID NO: 1607 - DNA, 20 bp, Artificial Sequence
  Description of Artificial Sequence: Synthetic oligonucleotide
cgtaaacgtaaaagttttcg

SEQ ID NO: 1608 - DNA, 69 bp, Artificial Sequence
  Description of Artificial Sequence: Synthetic oligonucleotide
cgttttttggggtttttggttgtcgagtttcgttaaggtaaagacgttagtaagcgaggaagcgtagcg

SEQ ID NO: 1609 - DNA, 2 bp, Artificial Sequence
  Description of Artificial Sequence: Synthetic oligonucleotide
cg

SEQ ID NO: 1610 - DNA, 318 bp, Artificial Sequence
  Description of Artificial Sequence: Synthetic polynucleotide
cgtttcgcggtagtgttagttttttggggattaggaagggcgatttttgtttgggagttagtgtttgggtcgtcgggttcgggtaagcgttgggggtttggttcgagaagatgcggataggtggtttagggcgtcgcggattttcgttttttgcgggtatcgggagtttagggtcgaggcgcgtcgtttcgaggggtttttttttttaataatgcgttcggaatggagttcgcgttttgatagcgcgggttagttcgaaatcgtttagaattcgtttcgatgagtgggtgagtcgttttgggagtttgtcgcgtttcg

SEQ ID NO: 1611 - DNA, 27 bp, Artificial Sequence
  Description of Artificial Sequence: Synthetic oligonucleotide
cgtggtggtttttcgagcggaggcgcg

SEQ ID NO: 1612 - DNA, 2 bp, Artificial Sequence
  Description of Artificial Sequence: Synthetic oligonucleotide
cg

SEQ ID NO: 1613 - DNA, 13 bp, Artificial Sequence
  Description of Artificial Sequence: Synthetic oligonucleotide
cgagtttttcgcg

SEQ ID NO: 1614 - DNA, 189 bp, Artificial Sequence
  Description of Artificial Sequence: Synthetic polynucleotide
cggtgacgatgtgtagagttttttggtatagattgtttatttcgttttttttgtggaaatttatcgtttggtttttttttcgtttttttttttttttttagttagtcgttttttttttttttcgtatttttaatttttttggcgttttaagttatagttcgttcgcggtgattttggttggagattgcg

SEQ ID NO: 1615 - DNA, 2 bp, Artificial Sequence
  Description of Artificial Sequence: Synthetic oligonucleotide
cg

SEQ ID NO: 1616 - DNA, 2 bp, Artificial Sequence
  Description of Artificial Sequence: Synthetic oligonucleotide
cg

SEQ ID NO: 1617 - DNA, 13 bp, Artificial Sequence
  Description of Artificial Sequence: Synthetic oligonucleotide
cgggggttgagcg

SEQ ID NO: 1618 - DNA, 51 bp, Artificial Sequence
  Description of Artificial Sequence: Synthetic oligonucleotide
cggcgtgtgtcgtgcgtggggtggggtgcgggttgggcggtttcgttttcg

SEQ ID NO: 1619 - DNA, 289 bp, Artificial Sequence
  Description of Artificial Sequence: Synthetic polynucleotide
cgttcgttcgtatttcgtttttttcggttttttttttaaattttaaacgtatcgtcgtgttttaaagaaggtgtttacgtcgtttttagatttcggagcgttttttttttattttcgggattttttaggtcgtttatttttttcgtttttcgtttagatttgagagggatcgaaaatatattttcgattcgggtagttagggtcgaaattgttaagaggagaaaaggtaaagcggaaggagggtggttataaatagatttttttgtttttttttaaaaggatattgtcg

SEQ ID NO: 1620 - DNA, 2 bp, Artificial Sequence
  Description of Artificial Sequence: Synthetic oligonucleotide
cg

SEQ ID NO: 1621 - DNA, 165 bp, Artificial Sequence
  Description of Artificial Sequence: Synthetic polynucleotide
cggatttgttttcgtagtcgttgcggatttttcggtcgttatggcgattgtgaaatgtggggtggggcgtatgcgttggaagttattcgcgcgggtagtttttgagtgtttttttacgtgttttttagcgcgagtagtattttcgtttttgcgttttttagagcg

SEQ ID NO: 1622 - DNA, 21 bp, Artificial Sequence
  Description of Artificial Sequence: Synthetic oligonucleotide
cgtcgtttttgtattatttcg

SEQ ID NO: 1623 - DNA, 2 bp, Artificial Sequence
  Description of Artificial Sequence: Synthetic oligonucleotide
cg

SEQ ID NO: 1624 - DNA, 2 bp, Artificial Sequence
  Description of Artificial Sequence: Synthetic oligonucleotide
cg

SEQ ID NO: 1625 - DNA, 2 bp, Artificial Sequence
  Description of Artificial Sequence: Synthetic oligonucleotide
cg

SEQ ID NO: 1626 - DNA, 159 bp, Artificial Sequence
  Description of Artificial Sequence: Synthetic polynucleotide
cggttgcgttggtcgtattgtttttttataatatgagtagcgtcggcggcgatcgtttgggtcgcggtaagtcggttcgttgcggttttatttttttcgtgggtcgcgtgtatcgttggatggtggatagtcgcgtggcgttgcgtatttacgagtacg

SEQ ID NO: 1627 - DNA, 2 bp, Artificial Sequence
  Description of Artificial Sequence: Synthetic oligonucleotide
cg

SEQ ID NO: 1628 - DNA, 129 bp, Artificial Sequence
  Description of Artificial Sequence: Synthetic polynucleotide
cggggggcggaatttagagaggtaaagtgattcgtttttaaatcgtaatattaggaggatagtagggttagatggaatttttcggtttatagttttcgatttcgggtaagtgttttattcgggcgtacg

SEQ ID NO: 1629 - DNA, 2 bp, Artificial Sequence
  Description of Artificial Sequence: Synthetic oligonucleotide
cg

SEQ ID NO: 1630 - DNA, 120 bp, Artificial Sequence
  Description of Artificial Sequence: Synthetic polynucleotide
cgttggagatggcgagtttcgagattttttttattttttgtttttagagtaattttatggtattaaaaaaaaaaaaaaaaaaaaaaaaaaaaaaaaaaaaaaaaaaagaaggagaaggcg

SEQ ID NO: 1631 - DNA, 2 bp, Artificial Sequence
  Description of Artificial Sequence: Synthetic oligonucleotide
cg

SEQ ID NO: 1632 - DNA, 171 bp, Artificial Sequence
  Description of Artificial Sequence: Synthetic polynucleotide
cgcggacgttgacgattttttttacgttcgataagttttcgttttcgtcgtatcgttggcggttaatcgggcgttgcgaggatttaaattagagagttcgggatattattgtgggggttggaggtcgttttttaatttgggtttagtattaataggtgtagtagtcgagcg

SEQ ID NO: 1633 - DNA, 2 bp, Artificial Sequence
  Description of Artificial Sequence: Synthetic oligonucleotide
cg

SEQ ID NO: 1634 - DNA, 2 bp, Artificial Sequence
  Description of Artificial Sequence: Synthetic oligonucleotide
cg

SEQ ID NO: 1635 - DNA, 2 bp, Artificial Sequence
  Description of Artificial Sequence: Synthetic oligonucleotide
cg

SEQ ID NO: 1636 - DNA, 64 bp, Artificial Sequence
  Description of Artificial Sequence: Synthetic oligonucleotide
cggtaggtgagcggcgcggttgtaggtgagtagtagtttcggttcgcgcgtttagtttttttcg

SEQ ID NO: 1637 - DNA, 2 bp, Artificial Sequence
  Description of Artificial Sequence: Synthetic oligonucleotide
cg

SEQ ID NO: 1638 - DNA, 2 bp, Artificial Sequence
  Description of Artificial Sequence: Synthetic oligonucleotide
cg

SEQ ID NO: 1639 - DNA, 2 bp, Artificial Sequence
  Description of Artificial Sequence: Synthetic oligonucleotide
cg

SEQ ID NO: 1640 - DNA, 2 bp, Artificial Sequence
  Description of Artificial Sequence: Synthetic oligonucleotide
cg

SEQ ID NO: 1641 - DNA, 16 bp, Artificial Sequence
  Description of Artificial Sequence: Synthetic oligonucleotide
cgtttcgtagggttcg

SEQ ID NO: 1642 - DNA, 2 bp, Artificial Sequence
  Description of Artificial Sequence: Synthetic oligonucleotide
cg

SEQ ID NO: 1643 - DNA, 2 bp, Artificial Sequence
  Description of Artificial Sequence: Synthetic oligonucleotide
cg

SEQ ID NO: 1644 - DNA, 2 bp, Artificial Sequence
  Description of Artificial Sequence: Synthetic oligonucleotide
cg

SEQ ID NO: 1645 - DNA, 18 bp, Artificial Sequence
  Description of Artificial Sequence: Synthetic oligonucleotide
cgtattttttcggtcgcg

SEQ ID NO: 1646 - DNA, 118 bp, Artificial Sequence
  Description of Artificial Sequence: Synthetic polynucleotide
cgggcggatgggggttatcgaggcggttcgtttttaggcgtatatttcgtatatttttttgttaagtgaaggggttaaaatgtatagatgggggagtttatttaggaatagaggcgcg

SEQ ID NO: 1647 - DNA, 2 bp, Artificial Sequence
  Description of Artificial Sequence: Synthetic oligonucleotide
cg

SEQ ID NO: 1648 - DNA, 2 bp, Artificial Sequence
  Description of Artificial Sequence: Synthetic oligonucleotide
cg

SEQ ID NO: 1649 - DNA, 2 bp, Artificial Sequence
  Description of Artificial Sequence: Synthetic oligonucleotide
cg

SEQ ID NO: 1650 - DNA, 2 bp, Artificial Sequence
  Description of Artificial Sequence: Synthetic oligonucleotide
cg

SEQ ID NO: 1651 - DNA, 2 bp, Artificial Sequence
  Description of Artificial Sequence: Synthetic oligonucleotide
cg

SEQ ID NO: 1652 - DNA, 22 bp, Artificial Sequence
  Description of Artificial Sequence: Synthetic oligonucleotide
cgcgtcgttttagaggagttcg

SEQ ID NO: 1653 - DNA, 112 bp, Artificial Sequence
  Description of Artificial Sequence: Synthetic polynucleotide
cgggagcgtacgagtgtgtgtgtgtgtgtgtgtgttcgcggtgtgttcgcggttcggtgtatacgcgcgcgggttgtaaagttaggagttgcgggagcgtttttttgtttcg

SEQ ID NO: 1654 - DNA, 109 bp, Artificial Sequence
  Description of Artificial Sequence: Synthetic polynucleotide
cgttttgtttgggttgggtttatttacgttttgggtggggtttaggaattgcgtgcgggcgtagcgggtgagtatgttgatgatgattatttggttttatttttttacg

SEQ ID NO: 1655 - DNA, 2 bp, Artificial Sequence
  Description of Artificial Sequence: Synthetic oligonucleotide
cg

SEQ ID NO: 1656 - DNA, 2 bp, Artificial Sequence
  Description of Artificial Sequence: Synthetic oligonucleotide
cg

SEQ ID NO: 1657 - DNA, 2 bp, Artificial Sequence
  Description of Artificial Sequence: Synthetic oligonucleotide
cg

SEQ ID NO: 1658 - DNA, 431 bp, Artificial Sequence
  Description of Artificial Sequence: Synthetic polynucleotide
cgagggggttttgggatcgagcggtttcgtagcggcgatagaaatatatattttacgaaaaagaaaaaaaaaaaaacgagtcgcgcgaattcgttaagttagatgtgcgcggtttgaagcggaggaggttttgacgttagttttatttcgcgtagttcggtttggtcgtagattcgtcggttattcgtcggcggtttaggtcgggaggggttaggatagtttcggtcgcgcggtggacggaggggttattttttcgggcgttagtaaataaattttattcgagttaatatcgtttagcgaacggtgtttttttttagttattcgagaacgagaggtatttttaattagaaattaattaatgagtagttgttttttttcgttttattgtaattattcgttttaattataaatgagatttatgaaaggatacg

SEQ ID NO: 1659 - DNA, 2 bp, Artificial Sequence
  Description of Artificial Sequence: Synthetic oligonucleotide
cg

SEQ ID NO: 1660 - DNA, 40 bp, Artificial Sequence
  Description of Artificial Sequence: Synthetic oligonucleotide
cgtcgcgtttcgttgtagtttcgttggagagatggggacg

SEQ ID NO: 1661 - DNA, 2 bp, Artificial Sequence
  Description of Artificial Sequence: Synthetic oligonucleotide
cg

SEQ ID NO: 1662 - DNA, 22 bp, Artificial Sequence
  Description of Artificial Sequence: Synthetic oligonucleotide
cgttagtaggtttagggttacg

SEQ ID NO: 1663 - DNA, 2 bp, Artificial Sequence
  Description of Artificial Sequence: Synthetic oligonucleotide
cg

SEQ ID NO: 1664 - DNA, 47 bp, Artificial Sequence
  Description of Artificial Sequence: Synthetic oligonucleotide
cgggtattttgtattgtacgtagtatatgttgtggttttttagttcg

SEQ ID NO: 1665 - DNA, 24 bp, Artificial Sequence
  Description of Artificial Sequence: Synthetic oligonucleotide
cgtcgttgggggatttttggtacg

SEQ ID NO: 1666 - DNA, 2 bp, Artificial Sequence
  Description of Artificial Sequence: Synthetic oligonucleotide
cg

SEQ ID NO: 1667 - DNA, 45 bp, Artificial Sequence
  Description of Artificial Sequence: Synthetic oligonucleotide
cgggattttaggtttatttagtaagttaattggttgaggttttcg

SEQ ID NO: 1668 - DNA, 2 bp, Artificial Sequence
  Description of Artificial Sequence: Synthetic oligonucleotide
cg

SEQ ID NO: 1669 - DNA, 258 bp, Artificial Sequence
  Description of Artificial Sequence: Synthetic polynucleotide
cgaagcggcgggagtcggtgtagttttaatttttattgcgtgttttaggtcgttaattagttttgttcgcgtgtcgttggttcggaggttgtcgcgttagtttttgcgtgcgtttgagcgcgttggagtatttgcgaggttagggttgtcgacggcgagaggatattttgaggaatacggtgttttagtttcgttttcgtttttcgttcgagttggaggttggggcgcgttgagtcgtagcgtttggataagtgcgcg

SEQ ID NO: 1670 - DNA, 45 bp, Artificial Sequence
  Description of Artificial Sequence: Synthetic oligonucleotide
cgttttggcggtttcgagggatttgggttcgggtttgcggtcgcg

SEQ ID NO: 1671 - DNA, 7 bp, Artificial Sequence
  Description of Artificial Sequence: Synthetic oligonucleotide
cgcggcg

SEQ ID NO: 1672 - DNA, 4 bp, Artificial Sequence
  Description of Artificial Sequence: Synthetic oligonucleotide
cgcg

SEQ ID NO: 1673 - DNA, 67 bp, Artificial Sequence
  Description of Artificial Sequence: Synthetic oligonucleotide
cggggcgttaatagtttaggatttgggttgtaggttggtttttgtattaattagcggggcggtttcg

SEQ ID NO: 1674 - DNA, 43 bp, Artificial Sequence
  Description of Artificial Sequence: Synthetic oligonucleotide
cggttgattcgtagcggtagcggtagtagcgaggattcgagcg

SEQ ID NO: 1675 - DNA, 2 bp, Artificial Sequence
  Description of Artificial Sequence: Synthetic oligonucleotide
cg

SEQ ID NO: 1676 - DNA, 2 bp, Artificial Sequence
  Description of Artificial Sequence: Synthetic oligonucleotide
cg

SEQ ID NO: 1677 - DNA, 113 bp, Artificial Sequence
  Description of Artificial Sequence: Synthetic polynucleotide
cgtgtgtttagttgaatttagtatatttttttcgtatttttcgtttttttttttttttttttgaatttgtttttttgttttgcgggtttttaatttttttcgaatttcgggcg

SEQ ID NO: 1678 - DNA, 4 bp, Artificial Sequence
  Description of Artificial Sequence: Synthetic oligonucleotide
cgcg

SEQ ID NO: 1679 - DNA, 2 bp, Artificial Sequence
  Description of Artificial Sequence: Synthetic oligonucleotide
cg

SEQ ID NO: 1680 - DNA, 84 bp, Artificial Sequence
  Description of Artificial Sequence: Synthetic oligonucleotide
cgttgcgcgtcgttttcgcggagtcgagcggcggtggttgcggaagcgattggggttgcgcggatattagcgttttagagttcg

SEQ ID NO: 1681 - DNA, 2 bp, Artificial Sequence
  Description of Artificial Sequence: Synthetic oligonucleotide
cg

SEQ ID NO: 1682 - DNA, 48 bp, Artificial Sequence
  Description of Artificial Sequence: Synthetic oligonucleotide
cgcgttttattttgtagcggtggttttggaattagattttgatttgcg

SEQ ID NO: 1683 - DNA, 228 bp, Artificial Sequence
  Description of Artificial Sequence: Synthetic polynucleotide
cgggtcgcgcgtttatttgcgttttcgtcgtcgaaggagtttatgtacgggaagtagatggcgagcgtttcgaaggaggcggatagattgaggcggttttgcgagcgttttatgttcgcgtcggcgtcgggcgtttcggtcgcggcggcggcggcggcggcgggcggtttgggtagtttggtcgttttatttttgacgcggagtacggcgcgcggcgtggtggcggcg

SEQ ID NO: 1684 - DNA, 47 bp, Artificial Sequence
  Description of Artificial Sequence: Synthetic oligonucleotide
cgtattttggtcgtaataagcgcgttttacgtcgttacgtattagcg

SEQ ID NO: 1685 - DNA, 185 bp, Artificial Sequence
  Description of Artificial Sequence: Synthetic polynucleotide
cgcgtagggggcgggttttatttttttttcgttttcgtttcggttttaagtcgcggaggcgttcggtgggatttcgttgttgtttaattaggggggatcgggtgagtttttttttttggagtcgggttttattagcgtcgtaggtttataggtcgggggtgggggttttggatcgaggggcggcg

SEQ ID NO: 1686 - DNA, 216 bp, Artificial Sequence
  Description of Artificial Sequence: Synthetic polynucleotide
cgggggcgttaatttcgggagtaggaggtcgggttttagtcgtcgggttttgcgcgtttgttttttgcggcgcggtcggtatttgtagttggggtggtcgcgtaagtgttgtacgcgtagtcgttcggttttttttacgaagggtcgttttttcgtcgcgtttagttttttttacgttttgtttgcgggtcgtgggcgttagtgagtggaacgtcg

SEQ ID NO: 1687 - DNA, 344 bp, Artificial Sequence
  Description of Artificial Sequence: Synthetic polynucleotide
cgtggtttcgtgtttcggggcgcgttttagtttcggtattattagtttttcgtttttttcggaggggcgttcgagtgcgttcgatacggttagtagcgtcgcggcgagtagtagtagcgtgggtattggtttaaagtttcgagatttcggagttcgtttcgcgttttttatgtcgttgtttagtttgcgtttttcgaatttttcgggtatagttcgttgtattggagttttaggagatatcgttcgtagtagcgtacggagcgagggatttttagttcgggtcgggagagtaaagtttcgttggtttgttttggattgttaaaattaataatttttattattcg

SEQ ID NO: 1688 - DNA, 28 bp, Artificial Sequence
  Description of Artificial Sequence: Synthetic oligonucleotide
cgttttgtttggtagttaggtcgagacg

SEQ ID NO: 1689 - DNA, 124 bp, Artificial Sequence
  Description of Artificial Sequence: Synthetic polynucleotide
cgtggggcgttggatttatcgagaggttagcgtcgtcgtcgggggagggcgtgtttcgtacgtgtgtgttcgcgcgtgttcgcgttcgcgtgtgttagcgcgcgtgttttggtcgtgcgcgtcg

SEQ ID NO: 1690 - DNA, 80 bp, Artificial Sequence
  Description of Artificial Sequence: Synthetic oligonucleotide
cgttcgttagggttacgaagagcgtaacgaacgttagtagtacggcgtttacggtgagcgttcgcgtcgtttgtatttcg

SEQ ID NO: 1691 - DNA, 62 bp, Artificial Sequence
  Description of Artificial Sequence: Synthetic oligonucleotide
cggataggtttcgtagtgagtaggtaagggtcgtttcgtcgcggttgtttttttacgtttcg

SEQ ID NO: 1692 - DNA, 165 bp, Artificial Sequence
  Description of Artificial Sequence: Synthetic polynucleotide
cgatcgtatgcgtcgatttgtcgttgggcgttcgtttttttttgttggggttgggcgcggtttcggagtttggcggcggtggtgagggcgtacggttagttgtagcggcgttgtgtttgtcgtggatttaggatattttaggtttggtggcggggttaggtggcg

SEQ ID NO: 1693 - DNA, 43 bp, Artificial Sequence
  Description of Artificial Sequence: Synthetic oligonucleotide
cgtttttgtgtttttggtggtttcggcgttttttcggagcgcg

SEQ ID NO: 1694 - DNA, 86 bp, Artificial Sequence
  Description of Artificial Sequence: Synthetic oligonucleotide
cgtcgtcgttttcgtcgggagttaagttcgtcgggtcggttcggttttaggtgggtagttcggtttgtagttggttggaggtggcg

SEQ ID NO: 1695 - DNA, 23 bp, Artificial Sequence
  Description of Artificial Sequence: Synthetic oligonucleotide
cgagttcgtgggataagggggcg

SEQ ID NO: 1696 - DNA, 2 bp, Artificial Sequence
  Description of Artificial Sequence: Synthetic oligonucleotide
cg

SEQ ID NO: 1697 - DNA, 99 bp, Artificial Sequence
  Description of Artificial Sequence: Synthetic oligonucleotide
cgcggttatgtaattggtggatttttttaaatcgttttggaggggggagcgcggcgttgggggcgggagagcgtttttggttgtgagttgtttttgtcg

SEQ ID NO: 1698 - DNA, 73 bp, Artificial Sequence
  Description of Artificial Sequence: Synthetic oligonucleotide
cgtggaattcgtgagttttacgtaacgtttttttgtcgtttagggtgggtttttagaagtatagaaatggtcg

SEQ ID NO: 1699 - DNA, 2 bp, Artificial Sequence
  Description of Artificial Sequence: Synthetic oligonucleotide
cg

SEQ ID NO: 1700 - DNA, 52 bp, Artificial Sequence
  Description of Artificial Sequence: Synthetic oligonucleotide
cggggcgggtagggatcgagttaggagagagcgggcgggggttttgggagcg

SEQ ID NO: 1701 - DNA, 50 bp, Artificial Sequence
  Description of Artificial Sequence: Synthetic oligonucleotide
cgcgagtaggagggcgtattttatggttaggtgcggacgcggcggttgcg

SEQ ID NO: 1702 - DNA, 50 bp, Artificial Sequence
  Description of Artificial Sequence: Synthetic oligonucleotide
cgggtcggggtattataggcgcgggaatttacgtgtggattttgcgttcg

SEQ ID NO: 1703 - DNA, 2 bp, Artificial Sequence
  Description of Artificial Sequence: Synthetic oligonucleotide
cg

SEQ ID NO: 1704 - DNA, 2 bp, Artificial Sequence
  Description of Artificial Sequence: Synthetic oligonucleotide
cg

SEQ ID NO: 1705 - DNA, 52 bp, Artificial Sequence
  Description of Artificial Sequence: Synthetic oligonucleotide
cggggtagcgtaggagtaggtaggggttcgcggttcgcgtgggttttaggcg

SEQ ID NO: 1706 - DNA, 2 bp, Artificial Sequence
  Description of Artificial Sequence: Synthetic oligonucleotide
cg

SEQ ID NO: 1707 - DNA, 2 bp, Artificial Sequence
  Description of Artificial Sequence: Synthetic oligonucleotide
cg

SEQ ID NO: 1708 - DNA, 2 bp, Artificial Sequence
  Description of Artificial Sequence: Synthetic oligonucleotide
cg

SEQ ID NO: 1709 - DNA, 138 bp, Artificial Sequence
  Description of Artificial Sequence: Synthetic polynucleotide
cgagtggtagtagtaggagcggggtgacgaataagattacgaaggatttgaatttggagatatagtttagcgtcgaggttatcgcgcgggagggagattggcgggcgagacgagtgaggggtagttagaggcgtcgcg

SEQ ID NO: 1710 - DNA, 2 bp, Artificial Sequence
  Description of Artificial Sequence: Synthetic oligonucleotide
cg

SEQ ID NO: 1711 - DNA, 2 bp, Artificial Sequence
  Description of Artificial Sequence: Synthetic oligonucleotide
cg

SEQ ID NO: 1712 - DNA, 2 bp, Artificial Sequence
  Description of Artificial Sequence: Synthetic oligonucleotide
cg

SEQ ID NO: 1713 - DNA, 1017 bp, Artificial Sequence
  Description of Artificial Sequence: Synthetic polynucleotide
ygtttatttgagttttaaaagttgttgaatttatatggttaygtttyggggagyggggttttagatttggttygtttaggttatttgygyggygttygygttygttygttttygtttygyggygtyggttttyggttttyggttygtygtttttygtygttygtyggtygyggggygtatagygagttagagygyggtygygyggggttttatgtyggtyggygygtygtygtygttggggygtatggtttaggttgggyggttygygggggygtatatttttyggtyggggygyggggttygyggtttttttygtyggyggtatagygaaggyggtagygaggyggggygtgtttyggygttgtygyggygtagtaaagggttggggagtygyggtttygtttttyggggyggygaggagggaggtyggyggygttgtygtttayggtgygtgtttttyggygygyggtttttgtttttagtyggagtttygygtygatggggyggygttgtttagggtttggggtgaygygaygyggayggaygygagtttttttygygttgtygggtyggggggttttgttagaggtttygtygtygatyggygttatttaagttgttygggggtttygtttgagygttygttttgtagayggtygyggttyggagattggtaggaggygggtaygagaggygygyggggygagggygtygtggagygyggggygtggggaygygyggyggyggygtygygyggaggaggygygyggggatttyggggtttygtygttygygtttatygygttygtygtagagtygttygygttgtttagtygttttttttttygygtttgttttttygygygttygttttygtttttyggagtyggttttaatttygttygttyggttyggtttaygttattygtttttttygtttttygaaygggagttygagtttttggtttggtttyggtttttgttygtygttttattttgygggggtyggggtygtyg

SEQ ID NO: 1714 - DNA, 166 bp, Artificial Sequence
  Description of Artificial Sequence: Synthetic polynucleotide
ygygygttgagggtgyggtgagttgagtgyggggttaagtatgttttggygtygatttygtttaggggtttaggatttggygtttaaggggttttttggygayggagattttygaygtagtagygattygyggttgtttaagttgatttygttygygtttygagyg

SEQ ID NO: 1715 - DNA, 2 bp, Artificial Sequence
  Description of Artificial Sequence: Synthetic oligonucleotide
yg

SEQ ID NO: 1716 - DNA, 2 bp, Artificial Sequence
  Description of Artificial Sequence: Synthetic oligonucleotide
yg

SEQ ID NO: 1717 - DNA, 2 bp, Artificial Sequence
  Description of Artificial Sequence: Synthetic oligonucleotide
yg

SEQ ID NO: 1718 - DNA, 2 bp, Artificial Sequence
  Description of Artificial Sequence: Synthetic oligonucleotide
yg

SEQ ID NO: 1719 - DNA, 2 bp, Artificial Sequence
  Description of Artificial Sequence: Synthetic oligonucleotide
yg

SEQ ID NO: 1720 - DNA, 2 bp, Artificial Sequence
  Description of Artificial Sequence: Synthetic oligonucleotide
yg

SEQ ID NO: 1721 - DNA, 14 bp, Artificial Sequence
  Description of Artificial Sequence: Synthetic oligonucleotide
ygygttgagaygyg

SEQ ID NO: 1722 - DNA, 2 bp, Artificial Sequence
  Description of Artificial Sequence: Synthetic oligonucleotide
yg

SEQ ID NO: 1723 - DNA, 2 bp, Artificial Sequence
  Description of Artificial Sequence: Synthetic oligonucleotide
yg

SEQ ID NO: 1724 - DNA, 2 bp, Artificial Sequence
  Description of Artificial Sequence: Synthetic oligonucleotide
yg

SEQ ID NO: 1725 - DNA, 125 bp, Artificial Sequence
  Description of Artificial Sequence: Synthetic polynucleotide
ygtttygygttttygtttygttatgtttttgttgttggggttgtgtttggggttgtttttgtgtgtggggtygtaggaagaggygtagagttggggttatttttyggagtaggtaagtggagtyg

SEQ ID NO: 1726 - DNA, 2 bp, Artificial Sequence
  Description of Artificial Sequence: Synthetic oligonucleotide
yg

SEQ ID NO: 1727 - DNA, 131 bp, Artificial Sequence
  Description of Artificial Sequence: Synthetic polynucleotide
ygtgygtagtttagtttttttyggaygttttygttttygttygggtatatygtgtttygtatygaggtagagaggggtaygyggattttagtttttgygagtttttttgttygtygttattttatatttyg

SEQ ID NO: 1728 - DNA, 94 bp, Artificial Sequence
  Description of Artificial Sequence: Synthetic oligonucleotide
ygggtygygtgggtttgggygygtygtggtgggtaagyggggttagyggagygggaattygtatatttttygagyggagtygaggataggttyg

SEQ ID NO: 1729 - DNA, 2 bp, Artificial Sequence
  Description of Artificial Sequence: Synthetic oligonucleotide
yg

SEQ ID NO: 1730 - DNA, 2 bp, Artificial Sequence
  Description of Artificial Sequence: Synthetic oligonucleotide
yg

SEQ ID NO: 1731 - DNA, 27 bp, Artificial Sequence
  Description of Artificial Sequence: Synthetic oligonucleotide
ygygtaagtatttttttttttatygyg

SEQ ID NO: 1732 - DNA, 164 bp, Artificial Sequence
  Description of Artificial Sequence: Synthetic polynucleotide
ygygatttttttygggaggtgtttgygaaggyggttttgtygyggtgggggtggggaggttagggtttyggatygttggagttggggtygtagttagtttttggygagtgttttttggttgttgtygtaggggtttgttttttyggattttttttttaatttyg

SEQ ID NO: 1733 - DNA, 2 bp, Artificial Sequence
  Description of Artificial Sequence: Synthetic oligonucleotide
yg

SEQ ID NO: 1734 - DNA, 2 bp, Artificial Sequence
  Description of Artificial Sequence: Synthetic oligonucleotide
yg

SEQ ID NO: 1735 - DNA, 68 bp, Artificial Sequence
  Description of Artificial Sequence: Synthetic oligonucleotide
ygtatttgaaaatttygtygtagttattttttttttatgggaaagtttygatttyggygggtttagyg

SEQ ID NO: 1736 - DNA, 508 bp, Artificial Sequence
  Description of Artificial Sequence: Synthetic polynucleotide
ygtaatttgggygygttagtataaattyggttttyggtttttttgaagttagttaagttygtatagggtttttagygtttggaaatttgagaggygtggaagggtggggagtttygygaagtttttagtttttgggtgtttttyggtttygygggggagygggtttggagttaaatyggtyggtygtaggttggagtagygggygtyggagygygyggtggggatgttygaaaaggagttagaggtttagtyggagagttygagaataygagggatgtttattttgtaatatggttttaagtttttttttgtttaygyggaagygtttttygttttatttygggttgtgtagggtygtttyggygattaagtygttttyggagtygggtattggggagtyggtgttgygttygttgttggagtyggggttygattgygtygttaggtagtygggttttttttgggyggttatggtgggygygtagygttygggttttygttgtygtyg

SEQ ID NO: 1737 - DNA, 2 bp, Artificial Sequence
  Description of Artificial Sequence: Synthetic oligonucleotide
yg

SEQ ID NO: 1738 - DNA, 2 bp, Artificial Sequence
  Description of Artificial Sequence: Synthetic oligonucleotide
yg

SEQ ID NO: 1739 - DNA, 2 bp, Artificial Sequence
  Description of Artificial Sequence: Synthetic oligonucleotide
yg

SEQ ID NO: 1740 - DNA, 2 bp, Artificial Sequence
  Description of Artificial Sequence: Synthetic oligonucleotide
yg

SEQ ID NO: 1741 - DNA, 4 bp, Artificial Sequence
  Description of Artificial Sequence: Synthetic oligonucleotide
ygyg

SEQ ID NO: 1742 - DNA, 2 bp, Artificial Sequence
  Description of Artificial Sequence: Synthetic oligonucleotide
yg

SEQ ID NO: 1743 - DNA, 2 bp, Artificial Sequence
  Description of Artificial Sequence: Synthetic oligonucleotide
yg

SEQ ID NO: 1744 - DNA, 9 bp, Artificial Sequence
  Description of Artificial Sequence: Synthetic oligonucleotide
ygttgtayg

SEQ ID NO: 1745 - DNA, 2 bp, Artificial Sequence
  Description of Artificial Sequence: Synthetic oligonucleotide
yg

SEQ ID NO: 1746 - DNA, 2 bp, Artificial Sequence
  Description of Artificial Sequence: Synthetic oligonucleotide
yg

SEQ ID NO: 1747 - DNA, 396 bp, Artificial Sequence
  Description of Artificial Sequence: Synthetic polynucleotide
ygggyggyggyggttygttgtatatatttyggygtatttygttaggtygygtatagygtttygagtttaggygttttttygtttttttttygygttttgyggyggyggyggyggyggtagtagtagtagtaatatggttgttgatgggtgtttggggtggygttggyggygggaggagttttttygagtttttgygtyggttgttygttgttagttatggtaaatggtggyggyggyggyggyggtagtagyggyggyggyggyggyggyggaggtagtagttttagaatgagtagtaatatttaygygaattattttagtttagaygygttttttttttttttttttttttttttttttttttttttttttttttttttttttttttygtttttg

SEQ ID NO: 1748 - DNA, 2 bp, Artificial Sequence
  Description of Artificial Sequence: Synthetic oligonucleotide
yg

SEQ ID NO: 1749 - DNA, 70 bp, Artificial Sequence
  Description of Artificial Sequence: Synthetic oligonucleotide
ygtgatttttttatttagagattatttagggagatgttttggatgggataagtagataaatggyggttyg

SEQ ID NO: 1750 - DNA, 2 bp, Artificial Sequence
  Description of Artificial Sequence: Synthetic oligonucleotide
yg

SEQ ID NO: 1751 - DNA, 68 bp, Artificial Sequence
  Description of Artificial Sequence: Synthetic oligonucleotide
ygggagttyggtygygttttttagtttyggtattygygtttagygygtygygtttygygtttttygyg

SEQ ID NO: 1752 - DNA, 88 bp, Artificial Sequence
  Description of Artificial Sequence: Synthetic oligonucleotide
ygtttygygtatygttttygttttagtttttagtggygyggygttttttygygatattygygggtttttaggagygagtygattttyg

SEQ ID NO: 1753 - DNA, 2 bp, Artificial Sequence
  Description of Artificial Sequence: Synthetic oligonucleotide
yg

SEQ ID NO: 1754 - DNA, 2 bp, Artificial Sequence
  Description of Artificial Sequence: Synthetic oligonucleotide
yg

SEQ ID NO: 1755 - DNA, 87 bp, Artificial Sequence
  Description of Artificial Sequence: Synthetic oligonucleotide
ygggggttttttaggtygyggygtttttygtttttttttatttttygattttttttygtttttaaaatgaggaaayggagtaattyg

SEQ ID NO: 1756 - DNA, 45 bp, Artificial Sequence
  Description of Artificial Sequence: Synthetic oligonucleotide
ygtggtaaattygggtttygaygatagaggtagygtagaagttyg

SEQ ID NO: 1757 - DNA, 2 bp, Artificial Sequence
  Description of Artificial Sequence: Synthetic oligonucleotide
yg

SEQ ID NO: 1758 - DNA, 173 bp, Artificial Sequence
  Description of Artificial Sequence: Synthetic polynucleotide
ygggtygtggttgatatygyggagaagttaggatttttatagtttttgttagatttgaaagtaagttggaaatygatagttgttttagttgttttagattttaatttggtttgggttttttttttttttatttgaaaatagatttagggtaatgtttaagagaattttaatyg

SEQ ID NO: 1759 - DNA, 2 bp, Artificial Sequence
  Description of Artificial Sequence: Synthetic oligonucleotide
yg

SEQ ID NO: 1760 - DNA, 48 bp, Artificial Sequence
  Description of Artificial Sequence: Synthetic oligonucleotide
yggggtttttgtttttggttgtagttggagttttgygtttygttttyg

SEQ ID NO: 1761 - DNA, 2 bp, Artificial Sequence
  Description of Artificial Sequence: Synthetic oligonucleotide
yg

SEQ ID NO: 1762 - DNA, 2 bp, Artificial Sequence
  Description of Artificial Sequence: Synthetic oligonucleotide
yg

SEQ ID NO: 1763 - DNA, 36 bp, Artificial Sequence
  Description of Artificial Sequence: Synthetic oligonucleotide
yggggtagagggggygggaagttggygttayggtyg

SEQ ID NO: 1764 - DNA, 2 bp, Artificial Sequence
  Description of Artificial Sequence: Synthetic oligonucleotide
yg

SEQ ID NO: 1765 - DNA, 2 bp, Artificial Sequence
  Description of Artificial Sequence: Synthetic oligonucleotide
yg

SEQ ID NO: 1766 - DNA, 2 bp, Artificial Sequence
  Description of Artificial Sequence: Synthetic oligonucleotide
yg

SEQ ID NO: 1767 - DNA, 2 bp, Artificial Sequence
  Description of Artificial Sequence: Synthetic oligonucleotide
yg

SEQ ID NO: 1768 - DNA, 2 bp, Artificial Sequence
  Description of Artificial Sequence: Synthetic oligonucleotide
yg

SEQ ID NO: 1769 - DNA, 97 bp, Artificial Sequence
  Description of Artificial Sequence: Synthetic oligonucleotide
ygattygggagggaaaatttttgttttttttyggggtttgttttgttygttttttaaattygttttatatttttttygattttygtttttgtaagyg

SEQ ID NO: 1770 - DNA, 2 bp, Artificial Sequence
  Description of Artificial Sequence: Synthetic oligonucleotide
yg

SEQ ID NO: 1771 - DNA, 2 bp, Artificial Sequence
  Description of Artificial Sequence: Synthetic oligonucleotide
yg

SEQ ID NO: 1772 - DNA, 67 bp, Artificial Sequence
  Description of Artificial Sequence: Synthetic oligonucleotide
ygatgtttgtgtttgtggttttttgaggtagtgggagtggygtgtgaaggattgtgagagtttggyg

SEQ ID NO: 1773 - DNA, 2 bp, Artificial Sequence
  Description of Artificial Sequence: Synthetic oligonucleotide
yg

SEQ ID NO: 1774 - DNA, 29 bp, Artificial Sequence
  Description of Artificial Sequence: Synthetic oligonucleotide
ygggtgattgttgattttttgttttgtyg

SEQ ID NO: 1775 - DNA, 49 bp, Artificial Sequence
  Description of Artificial Sequence: Synthetic oligonucleotide
ygaggtttygygtattttygttygygttttagttatttaggttyggtyg

SEQ ID NO: 1776 - DNA, 188 bp, Artificial Sequence
  Description of Artificial Sequence: Synthetic polynucleotide
ygtttattgaaaatttttagttggtgttggagyggyggygtgtggttaaygttaaggagygtgagygggtgagggatttttagggtygaygttygttttttttttttttgttttattattaaatatttggttaatattygggggttygtttatygtttattttygttygaggygatttygagttttyg

SEQ ID NO: 1777 - DNA, 4 bp, Artificial Sequence
  Description of Artificial Sequence: Synthetic oligonucleotide
ygyg

SEQ ID NO: 1778 - DNA, 4 bp, Artificial Sequence
  Description of Artificial Sequence: Synthetic oligonucleotide
ygyg

SEQ ID NO: 1779 - DNA, 113 bp, Artificial Sequence
  Description of Artificial Sequence: Synthetic polynucleotide
ygygggtgaaggyggagtygtagggttggtttttaaagggatgttttygttygagyggygagattagtttygttygtttttygtygyggtygygtygtagtygtttayggtyg

SEQ ID NO: 1780 - DNA, 208 bp, Artificial Sequence
  Description of Artificial Sequence: Synthetic polynucleotide
ygygttygttatagtagygygttaggyggaygtygygggaatttgaygttygaggttygyggtttttaatgagagttttagaatatttttygtttttgayggttagyggtagygtygtygtttttygtagagygttygttttttygtttttagagttttagttttttttygagygatttygtagtttttttttygtttttattygtyg

SEQ ID NO: 1781 - DNA, 96 bp, Artificial Sequence
  Description of Artificial Sequence: Synthetic oligonucleotide
ygtattttttygtattyggygtygtygtttygtygttttttttygtttgtagggtygtttygggtattttagggttgttgaggggygggygggtyg

SEQ ID NO: 1782 - DNA, 236 bp, Artificial Sequence
  Description of Artificial Sequence: Synthetic polynucleotide
ygygtggaggttgygygtaggggttygggaygygggatagggatttygygtagtttaggygtyggggaatyggggttggagtyggggatttgagtttagyggaygtttttttygtttggaggttyggtayggatygggatattagggygttygtggtygtggttyggtttttggttgttgygggtygyggtttttagtgggtttttaggatttttttttayggygggtatttatyg

SEQ ID NO: 1783 - DNA, 211 bp, Artificial Sequence
  Description of Artificial Sequence: Synthetic polynucleotide
ygtygttygygttttttgttttttattttttaatttttgygtggttttagggtttatatttttggagtttttttttttagtaaatagtgttgttttttatttaatagtagaggygtttaggagtttaggygatgtgtttaaggtygaatagagggatagtagtgagttgtttaatttttttagttgygtagttaggatayggttgggggyg

SEQ ID NO: 1784 - DNA, 193 bp, Artificial Sequence
  Description of Artificial Sequence: Synthetic polynucleotide
ygygggggattttaggtygggayggagttttttttggttygttgtgygygtaygtttggaaaggygggatttaaggtagygatgttgygggaggttttgtagtgttaaygagttttygaayggtttygttttattttttttttgtgtgtttygtaagtttttgtttagtaaatygttatagtttyggygygyg

SEQ ID NO: 1785 - DNA, 4 bp, Artificial Sequence
  Description of Artificial Sequence: Synthetic oligonucleotide
ygyg

SEQ ID NO: 1786 - DNA, 199 bp, Artificial Sequence
  Description of Artificial Sequence: Synthetic polynucleotide
ygtaataaattttygtagatatygtatttttaatgyggtgtttttttgtgttagtgtttyggyggtttttgtagggtgttaatgttayggttgtatatygttttttttttttattatttttatttgaatagatttggaggaggyggaaatggaaattagggtatgtttataagttggattygttagatttttttgttyg

SEQ ID NO: 1787 - DNA, 87 bp, Artificial Sequence
  Description of Artificial Sequence: Synthetic oligonucleotide
ygyggtygttaygtttygttttttgtatttagtttttttggygttttygttgtagtatttaagattaggygtygtttttgttagtyg

SEQ ID NO: 1788 - DNA, 68 bp, Artificial Sequence
  Description of Artificial Sequence: Synthetic oligonucleotide
ygtaaattgattatgaaatataygatgttaattyggagttgtattttttagttgggtattttygygyg

SEQ ID NO: 1789 - DNA, 61 bp, Artificial Sequence
  Description of Artificial Sequence: Synthetic oligonucleotide
yggtgaaaattagtttgtggtgtattgagatttgtaaattattttttgaatgttaggggyg

SEQ ID NO: 1790 - DNA, 40 bp, Artificial Sequence
  Description of Artificial Sequence: Synthetic oligonucleotide
yggatyggyggtagtagaagyggtagyggtaaagtattyg

SEQ ID NO: 1791 - DNA, 647 bp, Artificial Sequence
  Description of Artificial Sequence: Synthetic polynucleotide
yggttgttgttattgttttgtygttgtygagtyggttatttgggtattygyggagtygygtygttgttatygtttyggyggtttttyggagtgygyggagggggyggyggaggagygagatatttatagtaatygaggatgygaggggygtttagtagtagygagtgtttgggagttaggaggaggttttygygygtyggtaatttttagtgttaggygttttgtagttttygygygtygygtttgggttygtatygttttygtagtgagggttygttygagyggtaagtttttttyggyggttaagtygatatttttttttygtttygtygtttatttygggtagtagtygyggaataatggagagygtagttagtagttttggagayggygttygggggaggaygygtygtygtygtygtygttgtygttagggtaggygygygtygygtggagtygggygggtgygagggygygyggyggggggtggggggtaygygtygygyggggggygggggtagtggggggygygygygygggttyggggagttygyggggagagttyggygttyggygtagygyggygyggttaagtttygygtttttttygttttttttyggygygttygttttygtttygtygttyg

SEQ ID NO: 1792 - DNA, 327 bp, Artificial Sequence
  Description of Artificial Sequence: Synthetic polynucleotide
ygaggygygggttgagtttttagtatttggtttgagyggygtgggtagtagtttgtatygyggatatttttaattttgtygygtttgygtygtattttggtygtggtagygatttttygggtatttttgaggtygtttttagttttataagtatttagtygtttattttagagtagyggygtygatygttttaagaggagttagttttygatatygttttttatttatttttttatatttttatygttggagggggtgagtgtygtggataggygttttygttyggggatagtttagyggyggtagttagttygattttttttygyg

SEQ ID NO: 1793 - DNA, 2 bp, Artificial Sequence
  Description of Artificial Sequence: Synthetic oligonucleotide
yg

SEQ ID NO: 1794 - DNA, 324 bp, Artificial Sequence
  Description of Artificial Sequence: Synthetic polynucleotide
ygtaagggtaattattggaygttggattyggtttgygaagatatgttygagaagggtaattatyggygtygtygtygtatgaagaggttttttyggtygtygttygygtatttttagttyggtaaggggtttttyggggtyggaggygtygtaggygggtgyggygtggygggygtyggggtygayggttayggttatttggygttttttaagtatttgtagtttggtttttttaataattygtggtygttatygtagttttttttatttatgttttatgttttttgttagatggyggtagtygtagyggttgtagtagttgyg

SEQ ID NO: 1795 - DNA, 77 bp, Artificial Sequence
  Description of Artificial Sequence: Synthetic oligonucleotide
ygtttygtygtgttygatgggtgygtttttagygttgtygtygyggygttyggtttygggttttygtygttgygtyg

SEQ ID NO: 1796 - DNA, 158 bp, Artificial Sequence
  Description of Artificial Sequence: Synthetic polynucleotide
ygtttttatttyggtatagatagtttttaaagttgttygtattttttagatttygttttttgtttagttttyggatttygtttaggggttgagttgaygttygygggtggatttttttggttygttgygtagggaattgatttygggaatttagggyg

SEQ ID NO: 1797 - DNA, 79 bp, Artificial Sequence
  Description of Artificial Sequence: Synthetic oligonucleotide
ygygygtttygygtttttggyggtygtagygttgtttattaattgatttttttattgatttatttaatttttaggagyg

SEQ ID NO: 1798 - DNA, 137 bp, Artificial Sequence
  Description of Artificial Sequence: Synthetic polynucleotide
ygttttggagyggtgggaggaygyggagygtygttttttggttttygatattttgttygttttttttagtgggtttgtggttgygttttttygaaggaagtaataaatttttttgattttgggggttagaggagayg

SEQ ID NO: 1799 - DNA, 112 bp, Artificial Sequence
  Description of Artificial Sequence: Synthetic polynucleotide
ygttgyggtatttagyggtttatyggggttgtattgttgtagyggttttttgtgttatttgtagtttaggaggttgagtatagtgagtattagtagtagtgtatagttygyg

SEQ ID NO: 1800 - DNA, 2 bp, Artificial Sequence
  Description of Artificial Sequence: Synthetic oligonucleotide
yg

SEQ ID NO: 1801 - DNA, 2 bp, Artificial Sequence
  Description of Artificial Sequence: Synthetic oligonucleotide
yg

SEQ ID NO: 1802 - DNA, 282 bp, Artificial Sequence
  Description of Artificial Sequence: Synthetic polynucleotide
yggttttttagttttagttgtgygttttygttygggygaggtggggttgatygyggtygtttgtataygttttttttggttygygttttyggtttgggagggyggattygtttattttaygatggtttyggttttggaagggattgttttygtgattygtttttttaatagtygttaataattttttttaaygttttttgygyggttygtttttgagaattttggttygggagagygaygyggggttttyggggttgygtaggttgyggygttttgtttayg

SEQ ID NO: 1803 - DNA, 81 bp, Artificial Sequence
  Description of Artificial Sequence: Synthetic oligonucleotide
yggygyggyggyggggggygtttygtaagttygyggttttgagyggttattygygtagtaagttgggygagttggtagtyg

SEQ ID NO: 1804 - DNA, 53 bp, Artificial Sequence
  Description of Artificial Sequence: Synthetic oligonucleotide
ygyggtttttgttttttgygttagygtgagttyggttagggtttttayggtyg

SEQ ID NO: 1805 - DNA, 40 bp, Artificial Sequence
  Description of Artificial Sequence: Synthetic oligonucleotide
yggygttagtttaygttttygttggygttttttyggygyg

SEQ ID NO: 1806 - DNA, 206 bp, Artificial Sequence
  Description of Artificial Sequence: Synthetic polynucleotide
yggtygatttatttggtgtygygtgygttggyggttygygyggtagttaagttaaaggtygaggtygaggtygagygyggygtttagtagtayggygggggttagtagggygggygtyggtygtagygygtttygttttagtagtagtygygygtygtttttgtaggtygtttygtygygggttattyggggygtttaggttgtyg

SEQ ID NO: 1807 - DNA, 38 bp, Artificial Sequence
  Description of Artificial Sequence: Synthetic oligonucleotide
ygttgttgttgygyggggyggyggtygtygtgttttyg

SEQ ID NO: 1808 - DNA, 5 bp, Artificial Sequence
  Description of Artificial Sequence: Synthetic oligonucleotide
ygtyg

SEQ ID NO: 1809 - DNA, 25 bp, Artificial Sequence
  Description of Artificial Sequence: Synthetic oligonucleotide
ygtgtgtaygygttgtattygttyg

SEQ ID NO: 1810 - DNA, 79 bp, Artificial Sequence
  Description of Artificial Sequence: Synthetic oligonucleotide
ygttttttttttttttttttttttattaaatattatttgggaattgtttaaattttttttttaaaaaaagagagaggyg

SEQ ID NO: 1811 - DNA, 33 bp, Artificial Sequence
  Description of Artificial Sequence: Synthetic oligonucleotide
yggtttygygtggygtttyggtygttgttttyg

SEQ ID NO: 1812 - DNA, 132 bp, Artificial Sequence
  Description of Artificial Sequence: Synthetic polynucleotide
yggygggyggyggyggygyggagttgtatayggagaagayggagtgygggygttayggagagtattygtttaagtaggaygttygyggggaggtggttatggttagttyggtttaygatygtttggtttgyg

SEQ ID NO: 1813 - DNA, 32 bp, Artificial Sequence
  Description of Artificial Sequence: Synthetic oligonucleotide
ygtttggtatttttttttttgtttygagggyg

SEQ ID NO: 1814 - DNA, 2 bp, Artificial Sequence
  Description of Artificial Sequence: Synthetic oligonucleotide
yg

SEQ ID NO: 1815 - DNA, 2 bp, Artificial Sequence
  Description of Artificial Sequence: Synthetic oligonucleotide
yg

SEQ ID NO: 1816 - DNA, 20 bp, Artificial Sequence
  Description of Artificial Sequence: Synthetic oligonucleotide
ygagtatgttagyggygtyg

SEQ ID NO: 1817 - DNA, 85 bp, Artificial Sequence
  Description of Artificial Sequence: Synthetic oligonucleotide
yggtaygttttttttttyggtygtttttttttatataagygtaggtagagggygygttagttatgttttgtttttgygttygtyg

SEQ ID NO: 1818 - DNA, 230 bp, Artificial Sequence
  Description of Artificial Sequence: Synthetic polynucleotide
yggtttygygaaattyggttttttagttygygggaygygttgtttgttaggygggttyggyggtatttygggggygggaggggtyggtygtagggtttttagtttggygttygyggggygttygtagygaaggggtgggtgtygttygtgaaygtagtagggattagtttagttygygttygtttttgggtttyggttatygttttttygttattttttyggtttttgyg

SEQ ID NO: 1819 - DNA, 84 bp, Artificial Sequence
  Description of Artificial Sequence: Synthetic oligonucleotide
ygggtygttagttttagggtgtygggttttaattaaggtttygaagtttttaygtatttgagggtattttgattagtttttgyg

SEQ ID NO: 1820 - DNA, 42 bp, Artificial Sequence
  Description of Artificial Sequence: Synthetic oligonucleotide
ygygatttttttttgatttagttaaayggaaaagttygygyg

SEQ ID NO: 1821 - DNA, 45 bp, Artificial Sequence
  Description of Artificial Sequence: Synthetic oligonucleotide
ygtygtgttttttttygttttygaaagggtagaaagagtygttyg

SEQ ID NO: 1822 - DNA, 26 bp, Artificial Sequence
  Description of Artificial Sequence: Synthetic oligonucleotide
ygttygttagtattttttgtttygyg

SEQ ID NO: 1823 - DNA, 50 bp, Artificial Sequence
  Description of Artificial Sequence: Synthetic oligonucleotide
ygaggtttaggtggaggttgaggttgtygygygtygygggaggagtttyg

SEQ ID NO: 1824 - DNA, 56 bp, Artificial Sequence
  Description of Artificial Sequence: Synthetic oligonucleotide
ygtttttgagttagggaygygygtggggggtgggygtgtaygygggtgggttagyg

SEQ ID NO: 1825 - DNA, 44 bp, Artificial Sequence
  Description of Artificial Sequence: Synthetic oligonucleotide
ygtttttatygygtaygygtttttttygygygygtataygttyg

SEQ ID NO: 1826 - DNA, 2 bp, Artificial Sequence
  Description of Artificial Sequence: Synthetic oligonucleotide
yg

SEQ ID NO: 1827 - DNA, 9 bp, Artificial Sequence
  Description of Artificial Sequence: Synthetic oligonucleotide
ygtttttyg

SEQ ID NO: 1828 - DNA, 58 bp, Artificial Sequence
  Description of Artificial Sequence: Synthetic oligonucleotide
ygyggggtagttgtttaagtggatygatattatygtttgtttggygggtaggygggyg

SEQ ID NO: 1829 - DNA, 151 bp, Artificial Sequence
  Description of Artificial Sequence: Synthetic polynucleotide
yggtagaagatagygtttttaggattagygattttgtggtttattyggttattgggtttyggygtaaattttttttaggtagtgygggygatgttgattgtagaygtygggtagggttttygtgygggygggagygggggaagttagtgyg

SEQ ID NO: 1830 - DNA, 17 bp, Artificial Sequence
  Description of Artificial Sequence: Synthetic oligonucleotide
yggattttttaggatyg

SEQ ID NO: 1831 - DNA, 70 bp, Artificial Sequence
  Description of Artificial Sequence: Synthetic oligonucleotide
ygttygttgtttttygttgygtttagggatggagggttttattatttatggaattgttggtttttttgyg

SEQ ID NO: 1832 - DNA, 59 bp, Artificial Sequence
  Description of Artificial Sequence: Synthetic oligonucleotide
ygtttttgagatttygttgagaaatttttagygggttagygtttgggygttgggygtyg

SEQ ID NO: 1833 - DNA, 25 bp, Artificial Sequence
  Description of Artificial Sequence: Synthetic oligonucleotide
ygttgggtaatttttattygagtyg

SEQ ID NO: 1834 - DNA, 57 bp, Artificial Sequence
  Description of Artificial Sequence: Synthetic oligonucleotide
yggygttgaygttttggttttgggggttgtttggttggtgttaggtagyggaagayg

SEQ ID NO: 1835 - DNA, 111 bp, Artificial Sequence
  Description of Artificial Sequence: Synthetic polynucleotide
ygagtagttttaygttttgttaaggayggtaggtgtaagggtygggggattttttgayggggtygttttttygggtayggggaggtttttatygagttttaattttgaayg

SEQ ID NO: 1836 - DNA, 211 bp, Artificial Sequence
  Description of Artificial Sequence: Synthetic polynucleotide
ygggtygttgtttttgttgtattatgtaaaggtggttgggaaagygygttgatttatatttatatagtttattttttttttatagtatgtgattaataygtatttyggggaggagggagygyggttgggggtgttaatyggaagggaatagatagtgagtgttattttgttgggaggttttagaagtaaagygttaaygaygatagtagyg

SEQ ID NO: 1837 - DNA, 75 bp, Artificial Sequence
  Description of Artificial Sequence: Synthetic oligonucleotide
ygtttttaygygygttgtyggtatttgttygttttgttgtaatttgttgtagtgtttgaaagagtagtaggagyg

SEQ ID NO: 1838 - DNA, 2 bp, Artificial Sequence
  Description of Artificial Sequence: Synthetic oligonucleotide
yg

SEQ ID NO: 1839 - DNA, 66 bp, Artificial Sequence
  Description of Artificial Sequence: Synthetic oligonucleotide
ygggygttggagaaggygtttggygygaagttgggyggygtttygagggyggaggataggtggtyg

SEQ ID NO: 1840 - DNA, 2 bp, Artificial Sequence
  Description of Artificial Sequence: Synthetic oligonucleotide
yg

SEQ ID NO: 1841 - DNA, 163 bp, Artificial Sequence
  Description of Artificial Sequence: Synthetic polynucleotide
yggggyggygggygtatgygygtgygyggtgyggttttagttttggttgtygtygtttgtygtygtygtygygatgtttattttagttaaagyggttgygggtttggggattyggttygggtagyggagttttyggattygtygattygtygaggagygygyg

SEQ ID NO: 1842 - DNA, 99 bp, Artificial Sequence
  Description of Artificial Sequence: Synthetic oligonucleotide
yggagtaaagttagygygtttygyggttyggaatttagttggttygttatttttttatttttgygattttattttygatygygttttagggtagaagyg

SEQ ID NO: 1843 - DNA, 96 bp, Artificial Sequence
  Description of Artificial Sequence: Synthetic oligonucleotide
yggyggyggyggtagttttagtygygttygttatatatatttttattygttyggtgtataygtygygtygygggtagtgtygtttgyggaggygyg

SEQ ID NO: 1844 - DNA, 4 bp, Artificial Sequence
  Description of Artificial Sequence: Synthetic oligonucleotide
ygyg

SEQ ID NO: 1845 - DNA, 16 bp, Artificial Sequence
  Description of Artificial Sequence: Synthetic oligonucleotide
ygtgttaatttygtyg

SEQ ID NO: 1846 - DNA, 2 bp, Artificial Sequence
  Description of Artificial Sequence: Synthetic oligonucleotide
yg

SEQ ID NO: 1847 - DNA, 141 bp, Artificial Sequence
  Description of Artificial Sequence: Synthetic polynucleotide
ygtttattttgtagtygagtatataaggttygtygaagttatygagtaggttttgtagttgtaggtagttttygtygtygygttttattaygtygtggaaggtaggtaygtagtygygtagygygttagttattagtygyg

SEQ ID NO: 1848 - DNA, 2 bp, Artificial Sequence
  Description of Artificial Sequence: Synthetic oligonucleotide
yg

SEQ ID NO: 1849 - DNA, 37 bp, Artificial Sequence
  Description of Artificial Sequence: Synthetic oligonucleotide
ygaggtgttgygggttttgtgyggttggttgggaayg

SEQ ID NO: 1850 - DNA, 52 bp, Artificial Sequence
  Description of Artificial Sequence: Synthetic oligonucleotide
ygaggygttttygttttygttatttatatagggygttaagtgtttygattyg

SEQ ID NO: 1851 - DNA, 2 bp, Artificial Sequence
  Description of Artificial Sequence: Synthetic oligonucleotide
yg

SEQ ID NO: 1852 - DNA, 7 bp, Artificial Sequence
  Description of Artificial Sequence: Synthetic oligonucleotide
ygtttyg

SEQ ID NO: 1853 - DNA, 2 bp, Artificial Sequence
  Description of Artificial Sequence: Synthetic oligonucleotide
yg

SEQ ID NO: 1854 - DNA, 4 bp, Artificial Sequence
  Description of Artificial Sequence: Synthetic oligonucleotide
ygyg

SEQ ID NO: 1855 - DNA, 17 bp, Artificial Sequence
  Description of Artificial Sequence: Synthetic oligonucleotide
ygtttygttttaattyg

SEQ ID NO: 1856 - DNA, 136 bp, Artificial Sequence
  Description of Artificial Sequence: Synthetic polynucleotide
ygyggggggaggtttttggttygtygttttygttgtygtttgatygtatttttggagggtttygtattttgttaggtttttggaggtaaatatatattttygatttataattggttttygygttaggggattygyg

SEQ ID NO: 1857 - DNA, 31 bp, Artificial Sequence
  Description of Artificial Sequence: Synthetic oligonucleotide
yggttagggagtgagyggggygttgggygyg

SEQ ID NO: 1858 - DNA, 25 bp, Artificial Sequence
  Description of Artificial Sequence: Synthetic oligonucleotide
ygttaattagattttagggtgtayg

SEQ ID NO: 1859 - DNA, 12 bp, Artificial Sequence
  Description of Artificial Sequence: Synthetic oligonucleotide
ygttygttaayg

SEQ ID NO: 1860 - DNA, 6 bp, Artificial Sequence
  Description of Artificial Sequence: Synthetic oligonucleotide
ygtayg

SEQ ID NO: 1861 - DNA, 199 bp, Artificial Sequence
  Description of Artificial Sequence: Synthetic polynucleotide
ygtagygtgtagtygyggaatagygtttttagttttgggtaagygaatttttygtygtaygttyggagttygygtyggyggtttgtttyggtygttygttyggygttttygggttygttygygtygttttygtygtygttttygtygygyggygttttygttattttagygttatgtagyggtygyggtygygggygyg

SEQ ID NO: 1862 - DNA, 91 bp, Artificial Sequence
  Description of Artificial Sequence: Synthetic oligonucleotide
ygtgggggygyggygygggygataygtgygggtygttaggagggggagggggaygygygtygtygggttygttattttgtattyggggtyg

SEQ ID NO: 1863 - DNA, 108 bp, Artificial Sequence
  Description of Artificial Sequence: Synthetic polynucleotide
ygttttttttatggattttttagtatttgtaggttataggataatagaagttatagtagagttatygaggaattttaggaayggaggagatggaatagtggagaygyg

SEQ ID NO: 1864 - DNA, 13 bp, Artificial Sequence
  Description of Artificial Sequence: Synthetic oligonucleotide
ygaaatyggtgyg

SEQ ID NO: 1865 - DNA, 176 bp, Artificial Sequence
  Description of Artificial Sequence: Synthetic polynucleotide
ygggggyggyggggtgatagttttygtgtatgaattagttattttttaggtttygtttyggygggggtyggtyggaygttygtttygtataaagygggtattygggtygtttggagtagaaagtygygtattttttttygttaggygttttttyggaygttttgtttagygggtyg

SEQ ID NO: 1866 - DNA, 2 bp, Artificial Sequence
  Description of Artificial Sequence: Synthetic oligonucleotide
yg

SEQ ID NO: 1867 - DNA, 157 bp, Artificial Sequence
  Description of Artificial Sequence: Synthetic polynucleotide
ygggygtttttttaggtttggtygaggggygtygygtagaggyggyggyggygtayggaggyggtagaygaygygttttyggygttygtagtttyggtttygygttttygyggtttaaagtaattttgggagtygtygtttttygyggaatttttyg

SEQ ID NO: 1868 - DNA, 66 bp, Artificial Sequence
  Description of Artificial Sequence: Synthetic oligonucleotide
yggtygyggygggagggatagggggtttgggtgggaagggagygygagggtttttagyggttygyg

SEQ ID NO: 1869 - DNA, 498 bp, Artificial Sequence
  Description of Artificial Sequence: Synthetic polynucleotide
ygtgygttaggyggaaatgttttagtaggttttygygtatygggtygttyggggggtagtaggggtaggyggyggygggtaggtygagygygtygggyggtggygtagyggggtaygagtattttttgtgygttaggtaggtttygaggttgtggaagtttaygyggtaggtygtgtattygtggtagtyggttagygtyggtgtyggggtttyggggagygggygtygyggttttttgtttaggtygatggggtygtyggtygyggggtygggygagygygtaggggygaggtyggggtygttttygttttygttttygggtygyggygattygggygygggggygtggtygggyggyggggggggyggggygtyggtygygtgtagttygtagagtttgyggygtttgygygtgygtataggygyggygggagagggggtygggggygyggtyggtttagggggtttygggggygyggtyggtyggygyggyggyg

SEQ ID NO: 1870 - DNA, 27 bp, Artificial Sequence
  Description of Artificial Sequence: Synthetic oligonucleotide
ygagygygaagggygttyggattygyg

SEQ ID NO: 1871 - DNA, 2 bp, Artificial Sequence
  Description of Artificial Sequence: Synthetic oligonucleotide
yg

SEQ ID NO: 1872 - DNA, 2 bp, Artificial Sequence
  Description of Artificial Sequence: Synthetic oligonucleotide
yg

SEQ ID NO: 1873 - DNA, 16 bp, Artificial Sequence
  Description of Artificial Sequence: Synthetic oligonucleotide
ygygaggtaggygayg

SEQ ID NO: 1874 - DNA, 53 bp, Artificial Sequence
  Description of Artificial Sequence: Synthetic oligonucleotide
ygtygtaagagaagttgttaagtttygtaggttttgattyggygtttttygyg

SEQ ID NO: 1875 - DNA, 4 bp, Artificial Sequence
  Description of Artificial Sequence: Synthetic oligonucleotide
ygyg

SEQ ID NO: 1876 - DNA, 2 bp, Artificial Sequence
  Description of Artificial Sequence: Synthetic oligonucleotide
yg

SEQ ID NO: 1877 - DNA, 2 bp, Artificial Sequence
  Description of Artificial Sequence: Synthetic oligonucleotide
yg

SEQ ID NO: 1878 - DNA, 2 bp, Artificial Sequence
  Description of Artificial Sequence: Synthetic oligonucleotide
yg

SEQ ID NO: 1879 - DNA, 14 bp, Artificial Sequence
  Description of Artificial Sequence: Synthetic oligonucleotide
ygtaggtggatayg

SEQ ID NO: 1880 - DNA, 186 bp, Artificial Sequence
  Description of Artificial Sequence: Synthetic polynucleotide
ygttatggagaaaattaatggaggaaaaattatagagttattygaaatagttgygttgtttattattyggtgtttgagtttgttttttttgtaattagattatatgtgaggtagttttagttaattgtttgtgttatttatyggggaattttagttttatttgtgaatatttaggttttttygtyg

SEQ ID NO: 1881 - DNA, 79 bp, Artificial Sequence
  Description of Artificial Sequence: Synthetic oligonucleotide
ygygtattttttttatttygatatttattgttatttttatagyggagygaggggtttygtygagggygagygtatttyg

SEQ ID NO: 1882 - DNA, 49 bp, Artificial Sequence
  Description of Artificial Sequence: Synthetic oligonucleotide
ygygggggygtttttygttgtttgtagggagygyggygyggaygyggyg

SEQ ID NO: 1883 - DNA, 17 bp, Artificial Sequence
  Description of Artificial Sequence: Synthetic oligonucleotide
ygygaayggtttattyg

SEQ ID NO: 1884 - DNA, 2 bp, Artificial Sequence
  Description of Artificial Sequence: Synthetic oligonucleotide
yg

SEQ ID NO: 1885 - DNA, 9 bp, Artificial Sequence
  Description of Artificial Sequence: Synthetic oligonucleotide
ygtggttyg

SEQ ID NO: 1886 - DNA, 2 bp, Artificial Sequence
  Description of Artificial Sequence: Synthetic oligonucleotide
yg

SEQ ID NO: 1887 - DNA, 165 bp, Artificial Sequence
  Description of Artificial Sequence: Synthetic polynucleotide
yggggtttggtaggaagtgtagtgtattttttagttttagggtaattaggatagtatgaattttttattttgtggtagaataaayggttagygtttygatgtggygygttygatttttttttatagagtttaaaagttaygtttaattaaattgtagygttttyg

SEQ ID NO: 1888 - DNA, 14 bp, Artificial Sequence
  Description of Artificial Sequence: Synthetic oligonucleotide
ygttgattygygyg

SEQ ID NO: 1889 - DNA, 2 bp, Artificial Sequence
  Description of Artificial Sequence: Synthetic oligonucleotide
yg

SEQ ID NO: 1890 - DNA, 2 bp, Artificial Sequence
  Description of Artificial Sequence: Synthetic oligonucleotide
yg

SEQ ID NO: 1891 - DNA, 97 bp, Artificial Sequence
  Description of Artificial Sequence: Synthetic oligonucleotide
ygtttygtaygttygtaygtttagyggggttygtattgagtatgggygyggyggtygtgygttggtatttgtgygtgttgttggttttgggtatayg

SEQ ID NO: 1892 - DNA, 2 bp, Artificial Sequence
  Description of Artificial Sequence: Synthetic oligonucleotide
yg

SEQ ID NO: 1893 - DNA, 98 bp, Artificial Sequence
  Description of Artificial Sequence: Synthetic oligonucleotide
ygaggtttagtttttggttttaaggaataaattygttggtttgaaagggagttayggtagaagtttaggggtagagyggygggagygygygattygyg

SEQ ID NO: 1894 - DNA, 69 bp, Artificial Sequence
  Description of Artificial Sequence: Synthetic oligonucleotide
ygyggaaggttygygygttttgygtygtygtygtttagtgtygtygttagtatttttttygttttttyg

SEQ ID NO: 1895 - DNA, 2 bp, Artificial Sequence
  Description of Artificial Sequence: Synthetic oligonucleotide
yg

SEQ ID NO: 1896 - DNA, 2 bp, Artificial Sequence
  Description of Artificial Sequence: Synthetic oligonucleotide
yg

SEQ ID NO: 1897 - DNA, 2 bp, Artificial Sequence
  Description of Artificial Sequence: Synthetic oligonucleotide
yg

SEQ ID NO: 1898 - DNA, 2 bp, Artificial Sequence
  Description of Artificial Sequence: Synthetic oligonucleotide
yg

SEQ ID NO: 1899 - DNA, 103 bp, Artificial Sequence
  Description of Artificial Sequence: Synthetic polynucleotide
ygygttygtygttttyggaggagygggttggtygatygttatygygtygtttttyggtygttttygaagtygttttatygyggtttttgtygttttggggtyg

SEQ ID NO: 1900 - DNA, 2 bp, Artificial Sequence
  Description of Artificial Sequence: Synthetic oligonucleotide
yg

SEQ ID NO: 1901 - DNA, 21 bp, Artificial Sequence
  Description of Artificial Sequence: Synthetic oligonucleotide
ygtygtygtygttgagagtyg

SEQ ID NO: 1902 - DNA, 148 bp, Artificial Sequence
  Description of Artificial Sequence: Synthetic polynucleotide
ygygygggygygaggggttgggaygygggagttttttgagtgyggagygyggagttttggtgtttyggygtattgtagttatattttygggtygygygttttygtygttttttattygygtygtagggtttttttttttgaggygtyg

SEQ ID NO: 1903 - DNA, 2 bp, Artificial Sequence
  Description of Artificial Sequence: Synthetic oligonucleotide
yg

SEQ ID NO: 1904 - DNA, 2 bp, Artificial Sequence
  Description of Artificial Sequence: Synthetic oligonucleotide
yg

SEQ ID NO: 1905 - DNA, 26 bp, Artificial Sequence
  Description of Artificial Sequence: Synthetic oligonucleotide
yggttattaygygttgtttttyggyg

SEQ ID NO: 1906 - DNA, 119 bp, Artificial Sequence
  Description of Artificial Sequence: Synthetic polynucleotide
ygttygatgatgaggatgtatttttygtaggtgtagtttttgaagyggtagtaaygtttgtggtttttgagttaggataggaygttatggttgyggtagygygygtatttgggygtgyg

SEQ ID NO: 1907 - DNA, 66 bp, Artificial Sequence
  Description of Artificial Sequence: Synthetic oligonucleotide
ygttttattttgttgaggtygttttyggttttttttgatttaggttgggygggaaaggtygggtyg

SEQ ID NO: 1908 - DNA, 60 bp, Artificial Sequence
  Description of Artificial Sequence: Synthetic oligonucleotide
ygyggttggggtttygygttttttggagygttttttgtttagataygaygatttygttyg

SEQ ID NO: 1909 - DNA, 2 bp, Artificial Sequence
  Description of Artificial Sequence: Synthetic oligonucleotide
yg

SEQ ID NO: 1910 - DNA, 124 bp, Artificial Sequence
  Description of Artificial Sequence: Synthetic polynucleotide
yggyggtaggagaagtttaaggttygagyggttygtagtttttaygtttgtatttttttattttygttagttygatggttygtttygyggygtgtattggagtaagtaggtttygtttygagyg

SEQ ID NO: 1911 - DNA, 2 bp, Artificial Sequence
  Description of Artificial Sequence: Synthetic oligonucleotide
yg

SEQ ID NO: 1912 - DNA, 156 bp, Artificial Sequence
  Description of Artificial Sequence: Synthetic polynucleotide
ygtttyggtttttatygtygygtttttataggttattaggtgtygttygtttagaatgttaattatggygtagataygtagttatttgagattygaggatatttgtaggaggatgattatttgyggggaggyggyggygagygtygyggtgtttyg

SEQ ID NO: 1913 - DNA, 2 bp, Artificial Sequence
  Description of Artificial Sequence: Synthetic oligonucleotide
yg

SEQ ID NO: 1914 - DNA, 91 bp, Artificial Sequence
  Description of Artificial Sequence: Synthetic oligonucleotide
ygttttaggaatgattyggtgatatyggtygatgattttttttatagtttgtyggtgagyggyggyggaggtaaggtttyggyggygygyg

SEQ ID NO: 1915 - DNA, 2 bp, Artificial Sequence
  Description of Artificial Sequence: Synthetic oligonucleotide
yg

SEQ ID NO: 1916 - DNA, 2 bp, Artificial Sequence
  Description of Artificial Sequence: Synthetic oligonucleotide
yg

SEQ ID NO: 1917 - DNA, 89 bp, Artificial Sequence
  Description of Artificial Sequence: Synthetic oligonucleotide
ygtygagttgtaggygygygtttaatygttttgttgggtttaygyggtttgagaggtyggagygtttaattgttggtaygygagtaayg

SEQ ID NO: 1918 - DNA, 13 bp, Artificial Sequence
  Description of Artificial Sequence: Synthetic oligonucleotide
yggattaaagayg

SEQ ID NO: 1919 - DNA, 2 bp, Artificial Sequence
  Description of Artificial Sequence: Synthetic oligonucleotide
yg

SEQ ID NO: 1920 - DNA, 47 bp, Artificial Sequence
  Description of Artificial Sequence: Synthetic oligonucleotide
ygygatgtggtttygtttggttttttgttgttggggtttggygttyg

SEQ ID NO: 1921 - DNA, 2 bp, Artificial Sequence
  Description of Artificial Sequence: Synthetic oligonucleotide
yg

SEQ ID NO: 1922 - DNA, 2 bp, Artificial Sequence
  Description of Artificial Sequence: Synthetic oligonucleotide
yg

SEQ ID NO: 1923 - DNA, 159 bp, Artificial Sequence
  Description of Artificial Sequence: Synthetic polynucleotide
ygtttttygtygaggygtaggggtagttatattgyggggygtttgggygayggygttaaagttagggttataagggtaygggataagyggggyggggggagtaggagattaggatagaggtyggygttygtygygggygtttttaygtygygggtatyg

SEQ ID NO: 1924 - DNA, 2 bp, Artificial Sequence
  Description of Artificial Sequence: Synthetic oligonucleotide
yg

SEQ ID NO: 1925 - DNA, 2 bp, Artificial Sequence
  Description of Artificial Sequence: Synthetic oligonucleotide
yg

SEQ ID NO: 1926 - DNA, 2 bp, Artificial Sequence
  Description of Artificial Sequence: Synthetic oligonucleotide
yg

SEQ ID NO: 1927 - DNA, 78 bp, Artificial Sequence
  Description of Artificial Sequence: Synthetic oligonucleotide
yggtygttttttygaygttygyggttttttattgygtygaggygagygttayggttaaagtttaagtttyggygttyg

SEQ ID NO: 1928 - DNA, 2 bp, Artificial Sequence
  Description of Artificial Sequence: Synthetic oligonucleotide
yg

SEQ ID NO: 1929 - DNA, 48 bp, Artificial Sequence
  Description of Artificial Sequence: Synthetic oligonucleotide
ygygttaattyggtygttgtgtayggtygggtgygaaattttttygyg

SEQ ID NO: 1930 - DNA, 2 bp, Artificial Sequence
  Description of Artificial Sequence: Synthetic oligonucleotide
yg

SEQ ID NO: 1931 - DNA, 2 bp, Artificial Sequence
  Description of Artificial Sequence: Synthetic oligonucleotide
yg

SEQ ID NO: 1932 - DNA, 2 bp, Artificial Sequence
  Description of Artificial Sequence: Synthetic oligonucleotide
yg

SEQ ID NO: 1933 - DNA, 157 bp, Artificial Sequence
  Description of Artificial Sequence: Synthetic polynucleotide
ygtgtttaattggtatttgttattaatatgtttgtttttatttaaatggtttagagtaaggttttgattaaattagtatttttaygttaatatttagtagygtttttggtttttggtagattttttttttagttgttaaagtaaaattatagaagyg

SEQ ID NO: 1934 - DNA, 2 bp, Artificial Sequence
  Description of Artificial Sequence: Synthetic oligonucleotide
yg

SEQ ID NO: 1935 - DNA, 82 bp, Artificial Sequence
  Description of Artificial Sequence: Synthetic oligonucleotide
ygtattygyggggagggyggygagyggggattagtygaagtygggagaggggygtttttayggggygggaaattggygygyg

SEQ ID NO: 1936 - DNA, 23 bp, Artificial Sequence
  Description of Artificial Sequence: Synthetic oligonucleotide
yggttaggtgaggyggttaggyg

SEQ ID NO: 1937 - DNA, 38 bp, Artificial Sequence
  Description of Artificial Sequence: Synthetic oligonucleotide
ygaattygtaaagttgttygtagaygygygggaattyg

SEQ ID NO: 1938 - DNA, 2 bp, Artificial Sequence
  Description of Artificial Sequence: Synthetic oligonucleotide
ct

SEQ ID NO: 1939 - DNA, 165 bp, Artificial Sequence
  Description of Artificial Sequence: Synthetic polynucleotide
ygygggttgtttagygtgttagattttttttttttggaygtgygtaagttgttggtggtyggtaatygtatttagyggattttygaggatttttttattttttayggygatttggtttatttggattttaggaataattygttgygttygttggaggagggtayg

SEQ ID NO: 1940 - DNA, 2 bp, Artificial Sequence
  Description of Artificial Sequence: Synthetic oligonucleotide
yg

SEQ ID NO: 1941 - DNA, 2 bp, Artificial Sequence
  Description of Artificial Sequence: Synthetic oligonucleotide
yg

SEQ ID NO: 1942 - DNA, 2 bp, Artificial Sequence
  Description of Artificial Sequence: Synthetic oligonucleotide
yg

SEQ ID NO: 1943 - DNA, 23 bp, Artificial Sequence
  Description of Artificial Sequence: Synthetic oligonucleotide
ygataggyggttttyggatatyg

SEQ ID NO: 1944 - DNA, 2 bp, Artificial Sequence
  Description of Artificial Sequence: Synthetic oligonucleotide
yg

SEQ ID NO: 1945 - DNA, 66 bp, Artificial Sequence
  Description of Artificial Sequence: Synthetic oligonucleotide
yggygttttyggggttgttgygygttygygtttagagttgtygttttagggagttygttayggtyg

SEQ ID NO: 1946 - DNA, 43 bp, Artificial Sequence
  Description of Artificial Sequence: Synthetic oligonucleotide
ygggygygtagttygttygygyggtttggattttttttgttyg

SEQ ID NO: 1947 - DNA, 2 bp, Artificial Sequence
  Description of Artificial Sequence: Synthetic oligonucleotide
yg

SEQ ID NO: 1948 - DNA, 62 bp, Artificial Sequence
  Description of Artificial Sequence: Synthetic oligonucleotide
ygygttgtaygaggatggttaygaggygtagttggagtygtygtygtygtygtatttgggyg

SEQ ID NO: 1949 - DNA, 2 bp, Artificial Sequence
  Description of Artificial Sequence: Synthetic oligonucleotide
yg

SEQ ID NO: 1950 - DNA, 138 bp, Artificial Sequence
  Description of Artificial Sequence: Synthetic polynucleotide
ygttttygggygtayggaaattatttgttaggaaatttttaaygttttttttygtttatttttttttattttttttttggygygttttttttttttttagaggtaygtagtggagtttttggagtttygaatttttyg

SEQ ID NO: 1951 - DNA, 2 bp, Artificial Sequence
  Description of Artificial Sequence: Synthetic oligonucleotide
yg

SEQ ID NO: 1952 - DNA, 2 bp, Artificial Sequence
  Description of Artificial Sequence: Synthetic oligonucleotide
yg

SEQ ID NO: 1953 - DNA, 2 bp, Artificial Sequence
  Description of Artificial Sequence: Synthetic oligonucleotide
yg

SEQ ID NO: 1954 - DNA, 2 bp, Artificial Sequence
  Description of Artificial Sequence: Synthetic oligonucleotide
yg

SEQ ID NO: 1955 - DNA, 187 bp, Artificial Sequence
  Description of Artificial Sequence: Synthetic polynucleotide
ygagyggttttaatttygtttygtttgttgttgttgttgttggtgttgtttyggttgtagttgttgtygttttaygatttyggggygttgaggtaatagggttttttttttttattttttatttttttyggtttttttatagaagygtygtttttagtaatttttygtgtattttttatttttgtyg

SEQ ID NO: 1956 - DNA, 2 bp, Artificial Sequence
  Description of Artificial Sequence: Synthetic oligonucleotide
yg

SEQ ID NO: 1957 - DNA, 2 bp, Artificial Sequence
  Description of Artificial Sequence: Synthetic oligonucleotide
yg

SEQ ID NO: 1958 - DNA, 110 bp, Artificial Sequence
  Description of Artificial Sequence: Synthetic polynucleotide
ygtaggttaagatttggttttagaattatygttataagttgaagygygttygygttttaggggyggyggagtygtttgatttggtagtattygtygagttgtaygtygyg

SEQ ID NO: 1959 - DNA, 4 bp, Artificial Sequence
  Description of Artificial Sequence: Synthetic oligonucleotide
ygyg

SEQ ID NO: 1960 - DNA, 189 bp, Artificial Sequence
  Description of Artificial Sequence: Synthetic polynucleotide
ygtgttttygttygygtttgggtttygtygtattttagtagaagttattatagagaataaattatttttttgttttygagatgggttttyggggaggaaggtaaattgtttgtttygtgtataataagttaggygtggagagtagygyggaggaggtygyggtagttatygagygggtagagtttttyg

SEQ ID NO: 1961 - DNA, 42 bp, Artificial Sequence
  Description of Artificial Sequence: Synthetic oligonucleotide
ygygagtgtatttaagygttttygttttatttatttttagyg

SEQ ID NO: 1962 - DNA, 33 bp, Artificial Sequence
  Description of Artificial Sequence: Synthetic oligonucleotide
ygtggagygtaaagtgtttgaagttttygygyg

SEQ ID NO: 1963 - DNA, 15 bp, Artificial Sequence
  Description of Artificial Sequence: Synthetic oligonucleotide
ygttyggttggygyg

SEQ ID NO: 1964 - DNA, 51 bp, Artificial Sequence
  Description of Artificial Sequence: Synthetic oligonucleotide
ygtttattayggygatttgyggtagttttagtaggtagttttgttttagyg

SEQ ID NO: 1965 - DNA, 2 bp, Artificial Sequence
  Description of Artificial Sequence: Synthetic oligonucleotide
yg

SEQ ID NO: 1966 - DNA, 268 bp, Artificial Sequence
  Description of Artificial Sequence: Synthetic polynucleotide
ygaagatgggaaayggtygtttgttgagagggggtatttgtagtttttttagaaaaggttggggtaggagagygtgyggttagaggggtgggggtatyggagggggggttttattttttgttttatagtygggtttttttygygaggygttgggaagtatgaggtatgtagtatttaaaatgttttttgaaaaagayggatttgaagtttttttttataaataygttattgtatttattttttatttagagaygggttgygygtttyg

SEQ ID NO: 1967 - DNA, 2 bp, Artificial Sequence
  Description of Artificial Sequence: Synthetic oligonucleotide
yg

SEQ ID NO: 1968 - DNA, 33 bp, Artificial Sequence
  Description of Artificial Sequence: Synthetic oligonucleotide
yggtgatyggtttgattgtttttgggggtttyg

SEQ ID NO: 1969 - DNA, 23 bp, Artificial Sequence
  Description of Artificial Sequence: Synthetic oligonucleotide
ygaaagtttygggttagtgggyg

SEQ ID NO: 1970 - DNA, 40 bp, Artificial Sequence
  Description of Artificial Sequence: Synthetic oligonucleotide
ygaggtatttggtygggyggggaggygtygggtyggggyg

SEQ ID NO: 1971 - DNA, 10 bp, Artificial Sequence
  Description of Artificial Sequence: Synthetic oligonucleotide
yggagtygyg

SEQ ID NO: 1972 - DNA, 181 bp, Artificial Sequence
  Description of Artificial Sequence: Synthetic polynucleotide
ygaaaaygaaatttatttttttgygtttatttttgttagaggtttgtaggaygtgttttaatttggtatttygagtttagaataaaagttaygggggttgyggtatgggtagggggaaggygygyggtggttgaygyggggtaggggttttggygagygygggaggggyggttagtagtyg

SEQ ID NO: 1973 - DNA, 195 bp, Artificial Sequence
  Description of Artificial Sequence: Synthetic polynucleotide
ygttaagtagtaggattatagygttagygtttggtttyggaggaaagataagttggagtaygtaagggygattygttttygggggtttyggttaggtatttgtygtatgtatttttttygtggtggtggtatgagygygygyggggygyggggggtaggygaggggattttggtaggygtygaygttttaggtyg

SEQ ID NO: 1974 - DNA, 2 bp, Artificial Sequence
  Description of Artificial Sequence: Synthetic oligonucleotide
yg

SEQ ID NO: 1975 - DNA, 358 bp, Artificial Sequence
  Description of Artificial Sequence: Synthetic polynucleotide
ygygagttygggtgagagttatyggaatgygggaaygtagtttagtygggaatagggttttygataggggtygttygtggttaggaygyggtygttgaatagaggtygygyggyggtttttgttygagggatttygtgggygggggttatayggaggtygygtayggttttyggggttggygggggtaggtgggaggatttttttygggttygygaatttgatttggtagyggttaggtgtttggaagygtttttaaatgatagggttataaagatatgttggttaggtttgtagttagygtagtaaygtggtttgtaggagygtagaaygaggttagatagggttattyggaygtyg

SEQ ID NO: 1976 - DNA, 13 bp, Artificial Sequence
  Description of Artificial Sequence: Synthetic oligonucleotide
ygttataattgyg

SEQ ID NO: 1977 - DNA, 2 bp, Artificial Sequence
  Description of Artificial Sequence: Synthetic oligonucleotide
yg

SEQ ID NO: 1978 - DNA, 2 bp, Artificial Sequence
  Description of Artificial Sequence: Synthetic oligonucleotide
yg

SEQ ID NO: 1979 - DNA, 95 bp, Artificial Sequence
  Description of Artificial Sequence: Synthetic oligonucleotide
ygggtattygggaygaggygagggygtagaaaatttggagtttaattagtayggagttgagttttygygttttaatttttaggtgatttygtgyg

SEQ ID NO: 1980 - DNA, 45 bp, Artificial Sequence
  Description of Artificial Sequence: Synthetic oligonucleotide
ygtygagagggtaggaygygtayggtgygttttaatttgttgtyg

SEQ ID NO: 1981 - DNA, 104 bp, Artificial Sequence
  Description of Artificial Sequence: Synthetic polynucleotide
ygygagttagggggaggygygtyggaaagygagagtgataagtagtttataagtygaaaagtttttygygggaggygygygtygygtgggtttygatttagtyg

SEQ ID NO: 1982 - DNA, 87 bp, Artificial Sequence
  Description of Artificial Sequence: Synthetic oligonucleotide
ygggagggtggyggaaggtggtgtatygtagygtggttttygtygttgtygtygyggttttgtaaagtgttagygggggygaaagyg

SEQ ID NO: 1983 - DNA, 62 bp, Artificial Sequence
  Description of Artificial Sequence: Synthetic oligonucleotide
ygatattgaataataatygyggggaggagaggttatttgtagtygaggttygtaaattgtyg

SEQ ID NO: 1984 - DNA, 2 bp, Artificial Sequence
  Description of Artificial Sequence: Synthetic oligonucleotide
yg

SEQ ID NO: 1985 - DNA, 2 bp, Artificial Sequence
  Description of Artificial Sequence: Synthetic oligonucleotide
yg

SEQ ID NO: 1986 - DNA, 2 bp, Artificial Sequence
  Description of Artificial Sequence: Synthetic oligonucleotide
yg

SEQ ID NO: 1987 - DNA, 2 bp, Artificial Sequence
  Description of Artificial Sequence: Synthetic oligonucleotide
yg

SEQ ID NO: 1988 - DNA, 2 bp, Artificial Sequence
  Description of Artificial Sequence: Synthetic oligonucleotide
yg

SEQ ID NO: 1989 - DNA, 2 bp, Artificial Sequence
  Description of Artificial Sequence: Synthetic oligonucleotide
yg

SEQ ID NO: 1990 - DNA, 2 bp, Artificial Sequence
  Description of Artificial Sequence: Synthetic oligonucleotide
yg

SEQ ID NO: 1991 - DNA, 2 bp, Artificial Sequence
  Description of Artificial Sequence: Synthetic oligonucleotide
yg

SEQ ID NO: 1992 - DNA, 145 bp, Artificial Sequence
  Description of Artificial Sequence: Synthetic polynucleotide
ygggaatygtaggagaggattggggttttaggtggayggtgttgattgtattggttttgaagattggaagtgggtgtaggaggaatttgygatagttgagattagggygygygggtagatgygttaggtygttagtaaatyggyg

SEQ ID NO: 1993 - DNA, 2 bp, Artificial Sequence
  Description of Artificial Sequence: Synthetic oligonucleotide
yg

SEQ ID NO: 1994 - DNA, 19 bp, Artificial Sequence
  Description of Artificial Sequence: Synthetic oligonucleotide
yggtttttggyggtgggyg

SEQ ID NO: 1995 - DNA, 35 bp, Artificial Sequence
  Description of Artificial Sequence: Synthetic oligonucleotide
yggaggtttygttaatggggtygtygtygtygtyg

SEQ ID NO: 1996 - DNA, 2 bp, Artificial Sequence
  Description of Artificial Sequence: Synthetic oligonucleotide
yg

SEQ ID NO: 1997 - DNA, 2 bp, Artificial Sequence
  Description of Artificial Sequence: Synthetic oligonucleotide
yg

SEQ ID NO: 1998 - DNA, 36 bp, Artificial Sequence
  Description of Artificial Sequence: Synthetic oligonucleotide
yggtttttttgtagttagyggattagygttagttyg

SEQ ID NO: 1999 - DNA, 2 bp, Artificial Sequence
  Description of Artificial Sequence: Synthetic oligonucleotide
yg

SEQ ID NO: 2000 - DNA, 42 bp, Artificial Sequence
  Description of Artificial Sequence: Synthetic oligonucleotide
ygtataatggtaaatgggattaggtaggygaaggtttagtyg

SEQ ID NO: 2001 - DNA, 2 bp, Artificial Sequence
  Description of Artificial Sequence: Synthetic oligonucleotide
yg

SEQ ID NO: 2002 - DNA, 2 bp, Artificial Sequence
  Description of Artificial Sequence: Synthetic oligonucleotide
yg

SEQ ID NO: 2003 - DNA, 18 bp, Artificial Sequence
  Description of Artificial Sequence: Synthetic oligonucleotide
yggygygggygttgygyg

SEQ ID NO: 2004 - DNA, 2 bp, Artificial Sequence
  Description of Artificial Sequence: Synthetic oligonucleotide
yg

SEQ ID NO: 2005 - DNA, 2 bp, Artificial Sequence
  Description of Artificial Sequence: Synthetic oligonucleotide
yg

SEQ ID NO: 2006 - DNA, 2 bp, Artificial Sequence
  Description of Artificial Sequence: Synthetic oligonucleotide
yg

SEQ ID NO: 2007 - DNA, 118 bp, Artificial Sequence
  Description of Artificial Sequence: Synthetic polynucleotide
ygygtygttgttttgttttaggtttyggtgyggttttaagttttagtttagggtttttaggtttttttaggyggyggtggyggtatttatttgggtygyggagtyggggtttggtayg

SEQ ID NO: 2008 - DNA, 22 bp, Artificial Sequence
  Description of Artificial Sequence: Synthetic oligonucleotide
ygttygygtygttygyggttyg

SEQ ID NO: 2009 - DNA, 2 bp, Artificial Sequence
  Description of Artificial Sequence: Synthetic oligonucleotide
yg

SEQ ID NO: 2010 - DNA, 2 bp, Artificial Sequence
  Description of Artificial Sequence: Synthetic oligonucleotide
yg

SEQ ID NO: 2011 - DNA, 2 bp, Artificial Sequence
  Description of Artificial Sequence: Synthetic oligonucleotide
yg

SEQ ID NO: 2012 - DNA, 2 bp, Artificial Sequence
  Description of Artificial Sequence: Synthetic oligonucleotide
yg

SEQ ID NO: 2013 - DNA, 31 bp, Artificial Sequence
  Description of Artificial Sequence: Synthetic oligonucleotide
ygtaatatattttagtatygagtttttgtyg

SEQ ID NO: 2014 - DNA, 2 bp, Artificial Sequence
  Description of Artificial Sequence: Synthetic oligonucleotide
yg

SEQ ID NO: 2015 - DNA, 2 bp, Artificial Sequence
  Description of Artificial Sequence: Synthetic oligonucleotide
yg

SEQ ID NO: 2016 - DNA, 2 bp, Artificial Sequence
  Description of Artificial Sequence: Synthetic oligonucleotide
yg

SEQ ID NO: 2017 - DNA, 2 bp, Artificial Sequence
  Description of Artificial Sequence: Synthetic oligonucleotide
yg

SEQ ID NO: 2018 - DNA, 2 bp, Artificial Sequence
  Description of Artificial Sequence: Synthetic oligonucleotide
yg

SEQ ID NO: 2019 - DNA, 2 bp, Artificial Sequence
  Description of Artificial Sequence: Synthetic oligonucleotide
yg

SEQ ID NO: 2020 - DNA, 2 bp, Artificial Sequence
  Description of Artificial Sequence: Synthetic oligonucleotide
yg

SEQ ID NO: 2021 - DNA, 2 bp, Artificial Sequence
  Description of Artificial Sequence: Synthetic oligonucleotide
yg

SEQ ID NO: 2022 - DNA, 2 bp, Artificial Sequence
  Description of Artificial Sequence: Synthetic oligonucleotide
yg

SEQ ID NO: 2023 - DNA, 69 bp, Artificial Sequence
  Description of Artificial Sequence: Synthetic oligonucleotide
ygtttttyggttygtttttttygagygtygtygataygttagttaaayggtygttggtygtttttagyg

SEQ ID NO: 2024 - DNA, 415 bp, Artificial Sequence
  Description of Artificial Sequence: Synthetic polynucleotide
ygtaygggttgggtttgggaatggggatygygaggttttagtatttygatgttttgaaagttttttygtttyggggatttgtttttgtgttgtagttggtaggggtygtttgaagtgggagtagygtttggagaaggygggaggagttyggttygggggaygggyggygggatagygggatttyggyggygyggtgygttttagggygtagyggyggtygtagatygagtttygggygyggtaagaggyggygggagtyggtggyggttyggtattatgygtygagggygtttgttggagatygttttgggatttatygtgtttttagygttttataygagttatggggyggaygttaatttggaggttgggaaygtgaaggaaattagagttagtygggttaagagaagaggyg

SEQ ID NO: 2025 - DNA, 2 bp, Artificial Sequence
  Description of Artificial Sequence: Synthetic oligonucleotide
yg

SEQ ID NO: 2026 - DNA, 2 bp, Artificial Sequence
  Description of Artificial Sequence: Synthetic oligonucleotide
yg

SEQ ID NO: 2027 - DNA, 2 bp, Artificial Sequence
  Description of Artificial Sequence: Synthetic oligonucleotide
yg

SEQ ID NO: 2028 - DNA, 2 bp, Artificial Sequence
  Description of Artificial Sequence: Synthetic oligonucleotide
yg

SEQ ID NO: 2029 - DNA, 2 bp, Artificial Sequence
  Description of Artificial Sequence: Synthetic oligonucleotide
yg

SEQ ID NO: 2030 - DNA, 62 bp, Artificial Sequence
  Description of Artificial Sequence: Synthetic oligonucleotide
ygtgygtattttaagygygtgygggagtgtgygaggygttgtgygagttagyggygggygyg

SEQ ID NO: 2031 - DNA, 2 bp, Artificial Sequence
  Description of Artificial Sequence: Synthetic oligonucleotide
yg

SEQ ID NO: 2032 - DNA, 2 bp, Artificial Sequence
  Description of Artificial Sequence: Synthetic oligonucleotide
yg

SEQ ID NO: 2033 - DNA, 2 bp, Artificial Sequence
  Description of Artificial Sequence: Synthetic oligonucleotide
yg

SEQ ID NO: 2034 - DNA, 2 bp, Artificial Sequence
  Description of Artificial Sequence: Synthetic oligonucleotide
yg

SEQ ID NO: 2035 - DNA, 20 bp, Artificial Sequence
  Description of Artificial Sequence: Synthetic oligonucleotide
yggaggtttttgygtttgyg

SEQ ID NO: 2036 - DNA, 69 bp, Artificial Sequence
  Description of Artificial Sequence: Synthetic oligonucleotide
ygttgygttttttygtttgttggygtttttgttttagygggattyggtagttaggggttttagggggyg

SEQ ID NO: 2037 - DNA, 2 bp, Artificial Sequence
  Description of Artificial Sequence: Synthetic oligonucleotide
yg

SEQ ID NO: 2038 - DNA, 318 bp, Artificial Sequence
  Description of Artificial Sequence: Synthetic polynucleotide
ygagaygyggtagatttttagagyggtttatttatttatygaagyggattttgggyggtttygggttgattygygttgttagggygyggattttatttygggygtattgttaggagaaggggtttttyggggyggygygtttygattttgggttttyggtgttygtagagggyggagattygyggygttttaggttatttattygtattttttygagttaaatttttagygtttattyggattygayggtttaagtattgatttttaggtaagagtygttttttttggtttttagggaattgatattatygygggayg

SEQ ID NO: 2039 - DNA, 27 bp, Artificial Sequence
  Description of Artificial Sequence: Synthetic oligonucleotide
ygygttttygttyggggagttattayg

SEQ ID NO: 2040 - DNA, 2 bp, Artificial Sequence
  Description of Artificial Sequence: Synthetic oligonucleotide
yg

SEQ ID NO: 2041 - DNA, 13 bp, Artificial Sequence
  Description of Artificial Sequence: Synthetic oligonucleotide
ygyggggagttyg

SEQ ID NO: 2042 - DNA, 189 bp, Artificial Sequence
  Description of Artificial Sequence: Synthetic polynucleotide
ygtaatttttagttaaagttatygygggyggattatggtttagggygttagaggggttagaggtaygggaagaggaaaagayggttaattgggaaaaaaagagaaaaygaaagaaaagttaaaygatgagtttttataaggaggayggagtgaatagtttgtgttagaaggttttgtatatygttatyg

SEQ ID NO: 2043 - DNA, 2 bp, Artificial Sequence
  Description of Artificial Sequence: Synthetic oligonucleotide
yg

SEQ ID NO: 2044 - DNA, 2 bp, Artificial Sequence
  Description of Artificial Sequence: Synthetic oligonucleotide
yg

SEQ ID NO: 2045 - DNA, 13 bp, Artificial Sequence
  Description of Artificial Sequence: Synthetic oligonucleotide
ygtttagttttyg

SEQ ID NO: 2046 - DNA, 51 bp, Artificial Sequence
  Description of Artificial Sequence: Synthetic oligonucleotide
ygaaggygaggtygtttagttygtattttattttaygtayggtataygtyg

SEQ ID NO: 2047 - DNA, 289 bp, Artificial Sequence
  Description of Artificial Sequence: Synthetic polynucleotide
yggtagtgtttttttaagaaggggtaaaaaaatttgtttatggttatttttttttygttttattttttttttttttgatagtttyggttttggttgttygagtygggggtgtgttttyggttttttttagatttgggyggggggygggaggagtgagygatttgggaagtttygggggtggagagggggygtttyggggtttgggggygaygtggatattttttttggagtayggyggtgygtttgggatttgaaggaagggtygaaggaagyggggtgygggygggyg

SEQ ID NO: 2048 - DNA, 2 bp, Artificial Sequence
  Description of Artificial Sequence: Synthetic oligonucleotide
yg

SEQ ID NO: 2049 - DNA, 165 bp, Artificial Sequence
  Description of Artificial Sequence: Synthetic polynucleotide
ygttttgggaagygtagaggygggggtgttgttygygttggggagtaygtgaggggatatttagggattgttygygygaatggtttttaaygtatgygttttattttatattttatagtygttatgaygatygggaggttygtaayggttgyggggataagttyg

SEQ ID NO: 2050 - DNA, 21 bp, Artificial Sequence
  Description of Artificial Sequence: Synthetic oligonucleotide
ygaagtggtgtaggggyggyg

SEQ ID NO: 2051 - DNA, 2 bp, Artificial Sequence
  Description of Artificial Sequence: Synthetic oligonucleotide
yg

SEQ ID NO: 2052 - DNA, 2 bp, Artificial Sequence
  Description of Artificial Sequence: Synthetic oligonucleotide
yg

SEQ ID NO: 2053 - DNA, 2 bp, Artificial Sequence
  Description of Artificial Sequence: Synthetic oligonucleotide
yg

SEQ ID NO: 2054 - DNA, 159 bp, Artificial Sequence
  Description of Artificial Sequence: Synthetic polynucleotide
ygtgttygtggatgygtagygttaygyggttgtttattatttagygatataygyggtttayggagaaggtgaggtygtagygggtygatttgtygyggtttaggyggtygtygtyggygttgtttatgttgtagagggatagtgyggttagygtagtyg

SEQ ID NO: 2055 - DNA, 2 bp, Artificial Sequence
  Description of Artificial Sequence: Synthetic oligonucleotide
yg

SEQ ID NO: 2056 - DNA, 129 bp, Artificial Sequence
  Description of Artificial Sequence: Synthetic polynucleotide
ygtgygttygagtggggtatttgttygaggtyggggattgtgaatygaaagattttatttagttttgttgtttttttggtattgygatttgggggygggttattttatttttttgaatttygtttttyg

SEQ ID NO: 2057 - DNA, 2 bp, Artificial Sequence
  Description of Artificial Sequence: Synthetic oligonucleotide
yg

SEQ ID NO: 2058 - DNA, 120 bp, Artificial Sequence
  Description of Artificial Sequence: Synthetic polynucleotide
ygttttttttttttttttttttttttttttttttttttttttttttttttttttttggtattatagagttgttttgaaaatagaagatagagggagtttyggagttygttatttttagyg

SEQ ID NO: 2059 - DNA, 2 bp, Artificial Sequence
  Description of Artificial Sequence: Synthetic oligonucleotide
yg

SEQ ID NO: 2060 - DNA, 171 bp, Artificial Sequence
  Description of Artificial Sequence: Synthetic polynucleotide
ygttyggttgttgtatttgttagtgttgggtttaggttgagaggygatttttagtttttataataatgtttygggttttttggtttgggttttygtagygttygattgatygttagygataygaygagaaygaggatttgtyggaygtggaggagatygttagygttygyg

SEQ ID NO: 2061 - DNA, 2 bp, Artificial Sequence
  Description of Artificial Sequence: Synthetic oligonucleotide
yg

SEQ ID NO: 2062 - DNA, 2 bp, Artificial Sequence
  Description of Artificial Sequence: Synthetic oligonucleotide
yg

SEQ ID NO: 2063 - DNA, 2 bp, Artificial Sequence
  Description of Artificial Sequence: Synthetic oligonucleotide
yg

SEQ ID NO: 2064 - DNA, 64 bp, Artificial Sequence
  Description of Artificial Sequence: Synthetic oligonucleotide
yggggaaagttgggygygygagtygaggttgttgtttatttgtagtygygtygtttatttgtyg

SEQ ID NO: 2065 - DNA, 2 bp, Artificial Sequence
  Description of Artificial Sequence: Synthetic oligonucleotide
yg

SEQ ID NO: 2066 - DNA, 2 bp, Artificial Sequence
  Description of Artificial Sequence: Synthetic oligonucleotide
yg

SEQ ID NO: 2067 - DNA, 2 bp, Artificial Sequence
  Description of Artificial Sequence: Synthetic oligonucleotide
yg

SEQ ID NO: 2068 - DNA, 2 bp, Artificial Sequence
  Description of Artificial Sequence: Synthetic oligonucleotide
yg

SEQ ID NO: 2069 - DNA, 16 bp, Artificial Sequence
  Description of Artificial Sequence: Synthetic oligonucleotide
ygagttttgyggagyg

SEQ ID NO: 2070 - DNA, 2 bp, Artificial Sequence
  Description of Artificial Sequence: Synthetic oligonucleotide
yg

SEQ ID NO: 2071 - DNA, 2 bp, Artificial Sequence
  Description of Artificial Sequence: Synthetic oligonucleotide
yg

SEQ ID NO: 2072 - DNA, 2 bp, Artificial Sequence
  Description of Artificial Sequence: Synthetic oligonucleotide
yg

SEQ ID NO: 2073 - DNA, 18 bp, Artificial Sequence
  Description of Artificial Sequence: Synthetic oligonucleotide
ygyggtygagggaatgyg

SEQ ID NO: 2074 - DNA, 118 bp, Artificial Sequence
  Description of Artificial Sequence: Synthetic polynucleotide
ygygtttttgtttttgggtagatttttttatttgtgtattttggtttttttatttagtaaagagatgtgygaagtgtgygtttggagaygagtygtttyggtgatttttattygttyg

SEQ ID NO: 2075 - DNA, 2 bp, Artificial Sequence
  Description of Artificial Sequence: Synthetic oligonucleotide
yg

SEQ ID NO: 2076 - DNA, 2 bp, Artificial Sequence
  Description of Artificial Sequence: Synthetic oligonucleotide
yg

SEQ ID NO: 2077 - DNA, 2 bp, Artificial Sequence
  Description of Artificial Sequence: Synthetic oligonucleotide
yg

SEQ ID NO: 2078 - DNA, 2 bp, Artificial Sequence
  Description of Artificial Sequence: Synthetic oligonucleotide
yg

SEQ ID NO: 2079 - DNA, 2 bp, Artificial Sequence
  Description of Artificial Sequence: Synthetic oligonucleotide
yg

SEQ ID NO: 2080 - DNA, 22 bp, Artificial Sequence
  Description of Artificial Sequence: Synthetic oligonucleotide
yggatttttttggggyggygyg

SEQ ID NO: 2081 - DNA, 112 bp, Artificial Sequence
  Description of Artificial Sequence: Synthetic polynucleotide
ygaggtagggaggygttttygtagtttttgattttataattygygygygtgtgtatygagtygygggtatatygygaatatatatatatatatatatattygtgygttttyg

SEQ ID NO: 2082 - DNA, 109 bp, Artificial Sequence
  Description of Artificial Sequence: Synthetic polynucleotide
ygtggaggagtggggttaggtggttattattagtatgtttattygttaygttygtaygtagtttttgagttttatttagaaygtaagtgggtttagtttaggtagagyg

SEQ ID NO: 2083 - DNA, 2 bp, Artificial Sequence
  Description of Artificial Sequence: Synthetic oligonucleotide
yg

SEQ ID NO: 2084 - DNA, 2 bp, Artificial Sequence
  Description of Artificial Sequence: Synthetic oligonucleotide
yg

SEQ ID NO: 2085 - DNA, 2 bp, Artificial Sequence
  Description of Artificial Sequence: Synthetic oligonucleotide
yg

SEQ ID NO: 2086 - DNA, 431 bp, Artificial Sequence
  Description of Artificial Sequence: Synthetic polynucleotide
ygtgtttttttataggttttatttgtaattgagaygaatgattatagtggggygggaaggagtagttgtttattaattaatttttaattaaaagtgtttttygttttygggtgattaaagagaaatatygttygttgggygatattgattyggatggaatttatttgttaaygttyggaggaatggttttttygtttatygygyggtygggattgttttggtttttttyggtttgagtygtyggygagtgatyggygagtttgyggttaggtygggttgygygaggtggggttgaygttagagtttttttygttttaagtygygtatatttgatttgaygggttygygygattygtttttttttttttttttttygtaaaatatgtatttttgtygtygttgygaggtygttyggttttagagttttttyg

SEQ ID NO: 2087 - DNA, 2 bp, Artificial Sequence
  Description of Artificial Sequence: Synthetic oligonucleotide
yg

SEQ ID NO: 2088 - DNA, 40 bp, Artificial Sequence
  Description of Artificial Sequence: Synthetic oligonucleotide
ygtttttatttttttagyggagttatagyggggygyggyg

SEQ ID NO: 2089 - DNA, 2 bp, Artificial Sequence
  Description of Artificial Sequence: Synthetic oligonucleotide
yg

SEQ ID NO: 2090 - DNA, 22 bp, Artificial Sequence
  Description of Artificial Sequence: Synthetic oligonucleotide
ygtggttttgaatttgttggyg

SEQ ID NO: 2091 - DNA, 2 bp, Artificial Sequence
  Description of Artificial Sequence: Synthetic oligonucleotide
yg

SEQ ID NO: 2092 - DNA, 47 bp, Artificial Sequence
  Description of Artificial Sequence: Synthetic oligonucleotide
ygagttggagaattatagtatgtattgygtgtaatgtaagatgttyg

SEQ ID NO: 2093 - DNA, 24 bp, Artificial Sequence
  Description of Artificial Sequence: Synthetic oligonucleotide
ygtgttagaagttttttaayggyg

SEQ ID NO: 2094 - DNA, 2 bp, Artificial Sequence
  Description of Artificial Sequence: Synthetic oligonucleotide
yg

SEQ ID NO: 2095 - DNA, 45 bp, Artificial Sequence
  Description of Artificial Sequence: Synthetic oligonucleotide
ygagggttttagttaattagtttgttgggtgggtttggagtttyg

SEQ ID NO: 2096 - DNA, 2 bp, Artificial Sequence
  Description of Artificial Sequence: Synthetic oligonucleotide
yg

SEQ ID NO: 2097 - DNA, 258 bp, Artificial Sequence
  Description of Artificial Sequence: Synthetic polynucleotide
ygygtatttgtttaggygttgyggtttagygygttttaatttttagttygggyggagagygggggygggattgaagtatygtgttttttaaagtattttttygtygtyggtagttttggtttygtaaatgttttagygygtttaggygtaygtagagattggygyggtagttttygggttaayggtaygygagtaaagttggttggygatttgggataygtagtagaagttgaggttgtatygattttygtygtttyg

SEQ ID NO: 2098 - DNA, 45 bp, Artificial Sequence
  Description of Artificial Sequence: Synthetic oligonucleotide
ygygatygtaagttygagtttaggtttttyggagtygttagggyg

SEQ ID NO: 2099 - DNA, 7 bp, Artificial Sequence
  Description of Artificial Sequence: Synthetic oligonucleotide
ygtygyg

SEQ ID NO: 2100 - DNA, 4 bp, Artificial Sequence
  Description of Artificial Sequence: Synthetic oligonucleotide
ygyg

SEQ ID NO: 2101 - DNA, 67 bp, Artificial Sequence
  Description of Artificial Sequence: Synthetic oligonucleotide
ygaggtygtttygttggttggtgtaagaattagtttgtaatttaagttttgagttgttggygtttyg

SEQ ID NO: 2102 - DNA, 43 bp, Artificial Sequence
  Description of Artificial Sequence: Synthetic oligonucleotide
ygttygagttttygttgttgtygttgtygttgygggttagtyg

SEQ ID NO: 2103 - DNA, 2 bp, Artificial Sequence
  Description of Artificial Sequence: Synthetic oligonucleotide
yg

SEQ ID NO: 2104 - DNA, 2 bp, Artificial Sequence
  Description of Artificial Sequence: Synthetic oligonucleotide
yg

SEQ ID NO: 2105 - DNA, 113 bp, Artificial Sequence
  Description of Artificial Sequence: Synthetic polynucleotide
ygttygagattygggagagattaggggttygtaaagtagaagagtagatttagaaagaaaaaaaaaaaagygagaagtgygagaaaaatatattgaatttagttaaatatayg

SEQ ID NO: 2106 - DNA, 4 bp, Artificial Sequence
  Description of Artificial Sequence: Synthetic oligonucleotide
ygyg

SEQ ID NO: 2107 - DNA, 2 bp, Artificial Sequence
  Description of Artificial Sequence: Synthetic oligonucleotide
yg

SEQ ID NO: 2108 - DNA, 84 bp, Artificial Sequence
  Description of Artificial Sequence: Synthetic oligonucleotide
ygggttttggggygttggtgttygygtagttttagtygttttygtagttatygtygttyggtttygyggaggyggygygtagyg

SEQ ID NO: 2109 - DNA, 2 bp, Artificial Sequence
  Description of Artificial Sequence: Synthetic oligonucleotide
yg

SEQ ID NO: 2110 - DNA, 48 bp, Artificial Sequence
  Description of Artificial Sequence: Synthetic oligonucleotide
ygtaggttaagatttggttttagaattatygttataagatgaagygyg

SEQ ID NO: 2111 - DNA, 228 bp, Artificial Sequence
  Description of Artificial Sequence: Synthetic polynucleotide
ygtygttattaygtygygygtygtatttygygttaagaatggggyggttaagttgtttaagtygttygtygtygtygtygtygtygyggtygaggygttyggygtyggygygggtatggagygttygtagagtygttttagtttgttygtttttttygaggygttygttatttatttttygtgtatgaattttttygaygaygaggaygtaggtaagygygyggttyg

SEQ ID NO: 2112 - DNA, 47 bp, Artificial Sequence
  Description of Artificial Sequence: Synthetic oligonucleotide
ygttggtgygtggyggygtggagygygtttgttayggttaaggtgyg

SEQ ID NO: 2113 - DNA, 185 bp, Artificial Sequence
  Description of Artificial Sequence: Synthetic polynucleotide
ygtygtttttyggtttagagtttttattttyggtttgtgagtttgyggygttggtggagttyggttttaggaagaggagtttattyggttttttttgattggatagtagygaggttttatygggygttttygyggtttaaaatygaagygggggygagggggaggtagagttygttttttgygyg

SEQ ID NO: 2114 - DNA, 216 bp, Artificial Sequence
  Description of Artificial Sequence: Synthetic polynucleotide
yggygttttatttattggygtttayggttygtaggtaaagygtggaaggagttgaaygyggyggagaagyggtttttygtggaggaagtygaayggttgygygtgtagtatttgygygattattttaattataagtatyggtygygtygtaagaagtaggygygtaaggttyggyggttggagttyggttttttgttttygggattagygttttyg

SEQ ID NO: 2115 - DNA, 344 bp, Artificial Sequence
  Description of Artificial Sequence: Synthetic polynucleotide
ygaataatagaaattgttaattttaataatttagagtaggttaaygaggttttgttttttygattygaattaaaggtttttygtttygtgygttgttaygagyggtgttttttggggttttaatgtagygagttgtgttygaggggttyggaaggygtaagttgggtagygatatggggaaygyggagygggtttyggggtttyggagttttgggttagtatttaygttgttgttgttygtygyggygttattggtygtgtyggaygtattygggygttttttygaggaggaygaggagttagtggtgtyggagttggagygygtttygggataygggattayg

SEQ ID NO: 2116 - DNA, 28 bp, Artificial Sequence
  Description of Artificial Sequence: Synthetic oligonucleotide
ygtttyggtttggttgttaaatagaayg

SEQ ID NO: 2117 - DNA, 124 bp, Artificial Sequence
  Description of Artificial Sequence: Synthetic polynucleotide
yggygygtayggttaaggtaygygygttggtataygygggygyggataygygyggatatataygtgygggataygttttttttygayggyggygttaatttttyggtaagtttagygttttayg

SEQ ID NO: 2118 - DNA, 80 bp, Artificial Sequence
  Description of Artificial Sequence: Synthetic oligonucleotide
ygaggtgtaggyggygygggygtttatygtgagygtygtgttgttggygttygttgygtttttygtgattttggygggyg

SEQ ID NO: 2119 - DNA, 62 bp, Artificial Sequence
  Description of Artificial Sequence: Synthetic oligonucleotide
ygaggygtggaggggtagtygyggyggggygatttttatttgtttattgyggggtttgttyg

SEQ ID NO: 2120 - DNA, 165 bp, Artificial Sequence
  Description of Artificial Sequence: Synthetic polynucleotide
ygttatttgatttygttattaagtttaaggtgttttggatttayggtaagtatagygtygttgtagttggtygtgygtttttattatygtygttaggtttygaggtygygtttagttttagtaagaggaaayggaygtttagygataaatyggygtatayggtyg

SEQ ID NO: 2121 - DNA, 43 bp, Artificial Sequence
  Description of Artificial Sequence: Synthetic oligonucleotide
ygygtttygaggaagygtyggaattattagaagtatagggayg

SEQ ID NO: 2122 - DNA, 86 bp, Artificial Sequence
  Description of Artificial Sequence: Synthetic oligonucleotide
ygttatttttaattagttgtaagtygagttgtttatttgggatygggtyggttyggygggtttggttttyggygaaggyggyggyg

SEQ ID NO: 2123 - DNA, 23 bp, Artificial Sequence
  Description of Artificial Sequence: Synthetic oligonucleotide
ygtttttttattttaygggttyg

SEQ ID NO: 2124 - DNA, 2 bp, Artificial Sequence
  Description of Artificial Sequence: Synthetic oligonucleotide
yg

SEQ ID NO: 2125 - DNA, 99 bp, Artificial Sequence
  Description of Artificial Sequence: Synthetic oligonucleotide
yggtaggagtagtttatagttaggagygttttttygtttttaaygtygygtttttttttttaaaayggtttaaaaaaatttattaattgtatggtygyg

SEQ ID NO: 2126 - DNA, 73 bp, Artificial Sequence
  Description of Artificial Sequence: Synthetic oligonucleotide
ygattatttttgtgtttttaggagtttattttgggyggtagggaggygttgygtggggtttaygagttttayg

SEQ ID NO: 2127 - DNA, 2 bp, Artificial Sequence
  Description of Artificial Sequence: Synthetic oligonucleotide
yg

SEQ ID NO: 2128 - DNA, 52 bp, Artificial Sequence
  Description of Artificial Sequence: Synthetic oligonucleotide
ygtttttaggattttygttygtttttttttgattyggtttttgttygtttyg

SEQ ID NO: 2129 - DNA, 50 bp, Artificial Sequence
  Description of Artificial Sequence: Synthetic oligonucleotide
ygtagtygtygygttygtatttgattatggagtgygtttttttgttygyg

SEQ ID NO: 2130 - DNA, 50 bp, Artificial Sequence
  Description of Artificial Sequence: Synthetic oligonucleotide
ygaaygtagagtttataygtggattttygygtttgtgatgtttygattyg

SEQ ID NO: 2131 - DNA, 2 bp, Artificial Sequence
  Description of Artificial Sequence: Synthetic oligonucleotide
yg

SEQ ID NO: 2132 - DNA, 2 bp, Artificial Sequence
  Description of Artificial Sequence: Synthetic oligonucleotide
yg

SEQ ID NO: 2133 - DNA, 52 bp, Artificial Sequence
  Description of Artificial Sequence: Synthetic oligonucleotide
ygtttggggtttaygygagtygygagtttttgtttgtttttgygttatttyg

SEQ ID NO: 2134 - DNA, 2 bp, Artificial Sequence
  Description of Artificial Sequence: Synthetic oligonucleotide
yg

SEQ ID NO: 2135 - DNA, 2 bp, Artificial Sequence
  Description of Artificial Sequence: Synthetic oligonucleotide
yg

SEQ ID NO: 2136 - DNA, 2 bp, Artificial Sequence
  Description of Artificial Sequence: Synthetic oligonucleotide
yg

SEQ ID NO: 2137 - DNA, 138 bp, Artificial Sequence
  Description of Artificial Sequence: Synthetic polynucleotide
ygyggygtttttagttgttttttattygtttygttygttagtttttttttygygygatggtttyggygttgagttatgtttttaagtttaagtttttygtgattttgttygttatttygtttttgttgttgttattyg

SEQ ID NO: 2138 - DNA, 2 bp, Artificial Sequence
  Description of Artificial Sequence: Synthetic oligonucleotide
yg

SEQ ID NO: 2139 - DNA, 2 bp, Artificial Sequence
  Description of Artificial Sequence: Synthetic oligonucleotide
yg

SEQ ID NO: 2140 - DNA, 2 bp, Artificial Sequence
  Description of Artificial Sequence: Synthetic oligonucleotide
yg

SEQ ID NO: 2141 - DNA, 1017 bp, Artificial Sequence
  Description of Artificial Sequence: Synthetic polynucleotide
cgtttatttgagttttaaaagttgttgaatttatatggttacgtttcggggagcggggttttagatttggttcgtttaggttatttgcgcggcgttcgcgttcgttcgttttcgtttcgcggcgtcggttttcggttttcggttcgtcgtttttcgtcgttcgtcggtcgcggggcgtatagcgagttagagcgcggtcgcgcggggttttatgtcggtcggcgcgtcgtcgtcgttggggcgtatggtttaggttgggcggttcgcgggggcgtatatttttcggtcggggcgcggggttcgcggtttttttcgtcggcggtatagcgaaggcggtagcgaggcggggcgtgtttcggcgttgtcgcggcgtagtaaagggttggggagtcgcggtttcgtttttcggggcggcgaggagggaggtcggcggcgttgtcgtttacggtgcgtgtttttcggcgcgcggtttttgtttttagtcggagtttcgcgtcgatggggcggcgttgtttagggtttggggtgacgcgacgcggacggacgcgagtttttttcgcgttgtcgggtcggggggttttgttagaggtttcgtcgtcgatcggcgttatttaagttgttcgggggtttcgtttgagcgttcgttttgtagacggtcgcggttcggagattggtaggaggcgggtacgagaggcgcgcggggcgagggcgtcgtggagcgcggggcgtggggacgcgcggcggcggcgtcgcgcggaggaggcgcgcggggatttcggggtttcgtcgttcgcgtttatcgcgttcgtcgtagagtcgttcgcgttgtttagtcgttttttttttcgcgtttgttttttcgcgcgttcgttttcgtttttcggagtcggttttaatttcgttcgttcggttcggtttacgttattcgtttttttcgtttttcgaacgggagttcgagtttttggtttggtttcggtttttgttcgtcgttttattttgcgggggtcggggtcgtcg

SEQ ID NO: 2142 - DNA, 166 bp, Artificial Sequence
  Description of Artificial Sequence: Synthetic polynucleotide
cgcgcgttgagggtgcggtgagttgagtgcggggttaagtatgttttggcgtcgatttcgtttaggggtttaggatttggcgtttaaggggttttttggcgacggagattttcgacgtagtagcgattcgcggttgtttaagttgatttcgttcgcgtttcgagcg

SEQ ID NO: 2143 - DNA, 2 bp, Artificial Sequence
  Description of Artificial Sequence: Synthetic oligonucleotide
cg

SEQ ID NO: 2144 - DNA, 2 bp, Artificial Sequence
  Description of Artificial Sequence: Synthetic oligonucleotide
cg

SEQ ID NO: 2145 - DNA, 2 bp, Artificial Sequence
  Description of Artificial Sequence: Synthetic oligonucleotide
cg

SEQ ID NO: 2146 - DNA, 2 bp, Artificial Sequence
  Description of Artificial Sequence: Synthetic oligonucleotide
cg

SEQ ID NO: 2147 - DNA, 2 bp, Artificial Sequence
  Description of Artificial Sequence: Synthetic oligonucleotide
cg

SEQ ID NO: 2148 - DNA, 2 bp, Artificial Sequence
  Description of Artificial Sequence: Synthetic oligonucleotide
cg

SEQ ID NO: 2149 - DNA, 14 bp, Artificial Sequence
  Description of Artificial Sequence: Synthetic oligonucleotide
cgcgttgagacgcg

SEQ ID NO: 2150 - DNA, 2 bp, Artificial Sequence
  Description of Artificial Sequence: Synthetic oligonucleotide
cg

SEQ ID NO: 2151 - DNA, 2 bp, Artificial Sequence
  Description of Artificial Sequence: Synthetic oligonucleotide
cg

SEQ ID NO: 2152 - DNA, 2 bp, Artificial Sequence
  Description of Artificial Sequence: Synthetic oligonucleotide
cg

SEQ ID NO: 2153 - DNA, 125 bp, Artificial Sequence
  Description of Artificial Sequence: Synthetic polynucleotide
cgtttcgcgttttcgtttcgttatgtttttgttgttggggttgtgtttggggttgtttttgtgtgtggggtcgtaggaagaggcgtagagttggggttatttttcggagtaggtaagtggagtcg

SEQ ID NO: 2154 - DNA, 2 bp, Artificial Sequence
  Description of Artificial Sequence: Synthetic oligonucleotide
cg

SEQ ID NO: 2155 - DNA, 131 bp, Artificial Sequence
  Description of Artificial Sequence: Synthetic polynucleotide
cgtgcgtagtttagtttttttcggacgttttcgttttcgttcgggtatatcgtgtttcgtatcgaggtagagaggggtacgcggattttagtttttgcgagtttttttgttcgtcgttattttatatttcg

SEQ ID NO: 2156 - DNA, 94 bp, Artificial Sequence
  Description of Artificial Sequence: Synthetic oligonucleotide
cgggtcgcgtgggtttgggcgcgtcgtggtgggtaagcggggttagcggagcgggaattcgtatatttttcgagcggagtcgaggataggttcg

SEQ ID NO: 2157 - DNA, 2 bp, Artificial Sequence
  Description of Artificial Sequence: Synthetic oligonucleotide
cg

SEQ ID NO: 2158 - DNA, 2 bp, Artificial Sequence
  Description of Artificial Sequence: Synthetic oligonucleotide
cg

SEQ ID NO: 2159 - DNA, 27 bp, Artificial Sequence
  Description of Artificial Sequence: Synthetic oligonucleotide
cgcgtaagtatttttttttttatcgcg

SEQ ID NO: 2160 - DNA, 164 bp, Artificial Sequence
  Description of Artificial Sequence: Synthetic polynucleotide
cgcgatttttttcgggaggtgtttgcgaaggcggttttgtcgcggtgggggtggggaggttagggtttcggatcgttggagttggggtcgtagttagtttttggcgagtgttttttggttgttgtcgtaggggtttgttttttcggattttttttttaatttcg

SEQ ID NO: 2161 - DNA, 2 bp, Artificial Sequence
  Description of Artificial Sequence: Synthetic oligonucleotide
cg

SEQ ID NO: 2162 - DNA, 2 bp, Artificial Sequence
  Description of Artificial Sequence: Synthetic oligonucleotide
cg

SEQ ID NO: 2163 - DNA, 68 bp, Artificial Sequence
  Description of Artificial Sequence: Synthetic oligonucleotide
cgtatttgaaaatttcgtcgtagttattttttttttatgggaaagtttcgatttcggcgggtttagcg

SEQ ID NO: 2164 - DNA, 508 bp, Artificial Sequence
  Description of Artificial Sequence: Synthetic polynucleotide
cgtaatttgggcgcgttagtataaattcggttttcggtttttttgaagttagttaagttcgtatagggtttttagcgtttggaaatttgagaggcgtggaagggtggggagtttcgcgaagtttttagtttttgggtgtttttcggtttcgcgggggagcgggtttggagttaaatcggtcggtcgtaggttggagtagcgggcgtcggagcgcgcggtggggatgttcgaaaaggagttagaggtttagtcggagagttcgagaatacgagggatgtttattttgtaatatggttttaagtttttttttgtttacgcggaagcgtttttcgttttatttcgggttgtgtagggtcgtttcggcgattaagtcgttttcggagtcgggtattggggagtcggtgttgcgttcgttgttggagtcggggttcgattgcgtcgttaggtagtcgggttttttttgggcggttatggtgggcgcgtagcgttcgggttttcgttgtcgtcg

SEQ ID NO: 2165 - DNA, 2 bp, Artificial Sequence
  Description of Artificial Sequence: Synthetic oligonucleotide
cg

SEQ ID NO: 2166 - DNA, 2 bp, Artificial Sequence
  Description of Artificial Sequence: Synthetic oligonucleotide
cg

SEQ ID NO: 2167 - DNA, 2 bp, Artificial Sequence
  Description of Artificial Sequence: Synthetic oligonucleotide
cg

SEQ ID NO: 2168 - DNA, 2 bp, Artificial Sequence
  Description of Artificial Sequence: Synthetic oligonucleotide
cg

SEQ ID NO: 2169 - DNA, 4 bp, Artificial Sequence
  Description of Artificial Sequence: Synthetic oligonucleotide
cgcg

SEQ ID NO: 2170 - DNA, 2 bp, Artificial Sequence
  Description of Artificial Sequence: Synthetic oligonucleotide
cg

SEQ ID NO: 2171 - DNA, 2 bp, Artificial Sequence
  Description of Artificial Sequence: Synthetic oligonucleotide
cg

SEQ ID NO: 2172 - DNA, 9 bp, Artificial Sequence
  Description of Artificial Sequence: Synthetic oligonucleotide
cgttgtacg

SEQ ID NO: 2173 - DNA, 2 bp, Artificial Sequence
  Description of Artificial Sequence: Synthetic oligonucleotide
cg

SEQ ID NO: 2174 - DNA, 2 bp, Artificial Sequence
  Description of Artificial Sequence: Synthetic oligonucleotide
cg

SEQ ID NO: 2175 - DNA, 396 bp, Artificial Sequence
  Description of Artificial Sequence: Synthetic polynucleotide
cgggcggcggcggttcgttgtatatatttcggcgtatttcgttaggtcgcgtatagcgtttcgagtttaggcgttttttcgtttttttttcgcgttttgcggcggcggcggcggcggtagtagtagtagtaatatggttgttgatgggtgtttggggtggcgttggcggcgggaggagttttttcgagtttttgcgtcggttgttcgttgttagttatggtaaatggtggcggcggcggcggcggtagtagcggcggcggcggcggcggcggaggtagtagttttagaatgagtagtaatatttacgcgaattattttagtttagacgcgttttttttttttttttttttttttttttttttttttttttttttttttttttttttttcgtttttg

SEQ ID NO: 2176 - DNA, 2 bp, Artificial Sequence
  Description of Artificial Sequence: Synthetic oligonucleotide
cg

SEQ ID NO: 2177 - DNA, 70 bp, Artificial Sequence
  Description of Artificial Sequence: Synthetic oligonucleotide
cgtgatttttttatttagagattatttagggagatgttttggatgggataagtagataaatggcggttcg

SEQ ID NO: 2178 - DNA, 2 bp, Artificial Sequence
  Description of Artificial Sequence: Synthetic oligonucleotide
cg

SEQ ID NO: 2179 - DNA, 68 bp, Artificial Sequence
  Description of Artificial Sequence: Synthetic oligonucleotide
cgggagttcggtcgcgttttttagtttcggtattcgcgtttagcgcgtcgcgtttcgcgtttttcgcg

SEQ ID NO: 2180 - DNA, 88 bp, Artificial Sequence
  Description of Artificial Sequence: Synthetic oligonucleotide
cgtttcgcgtatcgttttcgttttagtttttagtggcgcggcgttttttcgcgatattcgcgggtttttaggagcgagtcgattttcg

SEQ ID NO: 2181 - DNA, 2 bp, Artificial Sequence
  Description of Artificial Sequence: Synthetic oligonucleotide
cg

SEQ ID NO: 2182 - DNA, 2 bp, Artificial Sequence
  Description of Artificial Sequence: Synthetic oligonucleotide
cg

SEQ ID NO: 2183 - DNA, 87 bp, Artificial Sequence
  Description of Artificial Sequence: Synthetic oligonucleotide
cgggggttttttaggtcgcggcgtttttcgtttttttttatttttcgattttttttcgtttttaaaatgaggaaacggagtaattcg

SEQ ID NO: 2184 - DNA, 45 bp, Artificial Sequence
  Description of Artificial Sequence: Synthetic oligonucleotide
cgtggtaaattcgggtttcgacgatagaggtagcgtagaagttcg

SEQ ID NO: 2185 - DNA, 2 bp, Artificial Sequence
  Description of Artificial Sequence: Synthetic oligonucleotide
cg

SEQ ID NO: 2186 - DNA, 173 bp, Artificial Sequence
  Description of Artificial Sequence: Synthetic polynucleotide
cgggtcgtggttgatatcgcggagaagttaggatttttatagtttttgttagatttgaaagtaagttggaaatcgatagttgttttagttgttttagattttaatttggtttgggttttttttttttttatttgaaaatagatttagggtaatgtttaagagaattttaatcg

SEQ ID NO: 2187 - DNA, 2 bp, Artificial Sequence
  Description of Artificial Sequence: Synthetic oligonucleotide
cg

SEQ ID NO: 2188 - DNA, 48 bp, Artificial Sequence
  Description of Artificial Sequence: Synthetic oligonucleotide
cggggtttttgtttttggttgtagttggagttttgcgtttcgttttcg

SEQ ID NO: 2189 - DNA, 2 bp, Artificial Sequence
  Description of Artificial Sequence: Synthetic oligonucleotide
cg

SEQ ID NO: 2190 - DNA, 2 bp, Artificial Sequence
  Description of Artificial Sequence: Synthetic oligonucleotide
cg

SEQ ID NO: 2191 - DNA, 36 bp, Artificial Sequence
  Description of Artificial Sequence: Synthetic oligonucleotide
cggggtagagggggcgggaagttggcgttacggtcg

SEQ ID NO: 2192 - DNA, 2 bp, Artificial Sequence
  Description of Artificial Sequence: Synthetic oligonucleotide
cg

SEQ ID NO: 2193 - DNA, 2 bp, Artificial Sequence
  Description of Artificial Sequence: Synthetic oligonucleotide
cg

SEQ ID NO: 2194 - DNA, 2 bp, Artificial Sequence
  Description of Artificial Sequence: Synthetic oligonucleotide
cg

SEQ ID NO: 2195 - DNA, 2 bp, Artificial Sequence
  Description of Artificial Sequence: Synthetic oligonucleotide
cg

SEQ ID NO: 2196 - DNA, 2 bp, Artificial Sequence
  Description of Artificial Sequence: Synthetic oligonucleotide
cg

SEQ ID NO: 2197 - DNA, 97 bp, Artificial Sequence
  Description of Artificial Sequence: Synthetic oligonucleotide
cgattcgggagggaaaatttttgttttttttcggggtttgttttgttcgttttttaaattcgttttatatttttttcgattttcgtttttgtaagcg

SEQ ID NO: 2198 - DNA, 2 bp, Artificial Sequence
  Description of Artificial Sequence: Synthetic oligonucleotide
cg

SEQ ID NO: 2199 - DNA, 2 bp, Artificial Sequence
  Description of Artificial Sequence: Synthetic oligonucleotide
cg

SEQ ID NO: 2200 - DNA, 67 bp, Artificial Sequence
  Description of Artificial Sequence: Synthetic oligonucleotide
cgatgtttgtgtttgtggttttttgaggtagtgggagtggcgtgtgaaggattgtgagagtttggcg

SEQ ID NO: 2201 - DNA, 2 bp, Artificial Sequence
  Description of Artificial Sequence: Synthetic oligonucleotide
cg

SEQ ID NO: 2202 - DNA, 29 bp, Artificial Sequence
  Description of Artificial Sequence: Synthetic oligonucleotide
cgggtgattgttgattttttgttttgtcg

SEQ ID NO: 2203 - DNA, 49 bp, Artificial Sequence
  Description of Artificial Sequence: Synthetic oligonucleotide
cgaggtttcgcgtattttcgttcgcgttttagttatttaggttcggtcg

SEQ ID NO: 2204 - DNA, 188 bp, Artificial Sequence
  Description of Artificial Sequence: Synthetic polynucleotide
cgtttattgaaaatttttagttggtgttggagcggcggcgtgtggttaacgttaaggagcgtgagcgggtgagggatttttagggtcgacgttcgttttttttttttttgttttattattaaatatttggttaatattcgggggttcgtttatcgtttattttcgttcgaggcgatttcgagttttcg

SEQ ID NO: 2205 - DNA, 4 bp, Artificial Sequence
  Description of Artificial Sequence: Synthetic oligonucleotide
cgcg

SEQ ID NO: 2206 - DNA, 4 bp, Artificial Sequence
  Description of Artificial Sequence: Synthetic oligonucleotide
cgcg

SEQ ID NO: 2207 - DNA, 113 bp, Artificial Sequence
  Description of Artificial Sequence: Synthetic polynucleotide
cgcgggtgaaggcggagtcgtagggttggtttttaaagggatgttttcgttcgagcggcgagattagtttcgttcgtttttcgtcgcggtcgcgtcgtagtcgtttacggtcg

SEQ ID NO: 2208 - DNA, 208 bp, Artificial Sequence
  Description of Artificial Sequence: Synthetic polynucleotide
cgcgttcgttatagtagcgcgttaggcggacgtcgcgggaatttgacgttcgaggttcgcggtttttaatgagagttttagaatatttttcgtttttgacggttagcggtagcgtcgtcgtttttcgtagagcgttcgttttttcgtttttagagttttagttttttttcgagcgatttcgtagtttttttttcgtttttattcgtcg

SEQ ID NO: 2209 - DNA, 96 bp, Artificial Sequence
  Description of Artificial Sequence: Synthetic oligonucleotide
cgtattttttcgtattcggcgtcgtcgtttcgtcgttttttttcgtttgtagggtcgtttcgggtattttagggttgttgaggggcgggcgggtcg

SEQ ID NO: 2210 - DNA, 236 bp, Artificial Sequence
  Description of Artificial Sequence: Synthetic polynucleotide
cgcgtggaggttgcgcgtaggggttcgggacgcgggatagggatttcgcgtagtttaggcgtcggggaatcggggttggagtcggggatttgagtttagcggacgtttttttcgtttggaggttcggtacggatcgggatattagggcgttcgtggtcgtggttcggtttttggttgttgcgggtcgcggtttttagtgggtttttaggatttttttttacggcgggtatttatcg

SEQ ID NO: 2211 - DNA, 211 bp, Artificial Sequence
  Description of Artificial Sequence: Synthetic polynucleotide
cgtcgttcgcgttttttgttttttattttttaatttttgcgtggttttagggtttatatttttggagtttttttttttagtaaatagtgttgttttttatttaatagtagaggcgtttaggagtttaggcgatgtgtttaaggtcgaatagagggatagtagtgagttgtttaatttttttagttgcgtagttaggatacggttgggggcg

SEQ ID NO: 2212 - DNA, 193 bp, Artificial Sequence
  Description of Artificial Sequence: Synthetic polynucleotide
cgcgggggattttaggtcgggacggagttttttttggttcgttgtgcgcgtacgtttggaaaggcgggatttaaggtagcgatgttgcgggaggttttgtagtgttaacgagttttcgaacggtttcgttttattttttttttgtgtgtttcgtaagtttttgtttagtaaatcgttatagtttcggcgcgcg

SEQ ID NO: 2213 - DNA, 4 bp, Artificial Sequence
  Description of Artificial Sequence: Synthetic oligonucleotide
cgcg

SEQ ID NO: 2214 - DNA, 199 bp, Artificial Sequence
  Description of Artificial Sequence: Synthetic polynucleotide
cgtaataaattttcgtagatatcgtatttttaatgcggtgtttttttgtgttagtgtttcggcggtttttgtagggtgttaatgttacggttgtatatcgttttttttttttattatttttatttgaatagatttggaggaggcggaaatggaaattagggtatgtttataagttggattcgttagatttttttgttcg

SEQ ID NO: 2215 - DNA, 87 bp, Artificial Sequence
  Description of Artificial Sequence: Synthetic oligonucleotide
cgcggtcgttacgtttcgttttttgtatttagtttttttggcgttttcgttgtagtatttaagattaggcgtcgtttttgttagtcg

SEQ ID NO: 2216 - DNA, 68 bp, Artificial Sequence
  Description of Artificial Sequence: Synthetic oligonucleotide
cgtaaattgattatgaaatatacgatgttaattcggagttgtattttttagttgggtattttcgcgcg

SEQ ID NO: 2217 - DNA, 61 bp, Artificial Sequence
  Description of Artificial Sequence: Synthetic oligonucleotide
cggtgaaaattagtttgtggtgtattgagatttgtaaattattttttgaatgttaggggcg

SEQ ID NO: 2218 - DNA, 40 bp, Artificial Sequence
  Description of Artificial Sequence: Synthetic oligonucleotide
cggatcggcggtagtagaagcggtagcggtaaagtattcg

SEQ ID NO: 2219 - DNA, 647 bp, Artificial Sequence
  Description of Artificial Sequence: Synthetic polynucleotide
cggttgttgttattgttttgtcgttgtcgagtcggttatttgggtattcgcggagtcgcgtcgttgttatcgtttcggcggtttttcggagtgcgcggagggggcggcggaggagcgagatatttatagtaatcgaggatgcgaggggcgtttagtagtagcgagtgtttgggagttaggaggaggttttcgcgcgtcggtaatttttagtgttaggcgttttgtagttttcgcgcgtcgcgtttgggttcgtatcgttttcgtagtgagggttcgttcgagcggtaagtttttttcggcggttaagtcgatatttttttttcgtttcgtcgtttatttcgggtagtagtcgcggaataatggagagcgtagttagtagttttggagacggcgttcgggggaggacgcgtcgtcgtcgtcgtcgttgtcgttagggtaggcgcgcgtcgcgtggagtcgggcgggtgcgagggcgcgcggcggggggtggggggtacgcgtcgcgcggggggcgggggtagtggggggcgcgcgcgcgggttcggggagttcgcggggagagttcggcgttcggcgtagcgcggcgcggttaagtttcgcgtttttttcgttttttttcggcgcgttcgttttcgtttcgtcgttcg

SEQ ID NO: 2220 - DNA, 327 bp, Artificial Sequence
  Description of Artificial Sequence: Synthetic polynucleotide
cgaggcgcgggttgagtttttagtatttggtttgagcggcgtgggtagtagtttgtatcgcggatatttttaattttgtcgcgtttgcgtcgtattttggtcgtggtagcgatttttcgggtatttttgaggtcgtttttagttttataagtatttagtcgtttattttagagtagcggcgtcgatcgttttaagaggagttagttttcgatatcgttttttatttatttttttatatttttatcgttggagggggtgagtgtcgtggataggcgttttcgttcggggatagtttagcggcggtagttagttcgattttttttcgcg

SEQ ID NO: 2221 - DNA, 2 bp, Artificial Sequence
  Description of Artificial Sequence: Synthetic oligonucleotide
cg

SEQ ID NO: 2222 - DNA, 324 bp, Artificial Sequence
  Description of Artificial Sequence: Synthetic polynucleotide
cgtaagggtaattattggacgttggattcggtttgcgaagatatgttcgagaagggtaattatcggcgtcgtcgtcgtatgaagaggttttttcggtcgtcgttcgcgtatttttagttcggtaaggggtttttcggggtcggaggcgtcgtaggcgggtgcggcgtggcgggcgtcggggtcgacggttacggttatttggcgttttttaagtatttgtagtttggtttttttaataattcgtggtcgttatcgtagttttttttatttatgttttatgttttttgttagatggcggtagtcgtagcggttgtagtagttgcg

SEQ ID NO: 2223 - DNA, 77 bp, Artificial Sequence
  Description of Artificial Sequence: Synthetic oligonucleotide
cgtttcgtcgtgttcgatgggtgcgtttttagcgttgtcgtcgcggcgttcggtttcgggttttcgtcgttgcgtcg

SEQ ID NO: 2224 - DNA, 158 bp, Artificial Sequence
  Description of Artificial Sequence: Synthetic polynucleotide
cgtttttatttcggtatagatagtttttaaagttgttcgtattttttagatttcgttttttgtttagttttcggatttcgtttaggggttgagttgacgttcgcgggtggatttttttggttcgttgcgtagggaattgatttcgggaatttagggcg

SEQ ID NO: 2225 - DNA, 79 bp, Artificial Sequence
  Description of Artificial Sequence: Synthetic oligonucleotide
cgcgcgtttcgcgtttttggcggtcgtagcgttgtttattaattgatttttttattgatttatttaatttttaggagcg

SEQ ID NO: 2226 - DNA, 137 bp, Artificial Sequence
  Description of Artificial Sequence: Synthetic polynucleotide
cgttttggagcggtgggaggacgcggagcgtcgttttttggttttcgatattttgttcgttttttttagtgggtttgtggttgcgttttttcgaaggaagtaataaatttttttgattttgggggttagaggagacg

SEQ ID NO: 2227 - DNA, 112 bp, Artificial Sequence
  Description of Artificial Sequence: Synthetic polynucleotide
cgttgcggtatttagcggtttatcggggttgtattgttgtagcggttttttgtgttatttgtagtttaggaggttgagtatagtgagtattagtagtagtgtatagttcgcg

SEQ ID NO: 2228 - DNA, 2 bp, Artificial Sequence
  Description of Artificial Sequence: Synthetic oligonucleotide
cg

SEQ ID NO: 2229 - DNA, 2 bp, Artificial Sequence
  Description of Artificial Sequence: Synthetic oligonucleotide
cg

SEQ ID NO: 2230 - DNA, 282 bp, Artificial Sequence
  Description of Artificial Sequence: Synthetic polynucleotide
cggttttttagttttagttgtgcgttttcgttcgggcgaggtggggttgatcgcggtcgtttgtatacgttttttttggttcgcgttttcggtttgggagggcggattcgtttattttacgatggtttcggttttggaagggattgttttcgtgattcgtttttttaatagtcgttaataattttttttaacgttttttgcgcggttcgtttttgagaattttggttcgggagagcgacgcggggttttcggggttgcgtaggttgcggcgttttgtttacg

SEQ ID NO: 2231 - DNA, 81 bp, Artificial Sequence
  Description of Artificial Sequence: Synthetic oligonucleotide
cggcgcggcggcggggggcgtttcgtaagttcgcggttttgagcggttattcgcgtagtaagttgggcgagttggtagtcg

SEQ ID NO: 2232 - DNA, 53 bp, Artificial Sequence
  Description of Artificial Sequence: Synthetic oligonucleotide
cgcggtttttgttttttgcgttagcgtgagttcggttagggtttttacggtcg

SEQ ID NO: 2233 - DNA, 40 bp, Artificial Sequence
  Description of Artificial Sequence: Synthetic oligonucleotide
cggcgttagtttacgttttcgttggcgttttttcggcgcg

SEQ ID NO: 2234 - DNA, 206 bp, Artificial Sequence
  Description of Artificial Sequence: Synthetic polynucleotide
cggtcgatttatttggtgtcgcgtgcgttggcggttcgcgcggtagttaagttaaaggtcgaggtcgaggtcgagcgcggcgtttagtagtacggcgggggttagtagggcgggcgtcggtcgtagcgcgtttcgttttagtagtagtcgcgcgtcgtttttgtaggtcgtttcgtcgcgggttattcggggcgtttaggttgtcg

SEQ ID NO: 2235 - DNA, 38 bp, Artificial Sequence
  Description of Artificial Sequence: Synthetic oligonucleotide
cgttgttgttgcgcggggcggcggtcgtcgtgttttcg

SEQ ID NO: 2236 - DNA, 5 bp, Artificial Sequence
  Description of Artificial Sequence: Synthetic oligonucleotide
cgtcg

SEQ ID NO: 2237 - DNA, 25 bp, Artificial Sequence
  Description of Artificial Sequence: Synthetic oligonucleotide
cgtgtgtacgcgttgtattcgttcg

SEQ ID NO: 2238 - DNA, 79 bp, Artificial Sequence
  Description of Artificial Sequence: Synthetic oligonucleotide
cgttttttttttttttttttttttattaaatattatttgggaattgtttaaattttttttttaaaaaaagagagaggcg

SEQ ID NO: 2239 - DNA, 33 bp, Artificial Sequence
  Description of Artificial Sequence: Synthetic oligonucleotide
cggtttcgcgtggcgtttcggtcgttgttttcg

SEQ ID NO: 2240 - DNA, 132 bp, Artificial Sequence
  Description of Artificial Sequence: Synthetic polynucleotide
cggcgggcggcggcggcgcggagttgtatacggagaagacggagtgcgggcgttacggagagtattcgtttaagtaggacgttcgcggggaggtggttatggttagttcggtttacgatcgtttggtttgcg

SEQ ID NO: 2241 - DNA, 32 bp, Artificial Sequence
  Description of Artificial Sequence: Synthetic oligonucleotide
cgtttggtatttttttttttgtttcgagggcg

SEQ ID NO: 2242 - DNA, 2 bp, Artificial Sequence
  Description of Artificial Sequence: Synthetic oligonucleotide
cg

SEQ ID NO: 2243 - DNA, 2 bp, Artificial Sequence
  Description of Artificial Sequence: Synthetic oligonucleotide
cg

SEQ ID NO: 2244 - DNA, 20 bp, Artificial Sequence
  Description of Artificial Sequence: Synthetic oligonucleotide
cgagtatgttagcggcgtcg

SEQ ID NO: 2245 - DNA, 85 bp, Artificial Sequence
  Description of Artificial Sequence: Synthetic oligonucleotide
cggtacgttttttttttcggtcgtttttttttatataagcgtaggtagagggcgcgttagttatgttttgtttttgcgttcgtcg

SEQ ID NO: 2246 - DNA, 230 bp, Artificial Sequence
  Description of Artificial Sequence: Synthetic polynucleotide
cggtttcgcgaaattcggttttttagttcgcgggacgcgttgtttgttaggcgggttcggcggtatttcgggggcgggaggggtcggtcgtagggtttttagtttggcgttcgcggggcgttcgtagcgaaggggtgggtgtcgttcgtgaacgtagtagggattagtttagttcgcgttcgtttttgggtttcggttatcgttttttcgttattttttcggtttttgcg

SEQ ID NO: 2247 - DNA, 84 bp, Artificial Sequence
  Description of Artificial Sequence: Synthetic oligonucleotide
cgggtcgttagttttagggtgtcgggttttaattaaggtttcgaagtttttacgtatttgagggtattttgattagtttttgcg

SEQ ID NO: 2248 - DNA, 42 bp, Artificial Sequence
  Description of Artificial Sequence: Synthetic oligonucleotide
cgcgatttttttttgatttagttaaacggaaaagttcgcgcg

SEQ ID NO: 2249 - DNA, 45 bp, Artificial Sequence
  Description of Artificial Sequence: Synthetic oligonucleotide
cgtcgtgttttttttcgttttcgaaagggtagaaagagtcgttcg

SEQ ID NO: 2250 - DNA, 26 bp, Artificial Sequence
  Description of Artificial Sequence: Synthetic oligonucleotide
cgttcgttagtattttttgtttcgcg

SEQ ID NO: 2251 - DNA, 50 bp, Artificial Sequence
  Description of Artificial Sequence: Synthetic oligonucleotide
cgaggtttaggtggaggttgaggttgtcgcgcgtcgcgggaggagtttcg

SEQ ID NO: 2252 - DNA, 56 bp, Artificial Sequence
  Description of Artificial Sequence: Synthetic oligonucleotide
cgtttttgagttagggacgcgcgtggggggtgggcgtgtacgcgggtgggttagcg

SEQ ID NO: 2253 - DNA, 44 bp, Artificial Sequence
  Description of Artificial Sequence: Synthetic oligonucleotide
cgtttttatcgcgtacgcgtttttttcgcgcgcgtatacgttcg

SEQ ID NO: 2254 - DNA, 2 bp, Artificial Sequence
  Description of Artificial Sequence: Synthetic oligonucleotide
cg

SEQ ID NO: 2255 - DNA, 9 bp, Artificial Sequence
  Description of Artificial Sequence: Synthetic oligonucleotide
cgtttttcg

SEQ ID NO: 2256 - DNA, 58 bp, Artificial Sequence
  Description of Artificial Sequence: Synthetic oligonucleotide
cgcggggtagttgtttaagtggatcgatattatcgtttgtttggcgggtaggcgggcg

SEQ ID NO: 2257 - DNA, 151 bp, Artificial Sequence
  Description of Artificial Sequence: Synthetic polynucleotide
cggtagaagatagcgtttttaggattagcgattttgtggtttattcggttattgggtttcggcgtaaattttttttaggtagtgcgggcgatgttgattgtagacgtcgggtagggttttcgtgcgggcgggagcgggggaagttagtgcg

SEQ ID NO: 2258 - DNA, 17 bp, Artificial Sequence
  Description of Artificial Sequence: Synthetic oligonucleotide
cggattttttaggatcg

SEQ ID NO: 2259 - DNA, 70 bp, Artificial Sequence
  Description of Artificial Sequence: Synthetic oligonucleotide
cgttcgttgtttttcgttgcgtttagggatggagggttttattatttatggaattgttggtttttttgcg

SEQ ID NO: 2260 - DNA, 59 bp, Artificial Sequence
  Description of Artificial Sequence: Synthetic oligonucleotide
cgtttttgagatttcgttgagaaatttttagcgggttagcgtttgggcgttgggcgtcg

SEQ ID NO: 2261 - DNA, 25 bp, Artificial Sequence
  Description of Artificial Sequence: Synthetic oligonucleotide
cgttgggtaatttttattcgagtcg

SEQ ID NO: 2262 - DNA, 57 bp, Artificial Sequence
  Description of Artificial Sequence: Synthetic oligonucleotide
cggcgttgacgttttggttttgggggttgtttggttggtgttaggtagcggaagacg

SEQ ID NO: 2263 - DNA, 111 bp, Artificial Sequence
  Description of Artificial Sequence: Synthetic polynucleotide
cgagtagttttacgttttgttaaggacggtaggtgtaagggtcgggggattttttgacggggtcgttttttcgggtacggggaggtttttatcgagttttaattttgaacg

SEQ ID NO: 2264 - DNA, 211 bp, Artificial Sequence
  Description of Artificial Sequence: Synthetic polynucleotide
cgggtcgttgtttttgttgtattatgtaaaggtggttgggaaagcgcgttgatttatatttatatagtttattttttttttatagtatgtgattaatacgtatttcggggaggagggagcgcggttgggggtgttaatcggaagggaatagatagtgagtgttattttgttgggaggttttagaagtaaagcgttaacgacgatagtagcg

SEQ ID NO: 2265 - DNA, 75 bp, Artificial Sequence
  Description of Artificial Sequence: Synthetic oligonucleotide
cgtttttacgcgcgttgtcggtatttgttcgttttgttgtaatttgttgtagtgtttgaaagagtagtaggagcg

SEQ ID NO: 2266 - DNA, 2 bp, Artificial Sequence
  Description of Artificial Sequence: Synthetic oligonucleotide
cg

SEQ ID NO: 2267 - DNA, 66 bp, Artificial Sequence
  Description of Artificial Sequence: Synthetic oligonucleotide
cgggcgttggagaaggcgtttggcgcgaagttgggcggcgtttcgagggcggaggataggtggtcg

SEQ ID NO: 2268 - DNA, 2 bp, Artificial Sequence
  Description of Artificial Sequence: Synthetic oligonucleotide
cg

SEQ ID NO: 2269 - DNA, 163 bp, Artificial Sequence
  Description of Artificial Sequence: Synthetic polynucleotide
cggggcggcgggcgtatgcgcgtgcgcggtgcggttttagttttggttgtcgtcgtttgtcgtcgtcgtcgcgatgtttattttagttaaagcggttgcgggtttggggattcggttcgggtagcggagttttcggattcgtcgattcgtcgaggagcgcgcg

SEQ ID NO: 2270 - DNA, 99 bp, Artificial Sequence
  Description of Artificial Sequence: Synthetic oligonucleotide
cggagtaaagttagcgcgtttcgcggttcggaatttagttggttcgttatttttttatttttgcgattttattttcgatcgcgttttagggtagaagcg

SEQ ID NO: 2271 - DNA, 96 bp, Artificial Sequence
  Description of Artificial Sequence: Synthetic oligonucleotide
cggcggcggcggtagttttagtcgcgttcgttatatatatttttattcgttcggtgtatacgtcgcgtcgcgggtagtgtcgtttgcggaggcgcg

SEQ ID NO: 2272 - DNA, 4 bp, Artificial Sequence
  Description of Artificial Sequence: Synthetic oligonucleotide
cgcg

SEQ ID NO: 2273 - DNA, 16 bp, Artificial Sequence
  Description of Artificial Sequence: Synthetic oligonucleotide
cgtgttaatttcgtcg

SEQ ID NO: 2274 - DNA, 2 bp, Artificial Sequence
  Description of Artificial Sequence: Synthetic oligonucleotide
cg

SEQ ID NO: 2275 - DNA, 141 bp, Artificial Sequence
  Description of Artificial Sequence: Synthetic polynucleotide
cgtttattttgtagtcgagtatataaggttcgtcgaagttatcgagtaggttttgtagttgtaggtagttttcgtcgtcgcgttttattacgtcgtggaaggtaggtacgtagtcgcgtagcgcgttagttattagtcgcg

SEQ ID NO: 2276 - DNA, 2 bp, Artificial Sequence
  Description of Artificial Sequence: Synthetic oligonucleotide
cg

SEQ ID NO: 2277 - DNA, 37 bp, Artificial Sequence; identical to SEQ ID NO: 565
  Description of Artificial Sequence: Synthetic oligonucleotide

SEQ ID NO: 2278 - DNA, 52 bp, Artificial Sequence
  Description of Artificial Sequence: Synthetic oligonucleotide
cgaggcgttttcgttttcgttatttatatagggcgttaagtgtttcgattcg

SEQ ID NO: 2279 - DNA, 2 bp, Artificial Sequence
  Description of Artificial Sequence: Synthetic oligonucleotide
cg

SEQ ID NO: 2280 - DNA, 7 bp, Artificial Sequence
  Description of Artificial Sequence: Synthetic oligonucleotide
cgtttcg

SEQ ID NO: 2281 - DNA, 2 bp, Artificial Sequence
  Description of Artificial Sequence: Synthetic oligonucleotide
cg

SEQ ID NO: 2282 - DNA, 4 bp, Artificial Sequence
  Description of Artificial Sequence: Synthetic oligonucleotide
cgcg

SEQ ID NO: 2283 - DNA, 17 bp, Artificial Sequence
  Description of Artificial Sequence: Synthetic oligonucleotide
cgtttcgttttaattcg

SEQ ID NO: 2284 - DNA, 136 bp, Artificial Sequence
  Description of Artificial Sequence: Synthetic polynucleotide
cgcggggggaggtttttggttcgtcgttttcgttgtcgtttgatcgtatttttggagggtttcgtattttgttaggtttttggaggtaaatatatattttcgatttataattggttttcgcgttaggggattcgcg

SEQ ID NO: 2285 - DNA, 31 bp, Artificial Sequence
  Description of Artificial Sequence: Synthetic oligonucleotide
cggttagggagtgagcggggcgttgggcgcg

SEQ ID NO: 2286 - DNA, 25 bp, Artificial Sequence
  Description of Artificial Sequence: Synthetic oligonucleotide
cgttaattagattttagggtgtacg

SEQ ID NO: 2287 - DNA, 12 bp, Artificial Sequence
  Description of Artificial Sequence: Synthetic oligonucleotide
cgttcgttaacg

SEQ ID NO: 2288 - DNA, 6 bp, Artificial Sequence
  Description of Artificial Sequence: Synthetic oligonucleotide
cgtacg

SEQ ID NO: 2289 - DNA, 199 bp, Artificial Sequence
  Description of Artificial Sequence: Synthetic polynucleotide
cgtagcgtgtagtcgcggaatagcgtttttagttttgggtaagcgaatttttcgtcgtacgttcggagttcgcgtcggcggtttgtttcggtcgttcgttcggcgttttcgggttcgttcgcgtcgttttcgtcgtcgttttcgtcgcgcggcgttttcgttattttagcgttatgtagcggtcgcggtcgcgggcgcg

SEQ ID NO: 2290 - DNA, 91 bp, Artificial Sequence
  Description of Artificial Sequence: Synthetic oligonucleotide
cgtgggggcgcggcgcgggcgatacgtgcgggtcgttaggagggggagggggacgcgcgtcgtcgggttcgttattttgtattcggggtcg

SEQ ID NO: 2291 - DNA, 108 bp, Artificial Sequence
  Description of Artificial Sequence: Synthetic polynucleotide
cgttttttttatggattttttagtatttgtaggttataggataatagaagttatagtagagttatcgaggaattttaggaacggaggagatggaatagtggagacgcg

SEQ ID NO: 2292 - DNA, 13 bp, Artificial Sequence
  Description of Artificial Sequence: Synthetic oligonucleotide
cgaaatcggtgcg

SEQ ID NO: 2293 - DNA, 176 bp, Artificial Sequence
  Description of Artificial Sequence: Synthetic polynucleotide
cgggggcggcggggtgatagttttcgtgtatgaattagttattttttaggtttcgtttcggcgggggtcggtcggacgttcgtttcgtataaagcgggtattcgggtcgtttggagtagaaagtcgcgtattttttttcgttaggcgttttttcggacgttttgtttagcgggtcg

SEQ ID NO: 2294 - DNA, 2 bp, Artificial Sequence
  Description of Artificial Sequence: Synthetic oligonucleotide
cg

SEQ ID NO: 2295 - DNA, 157 bp, Artificial Sequence
  Description of Artificial Sequence: Synthetic polynucleotide
cgggcgtttttttaggtttggtcgaggggcgtcgcgtagaggcggcggcggcgtacggaggcggtagacgacgcgttttcggcgttcgtagtttcggtttcgcgttttcgcggtttaaagtaattttgggagtcgtcgtttttcgcggaatttttcg

SEQ ID NO: 2296 - DNA, 66 bp, Artificial Sequence
  Description of Artificial Sequence: Synthetic oligonucleotide
cggtcgcggcgggagggatagggggtttgggtgggaagggagcgcgagggtttttagcggttcgcg

SEQ ID NO: 2297 - DNA, 498 bp, Artificial Sequence
  Description of Artificial Sequence: Synthetic polynucleotide
cgtgcgttaggcggaaatgttttagtaggttttcgcgtatcgggtcgttcggggggtagtaggggtaggcggcggcgggtaggtcgagcgcgtcgggcggtggcgtagcggggtacgagtattttttgtgcgttaggtaggtttcgaggttgtggaagtttacgcggtaggtcgtgtattcgtggtagtcggttagcgtcggtgtcggggtttcggggagcgggcgtcgcggttttttgtttaggtcgatggggtcgtcggtcgcggggtcgggcgagcgcgtaggggcgaggtcggggtcgttttcgttttcgttttcgggtcgcggcgattcgggcgcgggggcgtggtcgggcggcggggggggcggggcgtcggtcgcgtgtagttcgtagagtttgcggcgtttgcgcgtgcgtataggcgcggcgggagagggggtcgggggcgcggtcggtttagggggtttcgggggcgcggtcggtcggcgcggcggcg

SEQ ID NO: 2298 - DNA, 27 bp, Artificial Sequence
  Description of Artificial Sequence: Synthetic oligonucleotide
cgagcgcgaagggcgttcggattcgcg

SEQ ID NO: 2299 - DNA, 2 bp, Artificial Sequence
  Description of Artificial Sequence: Synthetic oligonucleotide
cg

SEQ ID NO: 2300 - DNA, 2 bp, Artificial Sequence
  Description of Artificial Sequence: Synthetic oligonucleotide
cg

SEQ ID NO: 2301 - DNA, 16 bp, Artificial Sequence
  Description of Artificial Sequence: Synthetic oligonucleotide
cgcgaggtaggcgacg

SEQ ID NO: 2302 - DNA, 53 bp, Artificial Sequence
  Description of Artificial Sequence: Synthetic oligonucleotide
cgtcgtaagagaagttgttaagtttcgtaggttttgattcggcgtttttcgcg

SEQ ID NO: 2303 - DNA, 4 bp, Artificial Sequence
  Description of Artificial Sequence: Synthetic oligonucleotide
cgcg

SEQ ID NO: 2304 - DNA, 2 bp, Artificial Sequence
  Description of Artificial Sequence: Synthetic oligonucleotide
cg

SEQ ID NO: 2305 - DNA, 2 bp, Artificial Sequence
  Description of Artificial Sequence: Synthetic oligonucleotide
cg

SEQ ID NO: 2306 - DNA, 2 bp, Artificial Sequence
  Description of Artificial Sequence: Synthetic oligonucleotide
cg

SEQ ID NO: 2307 - DNA, 14 bp, Artificial Sequence
  Description of Artificial Sequence: Synthetic oligonucleotide
cgtaggtggatacg

SEQ ID NO: 2308 - DNA, 186 bp, Artificial Sequence
  Description of Artificial Sequence: Synthetic polynucleotide
cgttatggagaaaattaatggaggaaaaattatagagttattcgaaatagttgcgttgtttattattcggtgtttgagtttgttttttttgtaattagattatatgtgaggtagttttagttaattgtttgtgttatttatcggggaattttagttttatttgtgaatatttaggttttttcgtcg

SEQ ID NO: 2309 - DNA, 79 bp, Artificial Sequence
  Description of Artificial Sequence: Synthetic oligonucleotide
cgcgtattttttttatttcgatatttattgttatttttatagcggagcgaggggtttcgtcgagggcgagcgtatttcg

SEQ ID NO: 2310 - DNA, 49 bp, Artificial Sequence
  Description of Artificial Sequence: Synthetic oligonucleotide
cgcgggggcgtttttcgttgtttgtagggagcgcggcgcggacgcggcg

SEQ ID NO: 2311 - DNA, 17 bp, Artificial Sequence
  Description of Artificial Sequence: Synthetic oligonucleotide
cgcgaacggtttattcg

SEQ ID NO: 2312 - DNA, 2 bp, Artificial Sequence
  Description of Artificial Sequence: Synthetic oligonucleotide
cg

SEQ ID NO: 2313 - DNA, 9 bp, Artificial Sequence
  Description of Artificial Sequence: Synthetic oligonucleotide
cgtggttcg

SEQ ID NO: 2314 - DNA, 2 bp, Artificial Sequence
  Description of Artificial Sequence: Synthetic oligonucleotide
cg

SEQ ID NO: 2315 - DNA, 165 bp, Artificial Sequence
  Description of Artificial Sequence: Synthetic polynucleotide
cggggtttggtaggaagtgtagtgtattttttagttttagggtaattaggatagtatgaattttttattttgtggtagaataaacggttagcgtttcgatgtggcgcgttcgatttttttttatagagtttaaaagttacgtttaattaaattgtagcgttttcg

SEQ ID NO: 2316 - DNA, 14 bp, Artificial Sequence
  Description of Artificial Sequence: Synthetic oligonucleotide
cgttgattcgcgcg

SEQ ID NO: 2317 - DNA, 2 bp, Artificial Sequence
  Description of Artificial Sequence: Synthetic oligonucleotide
cg

SEQ ID NO: 2318 - DNA, 2 bp, Artificial Sequence
  Description of Artificial Sequence: Synthetic oligonucleotide
cg

SEQ ID NO: 2319 - DNA, 97 bp, Artificial Sequence
  Description of Artificial Sequence: Synthetic oligonucleotide
cgtttcgtacgttcgtacgtttagcggggttcgtattgagtatgggcgcggcggtcgtgcgttggtatttgtgcgtgttgttggttttgggtatacg

SEQ ID NO: 2320 - DNA, 2 bp, Artificial Sequence
  Description of Artificial Sequence: Synthetic oligonucleotide
cg

SEQ ID NO: 2321 - DNA, 98 bp, Artificial Sequence
  Description of Artificial Sequence: Synthetic oligonucleotide
cgaggtttagtttttggttttaaggaataaattcgttggtttgaaagggagttacggtagaagtttaggggtagagcggcgggagcgcgcgattcgcg

SEQ ID NO: 2322 - DNA, 69 bp, Artificial Sequence
  Description of Artificial Sequence: Synthetic oligonucleotide
cgcggaaggttcgcgcgttttgcgtcgtcgtcgtttagtgtcgtcgttagtatttttttcgttttttcg

SEQ ID NO: 2323 - DNA, 2 bp, Artificial Sequence
  Description of Artificial Sequence: Synthetic oligonucleotide
cg

SEQ ID NO: 2324 - DNA, 2 bp, Artificial Sequence
  Description of Artificial Sequence: Synthetic oligonucleotide
cg

SEQ ID NO: 2325 - DNA, 2 bp, Artificial Sequence
  Description of Artificial Sequence: Synthetic oligonucleotide
cg

SEQ ID NO: 2326 - DNA, 2 bp, Artificial Sequence
  Description of Artificial Sequence: Synthetic oligonucleotide
cg

SEQ ID NO: 2327 - DNA, 103 bp, Artificial Sequence
  Description of Artificial Sequence: Synthetic polynucleotide
cgcgttcgtcgttttcggaggagcgggttggtcgatcgttatcgcgtcgtttttcggtcgttttcgaagtcgttttatcgcggtttttgtcgttttggggtcg

SEQ ID NO: 2328 - DNA, 2 bp, Artificial Sequence
  Description of Artificial Sequence: Synthetic oligonucleotide
cg

SEQ ID NO: 2329 - DNA, 21 bp, Artificial Sequence
  Description of Artificial Sequence: Synthetic oligonucleotide
cgtcgtcgtcgttgagagtcg

SEQ ID NO: 2330 - DNA, 148 bp, Artificial Sequence
  Description of Artificial Sequence: Synthetic polynucleotide
cgcgcgggcgcgaggggttgggacgcgggagttttttgagtgcggagcgcggagttttggtgtttcggcgtattgtagttatattttcgggtcgcgcgttttcgtcgttttttattcgcgtcgtagggtttttttttttgaggcgtcg

SEQ ID NO: 2331 - DNA, 2 bp, Artificial Sequence
  Description of Artificial Sequence: Synthetic oligonucleotide
cg

SEQ ID NO: 2332 - DNA, 2 bp, Artificial Sequence
  Description of Artificial Sequence: Synthetic oligonucleotide
cg

SEQ ID NO: 2333 - DNA, 26 bp, Artificial Sequence
  Description of Artificial Sequence: Synthetic oligonucleotide
cggttattacgcgttgtttttcggcg

SEQ ID NO: 2334 - DNA, 119 bp, Artificial Sequence
  Description of Artificial Sequence: Synthetic polynucleotide
cgttcgatgatgaggatgtatttttcgtaggtgtagtttttgaagcggtagtaacgtttgtggtttttgagttaggataggacgttatggttgcggtagcgcgcgtatttgggcgtgcg

SEQ ID NO: 2335 - DNA, 66 bp, Artificial Sequence
  Description of Artificial Sequence: Synthetic oligonucleotide
cgttttattttgttgaggtcgttttcggttttttttgatttaggttgggcgggaaaggtcgggtcg

SEQ ID NO: 2336 - DNA, 60 bp, Artificial Sequence
  Description of Artificial Sequence: Synthetic oligonucleotide
cgcggttggggtttcgcgttttttggagcgttttttgtttagatacgacgatttcgttcg

SEQ ID NO: 2337 - DNA, 2 bp, Artificial Sequence
  Description of Artificial Sequence: Synthetic oligonucleotide
cg

SEQ ID NO: 2338 - DNA, 124 bp, Artificial Sequence
  Description of Artificial Sequence: Synthetic polynucleotide
cggcggtaggagaagtttaaggttcgagcggttcgtagtttttacgtttgtatttttttattttcgttagttcgatggttcgtttcgcggcgtgtattggagtaagtaggtttcgtttcgagcg

SEQ ID NO: 2339 - DNA, 2 bp, Artificial Sequence
  Description of Artificial Sequence: Synthetic oligonucleotide
cg

SEQ ID NO: 2340 - DNA, 156 bp, Artificial Sequence
  Description of Artificial Sequence: Synthetic polynucleotide
cgtttcggtttttatcgtcgcgtttttataggttattaggtgtcgttcgtttagaatgttaattatggcgtagatacgtagttatttgagattcgaggatatttgtaggaggatgattatttgcggggaggcggcggcgagcgtcgcggtgtttcg

SEQ ID NO: 2341 - DNA, 2 bp, Artificial Sequence
  Description of Artificial Sequence: Synthetic oligonucleotide
cg

SEQ ID NO: 2342 - DNA, 91 bp, Artificial Sequence
  Description of Artificial Sequence: Synthetic oligonucleotide
cgttttaggaatgattcggtgatatcggtcgatgattttttttatagtttgtcggtgagcggcggcggaggtaaggtttcggcggcgcgcg

SEQ ID NO: 2343 - DNA, 2 bp, Artificial Sequence
  Description of Artificial Sequence: Synthetic oligonucleotide
cg

SEQ ID NO: 2344 - DNA, 2 bp, Artificial Sequence
  Description of Artificial Sequence: Synthetic oligonucleotide
cg

SEQ ID NO: 2345 - DNA, 89 bp, Artificial Sequence
  Description of Artificial Sequence: Synthetic oligonucleotide
cgtcgagttgtaggcgcgcgtttaatcgttttgttgggtttacgcggtttgagaggtcggagcgtttaattgttggtacgcgagtaacg

SEQ ID NO: 2346 - DNA, 13 bp, Artificial Sequence
  Description of Artificial Sequence: Synthetic oligonucleotide
cggattaaagacg

SEQ ID NO: 2347 - DNA, 2 bp, Artificial Sequence
  Description of Artificial Sequence: Synthetic oligonucleotide
cg

SEQ ID NO: 2348 - DNA, 47 bp, Artificial Sequence
  Description of Artificial Sequence: Synthetic oligonucleotide
cgcgatgtggtttcgtttggttttttgttgttggggtttggcgttcg

SEQ ID NO: 2349 - DNA, 2 bp, Artificial Sequence
  Description of Artificial Sequence: Synthetic oligonucleotide
cg

SEQ ID NO: 2350 - DNA, 2 bp, Artificial Sequence
  Description of Artificial Sequence: Synthetic oligonucleotide
cg

SEQ ID NO: 2351 - DNA, 159 bp, Artificial Sequence
  Description of Artificial Sequence: Synthetic polynucleotide
cgtttttcgtcgaggcgtaggggtagttatattgcggggcgtttgggcgacggcgttaaagttagggttataagggtacgggataagcggggcggggggagtaggagattaggatagaggtcggcgttcgtcgcgggcgtttttacgtcgcgggtatcg

SEQ ID NO: 2352 - DNA, 2 bp, Artificial Sequence
  Description of Artificial Sequence: Synthetic oligonucleotide
cg

SEQ ID NO: 2353 - DNA, 2 bp, Artificial Sequence
  Description of Artificial Sequence: Synthetic oligonucleotide
cg

SEQ ID NO: 2354 - DNA, 2 bp, Artificial Sequence
  Description of Artificial Sequence: Synthetic oligonucleotide
cg

SEQ ID NO: 2355 - DNA, 78 bp, Artificial Sequence
  Description of Artificial Sequence: Synthetic oligonucleotide
cggtcgttttttcgacgttcgcggttttttattgcgtcgaggcgagcgttacggttaaagtttaagtttcggcgttcg

SEQ ID NO: 2356 - DNA, 2 bp, Artificial Sequence
  Description of Artificial Sequence: Synthetic oligonucleotide
cg

SEQ ID NO: 2357 - DNA, 48 bp, Artificial Sequence
  Description of Artificial Sequence: Synthetic oligonucleotide
cgcgttaattcggtcgttgtgtacggtcgggtgcgaaattttttcgcg

SEQ ID NO: 2358 - DNA, 2 bp, Artificial Sequence
  Description of Artificial Sequence: Synthetic oligonucleotide
cg

SEQ ID NO: 2359 - DNA, 2 bp, Artificial Sequence
  Description of Artificial Sequence: Synthetic oligonucleotide
cg

SEQ ID NO: 2360 - DNA, 2 bp, Artificial Sequence
  Description of Artificial Sequence: Synthetic oligonucleotide
cg

SEQ ID NO: 2361 - DNA, 157 bp, Artificial Sequence
  Description of Artificial Sequence: Synthetic polynucleotide
cgtgtttaattggtatttgttattaatatgtttgtttttatttaaatggtttagagtaaggttttgattaaattagtatttttacgttaatatttagtagcgtttttggtttttggtagattttttttttagttgttaaagtaaaattatagaagcg

SEQ ID NO: 2362 - DNA, 2 bp, Artificial Sequence
  Description of Artificial Sequence: Synthetic oligonucleotide
cg

SEQ ID NO: 2363 - DNA, 82 bp, Artificial Sequence
  Description of Artificial Sequence: Synthetic oligonucleotide
cgtattcgcggggagggcggcgagcggggattagtcgaagtcgggagaggggcgtttttacggggcgggaaattggcgcgcg

SEQ ID NO: 2364 - DNA, 23 bp, Artificial Sequence
  Description of Artificial Sequence: Synthetic oligonucleotide
cggttaggtgaggcggttaggcg

SEQ ID NO: 2365 - DNA, 38 bp, Artificial Sequence
  Description of Artificial Sequence: Synthetic oligonucleotide
cgaattcgtaaagttgttcgtagacgcgcgggaattcg

SEQ ID NO: 2366 - DNA, 2 bp, Artificial Sequence
  Description of Artificial Sequence: Synthetic oligonucleotide
ct

SEQ ID NO: 2367 - DNA, 165 bp, Artificial Sequence
  Description of Artificial Sequence: Synthetic polynucleotide
cgcgggttgtttagcgtgttagattttttttttttggacgtgcgtaagttgttggtggtcggtaatcgtatttagcggattttcgaggatttttttattttttacggcgatttggtttatttggattttaggaataattcgttgcgttcgttggaggagggtacg

SEQ ID NO: 2368 - DNA, 2 bp, Artificial Sequence
  Description of Artificial Sequence: Synthetic oligonucleotide
cg

SEQ ID NO: 2369 - DNA, 2 bp, Artificial Sequence
  Description of Artificial Sequence: Synthetic oligonucleotide
cg

SEQ ID NO: 2370 - DNA, 2 bp, Artificial Sequence
  Description of Artificial Sequence: Synthetic oligonucleotide
cg

SEQ ID NO: 2371 - DNA, 23 bp, Artificial Sequence
  Description of Artificial Sequence: Synthetic oligonucleotide
cgataggcggttttcggatatcg

SEQ ID NO: 2372 - DNA, 2 bp, Artificial Sequence
  Description of Artificial Sequence: Synthetic oligonucleotide
cg

SEQ ID NO: 2373 - DNA, 66 bp, Artificial Sequence
  Description of Artificial Sequence: Synthetic oligonucleotide
cggcgttttcggggttgttgcgcgttcgcgtttagagttgtcgttttagggagttcgttacggtcg

SEQ ID NO: 2374 - DNA, 43 bp, Artificial Sequence
  Description of Artificial Sequence: Synthetic oligonucleotide
cgggcgcgtagttcgttcgcgcggtttggattttttttgttcg

SEQ ID NO: 2375 - DNA, 2 bp, Artificial Sequence
  Description of Artificial Sequence: Synthetic oligonucleotide
cg

SEQ ID NO: 2376 - DNA, 62 bp, Artificial Sequence
  Description of Artificial Sequence: Synthetic oligonucleotide
cgcgttgtacgaggatggttacgaggcgtagttggagtcgtcgtcgtcgtcgtatttgggcg

SEQ ID NO: 2377 - DNA, 2 bp, Artificial Sequence
  Description of Artificial Sequence: Synthetic oligonucleotide
cg

SEQ ID NO: 2378 - DNA, 138 bp, Artificial Sequence
  Description of Artificial Sequence: Synthetic polynucleotide
cgttttcgggcgtacggaaattatttgttaggaaatttttaacgttttttttcgtttatttttttttattttttttttggcgcgttttttttttttttagaggtacgtagtggagtttttggagtttcgaatttttcg

SEQ ID NO: 2379 - DNA, 2 bp, Artificial Sequence
  Description of Artificial Sequence: Synthetic oligonucleotide
cg

SEQ ID NO: 2380 - DNA, 2 bp, Artificial Sequence
  Description of Artificial Sequence: Synthetic oligonucleotide
cg

SEQ ID NO: 2381 - DNA, 2 bp, Artificial Sequence
  Description of Artificial Sequence: Synthetic oligonucleotide
cg

SEQ ID NO: 2382 - DNA, 2 bp, Artificial Sequence
  Description of Artificial Sequence: Synthetic oligonucleotide
cg

SEQ ID NO: 2383 - DNA, 187 bp, Artificial Sequence
  Description of Artificial Sequence: Synthetic polynucleotide
cgagcggttttaatttcgtttcgtttgttgttgttgttgttggtgttgtttcggttgtagttgttgtcgttttacgatttcggggcgttgaggtaatagggttttttttttttattttttatttttttcggtttttttatagaagcgtcgtttttagtaatttttcgtgtattttttatttttgtcg

SEQ ID NO: 2384 - DNA, 2 bp, Artificial Sequence
  Description of Artificial Sequence: Synthetic oligonucleotide
cg

SEQ ID NO: 2385 - DNA, 2 bp, Artificial Sequence
  Description of Artificial Sequence: Synthetic oligonucleotide
cg

SEQ ID NO: 2386 - DNA, 110 bp, Artificial Sequence
  Description of Artificial Sequence: Synthetic polynucleotide
cgtaggttaagatttggttttagaattatcgttataagttgaagcgcgttcgcgttttaggggcggcggagtcgtttgatttggtagtattcgtcgagttgtacgtcgcg

SEQ ID NO: 2387 - DNA, 4 bp, Artificial Sequence
  Description of Artificial Sequence: Synthetic oligonucleotide
cgcg

SEQ ID NO: 2388 - DNA, 189 bp, Artificial Sequence
  Description of Artificial Sequence: Synthetic polynucleotide
cgtgttttcgttcgcgtttgggtttcgtcgtattttagtagaagttattatagagaataaattatttttttgttttcgagatgggttttcggggaggaaggtaaattgtttgtttcgtgtataataagttaggcgtggagagtagcgcggaggaggtcgcggtagttatcgagcgggtagagtttttcg

SEQ ID NO: 2389 - DNA, 42 bp, Artificial Sequence
  Description of Artificial Sequence: Synthetic oligonucleotide
cgcgagtgtatttaagcgttttcgttttatttatttttagcg

SEQ ID NO: 2390 - DNA, 33 bp, Artificial Sequence
  Description of Artificial Sequence: Synthetic oligonucleotide
cgtggagcgtaaagtgtttgaagttttcgcgcg

SEQ ID NO: 2391 - DNA, 15 bp, Artificial Sequence
  Description of Artificial Sequence: Synthetic oligonucleotide
cgttcggttggcgcg

SEQ ID NO: 2392 - DNA, 51 bp, Artificial Sequence
  Description of Artificial Sequence: Synthetic oligonucleotide
cgtttattacggcgatttgcggtagttttagtaggtagttttgttttagcg

SEQ ID NO: 2393 - DNA, 2 bp, Artificial Sequence
  Description of Artificial Sequence: Synthetic oligonucleotide
cg

SEQ ID NO: 2394 - DNA, 268 bp, Artificial Sequence
  Description of Artificial Sequence: Synthetic polynucleotide
cgaagatgggaaacggtcgtttgttgagagggggtatttgtagtttttttagaaaaggttggggtaggagagcgtgcggttagaggggtgggggtatcggagggggggttttattttttgttttatagtcgggtttttttcgcgaggcgttgggaagtatgaggtatgtagtatttaaaatgttttttgaaaaagacggatttgaagtttttttttataaatacgttattgtatttattttttatttagagacgggttgcgcgtttcg

SEQ ID NO: 2395 - DNA, 2 bp, Artificial Sequence
  Description of Artificial Sequence: Synthetic oligonucleotide
cg

SEQ ID NO: 2396 - DNA, 33 bp, Artificial Sequence
  Description of Artificial Sequence: Synthetic oligonucleotide
cggtgatcggtttgattgtttttgggggtttcg

SEQ ID NO: 2397 - DNA, 23 bp, Artificial Sequence
  Description of Artificial Sequence: Synthetic oligonucleotide
cgaaagtttcgggttagtgggcg

SEQ ID NO: 2398 - DNA, 40 bp, Artificial Sequence
  Description of Artificial Sequence: Synthetic oligonucleotide
cgaggtatttggtcgggcggggaggcgtcgggtcggggcg

SEQ ID NO: 2399 - DNA, 10 bp, Artificial Sequence
  Description of Artificial Sequence: Synthetic oligonucleotide
cggagtcgcg

SEQ ID NO: 2400 - DNA, 181 bp, Artificial Sequence
  Description of Artificial Sequence: Synthetic polynucleotide
cgaaaacgaaatttatttttttgcgtttatttttgttagaggtttgtaggacgtgttttaatttggtatttcgagtttagaataaaagttacgggggttgcggtatgggtagggggaaggcgcgcggtggttgacgcggggtaggggttttggcgagcgcgggaggggcggttagtagtcg

SEQ ID NO: 2401 - DNA, 195 bp, Artificial Sequence
  Description of Artificial Sequence: Synthetic polynucleotide
cgttaagtagtaggattatagcgttagcgtttggtttcggaggaaagataagttggagtacgtaagggcgattcgttttcgggggtttcggttaggtatttgtcgtatgtatttttttcgtggtggtggtatgagcgcgcgcggggcgcggggggtaggcgaggggattttggtaggcgtcgacgttttaggtcg

SEQ ID NO: 2402 - DNA, 2 bp, Artificial Sequence
  Description of Artificial Sequence: Synthetic oligonucleotide
cg

SEQ ID NO: 2403 - DNA, 358 bp, Artificial Sequence
  Description of Artificial Sequence: Synthetic polynucleotide
cgcgagttcgggtgagagttatcggaatgcgggaacgtagtttagtcgggaatagggttttcgataggggtcgttcgtggttaggacgcggtcgttgaatagaggtcgcgcggcggtttttgttcgagggatttcgtgggcgggggttatacggaggtcgcgtacggttttcggggttggcgggggtaggtgggaggatttttttcgggttcgcgaatttgatttggtagcggttaggtgtttggaagcgtttttaaatgatagggttataaagatatgttggttaggtttgtagttagcgtagtaacgtggtttgtaggagcgtagaacgaggttagatagggttattcggacgtcg

SEQ ID NO: 2404 - DNA, 13 bp, Artificial Sequence
  Description of Artificial Sequence: Synthetic oligonucleotide
cgttataattgcg

SEQ ID NO: 2405 - DNA, 2 bp, Artificial Sequence
  Description of Artificial Sequence: Synthetic oligonucleotide
cg

SEQ ID NO: 2406 - DNA, 2 bp, Artificial Sequence
  Description of Artificial Sequence: Synthetic oligonucleotide
cg

SEQ ID NO: 2407 - DNA, 95 bp, Artificial Sequence
  Description of Artificial Sequence: Synthetic oligonucleotide
cgggtattcgggacgaggcgagggcgtagaaaatttggagtttaattagtacggagttgagttttcgcgttttaatttttaggtgatttcgtgcg

SEQ ID NO: 2408 - DNA, 45 bp, Artificial Sequence
  Description of Artificial Sequence: Synthetic oligonucleotide
cgtcgagagggtaggacgcgtacggtgcgttttaatttgttgtcg

SEQ ID NO: 2409 - DNA, 104 bp, Artificial Sequence
  Description of Artificial Sequence: Synthetic polynucleotide
cgcgagttagggggaggcgcgtcggaaagcgagagtgataagtagtttataagtcgaaaagtttttcgcgggaggcgcgcgtcgcgtgggtttcgatttagtcg

SEQ ID NO: 2410 - DNA, 87 bp, Artificial Sequence
  Description of Artificial Sequence: Synthetic oligonucleotide
cgggagggtggcggaaggtggtgtatcgtagcgtggttttcgtcgttgtcgtcgcggttttgtaaagtgttagcgggggcgaaagcg

SEQ ID NO: 2411 - DNA, 62 bp, Artificial Sequence
  Description of Artificial Sequence: Synthetic oligonucleotide
cgatattgaataataatcgcggggaggagaggttatttgtagtcgaggttcgtaaattgtcg

SEQ ID NO: 2412 - DNA, 2 bp, Artificial Sequence
  Description of Artificial Sequence: Synthetic oligonucleotide
cg

SEQ ID NO: 2413 - DNA, 2 bp, Artificial Sequence
  Description of Artificial Sequence: Synthetic oligonucleotide
cg

SEQ ID NO: 2414 - DNA, 2 bp, Artificial Sequence
  Description of Artificial Sequence: Synthetic oligonucleotide
cg

SEQ ID NO: 2415 - DNA, 2 bp, Artificial Sequence
  Description of Artificial Sequence: Synthetic oligonucleotide
cg

SEQ ID NO: 2416 - DNA, 2 bp, Artificial Sequence
  Description of Artificial Sequence: Synthetic oligonucleotide
cg

SEQ ID NO: 2417 - DNA, 2 bp, Artificial Sequence
  Description of Artificial Sequence: Synthetic oligonucleotide
cg

SEQ ID NO: 2418 - DNA, 2 bp, Artificial Sequence
  Description of Artificial Sequence: Synthetic oligonucleotide
cg

SEQ ID NO: 2419 - DNA, 2 bp, Artificial Sequence
  Description of Artificial Sequence: Synthetic oligonucleotide
cg

SEQ ID NO: 2420 - DNA, 145 bp, Artificial Sequence
  Description of Artificial Sequence: Synthetic polynucleotide
cgggaatcgtaggagaggattggggttttaggtggacggtgttgattgtattggttttgaagattggaagtgggtgtaggaggaatttgcgatagttgagattagggcgcgcgggtagatgcgttaggtcgttagtaaatcggcg

SEQ ID NO: 2421 - DNA, 2 bp, Artificial Sequence
  Description of Artificial Sequence: Synthetic oligonucleotide
cg

SEQ ID NO: 2422 - DNA, 19 bp, Artificial Sequence
  Description of Artificial Sequence: Synthetic oligonucleotide
cggtttttggcggtgggcg

SEQ ID NO: 2423 - DNA, 35 bp, Artificial Sequence
  Description of Artificial Sequence: Synthetic oligonucleotide
cggaggtttcgttaatggggtcgtcgtcgtcgtcg

SEQ ID NO: 2424 - DNA, 2 bp, Artificial Sequence
  Description of Artificial Sequence: Synthetic oligonucleotide
cg

SEQ ID NO: 2425 - DNA, 2 bp, Artificial Sequence
  Description of Artificial Sequence: Synthetic oligonucleotide
cg

SEQ ID NO: 2426 - DNA, 36 bp, Artificial Sequence
  Description of Artificial Sequence: Synthetic oligonucleotide
cggtttttttgtagttagcggattagcgttagttcg

SEQ ID NO: 2427 - DNA, 2 bp, Artificial Sequence
  Description of Artificial Sequence: Synthetic oligonucleotide
cg

SEQ ID NO: 2428 - DNA, 42 bp, Artificial Sequence
  Description of Artificial Sequence: Synthetic oligonucleotide
cgtataatggtaaatgggattaggtaggcgaaggtttagtcg

SEQ ID NO: 2429 - DNA, 2 bp, Artificial Sequence
  Description of Artificial Sequence: Synthetic oligonucleotide
cg

SEQ ID NO: 2430 - DNA, 2 bp, Artificial Sequence
  Description of Artificial Sequence: Synthetic oligonucleotide
cg

SEQ ID NO: 2431 - DNA, 18 bp, Artificial Sequence
  Description of Artificial Sequence: Synthetic oligonucleotide
cggcgcgggcgttgcgcg

SEQ ID NO: 2432 - DNA, 2 bp, Artificial Sequence
  Description of Artificial Sequence: Synthetic oligonucleotide
cg

SEQ ID NO: 2433 - DNA, 2 bp, Artificial Sequence
  Description of Artificial Sequence: Synthetic oligonucleotide
cg

SEQ ID NO: 2434 - DNA, 2 bp, Artificial Sequence
  Description of Artificial Sequence: Synthetic oligonucleotide
cg

SEQ ID NO: 2435 - DNA, 118 bp, Artificial Sequence
  Description of Artificial Sequence: Synthetic polynucleotide
cgcgtcgttgttttgttttaggtttcggtgcggttttaagttttagtttagggtttttaggtttttttaggcggcggtggcggtatttatttgggtcgcggagtcggggtttggtacg

SEQ ID NO: 2436 - DNA, 22 bp, Artificial Sequence
  Description of Artificial Sequence: Synthetic oligonucleotide
cgttcgcgtcgttcgcggttcg

SEQ ID NO: 2437 - DNA, 2 bp, Artificial Sequence
  Description of Artificial Sequence: Synthetic oligonucleotide
cg

SEQ ID NO: 2438 - DNA, 2 bp, Artificial Sequence
  Description of Artificial Sequence: Synthetic oligonucleotide
cg

SEQ ID NO: 2439 - DNA, 2 bp, Artificial Sequence
  Description of Artificial Sequence: Synthetic oligonucleotide
cg

SEQ ID NO: 2440 - DNA, 2 bp, Artificial Sequence
  Description of Artificial Sequence: Synthetic oligonucleotide
cg

SEQ ID NO: 2441 - DNA, 31 bp, Artificial Sequence
  Description of Artificial Sequence: Synthetic oligonucleotide
cgtaatatattttagtatcgagtttttgtcg

SEQ ID NO: 2442 - DNA, 2 bp, Artificial Sequence
  Description of Artificial Sequence: Synthetic oligonucleotide
cg

SEQ ID NO: 2443 - DNA, 2 bp, Artificial Sequence
  Description of Artificial Sequence: Synthetic oligonucleotide
cg

SEQ ID NO: 2444 - DNA, 2 bp, Artificial Sequence
  Description of Artificial Sequence: Synthetic oligonucleotide
cg

SEQ ID NO: 2445 - DNA, 2 bp, Artificial Sequence
  Description of Artificial Sequence: Synthetic oligonucleotide
cg

SEQ ID NO: 2446 - DNA, 2 bp, Artificial Sequence
  Description of Artificial Sequence: Synthetic oligonucleotide
cg

SEQ ID NO: 2447 - DNA, 2 bp, Artificial Sequence
  Description of Artificial Sequence: Synthetic oligonucleotide
cg

SEQ ID NO: 2448 - DNA, 2 bp, Artificial Sequence
  Description of Artificial Sequence: Synthetic oligonucleotide
cg

SEQ ID NO: 2449 - DNA, 2 bp, Artificial Sequence
  Description of Artificial Sequence: Synthetic oligonucleotide
cg

SEQ ID NO: 2450 - DNA, 2 bp, Artificial Sequence
  Description of Artificial Sequence: Synthetic oligonucleotide
cg

SEQ ID NO: 2451 - DNA, 69 bp, Artificial Sequence
  Description of Artificial Sequence: Synthetic oligonucleotide
cgtttttcggttcgtttttttcgagcgtcgtcgatacgttagttaaacggtcgttggtcgtttttagcg

SEQ ID NO: 2452 - DNA, 415 bp, Artificial Sequence
  Description of Artificial Sequence: Synthetic polynucleotide
cgtacgggttgggtttgggaatggggatcgcgaggttttagtatttcgatgttttgaaagttttttcgtttcggggatttgtttttgtgttgtagttggtaggggtcgtttgaagtgggagtagcgtttggagaaggcgggaggagttcggttcgggggacgggcggcgggatagcgggatttcggcggcgcggtgcgttttagggcgtagcggcggtcgtagatcgagtttcgggcgcggtaagaggcggcgggagtcggtggcggttcggtattatgcgtcgagggcgtttgttggagatcgttttgggatttatcgtgtttttagcgttttatacgagttatggggcggacgttaatttggaggttgggaacgtgaaggaaattagagttagtcgggttaagagaagaggcg

SEQ ID NO: 2453 - DNA, 2 bp, Artificial Sequence
  Description of Artificial Sequence: Synthetic oligonucleotide
cg

SEQ ID NO: 2454 - DNA, 2 bp, Artificial Sequence
  Description of Artificial Sequence: Synthetic oligonucleotide
cg

SEQ ID NO: 2455 - DNA, 2 bp, Artificial Sequence
  Description of Artificial Sequence: Synthetic oligonucleotide
cg

SEQ ID NO: 2456 - DNA, 2 bp, Artificial Sequence
  Description of Artificial Sequence: Synthetic oligonucleotide
cg

SEQ ID NO: 2457 - DNA, 2 bp, Artificial Sequence
  Description of Artificial Sequence: Synthetic oligonucleotide
cg

SEQ ID NO: 2458 - DNA, 62 bp, Artificial Sequence
  Description of Artificial Sequence: Synthetic oligonucleotide
cgtgcgtattttaagcgcgtgcgggagtgtgcgaggcgttgtgcgagttagcggcgggcgcg

SEQ ID NO: 2459 - DNA, 2 bp, Artificial Sequence
  Description of Artificial Sequence: Synthetic oligonucleotide
cg

SEQ ID NO: 2460 - DNA, 2 bp, Artificial Sequence
  Description of Artificial Sequence: Synthetic oligonucleotide
cg

SEQ ID NO: 2461 - DNA, 2 bp, Artificial Sequence
  Description of Artificial Sequence: Synthetic oligonucleotide
cg

SEQ ID NO: 2462 - DNA, 2 bp, Artificial Sequence
  Description of Artificial Sequence: Synthetic oligonucleotide
cg

SEQ ID NO: 2463 - DNA, 20 bp, Artificial Sequence
  Description of Artificial Sequence: Synthetic oligonucleotide
cggaggtttttgcgtttgcg

SEQ ID NO: 2464 - DNA, 69 bp, Artificial Sequence
  Description of Artificial Sequence: Synthetic oligonucleotide
cgttgcgttttttcgtttgttggcgtttttgttttagcgggattcggtagttaggggttttagggggcg

SEQ ID NO: 2465 - DNA, 2 bp, Artificial Sequence
  Description of Artificial Sequence: Synthetic oligonucleotide
cg

SEQ ID NO: 2466 - DNA, 318 bp, Artificial Sequence
  Description of Artificial Sequence: Synthetic polynucleotide
cgagacgcggtagatttttagagcggtttatttatttatcgaagcggattttgggcggtttcgggttgattcgcgttgttagggcgcggattttatttcgggcgtattgttaggagaaggggtttttcggggcggcgcgtttcgattttgggttttcggtgttcgtagagggcggagattcgcggcgttttaggttatttattcgtattttttcgagttaaatttttagcgtttattcggattcgacggtttaagtattgatttttaggtaagagtcgttttttttggtttttagggaattgatattatcgcgggacg

SEQ ID NO: 2467 - DNA, 27 bp, Artificial Sequence
  Description of Artificial Sequence: Synthetic oligonucleotide
cgcgttttcgttcggggagttattacg

SEQ ID NO: 2468 - DNA, 2 bp, Artificial Sequence
  Description of Artificial Sequence: Synthetic oligonucleotide
cg

SEQ ID NO: 2469 - DNA, 13 bp, Artificial Sequence
  Description of Artificial Sequence: Synthetic oligonucleotide
cgcggggagttcg

SEQ ID NO: 2470 - DNA, 189 bp, Artificial Sequence
  Description of Artificial Sequence: Synthetic polynucleotide
cgtaatttttagttaaagttatcgcgggcggattatggtttagggcgttagaggggttagaggtacgggaagaggaaaagacggttaattgggaaaaaaagagaaaacgaaagaaaagttaaacgatgagtttttataaggaggacggagtgaatagtttgtgttagaaggttttgtatatcgttatcg

SEQ ID NO: 2471 - DNA, 2 bp, Artificial Sequence
  Description of Artificial Sequence: Synthetic oligonucleotide
cg

SEQ ID NO: 2472 - DNA, 2 bp, Artificial Sequence
  Description of Artificial Sequence: Synthetic oligonucleotide
cg

SEQ ID NO: 2473 - DNA, 13 bp, Artificial Sequence
  Description of Artificial Sequence: Synthetic oligonucleotide
cgtttagttttcg

SEQ ID NO: 2474 - DNA, 51 bp, Artificial Sequence
  Description of Artificial Sequence: Synthetic oligonucleotide
cgaaggcgaggtcgtttagttcgtattttattttacgtacggtatacgtcg

SEQ ID NO: 2475 - DNA, 289 bp, Artificial Sequence
  Description of Artificial Sequence: Synthetic polynucleotide
cggtagtgtttttttaagaaggggtaaaaaaatttgtttatggttatttttttttcgttttattttttttttttttgatagtttcggttttggttgttcgagtcgggggtgtgttttcggttttttttagatttgggcggggggcgggaggagtgagcgatttgggaagtttcgggggtggagagggggcgtttcggggtttgggggcgacgtggatattttttttggagtacggcggtgcgtttgggatttgaaggaagggtcgaaggaagcggggtgcgggcgggcg

SEQ ID NO: 2476 - DNA, 2 bp, Artificial Sequence
  Description of Artificial Sequence: Synthetic oligonucleotide
cg

SEQ ID NO: 2477 - DNA, 165 bp, Artificial Sequence
  Description of Artificial Sequence: Synthetic polynucleotide
cgttttgggaagcgtagaggcgggggtgttgttcgcgttggggagtacgtgaggggatatttagggattgttcgcgcgaatggtttttaacgtatgcgttttattttatattttatagtcgttatgacgatcgggaggttcgtaacggttgcggggataagttcg

SEQ ID NO: 2478 - DNA, 21 bp, Artificial Sequence
  Description of Artificial Sequence: Synthetic oligonucleotide
cgaagtggtgtaggggcggcg

SEQ ID NO: 2479 - DNA, 2 bp, Artificial Sequence
  Description of Artificial Sequence: Synthetic oligonucleotide
cg

SEQ ID NO: 2480 - DNA, 2 bp, Artificial Sequence
  Description of Artificial Sequence: Synthetic oligonucleotide
cg

SEQ ID NO: 2481 - DNA, 2 bp, Artificial Sequence
  Description of Artificial Sequence: Synthetic oligonucleotide
cg

SEQ ID NO: 2482 - DNA, 159 bp, Artificial Sequence
  Description of Artificial Sequence: Synthetic polynucleotide
cgtgttcgtggatgcgtagcgttacgcggttgtttattatttagcgatatacgcggtttacggagaaggtgaggtcgtagcgggtcgatttgtcgcggtttaggcggtcgtcgtcggcgttgtttatgttgtagagggatagtgcggttagcgtagtcg

SEQ ID NO: 2483 - DNA, 2 bp, Artificial Sequence
  Description of Artificial Sequence: Synthetic oligonucleotide
cg

SEQ ID NO: 2484 - DNA, 129 bp, Artificial Sequence
  Description of Artificial Sequence: Synthetic polynucleotide
cgtgcgttcgagtggggtatttgttcgaggtcggggattgtgaatcgaaagattttatttagttttgttgtttttttggtattgcgatttgggggcgggttattttatttttttgaatttcgtttttcg

SEQ ID NO: 2485 - DNA, 2 bp, Artificial Sequence
  Description of Artificial Sequence: Synthetic oligonucleotide
cg

SEQ ID NO: 2486 - DNA, 120 bp, Artificial Sequence
  Description of Artificial Sequence: Synthetic polynucleotide
cgttttttttttttttttttttttttttttttttttttttttttttttttttttttggtattatagagttgttttgaaaatagaagatagagggagtttcggagttcgttatttttagcg

SEQ ID NO: 2487 - DNA, 2 bp, Artificial Sequence
  Description of Artificial Sequence: Synthetic oligonucleotide
cg

SEQ ID NO: 2488 - DNA, 171 bp, Artificial Sequence
  Description of Artificial Sequence: Synthetic polynucleotide
cgttcggttgttgtatttgttagtgttgggtttaggttgagaggcgatttttagtttttataataatgtttcgggttttttggtttgggttttcgtagcgttcgattgatcgttagcgatacgacgagaacgaggatttgtcggacgtggaggagatcgttagcgttcgcg

SEQ ID NO: 2489 - DNA, 2 bp, Artificial Sequence
  Description of Artificial Sequence: Synthetic oligonucleotide
cg

SEQ ID NO: 2490 - DNA, 2 bp, Artificial Sequence
  Description of Artificial Sequence: Synthetic oligonucleotide
cg

SEQ ID NO: 2491 - DNA, 2 bp, Artificial Sequence
  Description of Artificial Sequence: Synthetic oligonucleotide
cg

SEQ ID NO: 2492 - DNA, 64 bp, Artificial Sequence
  Description of Artificial Sequence: Synthetic oligonucleotide
cggggaaagttgggcgcgcgagtcgaggttgttgtttatttgtagtcgcgtcgtttatttgtcg

SEQ ID NO: 2493 - DNA, 2 bp, Artificial Sequence
  Description of Artificial Sequence: Synthetic oligonucleotide
cg

SEQ ID NO: 2494 - DNA, 2 bp, Artificial Sequence
  Description of Artificial Sequence: Synthetic oligonucleotide
cg

SEQ ID NO: 2495 - DNA, 2 bp, Artificial Sequence
  Description of Artificial Sequence: Synthetic oligonucleotide
cg

SEQ ID NO: 2496 - DNA, 2 bp, Artificial Sequence
  Description of Artificial Sequence: Synthetic oligonucleotide
cg

SEQ ID NO: 2497 - DNA, 16 bp, Artificial Sequence
  Description of Artificial Sequence: Synthetic oligonucleotide
cgagttttgcggagcg

SEQ ID NO: 2498 - DNA, 2 bp, Artificial Sequence
  Description of Artificial Sequence: Synthetic oligonucleotide
cg

SEQ ID NO: 2499 - DNA, 2 bp, Artificial Sequence
  Description of Artificial Sequence: Synthetic oligonucleotide
cg

SEQ ID NO: 2500 - DNA, 2 bp, Artificial Sequence
  Description of Artificial Sequence: Synthetic oligonucleotide
cg

SEQ ID NO: 2501 - DNA, 18 bp, Artificial Sequence
  Description of Artificial Sequence: Synthetic oligonucleotide
cgcggtcgagggaatgcg

SEQ ID NO: 2502 - DNA, 118 bp, Artificial Sequence
  Description of Artificial Sequence: Synthetic polynucleotide
cgcgtttttgtttttgggtagatttttttatttgtgtattttggtttttttatttagtaaagagatgtgcgaagtgtgcgtttggagacgagtcgtttcggtgatttttattcgttcg

SEQ ID NO: 2503 - DNA, 2 bp, Artificial Sequence
  Description of Artificial Sequence: Synthetic oligonucleotide
cg

SEQ ID NO: 2504 - DNA, 2 bp, Artificial Sequence
  Description of Artificial Sequence: Synthetic oligonucleotide
cg

SEQ ID NO: 2505 - DNA, 2 bp, Artificial Sequence
  Description of Artificial Sequence: Synthetic oligonucleotide
cg

SEQ ID NO: 2506 - DNA, 2 bp, Artificial Sequence
  Description of Artificial Sequence: Synthetic oligonucleotide
cg

SEQ ID NO: 2507 - DNA, 2 bp, Artificial Sequence
  Description of Artificial Sequence: Synthetic oligonucleotide
cg

SEQ ID NO: 2508 - DNA, 22 bp, Artificial Sequence
  Description of Artificial Sequence: Synthetic oligonucleotide
cggatttttttggggcggcgcg

SEQ ID NO: 2509 - DNA, 112 bp, Artificial Sequence
  Description of Artificial Sequence: Synthetic polynucleotide
cgaggtagggaggcgttttcgtagtttttgattttataattcgcgcgcgtgtgtatcgagtcgcgggtatatcgcgaatatatatatatatatatatattcgtgcgttttcg

SEQ ID NO: 2510 - DNA, 109 bp, Artificial Sequence
  Description of Artificial Sequence: Synthetic polynucleotide
cgtggaggagtggggttaggtggttattattagtatgtttattcgttacgttcgtacgtagtttttgagttttatttagaacgtaagtgggtttagtttaggtagagcg

SEQ ID NO: 2511 - DNA, 2 bp, Artificial Sequence
  Description of Artificial Sequence: Synthetic oligonucleotide
cg

SEQ ID NO: 2512 - DNA, 2 bp, Artificial Sequence
  Description of Artificial Sequence: Synthetic oligonucleotide
cg

SEQ ID NO: 2513 - DNA, 2 bp, Artificial Sequence
  Description of Artificial Sequence: Synthetic oligonucleotide
cg

SEQ ID NO: 2514 - DNA, 431 bp, Artificial Sequence
  Description of Artificial Sequence: Synthetic polynucleotide
cgtgtttttttataggttttatttgtaattgagacgaatgattatagtggggcgggaaggagtagttgtttattaattaatttttaattaaaagtgtttttcgttttcgggtgattaaagagaaatatcgttcgttgggcgatattgattcggatggaatttatttgttaacgttcggaggaatggttttttcgtttatcgcgcggtcgggattgttttggtttttttcggtttgagtcgtcggcgagtgatcggcgagtttgcggttaggtcgggttgcgcgaggtggggttgacgttagagtttttttcgttttaagtcgcgtatatttgatttgacgggttcgcgcgattcgtttttttttttttttttttcgtaaaatatgtatttttgtcgtcgttgcgaggtcgttcggttttagagttttttcg

SEQ ID NO: 2515 - DNA, 2 bp, Artificial Sequence
  Description of Artificial Sequence: Synthetic oligonucleotide
cg

SEQ ID NO: 2516 - DNA, 40 bp, Artificial Sequence
  Description of Artificial Sequence: Synthetic oligonucleotide
cgtttttatttttttagcggagttatagcggggcgcggcg

SEQ ID NO: 2517 - DNA, 2 bp, Artificial Sequence
  Description of Artificial Sequence: Synthetic oligonucleotide
cg

SEQ ID NO: 2518 - DNA, 22 bp, Artificial Sequence
  Description of Artificial Sequence: Synthetic oligonucleotide
cgtggttttgaatttgttggcg

SEQ ID NO: 2519 - DNA, 2 bp, Artificial Sequence
  Description of Artificial Sequence: Synthetic oligonucleotide
cg

SEQ ID NO: 2520 - DNA, 47 bp, Artificial Sequence
  Description of Artificial Sequence: Synthetic oligonucleotide
cgagttggagaattatagtatgtattgcgtgtaatgtaagatgttcg

SEQ ID NO: 2521 - DNA, 24 bp, Artificial Sequence
  Description of Artificial Sequence: Synthetic oligonucleotide
cgtgttagaagttttttaacggcg

SEQ ID NO: 2522 - DNA, 2 bp, Artificial Sequence
  Description of Artificial Sequence: Synthetic oligonucleotide
cg

SEQ ID NO: 2523 - DNA, 45 bp, Artificial Sequence
  Description of Artificial Sequence: Synthetic oligonucleotide
cgagggttttagttaattagtttgttgggtgggtttggagtttcg

SEQ ID NO: 2524 - DNA, 2 bp, Artificial Sequence
  Description of Artificial Sequence: Synthetic oligonucleotide
cg

SEQ ID NO: 2525 - DNA, 258 bp, Artificial Sequence
  Description of Artificial Sequence: Synthetic polynucleotide
cgcgtatttgtttaggcgttgcggtttagcgcgttttaatttttagttcgggcggagagcgggggcgggattgaagtatcgtgttttttaaagtattttttcgtcgtcggtagttttggtttcgtaaatgttttagcgcgtttaggcgtacgtagagattggcgcggtagttttcgggttaacggtacgcgagtaaagttggttggcgatttgggatacgtagtagaagttgaggttgtatcgattttcgtcgtttcg

SEQ ID NO: 2526 - DNA, 45 bp, Artificial Sequence
  Description of Artificial Sequence: Synthetic oligonucleotide
cgcgatcgtaagttcgagtttaggtttttcggagtcgttagggcg

SEQ ID NO: 2527 - DNA, 7 bp, Artificial Sequence
  Description of Artificial Sequence: Synthetic oligonucleotide
cgtcgcg

SEQ ID NO: 2528 - DNA, 4 bp, Artificial Sequence
  Description of Artificial Sequence: Synthetic oligonucleotide
cgcg

SEQ ID NO: 2529 - DNA, 67 bp, Artificial Sequence
  Description of Artificial Sequence: Synthetic oligonucleotide
cgaggtcgtttcgttggttggtgtaagaattagtttgtaatttaagttttgagttgttggcgtttcg

SEQ ID NO: 2530 - DNA, 43 bp, Artificial Sequence
  Description of Artificial Sequence: Synthetic oligonucleotide
cgttcgagttttcgttgttgtcgttgtcgttgcgggttagtcg

SEQ ID NO: 2531 - DNA, 2 bp, Artificial Sequence
  Description of Artificial Sequence: Synthetic oligonucleotide
cg

SEQ ID NO: 2532 - DNA, 2 bp, Artificial Sequence
  Description of Artificial Sequence: Synthetic oligonucleotide
cg

SEQ ID NO: 2533 - DNA, 113 bp, Artificial Sequence
  Description of Artificial Sequence: Synthetic polynucleotide
cgttcgagattcgggagagattaggggttcgtaaagtagaagagtagatttagaaagaaaaaaaaaaaagcgagaagtgcgagaaaaatatattgaatttagttaaatatacg

SEQ ID NO: 2534 - DNA, 4 bp, Artificial Sequence
  Description of Artificial Sequence: Synthetic oligonucleotide
cgcg

SEQ ID NO: 2535 - DNA, 2 bp, Artificial Sequence
  Description of Artificial Sequence: Synthetic oligonucleotide
cg

SEQ ID NO: 2536 - DNA, 84 bp, Artificial Sequence
  Description of Artificial Sequence: Synthetic oligonucleotide
cgggttttggggcgttggtgttcgcgtagttttagtcgttttcgtagttatcgtcgttcggtttcgcggaggcggcgcgtagcg

SEQ ID NO: 2537 - DNA, 2 bp, Artificial Sequence
  Description of Artificial Sequence: Synthetic oligonucleotide
cg

SEQ ID NO: 2538 - DNA, 48 bp, Artificial Sequence
  Description of Artificial Sequence: Synthetic oligonucleotide
cgtaggttaagatttggttttagaattatcgttataagatgaagcgcg

SEQ ID NO: 2539 - DNA, 228 bp, Artificial Sequence
  Description of Artificial Sequence: Synthetic polynucleotide
cgtcgttattacgtcgcgcgtcgtatttcgcgttaagaatggggcggttaagttgtttaagtcgttcgtcgtcgtcgtcgtcgtcgcggtcgaggcgttcggcgtcggcgcgggtatggagcgttcgtagagtcgttttagtttgttcgtttttttcgaggcgttcgttatttatttttcgtgtatgaattttttcgacgacgaggacgtaggtaagcgcgcggttcg

SEQ ID NO: 2540 - DNA, 47 bp, Artificial Sequence
  Description of Artificial Sequence: Synthetic oligonucleotide
cgttggtgcgtggcggcgtggagcgcgtttgttacggttaaggtgcg

SEQ ID NO: 2541 - DNA, 185 bp, Artificial Sequence
  Description of Artificial Sequence: Synthetic polynucleotide
cgtcgtttttcggtttagagtttttattttcggtttgtgagtttgcggcgttggtggagttcggttttaggaagaggagtttattcggttttttttgattggatagtagcgaggttttatcgggcgttttcgcggtttaaaatcgaagcgggggcgagggggaggtagagttcgttttttgcgcg

SEQ ID NO: 2542 - DNA, 216 bp, Artificial Sequence
  Description of Artificial Sequence: Synthetic polynucleotide
cggcgttttatttattggcgtttacggttcgtaggtaaagcgtggaaggagttgaacgcggcggagaagcggtttttcgtggaggaagtcgaacggttgcgcgtgtagtatttgcgcgattattttaattataagtatcggtcgcgtcgtaagaagtaggcgcgtaaggttcggcggttggagttcggttttttgttttcgggattagcgttttcg

SEQ ID NO: 2543 - DNA, 344 bp, Artificial Sequence
  Description of Artificial Sequence: Synthetic polynucleotide
cgaataatagaaattgttaattttaataatttagagtaggttaacgaggttttgttttttcgattcgaattaaaggtttttcgtttcgtgcgttgttacgagcggtgttttttggggttttaatgtagcgagttgtgttcgaggggttcggaaggcgtaagttgggtagcgatatggggaacgcggagcgggtttcggggtttcggagttttgggttagtatttacgttgttgttgttcgtcgcggcgttattggtcgtgtcggacgtattcgggcgttttttcgaggaggacgaggagttagtggtgtcggagttggagcgcgtttcgggatacgggattacg

SEQ ID NO: 2544 - DNA, 28 bp, Artificial Sequence
  Description of Artificial Sequence: Synthetic oligonucleotide
cgtttcggtttggttgttaaatagaacg

SEQ ID NO: 2545 - DNA, 124 bp, Artificial Sequence
  Description of Artificial Sequence: Synthetic polynucleotide
cggcgcgtacggttaaggtacgcgcgttggtatacgcgggcgcggatacgcgcggatatatacgtgcgggatacgttttttttcgacggcggcgttaatttttcggtaagtttagcgttttacg

SEQ ID NO: 2546 - DNA, 80 bp, Artificial Sequence
  Description of Artificial Sequence: Synthetic oligonucleotide
cgaggtgtaggcggcgcgggcgtttatcgtgagcgtcgtgttgttggcgttcgttgcgtttttcgtgattttggcgggcg

SEQ ID NO: 2547 - DNA, 62 bp, Artificial Sequence
  Description of Artificial Sequence: Synthetic oligonucleotide
cgaggcgtggaggggtagtcgcggcggggcgatttttatttgtttattgcggggtttgttcg

SEQ ID NO: 2548 - DNA, 165 bp, Artificial Sequence
  Description of Artificial Sequence: Synthetic polynucleotide
cgttatttgatttcgttattaagtttaaggtgttttggatttacggtaagtatagcgtcgttgtagttggtcgtgcgtttttattatcgtcgttaggtttcgaggtcgcgtttagttttagtaagaggaaacggacgtttagcgataaatcggcgtatacggtcg

SEQ ID NO: 2549 - DNA, 43 bp, Artificial Sequence
  Description of Artificial Sequence: Synthetic oligonucleotide
cgcgtttcgaggaagcgtcggaattattagaagtatagggacg

SEQ ID NO: 2550 - DNA, 86 bp, Artificial Sequence
  Description of Artificial Sequence: Synthetic oligonucleotide
cgttatttttaattagttgtaagtcgagttgtttatttgggatcgggtcggttcggcgggtttggttttcggcgaaggcggcggcg

SEQ ID NO: 2551 - DNA, 23 bp, Artificial Sequence
  Description of Artificial Sequence: Synthetic oligonucleotide
cgtttttttattttacgggttcg

SEQ ID NO: 2552 - DNA, 2 bp, Artificial Sequence
  Description of Artificial Sequence: Synthetic oligonucleotide
cg

SEQ ID NO: 2553 - DNA, 99 bp, Artificial Sequence
  Description of Artificial Sequence: Synthetic oligonucleotide
cggtaggagtagtttatagttaggagcgttttttcgtttttaacgtcgcgtttttttttttaaaacggtttaaaaaaatttattaattgtatggtcgcg

SEQ ID NO: 2554 - DNA, 73 bp, Artificial Sequence
  Description of Artificial Sequence: Synthetic oligonucleotide
cgattatttttgtgtttttaggagtttattttgggcggtagggaggcgttgcgtggggtttacgagttttacg

SEQ ID NO: 2555 - DNA, 2 bp, Artificial Sequence
  Description of Artificial Sequence: Synthetic oligonucleotide
cg

SEQ ID NO: 2556 - DNA, 52 bp, Artificial Sequence
  Description of Artificial Sequence: Synthetic oligonucleotide
cgtttttaggattttcgttcgtttttttttgattcggtttttgttcgtttcg

SEQ ID NO: 2557 - DNA, 50 bp, Artificial Sequence
  Description of Artificial Sequence: Synthetic oligonucleotide
cgtagtcgtcgcgttcgtatttgattatggagtgcgtttttttgttcgcg

SEQ ID NO: 2558 - DNA, 50 bp, Artificial Sequence
  Description of Artificial Sequence: Synthetic oligonucleotide
cgaacgtagagtttatacgtggattttcgcgtttgtgatgtttcgattcg

SEQ ID NO: 2559 - DNA, 2 bp, Artificial Sequence
  Description of Artificial Sequence: Synthetic oligonucleotide
cg

SEQ ID NO: 2560 - DNA, 2 bp, Artificial Sequence
  Description of Artificial Sequence: Synthetic oligonucleotide
cg

SEQ ID NO: 2561 - DNA, 52 bp, Artificial Sequence
  Description of Artificial Sequence: Synthetic oligonucleotide
cgtttggggtttacgcgagtcgcgagtttttgtttgtttttgcgttatttcg

SEQ ID NO: 2562 - DNA, 2 bp, Artificial Sequence
  Description of Artificial Sequence: Synthetic oligonucleotide
cg

SEQ ID NO: 2563 - DNA, 2 bp, Artificial Sequence
  Description of Artificial Sequence: Synthetic oligonucleotide
cg

SEQ ID NO: 2564 - DNA, 2 bp, Artificial Sequence
  Description of Artificial Sequence: Synthetic oligonucleotide
cg

SEQ ID NO: 2565 - DNA, 138 bp, Artificial Sequence
  Description of Artificial Sequence: Synthetic polynucleotide
cgcggcgtttttagttgttttttattcgtttcgttcgttagtttttttttcgcgcgatggtttcggcgttgagttatgtttttaagtttaagtttttcgtgattttgttcgttatttcgtttttgttgttgttattcg

SEQ ID NO: 2566 - DNA, 2 bp, Artificial Sequence
  Description of Artificial Sequence: Synthetic oligonucleotide
cg

SEQ ID NO: 2567 - DNA, 2 bp, Artificial Sequence
  Description of Artificial Sequence: Synthetic oligonucleotide
cg

SEQ ID NO: 2568 - DNA, 2 bp, Artificial Sequence
  Description of Artificial Sequence: Synthetic oligonucleotide
cg

SEQ ID NO: 2569 - DNA, 1216 bp, Homo sapiens
caaggtggggaccgggacgcgaccggggatggggaagggggctgcaggaggccccgcctgcgctgtcgcccctgctgggcacagcgccccccaccacccgcggcgaccccggcccccgcaaggtggggcggcgagcaggagccggggccaggccaggggctcgagctcccgttcgaggggcggggaaggcgggtgacgtgagccgggccgggcgggcggagttgggaccggctccgggaggcgggggcgagcgcgcggagaggcagacgcgaggagggaggcggctgagcagcgcgggcggctctgcggcgggcgcggtgggcgcgggcggcggggccccgggatccccgcgcgcctcctccgcgcggcgccgccgccgcgcgtccccacgccccgcgctccacggcgccctcgccccgcgcgcctctcgtgcccgcctcctgccagtctccgggccgcggccgtctgcagagcgagcgctcagacggagcccccgggcaacttgagtggcgccgatcggcggcggagcctctggcagagccccccgacccggcagcgcggaggggactcgcgtccgtccgcgtcgcgtcaccccaaaccctaagcagcgccgccccatcggcgcggagctccggctggaggcaagagccgcgcgccgggagacacgcaccgtgagcggcagcgccgccggcctccctcctcgccgccccggagggcgaagccgcggctccccagccctttgctgcgccgcgacagcgccggaacacgccccgcctcgctgccgccttcgctgtgccgccggcggagggggccgcgagccccgcgccccggccggaggatgtgcgcccccgcgggccgcccagcctgagccatgcgccccaacggcggcggcgcgccggccggcatggagccccgcgcggccgcgctctgactcgctgtgcgccccgcggccggcgggcggcgggaggcggcggaccgagagccggagaccggcgccgcgggacggaagcgagcgggcgcgggcgccgcgcagatggcctgggcgagccaggtctgaggccccgctccccgaaacgtgaccatgtggattcaacagcttttaggactcaggtgagcgacccggccggcgccgggtgcgtgtgggcgcgtgggtgccaggctgggcggaagcggcgctttcctctatgttgcaaatcaagggacccctcttcgcttc

SEQ ID NO: 2570 - DNA, 365 bp, Homo sapiens
ggcgtccgacgcccaccccgggcttggcgtccccttccggccaccacgcggcgccgccccccgggatcctccagtccccggagccccgcgcgcccagagccgctcggagcgcgggcggggtcagcttgggcagccgcgggtcgctgctgcgtcggaagtctccgtcgccagggagccccttgggcgccaggtcctgggcccctgggcgaagtcgacgccagaacatgcttggccccgcactcagctcaccgcaccctcagcgcgcgtgggtggggggcgccggctgaggtggggagggcatagtccagccccaggccatagtgccccgggcggggcagcgcggtgcggggtgaacgccaccggcc

SEQ ID NO: 2571 - DNA, 201 bp, Homo sapiens
tggcgtgacggcttgtggggcctgcggggtgcgctgcccccggacctgcggggggaggcggctgagctggcggcgctcgcgggcccagtggtgagtgcggcgtcctcacgcccagcccgacgcctccggagcggccgccgcgcaggggtgggcgcgggcttccaggagggagggcggctgtgaacgcgccttgctttccgc

SEQ ID NO: 2572 - DNA, 201 bp, Homo sapiens
atcacgtcgcccgtgctcatcatccacggcacggaggacgaggtgatcgacttctcgcacgggctggcgctctacgagcgctgccccaaggcggtggagccgctgtgggtggagggcgccgggcacaacgacatcgagctctacagccagtacctggagcgcctgcgtcgcttcatctcccaggagctgcccagccagcgc

SEQ ID NO: 2573 - DNA, 201 bp, Homo sapiens
gggcgcggcgggcgaggggtccgggctgagctgcgggccggcccggatggcgggcggcgcgggctggtcgggcgcccccgcggctctgctgcgctccgtgcgccgcctgcgcgaggtgttcgaggtgtgcggccgcgaccccgacggcttcctgcgcgtggagcgcgtcgcggcgctcggactgcgcttcggccagggcga

SEQ ID NO: 2574 - DNA, 201 bp, Homo sapiens
ggcgctctcccctcgcccctggcccaggcccggctcgcgggtgtagctcttcctagggccccctcccctttccgggccgcgcgtccgccccgcatcgcggcggctcctcggcagtgtttgtttttattggacgcacagtgaccgtgacgggcacggggcgcgagctctcatcaccacaatgggtgtgcatggcgcggggcg

SEQ ID NO: 2575 - DNA, 201 bp, Homo sapiens
cccccccttaattgacctaactttctaaccctagctcttcgcttctggcaccggtcccctcccaagtctccagaccctaaccctggctcccgacccgccccgctacagcttgggaagcgggagaagcagcgcgcgcccttctgcggaccccctcccagggaagattgtggtgttagctgcctagggggaccagggggccac

SEQ ID NO: 2576 - DNA, 201 bp, Homo sapiens
agcccaggggtagggggctcagggcagccagacctccctaggctcaggaagagtagtcttcagcgctcggctgtcaggcaatccggtccccggttccccacggcggtctcctcggtgtgccccaccaagagcgacagggctggtgacccgaggggcgcgtgcgcggtcgtcagcctgggatttgcacggacccccttctcc

SEQ ID NO: 2577 - DNA, 213 bp, Homo sapiens
gcctcttgcctgaaccaaagtggccaggcactcagtttgtaagatgaacaaatgaaggaaagaaggaacgaatgaataagggctcatcttgcagagcgttcgcgtctcagcgcgcaccaggcacatcagtgccaaaggtgctgggggtcgggcccagcgcccggcgcggctggaatgggggcggcgaggagctcctcctagccagccgcaggg

SEQ ID NO: 2578 - DNA, 201 bp, Homo sapiens
gggaggcggcaggcagggggcgctgcggggcgaggcaagtgcagtccgccgctgcctgcctgcgagtctggggctgcgcgccgctccccacctagctgcgcgacccgagcgccgcgcccaccgcgctccgtgggctcccgcgcctcgaagggtcgggatccggtctgagcctctcctggctctcggtgcaagccgctgggc

SEQ ID NO: 2579 - DNA, 201 bp, Homo sapiens
cggggcactcggccgtgccgccgccgccgccccagctgccgcctttgcccccgctcccgcgaccgctgtcagagcgcatcacccgcgaggaggtggagggcgaaagcctggacctgtgcctgcagcagctctacaaatagttaagtagctgggcttggctggtggtgggcccgcggtccccaccgcgccggcctcggacgc

SEQ ID NO: 2580 - DNA, 201 bp, Homo sapiens
aaggggggcctggctcgttagcgcaggggatccgagctgggcaggacatgtgagatagtcacagttttccagagatcacgacaagatctaaccagtcgcgcgtggtccccggcgccggagcgggccagctcagcccggcccagcccggccccgcgcagagcccccgccgcccccgcgcacagagccgggtgccccttgcgg

SEQ ID NO: 2581 - DNA, 324 bp, Homo sapiens
ggtgggggcctgggagacggtcgaagggggcccgggcagaagctccgcggccgggccggcggagggaagggggcggccgcgcccgggacccggctcccctcggctccacttacctgctccgaagagtggccccagctctgcgcctcttcctgcgaccccacacacagggacagccccaggcacagccccagcagcaggagcatggcggggcgagggcgcgggacgctcggggacccggcgggacacgctttgcagcgcccagggctccagccactgcgggacgctctcggggccgcccaccccgcggtcccagcccggaccccg

SEQ ID NO: 2582 - DNA, 201 bp, Homo sapiens
ccgcggtgctgccgcgccaagcgaaggaggaggagggctcggcgaccctggggacgaacgtcttggacgcttcgcccgcgtccttctctcgcgtccgccgcgcgcctgtctgctcggcctcttcttcgccttctctccggccgcccgggtcaaaacccaaggccaggttcttgagggtccgggtcctccagccgccccctc

SEQ ID NO: 2583 - DNA, 330 bp, Homo sapiens
ggactctggcgcccctccaggctgctgcgcgcgggctggggaccgtgcaccgctttgcgcgccagacgatgcatcttctggaacggcagctgaggcaatgcggggtgtgaagtggcggcgggcagaggggctcgcaggggctgggatccgcgtgcccctctctgcctcggtgcggagcacgatgtgcccgggcgggggcgaggacgtccgggaggggctgggctgcgcacgctcgcggggccgtcgcagatgggcggtttggaggcgctgcagtccctgggaaatgggagcctccgtcctgttctctctgctgcttggctgggctgggct

SEQ ID NO: 2584 - DNA, 293 bp, Homo sapiens
ttcagcatctcagcttttaagcctccctgagccggggctgcgttctcgttgtctccttcggccgccgcttcctggcgccagagggaccccgcggcccgcacgggcctgtcctcggctccgctcggagggtgtgcgggttcccgctccgctggccccgcttgcccaccacggcgcgcccaaacccacgcggcccgcggccccttgcgtgctctgccgaccccgggccgcaggaggggttagcctcgccggtccccacgcggggtctgcgccggcagcgccacgggctggaacgc

SEQ ID NO: 2585 - DNA, 201 bp, Homo sapiens
cgtccccgccccggtcctccgtcggcctggcgggcggcgacgtggggaggggccgctcagaagccggggtcgcccgggccggggaacttcctcgcgccgacgcccactccccacgggccgcactcgccgaggggccgaaaggggctccagtggaggacgcggtgggagctgggtcccgctctagctgccgacgccggcggt

SEQ ID NO: 2586 - DNA, 201 bp, Homo sapiens
tatcccgctaaagccggacaaagcgtggccagagtgcggcccagcctctcagcctgcggcccggggaggagggcagcgcgggcgcgggctgggggtggcgcggggcggcgctcaggatttcggtgcaggcgagagtgcggcggatttgctccaagaggagagcgaggcggatttgctccaagaggagagcgtggggcgccg

SEQ ID NO: 2587 - DNA, 226 bp, Homo sapiens
atggcgatgcctccactctcctcggcaggttttttcaattaaaaagttggaaacgggaatccgtaaacaacgacttagggcttcaaactacttgcaaagacgcgatggggaggggaatacttgcgcgcttcaaaaccccaacctcgaggtctccagccgcgcctgacccgggagccgggtgcgcccccagtgtccgcgcacgaacccggcgccctggcagccccga

SEQ ID NO: 2588 - DNA, 363 bp, Homo sapiens
ttgcaagggaccacagttacaatttactaggtaaccacacccaccgcattgcagaagccatgaacttggcgggcgtgggggggaaggggaagaagtccggcgagattagaggggaaatccgaaaaagcaagcccctgcggcagcagccaggaaacactcgccaggaactggctgcgaccccaactccagcggtccgaagccctagcctccccacccccaccgcggcagagccgccttcgcagacacctcccgaggagaatcgcggccccgagggcgccaggtgagtcgcgccgccccgagcccccgggccacggcaggccgacccaggcgcccccggcccgcccgtgctcccgcgcccgggtg

SEQ ID NO: 2589 - DNA, 201 bp, Homo sapiens
cggcccggtgggggtcccggcgagcgggagggcggttggggaccccggccgcgccgggcgcggggctcgggattcgggagaccgcgcggcgccgaagccacgcgtcagccccactgtcccgcgcgcctcgccccaggcctcgggctcttcctccgcacctcgtaaagccgagaccccctcgcagtcccccactccgagagg

SEQ ID NO: 2590 - DNA, 201 bp, Homo sapiens
ccgcgcttccccgccagccgccggccaggagctccccggcttctgagcaggacgcgccaaagggagttgggaggctcagcagcccccagcgtcgccttctcgggtgacgtgacgctctctctggagcgcgggcccgcctccgccaagcctccaccgcaggtccttacagccgagccacgggaagatgcaacgccgggcgag

SEQ ID NO: 2591 - DNA, 267 bp, Homo sapiens
cgcggggtgggggcgcgggagccgccccctgcccgccccgcgcgcatgctcccgccgcacctgcctcgctcagtgttccacaccccggggagccgggtggcgctgggcccgccgaggtcggggctttcccatgggagggaggtggctgcggcggaattttcagatgcgtccttctctgtattcgttccctgggaaggattcccccaaatcttggctacttcctgcctgccagcttgctccctggcagcgaagtcccagtagctcacc

SEQ ID NO: 2592 - DNA, 707 bp, Homo sapiens
gcggtggcgtcggcggctgcagggggacgagctagcgccgcggcgctgggagccagttgagcccggccggcgagcggaggcggcagcgcaggcagagcggcggcggcagcgggagcccgagcgctgcgcgcccaccatggccgcccagggagagcccggctacctggcggcgcagtcggaccccggctccaacagcgagcgcagcaccgactccccagtgcccggctccgaggacgacttggtcgccggggcgaccctgcacagcccggagtggagcgaggagcgcttccgcgtggacaggaagaaacttgaggccatgttacaaggtaggcatccctcgtgttctcggactctccgactgagcctctaactccttttcggacatccccaccgcgcgctccggcgcccgctactccagcctacggccggccggtttagctccaggcccgctcccccgcggagccggaggacacccagggactggagacttcgcgggactccccacccttccacgcctctcagatttccaggcgctgggggccctgtgcgaacttgactggcttcagaaaagccgaaggccgagtttgtactggcgcgcccaagttgcgttctggactttggagatgccaactttagcccggacacctgggctgtgccatccggaccactcgggccgcacagagtatgcgtgaccctccccattccct

SEQ ID NO: 2593 - DNA, 201 bp, Homo sapiens
ggacccaggaccctgtgcccgcgcccctggagccgctggagttcggacttctgcaactgttggcactttgggggcttggcttagcgctctgctgtttacccgtctctcctcgctgcctcggaaccaaagctcccggccccctccgccctcgcgcgcccacccaccgccgccggggagcggcccggcccgcactcagcacca

SEQ ID NO: 2594 - DNA, 201 bp, Homo sapiens
caggctccgcgcctgaccctccagcctgcgcagcgggcactcggccgggaagaacctctccagcaggcggctcagcactacgttcacgcgcccgcgcccgcgcccgcgcccgtggccgcgcgggccccagctccacgcagcgctcacagaccgtgagcccgcagggcagtgtcaccggcttgtgcagcagccccgggcagc

SEQ ID NO: 2595 - DNA, 201 bp, Homo sapiens
cactgggacccccacatacgagctggcacacactagtcacacacggctaattccagagggctggccctttgtcctgggacgctcccaggttttcgggccgcggtgcggagaactcaggtgggtgcccggcaagttacctaccaggggctgttcccccgcgaccctcgccataagcgcagggacccgggggccgcgctggct

SEQ ID NO: 2596 - DNA, 201 bp, Homo sapiens
gaaaactgcaaaacctgggagttatcctgcctcaccctcctgctgcctggggacaccccccgcgagcttgctcggccccgaagaaggagcagaggggacccgcaatccagcccctagagccccgccaggaaaggcgcgagagacctactggccccggcaaccctgccccggcgcccggacggagcccgatgcctgcgcagc

SEQ ID NO: 2597 - DNA, 203 bp, Homo sapiens
agcctagagtgcgccgagcaccgccccggcaggtggaggggctgcgggaaataaaataacttgggcaggaacttgattggtagcaggttcatctttggtccgcggtagggaatctaatggagatgaagaatggtggggaagggggggcggtgtctccttgggagcctaacgtacgcttctttattttgtcattctttggagat

SEQ ID NO: 2598 - DNA, 201 bp, Homo sapiens
cgcgcgtttccccgcgcgtctcccggacccgcgcctgcccacccctccggctctgctgcggtcgaggccccaagtcggttatcccgtgtccaggcaaccgcgggggcggcggcggcggcgtgaggagcgggcggctgctgctccggggcctcctggctcgagcccttagcccccgactcccggcgtttcggcgcccgatca

SEQ ID NO: 2599 - DNA, 201 bp, Homo sapiens
gggcttccagcctggcctttaggcgcggtggcggcggtgggacacgcgccaggcgcccagagaaggacatgggacaatggcccagcccgaggacgccagacgccgccgcccgacccggggaaggaagctcctgcagccggtccgggaacccgaggcggggagggaggccagctctggaggtgcgctgccgctttaaaataa

SEQ ID NO: 2600 - DNA, 208 bp, Homo sapiens
gcgccgcgccgccgcccggcctcccgaagtcgccccctgtcggcgcgtcggccgcttgcgccacggcgggcgccacttaccccgggcagagtcttctgctcgtgcagcgcgctctgggccttcagcgctgactcacgctcgcagtaggtgaggaaggcgcagcctggggaggaaagcaagcgccaagaagggtcagtggggcgccccc

SEQ ID NO: 2601 - DNA, 201 bp, Homo sapiens
gtaggggggctttatccaccaagctatgctctattagggcgccaggcgggcgaagcaaaggcagggatggcgggcggggcggcggcggaggtggaatgggcgcttttttcttccatctggctttatttatttatttagactagaaaagcgagccggcttggagggagtccgcccggggatccgagcgcgcattcatcagtg

SEQ ID NO: 2602 - DNA, 201 bp, Homo sapiens
gcgctccgcctcccgccccggcggctcccgcagccccgccgccgcccgcgcccgcgccccggagccgcgccacaaagggcccgcgcgcagccgccgccgccgccgccgcgcgaggagccaggatggtcctggtccacgtcggctatctcgtgcttccagtgtttggctctgtgcgaaacagaggtatcgctttttcctttc

SEQ ID NO: 2603 - DNA, 595 bp, Homo sapiens
aggaggccaggaaagcccaccacatgcgttggccccggctgtcgcacggcacctccatggtcaccgggatgatgagcgcatccatcttgggctcgtggaccgaggacgaggaggaagaggaggaggaagaagaagaagaggaagaggaggaggaggaggaggaggacgcgtctaggctgagatggttcgcgtggatattgctactcattctaagactgctgcctccgccgccgccgccgccgccgctgctgccgccgccgccgccgccaccatttgccatagctagcaacgggcagccggcgcaggggctcgggggagctcctcccgccgccagcgccaccccaaacacccatcaacagccatattgctgctactgctgccgccgccgccgccgccgcggagcgcgggaggggggcggggaggcgcctgggctcggggcgctgtgcgcgacctggcggggtgcgccgagatatatacagcgagccgccgccgcccgcccgggggggagggggatggagtgcgcgggcagctccccctccccggcccgcgccccgctcgccccgggctgcgctggccccgagcgccgagagccagg

SEQ ID NO: 2604 - DNA, 201 bp, Homo sapiens
caccgccggcgccgaggcggcgttcatgtctaaccgccgccgccaccgccgccgcctgctcctgcgcccgctcccgcgcctgctgcctccccgccgccgccgccgccgccgccactacagatccgcagacacacagccaagatccctgactcttaacaccaactctcttctccggggaggggaggggacggagggaagggg

SEQ ID NO: 2605 - DNA, 269 bp, Homo sapiens
ggtgtgatgtttccggtggataatgtctcccgttccctgccccggggcccagacagttggtgcttaagcgtctacaatgtagagtttcctgcattttcctcgggccgccatttgtctacttgtcccatccaggacatctccctaaataatctctaagtggaaaaatcacggtcctctaggagatttatccgggaacgaacgtgcgtggggcagttcaaattcctgagctcagatttcgtttcccgcggtcagatggtgcggtcggtggg

SEQ ID NO: 2606 - DNA, 201 bp, Homo sapiens
tcagcttgtcaccgcacggcggccgggaccgcagcccctgggtgcgcagtgcgcctctcgctgcgccctcctagagcgcgggtcccgtgcctgtgcccggcgcgacgcgatctccctgctagtcgggctccgcgtgctccccgcgcttcccgcagcctccgcgcagcccgcagcgccctccagccccgcctcgcggccgcg

SEQ ID NO: 2607 - DNA, 267 bp, Homo sapiens
gcaggagccccggcggcctgcaggggcggtggcgcggcgctgggcgcgcggccgctagatggcagcgcagccccggcccggcccgcgggaggcggccacgcgcgggggacgcggggcgcggcgcgctgagcgcgggtgccgaggctggagggcgcggccgggctcccgagtcctccctccgcggcatccttgtctccaccctcaaatgtcctgcaagccaggagcctccgtaggaaccgctgcatttttattttcctctaaatttca

SEQ ID NO: 2608 - DNA, 287 bp, Homo sapiens
ggcggtgtgcagagtggggcctgggcctcctgcccccaagggcagctgggtgggctccgtgctccctccgagtggacttggccccggctccaaacccagccgagggtcggctcgctcctggggacccgcggatgtcgcgagggggcgccgcgccactgaaggctgggacgggggcggtgcgcggggcggcgccggagtccgggatgccggctccagagacgccgcgctccgccccgaggaggccgccggccgggtaagcggagcccggagctcgcggagtctggacc

SEQ ID NO: 2609 - DNA, 201 bp, Homo sapiens
ggcctgccccgagcgcggcgggggcgccgggggcgccggcctccactttgcagggcaccggcggcgggaggaggggccggcgcccacgggttctcgccctcgcggcgccgcggaccaggagctggaactgctgcgggagtgcctgggagccgccgtgcctgcccggctgcgcaaggtggcctccgcgctggtgccaggtcg

SEQ ID NO: 2610 - DNA, 201 bp, Homo sapiens
gcgcctgctcgcgctctgcccaggtggccccggcggcctcggcgatcccctgcgagcgctgctgctcctgaaggcgctgcagggcctgcgcgtggagtggcgcgggcgggatccgcgcgggccgggtcgggcacagcgcagcgcgggggccaccgccgccgacgggccgtgcgcgctgcgcgagctcagcgtagacctccg

SEQ ID NO: 2611 - DNA, 286 bp, Homo sapiens
ctcagggggcgcccccgagccgcgccccgcgcccgcccccaggagggcctccgcgagccggctgcacaccccgaggcggtcccggctgcacaacttggagcgagttgctccgtttcctcattttgggggcgaagaagggtcggggagtgggggaaagcgggaggcgccgcggcctgggaggcccccgcgggtcctagcgccggccgcactgcggtctcctccgcgcgccgccgccgccgccggcccctccccgccccgcctccgcggcccccggcgcctcccgcgc

SEQ ID NO: 2612 - DNA, 244 bp, Homo sapiens
tagtagaccctggcgtggggcacctgagatctccgccactgaaaaggcgctatagaaatgcaaggaattatgattttaataaaattgtctcatttaggagcgagcttctgcgctgcctctgtcgtcggagcccgggtttgccacggcaaagtctgtaatcagagaaaaataccagctttgttgagggttagaatatatcattggctaatgtgtgtggttttctttttaaataatgctaagcatt

SEQ ID NO: 2613 - DNA, 201 bp, Homo sapiens
gtgggccggggatctcgctgctctgccttcctagcgggaaactgactgcctgagctctggaggacaaacagagacactggggggtcaacgggggcggccgcgggcggggctccaggcctccacccaccgggttgctgagcgcgcacgcagccacccgagggaagatccccgccgcccggggtctcggagaggggttagaac

SEQ ID NO: 2614 - DNA, 372 bp, Homo sapiens
gtggcattagcgaatgtggtggactccggcaggcctggggcaggggaatctccggtaacatccctcagtaccgaaggcaggatttcccggccacttccgtcggttggaattctcttaagcattgccctgagtctattttcaaatgaaagggggaaaaacccaaaccagattagaatctgaaacagctgaaacagctatcgatttccagcttgctttcaagtctggcagagactgtgaaagtcctaacttctccgcgatgtcagccacggcccgcggcggtcacggagccacttcagcacctcgcgatggacagtgacccccggcgtggcgcgagttccctgcggtccccacgcgggcctgggcggcgggtcc

SEQ ID NO: 2615 - DNA, 201 bp, Homo sapiens
agtcagctccacaatctgcgaccgacttctccttgcccagttcggcctcagtccccttcagccataagatggcaacagcgccgacagccgggccccgcggcgtcctgtctcttccctgccctggcctggagccctctctgggcagctctgcacccacagcgctgcgtctctcccagattgtgcagggagcacgggagggtt

SEQ ID NO: 2616 - DNA, 247 bp, Homo sapiens
gcttccggggggtcctggcgtcttagctgtggatcccccaatacccgcaggtcacagagccacagaggctggacctctagcagcagaggacacagaagaacgaagacgagacgcagagctccaactgcagccagagacaaaggccccgccacatcccggaagccgccctgtcctctcctgccccgtgcctgattggacggtttccagcccagcgtccctgattggataacttctaaggtcctgcccc

SEQ ID NO: 2617 - DNA, 201 bp, Homo sapiens
gatttggcgcggcctttgtttctcgctgccgccgaagctccaattttcgtctgtctgctttgtgtcctctgcacgtagaagcccagcctgtgtggccctgcgacctgcgggtattgggagatccacagctaagacgccagggccccctggaagcctagaaatggtgagagtgccggtccgacatcccgagagagggaacgg

SEQ ID NO: 2618 - DNA, 201 bp, Homo sapiens
ggcgtcttagctgtggatctcccaatgcttgcaggtcagagggccacagaggctgggcctctaagagcaggggacacaaagcagggaagacgagaccaagcgctccagctgcagcgagagacaaaggccccgccaaatcccggaagccgccctgtccgctccagttgcgtgcctgattggacggtccccagctcagggtcc

SEQ ID NO: 2619 - DNA, 235 bp, Homo sapiens
cttggtcggactgcgcgcttagggcctctcgcgcctgccagcctccgctctgcgggcattcctcctagcaccgggagcgcgcggctgctcgccctcgccgcgaccgtggcgccagcttcccgccccctctgccccgccctgagcatctgctctgcgccctccgctgcaaccctttatcctccgcctggattgcgggtctgggtgcggggtgttgcaggcttgcaggggacggggt

SEQ ID NO: 2620 - DNA, 201 bp, Homo sapiens
atcccgcgcctcccagtccggagtccatttgcataattggattttttttttttgcctccttctttctccctgaaacttgtttgaaaacccaagtgaaaaccgcgacgatctgcacactcaaaagcaagtgccaagtaagtgccctgcggtggcctcggcgcgccccggggtgagcgcgcaaagccgggagcgaggtgccgc

SEQ ID NO: 2621 - DNA, 201 bp, Homo sapiens
gggcgcggctctgggagcgggggaaggtgaggggaaatgggacatgatggcattaataatcgttaccaaagacggtgggagtaacaaaggaatgcgtctccgagacgccgcccagccccggggtgttttctggcgcggtcgcggtgcaggaacgcgagccccgccgccgagcctcccgccgcctgcgttcgttggcgcggc

SEQ ID NO: 2622 - DNA, 201 bp, Homo sapiens
gcccgggcgcgccggctggggctctggcgctctcgcaggccccgaggccgacagtcccggcgagggcgggcgccccgcgctccagcaccggctgcctgagcgctcctggagcagcaaaccccagacttcttcctccttctctccttccttccttccccctccccttatctttttctttttttagtctctttctccctcttt

SEQ ID NO: 2623 - DNA, 201 bp, Homo sapiens
tttgtttcaaaagttcacagcatgctttcttttcttttagaccgggagacagtgatctcacccacacggtaagatcaaaagtctccgctcgcccagcctgcgggcttgggctgggtccagacgtctcccaggatgcagatgcgccgccgctggcctccccggctataaagccgcctccagcgcctttccgcgcgcaggagc

SEQ ID NO: 2624 - DNA, 201 bp, Homo sapiens
gggcgaagcgacccagcgcgaggaccagtccccaaccaacccgctcctagttctgggcgccttccccagcagtcagatgggggcttcagaggccggtgcgcggccacatggccccgggccaggcagggggtcgtggggacgcatctgcgctaggcgcacagtattcctgggcgcgggacgggcgaagcgccgtgggttcca

SEQ ID NO: 2625 - DNA, 296 bp, Homo sapiens
tgcctccatctcccaccggggtccggctggccagaggcaagcttcgagaccccccaccaaccaccaccaccgttgcgagggccggtgaggctgcagataacgcttgcaaggacgggagtcggggagggtgtagggcgagtttaaaggacgggcagagcaagccccgggaagaggcaggggttttccctcccgggtcgccgccccccgcaccctcggagccagccgcagccacgcagcgccgcctgccgggcacaccaaggacctggcgcgcacgtggcgcttacccccacccccgg

SEQ ID NO: 2626 - DNA, 201 bp, Homo sapiens
agcccacgggccagcctggcggggtccgacggcggcggcggtggcggcagcgcccgatccagcggcatcagcctgggctacgaccagcgccacggcagcccgcgctccggtcgctcggacccgcgtcccggtcccgggccgccttcggtgggcagcgcccgctccagcgtttccagcctcggctcccggggctcggccggc

SEQ ID NO: 2627 - DNA, 201 bp, Homo sapiens
atccattggctgaaagctccgtctattttagggtgactgagagcgtctcttccttctgtgttgcctggaaacggactgttcgcctagtaacatctgatcacgtttcccattggtcaccgtttccggaagcccgctctcccgtttccggaatccccgcaggcgctgggtctgcagatggcgtccaggtacacagtggcgagt

SEQ ID NO: 2628 - DNA, 266 bp, Homo sapiens
gaaagataaaagggaaagcgcctccacgaaatccgcttacggacacgatcccggggccacactcagccagacgaatgtctggcaaatgacagtcacttcacgccagactctcacagtccttcacacgccactcccactgcctcagggaaccacaagcacaggcatcgccccgcccggcgtcctcctccaaagattggggcaccaggaccgcgggcccccactcccacccagcacaaagagtccggcgctcagagctagcggtttcc

SEQ ID NO: 2629 - DNA, 201 bp, Homo sapiens
tcgcaggccatctgtgtgactccggtgcgagtggaggttggtaccgttcagtgcgaggctgtcaccccgtgtgcctgtccacgtcctgtgtgactgggtgcgaggaagtcaatggcaccgtggaatgtgaggctgtgagttgaggcgggagcgggcgactgttcgctgcaccttgttgggccgatacccgcggcttctttg

SEQ ID NO: 2630 - DNA, 228 bp, Homo sapiens
cagagttcaggacaccccaggcttttcttgactcgattggaacccaccctccacgcttccctggccccaactaaccgccacctgcatgcacaaatggaaacgacagggcagagggtcagcagtcacccgcgtctgggttcgcagctccgggtacgctgtagttccgcacccggttgcccacgcccgggaccacccactgtgtcttttcggaactgtccagcgtgtcct

SEQ ID NO: 2631 - DNA, 248 bp, Homo sapiens
agaccccagacacccaccccaaatctaggtcccagcgttttgcaggggaccttcatcctggggcgttcacctctgacttccctcttgggccttttcgctacggccgagcctaagtggctgaagcgcggacgaggatgcgcggggcctcggtctccaactgcaccacaggccgcacccacgaacctggtccggcacagttactaccgcccgggcctccaggcctcagggctgcagaagctcagtcccgg

SEQ ID NO: 2632 - DNA, 387 bp, Homo sapiens
gaggcggccaccgcagcggccgccaacgagcagctgcacggaggtgcagaagaaggaggccactgccattctcctgacaagctgggggcgtgggaggcctcgggagctcgaagtcgcctcgagcgggggtgggcggtgagcggacccccgggtgttgaccaggtgtttggtggtagagcagggaaggggggaacggacgtcgaccctagggatccctcacccgctcacgctccttggcgttggccacacgccgccgctccagcaccaactggaggttttcagtggacgagtagccgcccgagggcagccgcttgagccggcagacagcggccagctggggcagcggcccgaactgctcccgcaacacgtcctccagcacctcggctt

SEQ ID NO: 2633 - DNA, 203 bp, Homo sapiens
cgctgcttccctgtgcgccaccgggggtctgccctgggcttgcccgacatcgtggctgcccgcctacctgagcgtaggtttttaccctgtgccagggccgcgcgtggctcccgtctgcggcctgctgggcttcggcgtcacaggtactgcggtcccggcgcccgcacgcgggggactgggcgggggctggagagcctaggtcg

SEQ ID NO: 2634 - DNA, 203 bp, Homo sapiens
gctgcgctccgctgctcagcccgggcggcccaccgtcccccttgcttgggtggacgcacccttgccctccgcctttattggcggcagcccccgtggggcgcgcgtggggggcgctggggtccccagctcccgcctcgagccccctgccgcggcgctgtcagtcccgggggcctgggcctcacctcgccttggtcttgttcgca

SEQ ID NO: 2635 - DNA, 312 bp, Homo sapiens
gccgggggggcgcccggggcggcggcggtggcggcgggcgggggcaggccgggctgcgaatacactccgaagttgtcgccgcagtagagggccatgtcggcggccgtgggcggctgcggcgcggccgcggcgaggggcgagcggggctggtctcgccgctcgggcgagagcatccctttgggggccaaccctgcggctccgccttcacccgcgctgggcgcccggtgctccgggccggggtcgggcgggtgctagcggagcgcctgctagccggcctcttataaccgagcccggcgcggctcctcctgggcc

SEQ ID NO: 2636 - DNA, 407 bp, Homo sapiens
cttcgggaggcccaggggcacggcgaggggtcggggaaaggcgatcgcccactacagcccgcgcgcctagactgagggaggagccgggctgcagaaccggcggcggatggagacgggagggaggctgcgaggtcgctcgaggagagactaaggctctagaaacggagaagcgggcgctctgcgggaggcggcggcgctgccgctggccgtcaagggcgggaagtgttctgggactctcattaggggccgcgagcctcgagcgtcaaattcccgcggcgtccgcctagcgcgctgctgtggcgggcgcggagggcgcgcgccggcagtgggggctgcggcggcggagggcacgggcccccgctcagcgtcctcaccttcttggtgcagctgcctcccgcgagccgaga

SEQ ID NO: 2637 - DNA, 295 bp, Homo sapiens
gcgcccgccccgcgcgcccctgtactccccgcgccgctcctcggggtcccgcggcgctcgcaggccgcgccgccctgccgcccctctctcgtggcttttacggcccgcccgcccctcagcagccctggggtgcccggggcggccctgcaagcgggagagagcggcgaggcggcggcgccgagtgcggggggatgcggagccgtgcccggccctgtcgcatccctcggccgcccgcccgcgcccggccccgcccggccttgcccgggctgcacgcacttctcccgcggcccagaat

SEQ ID NO: 2638 - DNA, 435 bp, Homo sapiens
cctggcccggcctggccagtccccgcggtctctgcccgggctgacgcccaggaatgtggtcgacgagaagccccaacagcacggcgtggcctctcagcctcggtgagtacccgccgtggggaagggtcctggggacccactggaggccgcggcccgcagcagccaggggccgagccacggccacggacgccctggtgtcccggtccgtgccgggcctccaggcggaggaggcgtccgctgggctcagatccccgactccagccccggttccccggcgcctgggctgcgcggagtccctgtcccgcgtcccggacccctacgcgcagcctccacgcgctccgagctggagaagccgccagcccgccctcccagggcgtgtcgcccgctttctgtttctttgtgcggggcatgtgaaatgtgtggggccagaattgt

SEQ ID NO: 2639 - DNA, 410 bp, Homo sapiens
cccttggagggaagcccgccgggaagctgaagacagtggtcaccgccctcggtcattacttcccgggacccggaccctaaccctgcgccacatctccacccgcccccagccgtgtcctggctgcgcagctggaaaggttgagcagctcactgctgtccctctgttcggccttggacacatcgcctgaactcctgggcgcctctgctgttaagtgggggacagcactatttactggggaggaaaactccaggaatgtggaccctggggccacgcaggggttgggaagtgaagggcagggaacgcgggcggcgcccggggtctgcgggtaggcaggcggcctggccgcggaggcttccccgagtcctgcgccttcctagagagggaggggctcatatcggctggcacagcca

SEQ ID NO: 2640 - DNA, 392 bp, Homo sapiens
ggagcccgctgggcgcgcccggcccggcccggccccgccgcacgcccgcccccctggcctggccgaggaccccggggtttggacgtgccaacgccactctcgcgcgccgaagctgtgacggtttactaagcagagacttgcgaggcacacagagagggaatgaggcggaaccgttcgggggctcgttgacactgcagagcctcccgcagcatcgctgccttaaatcccgcctttccaggcgtgcgcgcacagcgagccagaggaggctccgtcccgacctggggtcccccgcggtcctcagcccgggggctcgggtccccgaagagatccttggcaatggcagaggtcccaaagcctagatgccaagccccgcgatggggcggatgcttcca

SEQ ID NO: 2641 - DNA, 203 bp, Homo sapiens
agagaagacgccaggctgaggtcccagcgacctcaggcaccagctccgaaggagggcggggagaccgcaaaggggaagtgcccggagggccaacggcccccgcgcaccctgcgcccctctgaagcgcgccgcctccccgcgccggggactgggacctgcctctggggaatccgcctagaagacggcggcggactggggtcggg

SEQ ID NO: 2642 - DNA, 398 bp, Homo sapiens
aaaactgcgggagcccatctactgcgctcaggtggccagctcttgagccttccctatccgtggctccttgccggcatgcaggcatgcacaagcataccgccgagcaggaggatctaacgaatccagcttgtggacatgccctaatttccatttccgcctcctccaggtctgttcaggtgaggatgatgggagggaaaagcggtgtacagccgtaacattggcaccctgcaagagccgccggggcactgacacagagggacaccgcattggagatgcggtgtctacggagatttattgcgcgcggtgaaacactctaagcaccgcgcggaacaactgggttcagctccctcatcccggaccttccccaggaccacacgtcaccctttatccccgaaccc

SEQ ID NO: 2643 - DNA, 286 bp, Homo sapiens
tgcagagcttgaaccccaccgtccagaaggaaaggtgagtgggggacccgggcgggaggtgaggcctgccggcagcggccctcaggcgtgctgggcagcacggctagcagaggcggcgcctggtcttggatgctgcagcggagacgccaaggagactgaatgcagggagcgaggcgtagcggccgcggagggtggggccgcccggaaatccaggcggcgccagccttgtagcatctgcaggccgggggcgcgcacacgaggggcacgtgggtgtggaggaaccggc

SEQ ID NO: 2644 - DNA, 267 bp, Homo sapiens
ggctgccaaggaggcggggtggccagcgcggggggtggaggatgggggcaggacgcgggagggaagggcagggggtggggggcgaggccccggggaccagcgcgcgagagtgcccagctgggaaatgcagctccgaattaacatcgtatgtttcataatcagtttacgagccgatgtggggaaagccacttccagatggggaagagcagcccggatttccttaaggacgttcttcagccagactagggaggggagaaggagatgggg

SEQ ID NO: 2645 - DNA, 260 bp, Homo sapiens
cagagccgtctgcatctgcccgcatcctttgggaggctgcgatgatcgcagccagggtggccgagcgcccggcccactgcacccggcggctgttttgcagcgcccctggcattcagggaatggtttgcaaatctcaatgcaccacagactagttttcaccgtggagcaggaaaggcgcctattagccaggggcaaccggctttgcagacctgggcgggggcgtagggggaggggcggtggtgcaaacctatcgtgatttc

SEQ ID NO: 2646 - DNA, 239 bp, Homo sapiens
gaaggcaagctccaaacccctgcctggaagacgggctgtcgcggctgcaccaccagcaggaggaggaggagaagaaactatttcgcgataccccattctgcgggtgctttgccgctgccgcttctgctgccgccgatccgagtccgcgggttcgaacaccgcagcggtggggacggtgggtccggcgggcgccgggaggaggacaccagcggagccctgcactctcgtgccccgctcac

SEQ ID NO: 2647 - DNA, 846 bp, Homo sapiens
gctggcgggctctggcccccgaggacgcagacatgtggcttgaacctccgctcccctagccgttgcctctgtgcatctttctgggcgcccccagcgaatgcgagcggcgaggcgagggcgagcgcgccgaggaagggcgggagaggcgcggagcttggccgcgccgcgctgcgccgagcgccgggctctccccgcgagctccccgggcccgcgcgcgcgccccccactgcccccgccccccgcgcggcgcgtgccccccaccccccgccgcgcgccctcgcacccgcccggctccacgcggcgcgcgcctgccctggcggcagcggcggcggcggcggcgcgtcctcccccgaacgccgtctccagggctgctggctgcgctctccattgttccgcggctgctgcccggggtgggcggcgaggcgggggggaggtgtcggcttggccgccggggagggcttaccgctcgggcggaccctcactgcgagagcgatgcgggcccaggcgcggcgcgcgggggctgcagggcgcctagcactgggggttgccggcgcgcgggggcctcctcctggctcccaggcactcgctgctgctgggcgcccctcgcatcctcggttactatggatatctcgctcctccgccgccccctccgcgcactccgggaggccgccggggcggtagcagcggcgcggctccgcgggtgcccaggtgaccggctcggcagcggcagagcagtggcagcagccgccactgccgctgttactgcggtcgccgccgctggagagaggaggacgaggagggcaaggggcagaagcaggtcctgctctgtctgccccagaggccacc

SEQ ID NO: 2648 - DNA, 526 bp, Homo sapiens
tgctgcttcctcccggcgctttgcttttctacaactggaagccgcgaaggcggctactgcgctgagccgctcgctctgctggtcaagtttgggcgacccgcgcggaggagggtcgggctgactgccgccgctgagctgtccccggacgggagcgcctgtccacggcactcaccccctccagcggtggaaatgtggagaagtaagtgggaggcggtgtcgggaactgactcctcttaaaacggtcggcgccgctgctctgaaatgggcggctaagtgcttgtgggactaagggcggcctcagagatgcccggaaaatcgctgccacggccagagtgcggcgcagacgcggcagagttggaggtgtccgcggtgcaggctgctgcccacgccgctcaggccaggtgctgagggctcagcccgcgcctcggccgaaccactctcagccccgttgagccacctcgtccgcccggctttcatcgcaccggccagaggaaagttcccgcggcccccacgcctcttcacagct

SEQ ID NO: 2649 - DNA, 201 bp, Homo sapiens
gccccgcccggggacctagggaggagggagagaggagggagggagtgggcagcctgggcgcacgccaccggtccccgtacgcccggcaccccccgtggcgcggcgagtcaatgggatttgcacactcgaggtgtaacagcattactgcattaattaccatttccatttcacgtccagattgtttacttatctgcgggaaac

SEQ ID NO: 2650 - DNA, 523 bp, Homo sapiens
tgctctgcacgcgtgtgtacggcccgtacgaggcggccgggcccgccagccccttgaccacagcggccgcgccagggctaccggggcccgcggctgcagccgcagctgctgcagccgctgcggctgccgccatctggcaggaggcatagggcatgggtgagggaggctgcggtagcggccacgagttgttgaggaagccagactgcaggtacttggggggcgccaggtagccgtagccgtcggccccggcgcccgccacgccgcacccgcctgcggcgcctccggccccgaagagccccttgccgggctggaagtgcgcgggcggcggccggaagggcctcttcatgcggcggcggcgccggtagttgcccttctcgaacatgtcttcgcaggccgggtccagcgtccagtagttgcccttgcgctcgccgccgccctcgcgcggcaccttgatgaagcactcgttgaggctgaggttgtggcggatgctattttgccagcccttcttattcttctcgtagaa

SEQ ID NO: 2651 - DNA, 276 bp, Homo sapiens
gccacctccctccctccgtgacgtcacgggccgtcccggggtgagcgcctgagccgctccgggtccgcgccagtgagcgcggctgctgccggcgagctagcggcgcagcggcgggaacccgaggccgagcgccgcggcggcagcgctagaagcgcacccatcgggcacggcgaggcggcccacggtgcggcaggcaccgggaggcgagagccggcgcggacagtaggcggcggctgcagctcgttggcggctgctgcgaggatgctgcctgggcgg

SEQ ID NO: 2652 - DNA, 357 bp, Homo sapiens
aggagggaggcagggcaggcttgagggtgaaagcggcaaggacctaggctcaagctggatttgcccaccctcccttgccgcagcttctttggcctctgtgcgccctggattcccgaagtcagttccctgcgcagcggaccagagaggtccacccgcggacgtcaactcaacccctgggcggggtccgggggctgagcagaaggcgaggtctggggagtacggacaactttgagggctgtctgtgccggggtgggagcgcagtgggtgagtttcgagctctggcccagggacggctagagcagggcgctggcgcgccgtggggacaagcaggtgtctgctcctgcctgggggaaggat

SEQ ID NO: 2653 - DNA, 278 bp, Homo sapiens
ccgggcgctgggcagcccccgccggccgccgtcggagcctttgtgcccacgccgggggcgtcgctgcaggtttaggagaagacccgtgcctccgagcagccgctcctaaaaattaaataaatcaataagagaatcaattaataggcagcgctgcgaccgccaggagcgcggagcgcgcgaggctcagcggcttcctcgccaagcccctgctaccggcgcgcggccgcccgcgctgcggcagcggcggcggcgcggctgactgcggcggcagcgcggca

SEQ ID NO: 2654 - DNA, 336 bp, Homo sapiens
gctccgcatgtggggcacaatgaaacaagagcagccccggccagaggtccagtaaagcggaaagacggtcccgcccgcacacccctccggaaaactgaagcgtctcctctgacccccaaggtcagaaagatttattacttccttcgagagggcgcagccacagacccactagagagggcgggcagggtgtcggaagccagagaacggcgctccgcgtcctcccaccgctccagggcgcagaggtgtcctcagtgcccggagaggttggcagtgtcggccccgagggaagcgtggagcggacggccgacaggggatttctgcccaaacttcatcacc

SEQ ID NO: 2655 - DNA, 311 bp, Homo sapiens
cgcgtgccctgctcccgcagtggccccggcgcccaggacgccgctggcccgcgtcccctctcggaatgaaggtgttccgtaggaaggcgctggtgttgtgcgcgggctatgcactgctgctggtgctcactatgctcaacctcctggactacaagtggcacaaggagccgctgcagcagtgcaaccccgatgggccgctgggtgccgcagcgggggcagccggaggcagctgggggcgcccagggccgcctccggccgggccgccccgtgctcatgcccgtttggacctccgcactccttaccgccctccc

SEQ ID NO: 2656 - DNA, 201 bp, Homo sapiens
cacaggtaacagagacaaggttaggaggcaaagcacatttatgtgcaaatgagacgcgctagggaacttgtaatcctctgcacccccgcccttgatgtctcgatccctacaatcacagaattctaggcagaggccgccgacttctccgccctcgccaagagggacccggagcaccgaagcttcccagccggtgccggcgtt

SEQ ID NO: 2657 - DNA, 201 bp, Homo sapiens
aaacgttcctttagaaaacaagccaccaaccgcacgagagaaggagaggaaggcagcaatttaactccctgcggcccgcggttctgaagattaggaggtccgtcccagcagggtgaggtctacagaatgcatcgcgccggctgcggctttccaggggccggccacccgagttctggaattccgagaggcgcgaagtgggag

SEQ ID NO: 2658 - DNA, 481 bp, Homo sapiens
cgcgactgcacttggggcagccccgccgcgtcccagccgcctcccggcaggaagcgtaggtgtgtgagccgacccggagcgagccgcgccctcgggccagcgtgggcagggcgccgcagcctgcgcagccccgaggaccccgcgtcgctctcccgagccagggttctcaggagcgggccgcgcaggagacgttagagggggttgttagcggctgttgggagaacgggtcacggaaacagtcccttccaaagccggggccatcgtggggtgggcgagtccgccctcccaggccgggggcgcggaccagaggggacgtgtgcagacggccgcggtcagccccacctcgcccgggcggagacgcacagctggagctggagggccgtcgcccgttgggccctcaggggcctgaacgcccaggggtcgcggcgagtccacccggagcgagtcaggtgagcaggtcgccatggcgatgcggccccgg

SEQ ID NO: 2659 - DNA, 280 bp, Homo sapiens
taggcctcctggggctacctcgcgaggcagccgagggcgcaacccgggcgcttggggccggaggcggaatcaggggccggggccaggaggcaggtgcaggcggctgccaactcgcccaacttgctgcgcgggtggccgctcagagccgcgggcttgcggggcgccccccgccgccgcgccgccgcctccccaggcccgggagggggcgctcagggtggagtcccattcatgggctgaggctctgggcgcgcggagccgccgccgcccctccggctggctc

SEQ ID NO: 2660 - DNA, 252 bp, Homo sapiens
cggagtctcagctacgaatcatccaatacccgcaggtcacagagcgacggaggctgaggctgtgaccgaatcaccgacgcctccctgaggggtgaaagcacggccgtggagaccctaaccgagctcacgctggcgcaaaaggcaaaagccgcgccagatcccggatgccgccccctcctctccggctgcgcgcctgattgggcagttctcaatccagcgctctgattggataagataccaagctccccacgc

SEQ ID NO: 2661 - DNA, 239 bp, Homo sapiens
ttacctgcgtgctgctctcgggccccgccccgctccgccccggagggatcctcaggccgggcccagacctaggagccacctggggatcccggggtggctgcgcgccgagggggcgccagcggggacgtgagctggcgccgagacagcctcggccccccagcgccagggccactgccaggagacccccggccagcacccacgtggggcgcccccgggagcccgaggggtccatcgcctgt

SEQ ID NO: 2662 - DNA, 405 bp, Homo sapiens
aagtctgcggagcgggccgcgcccctggcccgcccgggctccaagtcccgcgtcgccgccctggcggggacggtgcagcaggcggcgggatgcggcggggcggcagcctgagcgccccggatggcccgcggcggggcggcctgcaagagcgacgcgcggctgctgctggggcgggacgcgctgcggccggcgcccgccctgctggcccccgccgtgctgctgggcgccgcgctcggcctcggcctcggcctttggcttggctgccgcgcgggccgccagcgcacgcgacaccaggtgggtcggccgagcagacagcggcggggcggggagcgcggggcgcgtggcttctgggtcctgcgggcccggagccccggctctgcgactccttgagcctggttgggaact

SEQ ID NO: 2663 - DNA, 237 bp, Homo sapiens
cgcgcacggtggtgtaggagccccggtagcccagcgtgaggaagcccgagcgcttgtcctgcgcgccgccgccgccgccaccaccgtgcgctcccgggcccgagggcacggcggccgccgccccgcgcagcagcagcgcgtcgctgctaccctgcgagacgttgtcctccaggtcgctctggcagccctcgtcgttgagagagttctgcttggtgaccttgggcgacagcagcttga

SEQ ID NO: 2664 - DNA, 204 bp, Homo sapiens
cgaccggggcggccccgctcagggttcggggcagcggcggcgtcggcggcgcccgagctccatcggaggagagacgcgcgagagaggagctccgccggtgcggcggcggcaatggagaggcaagaaggagctgctgctcctttggggcgagggcggggaagtgtgagagagacttgcgagaggctctagggctgctgctcggct

SEQ ID NO: 2665 - DNA, 224 bp, Homo sapiens
aggactccccactggggctgagcccctcccgccctcaacagaacctctaaacacaagtagcctttccctgcctccaggagctcacgaaacgctgccacaccgagcgaatgcaacgcgtacacacgtccacactcgaacagcacaagcaagagaccggctgggtgtggaatagaggcgcacatcgcgcaacgcattcacagcatgcacacgcgcgcaccccgacc

SEQ ID NO: 2666 - DNA, 278 bp, Homo sapiens
gtctcccatccggcgttctccaggatttccaaagacgcccgtttagatccacaggtacttacctgagtccctctgcttctccacaactccgactcctccccgcctctctctttttttaaaaaaaaaatttaaacaattcccaaataatatttaataggaaagaagaaggaaaaggagcgcacaggaagggcggaggcggcacccgggggggactgtccccagaggaggccgctgtgagccggcgacgcgaggctgggggagtgggaggcaaacccgct

SEQ ID NO: 2667 - DNA, 232 bp, Homo sapiens
ggtggggtaaaaagcaagacgaaacccacccagacagctcttccgactcccagaggaccgacacctctttcgagggccccaacagtggccgctcagggtccgagggcaacggccgaggcgccacgcggggccgcggctcgccctggccacggaggaccggacctgttgcgcctctgtgagtttgccttatttctacctactcggtgtctttcggcacgccgacctgtttccc

SEQ ID NO: 2668 - DNA, 331 bp, Homo sapiens
aacgcgttccggatcttatccctgtacgtgcagttgcccttggggatgagggctatccagttcttgccgcgggtcggggcggcgaacttggtgttggggtcgcaggccaggcggtcgtgggccgagctggccatgaccacctccccgcgggcgtcctgcttgggcgagtgctctccgtagcgcccgcactccgtcttctccgtgtgcagctccgcgccgccgccgcccgccgccccggccccggggtccggcgcgggctcggcgtaggtgatgttcacgaaggcggtgtaccattcctccttctcggccacggtaaagtccaggcagagca

SEQ ID NO: 2669 - DNA, 231 bp, Homo sapiens
gcggccatggtggccccgggaacgggtccggggagggagggcgcgggaggacggcgagccgggggcaccggaggggaaggcggcggcgcagaccgtggctcgccctcggggcagaggagggggtgccaggcgggactggggagaggggaaggggggctcagtcctgaccgggacccatcgccctctccgcggggcgcggggccaggcgcgcagatgcgcccagggcgcagc

SEQ ID NO: 2670 - DNA, 201 bp, Homo sapiens
ctcgcagtggtttctcctgcagctcccctgggctccgcggccagtagtgcagcccgtggagccgcggctttgcccgtctcctctgggtggccccagtgcgcgggctgacactcattcagccggggaaggtgaggcgagtagaggctggtgcggaacttgccgcccccagcagcgccggcgggctaagcccagggccgggca

SEQ ID NO: 2671 - DNA, 201 bp, Homo sapiens
agcccaggagcccggggcgcccgcggcgggcatgaggcggcgccggcggctgcagcaagaggacggcatctccttcgagtaccaccgctaccccgagctgcgcgaggcgctcgtgtccgtgtggctgcagtgcaccgccatcagcaggatttacacggtggggcgcagcttcgagggccgggagctcctggtcatcgagct

SEQ ID NO: 2672 - DNA, 219 bp, Homo sapiens
cggttggcggtgcctcggcgcttcaccgggcgcggcccccccaggcccgggggcccggcgcccggcggcacccccccgtaatgggagtggtccaggccggcggcgccgctggcatactcggggctgtaggacagggccatgctgtagtcggggggcgacatctcggggtggccgatgagccagccatggaagtaggggttctcctcatggctgcagcgg

SEQ ID NO: 2673 - DNA, 284 bp, Homo sapiens
gcgggaggagggcggcggggcggctggcggcggcggggcccgggagcgccgcggcgcaggatcctccagagcgcgccgggctgagcggcggcggcggcggcggcgggcgcaggggcagggcatgactgacgcgccctctgcctgcgcttatgtgagagaaagcggccgagggagggagcgtgccgagcccgggctgccctcccctctcactctccctcggaagccgtctccctggagctccccgtttccctcgcctcctccccggcggccccacctcccccggc

SEQ ID NO: 2674 - DNA, 429 bp, Homo sapiens
tctctccccgggtcgcgacactgactcgtcaacgttaatgggggtccgcgactgctgcggggacgagggcgcagagcagcccccgccacgggccggtccacgcaggggccgagaaagtggcggagaggcggtggccgaggcccaggggcgagcgcgggctgagctggtccctgctgcgttcacgagcgacacccaccccttcgctgcggacgccccgcgggcgccaggctgggggccctgcgaccgacccctcccgcccccgaggtaccgccgggcccgcctggcaggcagcgcgtcccgcgagctggagggccgagtttcgcggggccgtggggcgtgtgggtgaaggcgacacctcggatgcgggacgcatgaatggtggcagagcaggggtcgggatccgttcatgggttgggagagagatgcttt

SEQ ID NO: 2675 - DNA, 283 bp, Homo sapiens
ctcgtcactattgtttaatcgagaatcagcaacgcctcccgccggtttccaccctacgccggaatggactttcagaacccactgcggccgcaagacagcccgcaagagctggtcaaaatgccctcaggtgcgtgggggcttcggggccttagttggagcccgacaccctgagactggcggcccgagggctgtagggccgccccgggcgtgcgcccaccggctttgcacctctgggcagccgagtgtcgcggagaacgccccatcttctccaccgcggtctttt

SEQ ID NO: 2676 - DNA, 241 bp, Homo sapiens
ccgtccacaccgccttccctctgcaggtgaggaatggggtctgcttcgtttggaatgtgcctttgccgggtcctgcctgacctccaccttccagccgggacgcgcgagcttttccgtttggctgagtcaaaaagggatcgcgcgcatcccgccgcccctcaccacgaagcgcagacacaggaggttgcagggtcagtgctgcggagaatcccagacggccccacagccgccgccacccgcg

SEQ ID NO: 2677 - DNA, 244 bp, Homo sapiens
ccgccgtccccaccccggggcgcgcaggtcgaggaggaccccgctgactacgaagagtttgaggacttctcgagtctgccagacacccgcagcatcgcctcggacgactctttctaccctttcgaggacgaggaggagcacggcgtcgagagcgcggagagcgtcccggagggcgtcccggaaagcgtcccggagacggcgaccctcctgcgcgccgcctgcgccaacaacgtggggctgctgc

SEQ ID NO: 2678 - DNA, 225 bp, Homo sapiens
tcagtccgggaagaggcgtgcgcggcgccgcccggcttcagggcaaggtcctgaccttgcccaactgcagcatcttccgcttttgttgtctgagcgcggccgcgggacaagggatgctggcgggcggcaggggcgagcgccgcgggcgagaggcggctcccgacgcgagtgcgcagcgcccggcccggcggcccctccgagctcggcgagcgcagcgccccctgc

SEQ ID NO: 2679 - DNA, 249 bp, Homo sapiens
gagcctggggccgccgcggcgcccggcgccgagcgctcccgagctgcgccccgcgcgcggcccgcgccacctgtgccgccgccgcctcagccgccgagggcgaggctcctcccgcggcgcgcggcagcctcagcctccacctaaacctcggcggccggcccgggcgcccggctagtgagggagcgtccgccccgccgccgaaaccggccccgggtgcggagcatgcccagtgccgccgcgagagcggcg

SEQ ID NO: 2680 - DNA, 255 bp, Homo sapiens
gtacagcagatggcacgagcacgtgcggcgctcagcttaggctctcggaggcagctgagttggaaatcccgacggaaagcacccacaagctcccactctgcgctggcccacccgcgtgcacgcccaccccccacgcgcgtccctggctcagaagcgcacagatgtttactgcttagagccggtaccgctggggagatcgagcgacttgcgcggcgcacagtgcggcgctggcagggctctgggctcccggtcggg

SEQ ID NO: 2681 - DNA, 243 bp, Homo sapiens
tcagcagcgccgccgcctcccagcgccgatgcttcagccggcggggcggctgaggggtgagggggaactccgcgggcgggggcgagggagcgtgtgtgcgcgagcgtgtgcgcgcgcgaggggagcgcgtgcgcggtgaggacgcgcgccggcggttggggcgggggcgggggccggggcgctcctgtgggaagggaggggtgaaaggtcgctggtccccggcaacacggctcaggcaaacgt

SEQ ID NO: 2682 - DNA, 201 bp, Homo sapiens
tggagagaaatgagctggagagttacaccgagtcaacgcgggacacggctcccggcccgggccgggccaggggtgggaggcggttccctaccgcaggcggcgggactcccatgcgccgagggacccaagtctccactccacccacacgcccacccggcgtcggggcgctgcggcctcgcctcacgagcccagagcaggccg

SEQ ID NO: 2683 - DNA, 208 bp, Homo sapiens
gccggacatcctcctccaggactacccgcaccccacagtcgcgtcaaaagcgccccatccccctgtctctcgccgcgcaggtttcccaccgacgcccgctcggaaggcgagagcccccacgtggcccggcgcggcgcggcccccggggaccgcgagcaacaaaagcccggcccgcagcccctgctcctcgccttccttttcaattctc

SEQ ID NO: 2684 - DNA, 257 bp, Homo sapiens
ttcagctctccgcaagtaccttcctcgccttcctaccccccccagcccccagccgccgccgctcccgcagccccggtcccgcgcctccccgcagccccggcgcccgcctacccgccaggcaggcggtggtgtcgatccacttgagcagctgccccgcgctcagctcgccgcgcgcagtggcgtgcgccggctggatggcttggctcatgaccacctcgccgggcgccggccgctccatggccagggcgagagcgcta

SEQ ID NO: 2685 - DNA, 350 bp, Homo sapiens
gaacggctcagcccaggccctgcgccagagcaccgcacccgggggcggacggccctgcagctccccagcctcttcccgcatcaactagctgacgcccgggcgcactggcttcccccgctcccgcccgcacgaaagccctgcccgacgtctgcagtcagcatcgcccgcactgcctagggagggtttgcgccgagacccagtggccgagtgagccacagagtcgctggtcctggggacgctgtcttctaccgctccccaccgtcctcctctttcctgtatctcaccccggtaccccgcacccttctccccgctcggccccgcgcactctgctcagactttacaagcacttt

SEQ ID NO: 2686 - DNA, 216 bp, Homo sapiens
accaaattaggggctgggagtttccagattgaaatgcgccctccaccaccaagagggagctcacgcggccgcggggggccgaggcagccagccggcgccgcggtcctggggagtccgtgcaggggtgtgctctggtgtgaaacctggcaggactctgcctgggcttgcatgcagggaggggttagagactctgaaatgtactagcgggcagggtgg

SEQ ID NO: 2687 - DNA, 269 bp, Homo sapiens
ggcattgctgcccgaacgaacgaacgaacgaacgaacgaagcggtttcgtttaggaaaaataccctcttgacgcgaagccacggctgaagtcccgggccacgcagaggggccagcaattccatgggtggtggggccctccatccctggacgcagcggggagcagcgggcggccctctctcctgcccacttctcctgggggtgggggagccctgtgtcacccgacgctgcgaggggctgccacgggcttctcaggttgtgcccttcgcgg

SEQ ID NO: 2688 - DNA, 258 bp, Homo sapiens
agatcgggcccctgcccgtcccctttctgcgccccgggatgaggcagagactgaacagccggcgagcaaatcaacggcatccagaaagccatgtcggactcggcgcccagcgcccaagcgctaacccgctgaaagtttctcagcgaaatctcagggacgatctggaccccgctgagaggaactgcttttgagtgagatggtcccagaggcctggaggagcggactggtaagcaccgggagggtagtgggagttttgct

SEQ ID NO: 2689 - DNA, 224 bp, Homo sapiens
tgtgctcccctcttcctcctcctcctcttcctccttcgccgcttcccctcctcctcccactcttcctttttgctcgccttttccctcctcctcgcggccgcggctcggatagaggttacccagcgccctcccgtagctctccggagagcatgtgaccaggccgttagcagcgccgcgagtgcccggcaatggcagggatggtgcctcaaatatccctggaagct

SEQ ID NO: 2690 - DNA, 256 bp, Homo sapiens
cgccatcccgcgccagtgcctgagctgcaactgcaaactgcgcgtcctggcacgagcagcggtgggggcgggtgggggaaggagcgagtgactctccaggcgtcttccgctacctgacaccagccaggcagcccccagggccagagcgtcagcgccgaagccaggctcatccgggaagccactccggtggccgcggggtgcccatgccagcaccagatctctcttcggaaggaggagcggggcgggctacacggcc

SEQ ID NO: 2691 - DNA, 310 bp, Homo sapiens
gggaaggggcgttaacagggccaccactccggggctccgccactccccagccgttccctcctccggagaccttgcctgccaagagctctgccccctgccccgttcagggttggggctcggtgggaacctccccgtgcccgaagggacgaccccgtcagagagtcccccgacccttgcacctaccgtccttggcaggacgtggagctgctcggaagccattccgggttggcccccttacccgtgtgccacgacccctcggcgggcccctgccgcccgagtgccctcaccgccagcctccggagcggcggag

SEQ ID NO: 2692 - DNA, 410 bp, Homo sapiens
aggataactgggacgggctggacccatacttgatacccgggaaactcctagagcgtgtggtgctcctgccagcggcagttactggtggagctgaggccaccgctactgtcgtcgttggcgctttgcttctggaacctcccagcaagatggcactcactgtctgttcccttccgattagcacccccagccgcgctccctcctccccgggatacgtattagtcacatactgtggggagaagatgggctatgtaaatgtaagtcaacgcgctttcccagccacctttgcataatgcaacaggaacagcgacccgcgcgcacgaaccgggtagtgtgcgcgtgtgtgtgctcgcgtgtgtgagcgcgtgtgccagcgtgcgtctccgcgcgggcgtgcgtctgggtggatcctt

SEQ ID NO: 2693 - DNA, 274 bp, Homo sapiens
ctggggccagtcccccctccccaccgccgccgcctccccacccactccgcgctcaccccacaaccactccgcctggtctttccccggccccacctccatgcgctcctactactctttcaaacactgcagcaagttgcagcaaggcgggcaaataccgacagcgcgcgtgggggcgggcggcgggcgccgcggggcccaccccctccccggtctccccgcgccctcgccgcctcccgcgctggctctcaccgcatgagcagcgttccctcggtct

SEQ ID NO: 2694 - DNA, 201 bp, Homo sapiens
tctctggctggcgggcgccccgtcggccgccggcttcctccttgaaacccgccggcgcacatgaggccgctgcccccgccgcaggcgctggcggccccctcgcggtgcccgtggtgatgccatgccccgccaccacgcgggaggagaggagggcggcgccgccgggctctgggtgaagagcggcgcagcggcggcggcggc

SEQ ID NO: 2695 - DNA, 265 bp, Homo sapiens
ctcccgtggcaggcggcagcgagctgggcccggggccgggctgagctttgggaccgcgctgcgcagcccccgagccgttcgctacctggctgcggtcgcgcggccacctgtcctccgccctcggggcgccgcccagcttcgcgccaggcgccttctccagcgcccgccgccctttcccggcgagaccactcgggcgcgccccgcccgccggtccccgatgcaaacagttgggctccgtaggcggctggctccgcgcctcccggcc

SEQ ID NO: 2696 - DNA, 201 bp, Homo sapiens
accaccaccatcccaagtgcctgctcgctggggacccgccgccgccgccgccgcctggcctgccctgctctggggccctgcgcggcttccctctgctctccgtccccccggaagaggcgtccgccttcaagcacgtggagcgcgccccgcccgcagccgccgcgctgccaggagcgcgttatgcgcagctgccccctgcgc

SEQ ID NO: 2697 - DNA, 362 bp, Homo sapiens
cctggcggggagcctgggcagcgccgaccaaagttcggagcggcagcttcggggcgcgggacgcggggcacacgggctcagctgctcgacgggagcccgacgcgcgctcctcggcgggtcggcgggtccggaagctccgctgcccgggccgggtccccaagcccgcagccgctttgactaaaataggcatcgcgacggcggcggcaggcggcggcagccagggctggggccgcaccgcgcacgcgcatgcgcccgccgccccgcgccccccggcgggcggagcccggcgccgcggccaggatttcccacctcgctcccgcgactccgctgcgggtctgcacacccgaggactcggtttgaaa

SEQ ID NO: 2698 - DNA, 298 bp, Homo sapiens
gtccccgccccccaccgccccctcccgctccgcagcccccgagtggcgtcagcacgcccgccgggcatgggctttaaatgcccactagcgggagctcaggcgcttctgccctggagcgcggtcgggagtaaaatcgcaggagtgggagggtagcgagccagctggattccgagccgcggagcgcgctggctttgctccgcctgatgactccagagcgcgggtccaagcgccgcccatgcagcacccctgagctccggggaaggagagttaatgaaaaaacacttaaccgtctccgctg

SEQ ID NO: 2699 - DNA, 295 bp, Homo sapiens
gagcggcgcggagagcggcaggggcgaaacttcgcgggccagatgcccgagggcgcggcggcgctgccaggctgccgctgctgcccctgcgggccccgagcgcgcctccgcaggcggcactgcccgcggcgcggcgtgtgcaccgagcgagtgaaggtatgtgtggcgggcgcggctggagctgccgccgccgccgccgccgcgccagcaggtcctaatgcctgtcacttcccaggacgctggcagcagcagcagcccggagcccccgagccctcggcaggtttgcgtgtccttc

SEQ ID NO: 2700 - DNA, 203 bp, Homo sapiens
cgaaggcacttgggactcccagacgcaggatgcctctgaccgctgagtaaatgacaagggaggcgcggccgcggtacccgctcacctagcgcaaccgcctcgcgcggggagacctcggctgggcccttaggctggactccggtagccgaacgcccgctacccggccaggaagccagggagcgagcgcctgcgcggccgcatcc

SEQ ID NO: 2701 - DNA, 215 bp, Homo sapiens
cgcggatcggccggcctgggctcctgcagagcagatcctgtctgcgtcctccaggaggagtgggtggcaggactggggtttcccacaggttttggggcggcggcgagattggcacggtccggggtcgcaggcgcgcagccacgcccctggaagtccgccccggcccccgcccccaacccgcctcttcggggctttatggcgtgaggtttggggct

SEQ ID NO: 2702 - DNA, 201 bp, Homo sapiens
ggaggctgcagccgctcgagtcggcccgggtgggggcggggtgggggcggcgcggagggcacggagattacggcggcgccacccgggacatccagggccccgaggccctgggcggtccccacgcgagatcgcaaaccatgacaataggcagtcacccgaggtcaaataaaaacggagtgggtcccccgcgcgccgccgccc

SEQ ID NO: 2703 - DNA, 340 bp, Homo sapiens
ggcggcgctgacggatgccggtcctcagggagttttaaggcggcgggcaccagcgggctgatcctgaagcgctgctcggagccggagcgctactgcctggcgcggctgatggctgacgcgctgcgcggctgcgtgcctgccttccacggcgtggtggagcgcgacggcgaaagctacctgcagctgcaggacctgctcgatggcttcgacggaccttgtgtgctcgactgcaaaatgggcgtcaggtatgcgtgccctgccaggtcggttggggggatcaagtaggggtccggggccgggacagctgcttgagggggacccggggcgagtgctcgaaggg

SEQ ID NO: 2704 - DNA, 201 bp, Homo sapiens
agggctcagggcgcagggcgggtcccgtacgcagggcgggcgcgcgggcatctttgtggccaggcgaccccggctcgctctcccggagcccagggactcccgaggctggcgcgggctgcccgcgacaaggtgccagcagcctcgggctcgcgaggagcagctcccacccgcggcttccgagtccagctctgtccctccgcc

SEQ ID NO: 2705 - DNA, 236 bp, Homo sapiens
cctgagcagtgcattttcccaaaggtaaagagagataagggaggaaacacagcacccaaggtgatcagtcgattggacactgttgatggcacattctcctcgttcccaaccaaccgcacaaaacccgcaacacctcgcgtccccgcggggtctcccgcgcccctggcccggccctcccggccgcccccagcaggcgccccgctctccgcgggaactctgggacctggccgagcgtt

SEQ ID NO: 2706 - DNA, 251 bp, Homo sapiens
gctcctcagctccccgcgcaccctcctgcgctcgggccccgtcgtcccgctcagtgctggctacgggtcgtgtcactagcctgtgcgtcctcgtcactcgcgggtcggggcacttggcgccctgtgtgggtggcgggagcggggacgcctcggtgcccggggaccgcagcgcgctggcgtttaactttgccgtcgcccgccttggagtcgggaggctccagccgtctaagtgtcccgggagattcaggcac

SEQ ID NO: 2707 - DNA, 201 bp, Homo sapiens
ccccgcccccgccccatcccccaccggcgcaggttcaggccatcgctgccaggaccccccgctgtcgccgccccccgccccctccactcagactctgagtcgcccactccagccggtgcaggccgcggggccgcctctgatggcctgggcaccccccactcccgccccgttcacgaccaccgcggctgcctgagctgctca

SEQ ID NO: 2708 - DNA, 206 bp, Homo sapiens
gtccccgagtgcgcagcgtgcgcccccagcccctgctgcgcccccaggcctggcgcgcgatccgagcgcagcgggcaaagttggaggaacttggcggcggcggagcgggcgcaggctcagcccgacaaagcccgggggcccgggtcggggtcgctgccgcagcccgcacgctgccccgtgcctccgagaggtcccttccccagcgc

SEQ ID NO: 2709 - DNA, 201 bp, Homo sapiens
ggccgccgctcacctcgcgtatttcgtcttctggaaatccagcagccggggggcgaacatcgcggcgcttccatgggaatctggccccgggctcagagcgcgggtagctggcagagcctggggggcgcggcggcggcagcagcaggttggagggcgcgcggcgggggccaaggggacctggtcggcgcccggagccggagc

SEQ ID NO: 2710 - DNA, 203 bp, Homo sapiens
gctgtaaccctgggcctgggattgcggggacgggacgggtgggaagcggccaaaggcgcagcggcttctggtcagagccgcagaggcctgagacgtgggccgcgccccggcccaggagaccccgcggccgcgccctaaccctcagtctcccgactgcgactgcgacccgggaaaacgcctacgtttttggaaaggaagtccca

SEQ ID NO: 2711 - DNA, 216 bp, Homo sapiens
ttggggggttgggagaacgaaaataccagctgcgcttccaacatccaaggaaggaagtggcagcggggacggggagaggatgggaaggggatgctgactgcgagttggggcgggacgcggtgatgggaggggaccgggccgggaatgcgggaggcgaggggagcgacgggacctgccgttccggcggccgggcagccaatcgattcgtctccccta

SEQ ID NO: 2712 - DNA, 335 bp, Homo sapiens
agtgccggagcgctcggtggccgccgcgccgcgcgcctggagggatgctaacgtggagccggcgccgagtccgcccggcgtgcgtgcgtgtgtgggagcgcgcgagtcccctgacgcggggaccagttatgaatcgggggtgtgtgtttgcctccagagacctggcaaggtgcggagccctccagaagtgcggtcaagcggcagcggagacggcgagccaggaacctccccccgcgtccccagcttcccagcgtggcggcggaacccccggagaaagtttgcaaacttccagcgggcgcggcgaggacgccgggtcacctagggggcgggtgggc

SEQ ID NO: 2713 - DNA, 230 bp, Homo sapiens
gagagaaagtgagaagggagagaaaagcggcggctgagcaaagcgggagccggcgcgggcggtggggcctgacccggacgccgcgcacccggctccgccccgcgcccagcgccccgctcactccctggccgcgcctgccttcgcgcccctctgttttctctcacttaccagcagctctgctgacaagcgagaaaactgacaagtgagaaaagtcgtctgtcagcgcccgg

SEQ ID NO: 2714 - DNA, 224 bp, Homo sapiens
cagtacagggggtgagatggggtggtggttggtgaacgttggttactttattttatattattttattttgagagttgccataattaccggcgccaccccccgtgcaccctgaggtctggttggcgagccgctgctgggagttttctgcaaataccccccaaagcctgaaggcgggcttcaaacgcaggcgccggggaccatgggagccttcaaatagctgcgct

SEQ ID NO: 2715 - DNA, 211 bp, Homo sapiens
ggtcaatttcaggcacagcccatccgagtcaggcgaggtccagaaaggcctgactcgcctggcagcctcaacggacttgtccccgcagccgttgactagccgttgacgagcggacctcccggtcgtcatggcgactgtgaaatgtagggtggagcgcatgcgttcgaagccattcgcgcgggcagtccctgcgtgtccccctgcgtgtccc

SEQ ID NO: 2716 - DNA, 205 bp, Homo sapiens
cgtgtaatccgatcccttctgactcacaagccctgagtgacagttctgatttggttcaaccgcgggagggaggggaaagagaaagaaagaaacccccagccgtacgcctctcctggcatccaatcgactttctggaaaaaggtcccatcccggcctggtgccccgtgctgggtggagaagccccccgccccgacctggcaccgcc

SEQ ID NO: 2717 - DNA, 398 bp, Homo sapiens
ctccgcccgccccgcgccccgcgccccggcgcctcgccgcccgccgcccgcccgccccggcgccgccgcccgcgccccggcgccccgggccggcgaggggcgcgcccgcggccgcggccgctgcatggcgctgagatggcgggggcgccgcgcggcggaggcggcggcggaggcggcgcgggcgagcccgggggcgccgagcgggcggccgggacaagccgccggcgcgggctccgggcgtgcgacgaggagttcgcttgcccagagctggaggcgctgttccgcggctacacgctgcggctggagcaggcggccacgctgaaggcgctggccgttctcagcctgctggcgggcgcgctggcgctggccgagctgctgggcgcgccggggcccgcgcc

SEQ ID NO: 2718 - DNA, 290 bp, Homo sapiens
acagcgggcgctcccagacactggggaaagtgctttacgatgtcccgagtccctccagtctcgccagcggggcgagcgtgagggtgccccgaccgaccagcggccccgggtgcagggtggcgggcccggcggcgcgcgtccccctccccctcctggcggcccgcacgtgtcgcccgcgccgcgcccccacgggttacgcgcgggtcccgcagcgccgcggccgagccgggctgcccggcccgcggacacagcgccggccgccgcatcccgtgcggggccgcggcgcgatg

SEQ ID NO: 2719 - DNA, 307 bp, Homo sapiens
cgtgaaactgtccaatcaagtgcgcagctacagaggaagaggcggcctcttcaatatggcggggcctttgtctcctagcttccgggctctgatcctagttcgcgtctccactgttccatctcctccgttcctggagttcctcggtgactctactatagcttctgttatcctgtgacctgcaggtactgggagatccatagggaggacggcggaacatctggaggctgggaaatggtgagtgcgtggagtgggtgtcccgagaatggggaagaggctgtttgaatccggccggaaccggctgcggtgg

SEQ ID NO: 2720 - DNA, 212 bp, Homo sapiens
agtgctgccaggcggaggctcgtcagaaggctccgcagctgctgaggcggggtgggactgcgccccaggggccgcgctgaagctggcgccgcgattactgcgcaccgatttcgcccactctctgtccgctcccgggagccttctctgtctcaggacggttccttatctcccaaaccatgctcgtcctccacttcggacccacagccaccccc

SEQ ID NO: 2721 - DNA, 375 bp, Homo sapiens
tggctcctgagcagcatcgcccagtgcagcctccgtcaggaaaagcagcagaatcgacagccccagggggcgagcggggtccatggtgcagggggtcgggcggcccgctgggcaaggcgtccgagaaagcgcctggcgggaggaggtgcgcggctttctgctccaggcggcccgggtgcccgctttatgcggggcgagcgtccggccgacccccgccggggcggagcctgaggggtggctgattcatgcacggggactgtcaccccgccgcccccgcgctgcaaactgtgtaagagggagaggaattccccgccaagttgaaaagttgaacctgcctcccaaactttctcctgtagtccagacggggacgccctg

SEQ ID NO: 2722 - DNA, 201 bp, Homo sapiens
ggggttgcccgcaatatgcagggaaatgagcacctcgccctgctccccatccccttccagctccccgtggtgggtgcacaggaaaaagaagggcgaaaagcgggggtaatagccagccgccgcgcgcgccctcagcgtcgcccccagcaacagcgctaggaggaaagtctgccgggcccagccactgcgctccatgccgcc

SEQ ID NO: 2723 - DNA, 356 bp, Homo sapiens
ttggagacgccgggacggaggagccacgcggagagaaggcgagaagaaggcggacgggagcggaacgggctcgggagcgggcctgggagcgggcccccgccgagaagttccgcgggagacggcggctcccaaagttactttgggccgcgggagcgcgggaccggggctgcgggcgccgagagcgcgtcgtctgccgcctccgtgcgccgccgccgcctctgcgcgacgcccctcggccaggcctgggaaagcgcccgccccgctccacaccttcttaaagccccgggcgccgcgtcccccccgccgccgccacacgtgtcccggccgctcccccgcccccgcgcgccgccccgccc

SEQ ID NO: 2724 - DNA, 265 bp, Homo sapiens
gccggtttctttgtctgagccggctgcgtcccgcgcccctcggggctcgcagtctgccagtccgggcggcccgcactcgttctgggaatccgcccgaggccgcgaaccgctaggggccctcgcgctcccttcccacccaggccccctgtccctcccgccgcggccgcccggcccctcgcggcagcgacagagcctcatctgtagaggattttaaaatgagattaagcgaaagtggaattggcagactcgagtggtgcctggaaat

SEQ ID NO: 2725 - DNA, 697 bp, Homo sapiens
gaccccagccgcacgctgtgcgaggcctgcaacatccgcttcagccgccacgagacctacaccgtgcacaagcggtactactgcgcctcgcgccacgacccgccgccgcgccgaccggccgcgcccccgggaccccctgggccggccgcgcccccggccccctctcccgccgcgcctgtgcgcacgcgcagacgccgcaagctctacgagctgcacgcggccggcgccccgccccccccgccgcccggccacgcccccgcgcccgagtcgccgcggcccggaagcggaagcggaagcggccccggcctcgcccctgcgcgctcgcccggccccgcggccgacggccccatcgacctgagcaagaagccgcggcgcccgctccccggagccccggcaccggcgctggccgactaccacgagtgcacggcctgccgcgtgagcttccacagcctcgaggcctacctggcgcacaagaagtactcgtgccccgctgcgccaccgcccggcgcgctcggcctgcccgccgccgcctgcccctactgccccccgaacggcccggtgcgcggggacctgctggagcatttccgcctggcgcacggcctgctgctcggcgcgcccctggccggcccgggggtcgaggcccggacgccggccgaccgcggcccctcgcccgctcccgcccccgccgcctccccgc

SEQ ID NO: 2726 - DNA, 226 bp, Homo sapiens
tgggaggagcgcagacacctttcggtgatagggagggcttctcacttggctgttacctggaagtccacagtggccccggcgggcaggcgggcgggcagagcgcgggtccgaacgcccttcgcgctcgcggcggcgcacgtgcggcggcggcggcggcgccggcggcgcgggcgggacccactgggtggccgcgcgcgccacccgcgcgttttctgcgcgcctctgc

SEQ ID NO: 2727 - DNA, 201 bp, Homo sapiens
ttttctccatccccccaacccccagcaggacacggaactccggcgtttctcgaaagccacaaaagaggggcacggaaatcccaagctcgccgtgctaactcggagaacgcaaactcgaggcagagcgtgcgccgtgcggggatgtgggtgtcgaggaccccgaagcgcccggcttcccccgcgacccccatcctccctaga

SEQ ID NO: 2728 - DNA, 201 bp, Homo sapiens
tacctcgtcatctcggcggggcaagtccggattccaccagggcaggtccgggaggtcacccagggcagacgatccgaggcagagcgctttaaaatcctgccgccgcacgcccagtcagagcgccgagcgcgcctgcccccttcccgtcacccttcagtctcccattcgccgactaaacttttgggggatcacatctccaag

SEQ ID NO: 2729 - DNA, 215 bp, Homo sapiens
ttgtccttcagtcagaacgtgaatgtactgctgacgcatactgttctgggagaagattagcgtgatgcagtgctcttatgtattagcgccgctccccctccgtcgcctgcctcgcggggttaacgccggcgccttccagcgccgcgccggccggcgccgcgcagccccgcgcctccggccgcccgtcttcctctttcctccttccttcctcctct

SEQ ID NO: 2730 - DNA, 252 bp, Homo sapiens
tgaacgtgtgcgtgtgcgcgcgtgtggctgcctcctccagccccagccccgaacgcaaatactccaccgaggcacagggaagccgggagcagccgaggaacgcggagggcgccgaatcagagcctgcggggcttgacagcttctcttgcggcgtccaaggtgggcgtaatgtccaacaaaaaggtcggaaaatggggatcgattccgaacacccctttcctccacccagccccggagcccgagcagcggcgg

SEQ ID NO: 2731 - DNA, 203 bp, Homo sapiens
cgctccggcggccgcggagggagcgcaggcggcgccgctgcaggggccgggcgggctggcggcggcggcggcggcggctgcaggagcgcgggcaggtccgcgcgccgctggcaggggcagcaaatggcagccccttcccgcagcatccatccgcggctgcaccgcaccggggcattgtgggaaactccgctcactcccccgcc

SEQ ID NO: 2732 - DNA, 201 bp, Homo sapiens
cggcggcacccggcgcagaggctccagcgcggggagccgggctcagccccggcctgccagcgccgcggtcctagcccacccgaggccggcctggggggcccgcagggcgcgcggagcgccgagtgcgcgtcgggctgggccccgcaccccggtgcaggagcgcgggcgcggcgcggcggagcgccccgcatggagccggcc

SEQ ID NO: 2733 - DNA, 201 bp, Homo sapiens
gctgaacaccgcccgggcccagtccccactccgcggtttggtgaagttggtttccgtgcctgcttgggaagcccctgcctggggataatcgtcaggtcctcgagtcgcttcccccctaccttccgctgcgtcggcaaccttatcctcccgtcctcattaacggatcggcactcaaatcaaagcccagccctctggggttca

SEQ ID NO: 2734 - DNA, 201 bp, Homo sapiens
ccccgctccccggcagagcttctgtccgcgccaacccacccaccaggctctgcccgcgccacgcgcgcccctggcaggcctggggcggggaaaggcgaagcgctgggcacgcgagggcctgtgcaccccagttcctacgacgctcctggcccttttcaggcccgccgctgccgcatttaaccccctccttccgggggttat

SEQ ID NO: 2735 - DNA, 213 bp, Homo sapiens
cagctcatttaatattatttatgcattttgtgcaaggaattgtgggatttcgccccacggtaaacaatatggaaatcttaaaaatagcgatcttcctgtgcgtgtccacctacgcgccccggggtgacctggcggggctgtcgccgggtgactcacacccctgaaccgcgaagcgacagggaaagcgcgggcgagcgcaggagacgcggtcgg

SEQ ID NO: 2736 - DNA, 385 bp, Homo sapiens
tcatcccctgcttgtctaagccggctggctctcgtgactgactcggaacaacagagcagatgtttgcgtgggaggcaagcctcacccaacatctgtcctgcggcgggaaggcctgggtgttcacagatagagctggagttccccggtgggtggcacagacaattagctggggctgcctcacatgtaatctaattacaggggaaacaggctcaaacaccgggtgataagcagcgcaactgtttcgggtgactctgtaatttttcctccattaattttctccataacgcacatgattgtcataagggttaattaaaaagagcgtgagtggcctcatgtcacatgtagctggaccagaaagtgttgagtacctgctcatgcgtgcaag

SEQ ID NO: 2737 - DNA, 278 bp, Homo sapiens
ggcactgcggctcagcccccgcccggggactcgcgggccgactgtggccccttctggggaagccggggcgcggggaggcgttccgggcatctcagccgcacggggtacgctcgccctcggcggggcccctcgctccgctgtgggagtggcagtgggtgtcggggtggagaaagtacgcgtggcgcggagtcctggggacgcggcgtcccacccgctctggggagccccggactctctccagcttccaggctcgcatgcccctcttttcttagtgccct

SEQ ID NO: 2738 - DNA, 248 bp, Homo sapiens
acgcgagccgccagcggtgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccctcgagggacaaacttttcccaaacccgatccgagcccttggaccaaactcgcctgcgccga

SEQ ID NO: 2739 - DNA, 216 bp, Homo sapiens
tataacacaagggagagaaagcaacgctttggttccagaaacttccatcgtcaaggccagttctggccagacgcacagccaaagagcccccctagtctagcggatgaaccgttcgcgagtggcaccccctaaaaccttggccccatctcccaagatgcctctttactgcgcaatccagaaagcacccggaccgccgccacccaccagcggcggcga

SEQ ID NO: 2740 - DNA, 201 bp, Homo sapiens
tgaggtgcctccctcaccaattctaggcaccggcccctggtggaactgtccccagactgcctgagtccccagggtcaagcccccttcccacctcccagcacggagctctacctagaactgcacctcgaaagcccaaagcttacctatggttcccagagacaggcgaaggcgaggttttttacgggacgccctggtaggtgc

SEQ ID NO: 2741 - DNA, 208 bp, Homo sapiens
cgagcagccagggccagcgagcgaccccagcagcagggacgcggccgtgcgagagctcgcggacaggcgagggggatcccaggggagcagctgctgcccacgggccacgggcgatgcacggagtggagaagtgaacgtggtctacaggatttctgtccggaaggtggagagcgctacaggggaatctcctcgattcctgtccgtctcg

SEQ ID NO: 2742 - DNA, 201 bp, Homo sapiens
tcaggagcccggatccttgcccagcttcttggcggagccaagttcgagcgcacagatttcccgagctccagcggccagggggcactgtgtgagcggctgacgtcacccctccgcccggccgaaaccaggcggcgggatcccacacagttgaggagagggagccgaggccgtgacttagggctggcgacgattaaaccaagt

SEQ ID NO: 2743 - DNA, 364 bp, Homo sapiens
gccgcgggtgaggcctgtggttaacctcgcgctgccgaggtcttacctcctcgagtccagtctgattccaggccgcttccaggccggtgcccagctgaggcgggaacgctgcagtttggttgagcgtgacttttaggctctgtgaggaaaagtcgagcgcgccacatcgaggcgctagccgtttattctaccacaaggtaaaagattcatgctgtcctagttaccctaaagctgggagatacactgcacttcctaccagaccccgaatgctctcagtgtctgtaattctttaagaagttcctagagcagacagcccttggatcgtgggcacttctccccggggacggggaccctgctgaccgcc

SEQ ID NO: 2744 - DNA, 213 bp, Homo sapiens
gcccagcctctccccagcatgtaaagtcttctgtctctcctcggagttggcggaggcggcaactttccattctcgccgccgggggccgggcagcagcgggcgcgcgggtcagcgctcagcacggcgggcagcgccgcgctgcgcaccgccgccgaccatgagcgaggacagccgcggagacagccgcgccgagagcgccaaggacctggagaa

SEQ ID NO: 2745 - DNA, 201 bp, Homo sapiens
tctcctcgtcacggcaacccaactggaggcagaagccggcggggcggccgagcggggcggggcgggagcgcggccgccgcgagccacggtggggagcgggcgcgggggaccctggcgggccccgggcagcgcggctgcacttacttgtgtcacaactgcggcgacggggggctgaggaaccggttcttccaaaagcaaacc

SEQ ID NO: 2746 - DNA, 201 bp, Homo sapiens
ctctgggcggctgcagaggccggccgtccggtttggctcacctctcccaggaaacttcacactggagaggtaagggcgattctaaaatgcatcgctgagtcgtcaagctgccaccctttcctatctccctttgccttcttaaactgtacttaaaaaaaaaaaaaagccaactgtacagagtggttgggcgcgatgggtggg

SEQ ID NO: 2747 - DNA, 296 bp, Homo sapiens
tccgggaccgcgcctcggccgcccgagccccccgcgcccgccgccccccacctcggtcgggggcttacctgggagcccgctgcccccggccagccgcccgcgtgtgcccagggccagcagcacgcacaagtgccagcgcacggccgccgcgcccatgctcaatgcgggccccgctgggcgtgcgggcgtgcggggcgcggggacccgaccgaccggccgctcccgcaggcgctgctcgctgctcgccgctccgccaccgctcgggctcccgagccgcccagccagcccggctgatg

SEQ ID NO: 2748 - DNA, 201 bp, Homo sapiens
ccctgcctggcggctcctgcgcccggggctgctgagcccggggttcgtcctgaggccgcggctgtggttcctggccctcccggcccgcgtcactgtcgcgcggcgcccgctgcatcttgccttccttgcggcttcgcatgcccttggtggaacccagctcggcggacgacgaggaggatgagatggaagcctgctggaaac

SEQ ID NO: 2749 - DNA, 297 bp, Homo sapiens
ggggagggaggcgcggcgcgggaggaggaggggcgcagccgcggagccagtggccccgcttggacgcgctgctctccagatacccccggagctccagccgcgcggatcgcgcgctcccgccgctctgcccctaaacttctgccgtagctccctttcaagccagcgaatttattccttaaaaccagaaactgaacctcggcacgggaaaggagtccgcggaggagcaaaaccacagcagagcaagaagagcttcagagagcagccttcccggagcaccaactccgtgtcgggagtgca

SEQ ID NO: 2750 - DNA, 268 bp, Homo sapiens
tcgcgctcgggaggggcggctgccgcccgcggggcgcccgcggtgcccgggcctgggcagcgaggaggtgacgccgcccccgcgggatgagcccgggaggcggaggggcggaggaggtgctggcggcggcactgagcggcggcggcgcagggcgcgcgggccttccgcgccgactccatcgacccaaggggcggcggcggtggcggcggctgagcgaccctgggccgggcgcgtgatgaggaggggccggcgccagaccccgctgcac

SEQ ID NO: 2751 - DNA, 201 bp, Homo sapiens
ctgagcagtcgaagggacaactagacagtcatagacagacagacggccagcccgagcctcgggcaggagagaggctgcgaggagcagcccatgcttgccccgctcagccctcgcgctcccgggctgcttttttaattccgacccgcgcacgctgcgagtccccggcgctgtcgtccagccggaggggcagtcccgctcctt

SEQ ID NO: 2752 - DNA, 201 bp, Homo sapiens
cgcgatcagcatctctccgccacgaacctgagagacaagaagcgaaaacagggtgtgtgggggatggagagagccccggggaggcagctgcgccttcgcacgtcccaatttaaagaagagagggaaggaggaagcgaacccactgcctagcacgagccgcggagcggcttaatccagagcgggcagctgcggacgagttgg

SEQ ID NO: 2753 - DNA, 201 bp, Homo sapiens
ccctgtgcgagcaaagccgggagagcgagccccaagcacctggcagcggtgcccccagcaggcgccgaggaatccggctatccatttctggtgaactctgcgcccactgaggcattcgaggtacggatgtgtccgcctagtactcggagacgaaggagagagagcggggatatgcgctccagctctgctaggctccagggc

SEQ ID NO: 2754 - DNA, 201 bp, Homo sapiens
tttctcctcctcgcgcatctcgtggtccgactcgagggcgtcgaacacggcggcgcccaccagcaggtaggtgaaggtgcagacgatgagggacagagtccgcacgttctgcctcttcatggccgccagcaaggagccggcgcggggggcatgtcccgcaggctcacagccgcgcgcgtcccactgcagcgcccggcggcc

SEQ ID NO: 2755 - DNA, 302 bp, Homo sapiens
cgcccacccgggcgcgcgggtgcgcagcggggtccccgccgggcgtcggccggtgcgcgaagtttgctcggctcaacccccaaggcgcgggagcggggcgcggccccaggacggcagggaccgcgatggagcggcttcgggggcggccgggggacggcgcggtggcggtcggccagcccgctcctccgggggcggcgggcgcggcggcggcggcgggaggggtcccgcgggcctcgcggagcagcggggcggacgcgggcgcatgagccgcgcgggggtcggggccctccggcgtccgggcg

SEQ ID NO: 2756 - DNA, 201 bp, Homo sapiens
tcggtggccgcgtccgtgaaatggggacgcgggctctgctctcggatcccttccagcccccgaccctccgcacttgtcccgagatccaacgtgcccggtccgcagcgtgctgggtctgcggcgtcagggtggcccgagtcccgagaccatctgcgcttgcggacacagccgcggggcctggcatgaagggccccagggagg

SEQ ID NO: 2757 - DNA, 220 bp, Homo sapiens
gcggggcgggcgactgccgggccccgggccagctctcgccccccgccccgcccccgatcgctcggctcccccgcccggcgctccctcgggctgcgctccgcggctctcggcggcggcggcggcgggcgcagagcgcggcatgggcgcccgggccgcggggcctggcggcggcgggcggacgggcgcgcggctgcgggcgcaggtgcggggcggcgggccg

SEQ ID NO: 2758 - DNA, 347 bp, Homo sapiens
caccgtcccgggtgcggcggctccaagcggagacctgagcgcggcgggccgagctccccaatttgttggcgctgccccctcccccccggcggtgcgcgggcggcgcctcaaaggggaggaccctgcggcgcgggtaagaggcggcgggagcgcgcggcccgggagtgtggctgcagtgcgccgggacaccagggctccgcgctccgcactcaagaggctcccgcgtcccaacccctcgcgcccgcgcgttcgcggatccaggccgaggaccgaaaggggccgcccgagcccccggggccggcgcccagagagcccagcaaggccggccgccctgccggtgtgccgcc

SEQ ID NO: 2759 - DNA, 201 bp, Homo sapiens
tggcaccaggcttccccatgggcaccggagcaggcggacaggggtggggtcccgcgagcgacacggaagggtcagtgtggcggagcggaccctgtggaggcggggtcactgtgctcctgagaagggtcctcgggggtggagtctatcaaggttgcgggggcgtggtcacggagcggagccaataaaagcggggcgtgcacg

SEQ ID NO: 2760 - DNA, 201 bp, Homo sapiens
cgtcctggcaccgggggcggcggcgcagaggccgggaggaagaaatccgggccctggcccaggtcgggcttccacccctgcgacccgcgagaggcccaggcgggaaaggcggcgagtggcgtcagcggttccgaaagcaaacctggcccggtgctactgcccgagggtcgccgggcgcgtttcctaattcccccgagtctg

SEQ ID NO: 2761 - DNA, 225 bp, Homo sapiens
agtgcgcacgctgcaggaaccacggctacgcctcgccgctcaagggccacaagcgcttctgcatgtggcgcgactgccagtgcaagaagtgcaacctgatcgccgagaggcagcgcgtgatggccgcgcaggtgggtgcgggcgtgcgggagcccgggttcagccttagtttttttttttttttttttttttagatggagtctcgctcggttgcccaggctgcag

SEQ ID NO: 2762 - DNA, 318 bp, Homo sapiens
gctgccaactcattcgggagcccggggcatgaacggctacggctccccctacctgtacatgggcggcccggtgtcgcagccgccacgggcgcccctgcagcgcacgcccaagtgcgcgcgctgccgcaaccatggcgtcctgtcctggctcaagggccacaagcgttactgccgcttcaaggactgcacctgcgagaagtgcatcctcatcatcgagcggcagcgggtcatggctgcgcaggtggcgctgcgccggcagcaggccaacgagagcttggagagcctcatccccgactcgctgcgcgctctgccagggcc

SEQ ID NO: 2763 - DNA, 265 bp, Homo sapiens
aggaaggggagcgcagtctgcagactgaagccagtggcgctgcgctgaatgcaactgcgcgcgcccgccgggtgagccagcgatctgagccaggcgggggcggcccgacctttcccgcccagcctgggtcagaggaagccgaaagcggcctcagcaaggtgaggcgcccgaggctgcagaagaccgagcagaactttgcagagttcgggatgtgctgggctaggtcgctgaggacttgactggcttcctccctccttccctccac

SEQ ID NO: 2764 - DNA, 259 bp, Homo sapiens
cggaggggaggccgcggagggccgggtggaggtccttaccgccagccccaaggtctgcagcatctctctctggtctttgtccccagggccgatgtgcctccgagcgaagtcgtcgtgtctgggcagaaggcgctccaggaggcgcgaggccccagccgcggcgctgtccccgccgccactgctgctgtcccggctccgcggcgcccagcacggccccgatcccccagccaggcggcggccgcccccgaccccgcggccc

SEQ ID NO: 2765 - DNA, 201 bp, Homo sapiens
gacggggcaccggtaccaattagcggctcgcctcggggtccccgcggctaaggcgagaacgcaggaccaggagcattgctgcccactctctaccgcaacccgcacatcccgggaccacgtaacggcggatggggcgtccgggagcggcccctgcaggggagagcaacaggctcccgcgccctggaggcctggtctgcgctc

SEQ ID NO: 2766 - DNA, 323 bp, Homo sapiens
cccccgcgacctcaccggggaaacaccgcggacagtcgggccagcagcgcccggagctcactccaggtctccaaacttgcagcacttcccagagcgcgcgcgctcggagcgggacctgcttgctccagtgcacgccgcggagcgaaccatcgggctggcgggggtggaggggtgcaggcgtgggggctgcgggccgctcgggccttgggcttctcctgccgccgccgccgcctcccgcccccggccaggagtcgcgcgtgacgcggttcgccgcaggagcctcgaaggcgcggcgccggcgagcccttccccggcaggcgcgt

SEQ ID NO: 2767 - DNA, 201 bp, Homo sapiens
agccgcctccgcacctcccgtcacagcccccgcagcaaccgccccagcagtcgcagcctcagcagccgtctcaccccggcaagatgcaggaggcggcggccgtggcggcggcggcggcggcggccgcggcagccgcggtgggcagcgtgggacgcctgtctcagttcccaccctacgggctgggctcggccgccgccgctg

SEQ ID NO: 2768 - DNA, 355 bp, Homo sapiens
gcgaacacaattgctccagccacaggcgaggcctggccaaggtgtgggcgcatctggggcaggtcttgagaggtccagcgcccggtggtgcggacagaggcggggcaccgcggcgctcgccgccgcctccccgcaggtgatcatcctcctgcaggtgtcctcgggtctcaggtggctgcgtgtctgcgccatggttgacattctgggcgagcggcacctggtgacctgtaagggcgcgacggtggaggccgaggcggcgctgcagaacaaggtggtggcactgtacttcgcggcggcccggtgcgcgccgagccgcgacttcacgccgctgctctgcgacttctatacggcgctg

SEQ ID NO: 2769 - DNA, 201 bp, Homo sapiens
cccgcgcggagcgattgtgaggggctctgctggaatttggcagcgcggaggcttggagagaagccccatgctggctcccattcagccggcccgttttcctcgagctttggaagtttcactcagccgtgcactcaatggcttcacaaagctgattacaagcttcagcgcattcctgaaggagccaaaagcgacgcaggtgca

SEQ ID NO: 2770 - DNA, 290 bp, Homo sapiens
gacaccttgtggagcaggtggcccaggctgccgggcccatcgtcgggcgccttgcgcagcgcctcgccggacaccaagtagggagccgccgccggggtcgcgcgcgccgccgaaaccttgcctccgccgccgctcaccgacaggctgtggagaaggtcatcgaccgatgtcaccgagtcattcctgaagcggttatacttggtgcgtggaagcatgcccctccgtgggctcgctgcatccgcccgggcgctgctggtgccggccccggcgcgggctgccgcgcatagcag

SEQ ID NO: 2771 - DNA, 201 bp, Homo sapiens
tagagactgtagcttccgccgggctggatgcgagtctcccaggttagagcccagaagcgcgctgggacctgggtctggcttttgggtctgtgtccttcctcgtttggccccaattgtccgcattcaagatcataataaaaaggcttaggaagtaaacttcttggacgcggaagggccggctcgcgggtttccgccgagtga

SEQ ID NO: 2772 - DNA, 201 bp, Homo sapiens
agaggccggcccgccgcgcgggagacactctttccaaagtggaagcgctgcgtgggcagcagcgcgggccgggccctcggatcccagtctctgttgctcccgagacccccgccccgcgccgcatcctccgagctcagcgccctcgggctgcgctgggcgcagtggctcccggtcagggcgcagtcggcctgggcgctagag

SEQ ID NO: 2773 - DNA, 288 bp, Homo sapiens
cgatgtagctcagaatccgcgatccagcccggtccaccacagccttcagcagcgacactcgcagcctccgacctctcagaccgagtgagcttaactaagccgttactcgcgtgccagcagttgggcgctccgacctctcagaccgcgtgagcccagcaaagcggttaggcgcgcgcctgcagctcggcgctagcccggactccgggagccgctctcgagctcgcgtggacggcagagggcggctgcagctcgggcgcaggcgccgctggcttgcgggttctcctgggc

SEQ ID NO: 2774 - DNA, 212 bp, Homo sapiens
tcactccccgctgcgggaaggggctgcttggctgcctctgggggtcttcagagctaccctggtcccgggggattggaggaggaggttacctatcctgcgtcgtctttaatccgtgcaccactatccatcaaatagagacagatcctgggcctctcaaagacggatgattgggggtggtgattggcctatccctaaatatctaccacgcaagg

SEQ ID NO: 2775 - DNA, 201 bp, Homo sapiens
agtagcagcaggagcagcgacgcccagacccccgggtgctgccggggcggccgcgccatccgtgcgcacagatcccgcagccaggccgctcgggccgcagcgggggcgccgcgggcgcgggccgggactgagcctccgccgaggccaccagcacgcgcccgcgcagccgcggagcctcccgcacccccgcctccctgcctc

SEQ ID NO: 2776 - DNA, 246 bp, Homo sapiens
gcggggatactcccgggggccccgggcgcggtctcggggaagaggcggaagctgaaattgcgcgacggggacatctgctgaaaggtcgcccagcccgaaacgagcgccagaccccagcaacaaaaggccaggcgaggccacatcgcgctggagacagagcggctgccccggagcgcaggcggcggctcgggcgggaagaggcgctgggcggccggactcgcagaggggcgtgcgcggagctgggcg

SEQ ID NO: 2777 - DNA, 201 bp, Homo sapiens
ggcgctgcaccgtccctgcggccccagaggctcgcgggtgtctgggcgcgggtggcgggcgggtcgggggcttgcgggcgtgtctgtgcgagagctgccccgcgagcggcgcagagacatccgggcgagctgagagcctcactttgctccatcggtggaatgggcacactcggaaggcgtagctgctccatccctgggagg

SEQ ID NO: 2778 - DNA, 201 bp, Homo sapiens
ggttgcgcgacgttccccgccgctgggggagattagcaaagttacccgcctctggaccccggggcctgggcccctagatcccgccccgcggcgggagatgcgtttgagccttttacagacggagcgcgtcccagcctgacgcagagggatgaatagacaagcgcaccgggcgggaatcccgactgcctgtgtatctggggt

SEQ ID NO: 2779 - DNA, 358 bp, Homo sapiens
gacacctagcggcttcagggtgaaccccgaccgcagccgtcgccgcctcgggcagagtttgcgcccttgctttgcgccccgggcgctgaagccgggcgggcgatgcccgcggcgtgaaagcgcccgcggcgggcgccgacctctgtcctagtctcctgctccccccgccccgcttgtcccgtgcccttgtgaccctggctttggcgccgtcgcccaggcgccccgcaatgtagctgcccctgcgcctcggcgggaggcgtcctgccccgcgagcgcccggggcccggagcccggcctgggggctcagccgagctcgggcggggccggggccgcggtggcgatgcaccgggcccgttag

SEQ ID NO: 2780 - DNA, 201 bp, Homo sapiens
cggccgggctccctggagagggagtgcaaggaggagcagtgctccttcgaggaggcccgggagatcttcaaggacgcggagaggacggtgagcccagcctcggggcgccccgcgccgcggacactgcaggcggcggtgaaccaggccgcgtggggccgcctgcgtctctttggctgcggctgtgggcggcgaacacgcagc

SEQ ID NO: 2781 - DNA, 201 bp, Homo sapiens
gcccgggacgcgagagggggcgcgacggcggctgcggtcggcccggcgcccacctggtcgctcctgcgagcagcgccccgcgtcccgcccgcgcggagcccgcacctctcggccgcgccgccgccgccggcgaggagccgcacccgggcgcagcgccgcccgcccgcgatgacggccgctcgggccggggacggggaggcg

SEQ ID NO: 2782 - DNA, 201 bp, Homo sapiens
agagagaatccgaggctgtttctgccgctgaaatctgagcgggagagcatcccgaagccgcctgcgtggagcgagcagcccccgcgtcatgggccagaggcgcccgggagaatctgcgggtcacggatcacacccgcaggggcctggcggagcaaggtgccgttcgccgcctgcgggcaggagccggctctgggcctcggc

SEQ ID NO: 2783 - DNA, 277 bp, Homo sapiens
ccgcagagacccagccctgtctgccgactggcccttcgacgtcgccgccgtgcctgagccccgctgcctgctcggacaagcagaactccggcaggcgcagcgggcgccgaggcttgggctttagccgtggcgctcgcctcggcgcagtggggagccgcgggcgtcggagaagcggccgcgctgttccgggtcactgcaccggctgaaaaaaccaaaagcaaaaccaacacccagaaacgaagcctgcgtgcccccgggggctccgttttgctcccct

SEQ ID NO: 2784 - DNA, 201 bp, Homo sapiens
agtcagtggaaccggagggggacttcggaggaatttgtctctgatgtcccggctccctggcctcctattagaactcgtagaggatccgctctggagtccccgtgcgccctggcagaggtcggggacgccagagtgcacgcagtctcctgcgcgccgagcccaggctccgggcgcagggaggatcgggctgagagcagggtg

SEQ ID NO: 2785 - DNA, 247 bp, Homo sapiens
gcaagggccgggagcctggccttccatgaagctgtctcaggccgggaccagccccagccccgacggccgctgcggccccgcctcggcagccccgtgagcccgcggaggagtttcgcacccgaccgtgcacagcgaccgagttggcgcggcccgtatgaagcgaagcgccggcttcagcagcgcagtctgagcaggggatccgcgtggcaactagggctgcgcgcgagctcggggcgactgtggcggc

SEQ ID NO: 2786 - DNA, 201 bp, Homo sapiens
cccccgcgcgcagcccgcgcagcgctcagagccggacggcgcttcccggtggcggcggaggagcccggagggacgcagccgggcaaggcagggcgcagggcgggcggcgcgaggcgcagggcgcggcgggcagaggccacctggccaccttccctggcgcccggggaaggcgcggcgatggccggggcgcgcggggcggcg

SEQ ID NO: 2787 - DNA, 201 bp, Homo sapiens
cgccaggcccgcccccgcccggccgcccgcccgcccggtgggtcgcggtggccgcgggctgcgctgcgcgggccgggcctggcgggccgggggctgcgcgcgtccgcgagggcgcccgacgcgggctgaggggcgctggcgtgtgcccgcaggcggccctgcgcgggggacggcgcgctcctggacaccgccggcttcaag

SEQ ID NO: 2788 - DNA, 201 bp, Homo sapiens
cccccgagctccgcgatccctccgcctaccggggaaggagacctcagcgtcgctgtcctgcccctcctgaacgctgtccttgtccgacttggagccgccgcgggagcgcttcatgttgcggaaatactgcccccagcgctgccggccggcgtccttcttcagcctcttctccttggcccggcggttctggaaccaaacctg

SEQ ID NO: 2789 - DNA, 356 bp, Homo sapiens
aacacggagcacgaacataagcaggtaccgcacatctgcgagctattcgggtctccgggggaaggcaaaaagccccaacaagccttaagtaagaccaggacgcttctatagttttgctttgacagctaaggaaaaaatctgccaaaaaccagaggcgctgctgagtgttggcgtgggaatgctagtttagtcagagccttgctctgggccatttaaataaaaacagacatgttggtggcaaatgccagttgaacacgcaggagagcggtgcttctcgggcccggagaagggtttgcagctgcactctctcttcccttttctcttggcctccccagccttcttatcatcacgatcag

SEQ ID NO: 2790 - DNA, 201 bp, Homo sapiens
tcaacgcctgcctctacttcaagtcctgccacagctgctacacctactactgctcgcgcctgtgccgccgcgaggactgggacgcccacaaggcgcgctgcgtgtacggccgcgtgggcagcgtgtgccgccacgtactgcagttttgccgcgacagcggcccggtgcaccgcgctttctcgcgcatcgcgcgtgtcggct

SEQ ID NO: 2791 - DNA, 281 bp, Homo sapiens
agcctcgtgcgccggcccctgccccgccagccccgctatggtcccccatccacccccgcgggagcgcccctgtccccccatcctgcacttcccccagagtcgcgcgccagtttcccgccccgtggaagcgcccctctcccgacttcggctgatccccgctcgccgccctccccgcgggtgcgcgcccggcccctccctcgcccggggcgggtctgcgtgggcggtgctccgggtcggcgggcggagctccggttccccagccctgcgccccggtggagccc

SEQ ID NO: 2792 - DNA, 222 bp, Homo sapiens
gcccaggtcacacaccagatcccactggggatgtgagaagggtgcagcgggcgtgaggccccgccctcgccgctctctgcccgcccccagacccgcggcccgcctggccgcctcacctggccgatggcgttggtggtgagcacaggaaggccattatagtcccaatccttgaggcaatggttgaagtccggcggggcgaagccgctgcacgaggggtcggta

SEQ ID NO: 2793 - DNA, 237 bp, Homo sapiens
cgggcctggatcaggacggcgaggcgggccggcgcgcgcgcgaggtggccttcatccacatccagcgcgagctgcggctgcgcggcgtcttcctgcgccacgagttcccgcgcgtctacgagcagctttgcgagttcgtcgaggccaacaggcgcttcacgcccaccaccatctaccccacggaccggcgcaccggccgccccttcatgtgcatgatcatggccgcctccgagccgc

SEQ ID NO: 2794 - DNA, 201 bp, Homo sapiens
cctggttcctcaatctagcagtgcttttgaatgaacgtgtgacagcttaatgaagcagccgagtaccttgatttgaatgttggagccggggttcacagggggctgtattagtcagtacaggctgggttatgccactgtgacaaagagccccagatctcaaaccccgtccttgtgggtcagctgaggtctctgttccaggcc

SEQ ID NO: 2795 - DNA, 364 bp, Homo sapiens
gcttcaccagcctcccggccgagcggaaggcgccggcgcccagctgggtcaagttgttgtagctgaggtcgaggaacacgagcttggccgagccgctgaacgtgccctcctccagcgagcgcagcgagttgttcctgaagtccaggtagaccaggtcgccgtagaagatgaagaagtcctcggggatccgctggatgcggttgccggccaccagcagcttgcgcacgtccagggggaaagggtctggcacgctgggcagcccgcggtcgcggcagtccacggtgtgcgggtcggtgcaggcgcagcccgcggggcacgcgtgcccgggcgcgagcagcagcagaaggctgcagagcccgagcgc

SEQ ID NO: 2796 - DNA, 201 bp, Homo sapiens
gaaattaacccgctagaaaaatctcttgggagaggcgggagcggcaggggtggccgagtggccgtcgccaaaacgcggccccaccctggcagctgatttccgagatctggcagtaagacgccgcgcgcaccgggcgggctgcactcgacgtctaagttcagctaccaagcccaggagcggtttccctaaggcgtgtcccgg

SEQ ID NO: 2797 - DNA, 201 bp, Homo sapiens
gcgctccctcctggggtgggcagcgcaggtctggcctgcgggtggggggtggagagtgagaggcacgcggggcaccagctcagctcccctctggggatttcgtactcgcagtttaaggaaccggtggagcacgaactccactcctgagctggcgcaagcgtctcccttccatggagatccaccccggctcccctctgaggc

SEQ ID NO: 2798 - DNA, 201 bp, Homo sapiens
aggaaccggcgctgccggtgcctgggggtcggggcgcgggcgaagccgggccgcggaggacacaacaggtagagccgggggtgcccggccgcgcgccccccgcgcatcatgcagctctttgtcacctctctcgcccccaggccaaaatcctgagcatgatggaagacaataagcagctcgcgctccgcatcgatggggcgg

SEQ ID NO: 2799 - DNA, 222 bp, Homo sapiens
tgcgcgcgtgcgtgtgtggcgtgtgtctgggtgttttatgactgtcctccgtgaggccgtgtgtgagcccttgcgtgggccgtgagtgcggcagggagcgcggtgtccgggggccgcctgtcggtgtgtctgtgcgtgcttgtgcgctagcctttgcctctgcgagtgcgtatttttaggaccgagtctgtctatatgagcctgtgtctgtgtgtgtgcgct

SEQ ID NO: 2800 - DNA, 201 bp, Homo sapiens
gacaataagatctgttattgacgccaccgggttggtgatacttaggtacagcagccctagcaaacgaatacacccccatgagaactaagctccctgagagcggtaagctgccttgtcttgctcacagctgacaagaacacgcctgtacggtcacttagcacctagtactgccatttaaccgtttcactagtatgtatgaac

SEQ ID NO: 2801 - DNA, 265 bp, Homo sapiens
aggcgcacacgaggagcccggcccagtattcccaaaccagactccggaggcgccgccagggagcggtcatcgttgggcgccgccgagcgtgcccggggcgcggccgtggcgggctccctggggcggcagctctaggcgcgggcgcgcagcagccccgaaggcgccgcctggcccagccgcccggctcccgagcgccgctgcaagtggggggcgccccgcggcgccgcgcacatcttactggggggccgccccgccggcgcccgcc

SEQ ID NO: 2802 - DNA, 242 bp, Homo sapiens
ccgggctgtcttcgccgctcaccggagagggtcgtccgggtgtttggttttgttcgaaagtttctgggcttttttttttttttgtaaaatccaaagcaaccgaacaaaaagagtccaggccgcgcgggcgggctgcgcgcccgcgccctgcagcgcgccggcgggggcccggcccgcggggtcactgcactgagccgggcagtgtgtggtggtggtggtggtgcagcgccgccggcgggggc

SEQ ID NO: 2803 - DNA, 201 bp, Homo sapiens
ctccagggcgcagggccacgagctcccgctcccaccctcggcccctggcacccggcgccggctccgccgccctctctcacacgcacccttggcagggccccgcggggcgccccaaagcttgggggcagctcccaggtgtctctgggaagggaaagaaaggccacaaagcaaaagaaggagcaaagagaaggcgagggagga

SEQ ID NO: 2804 - DNA, 261 bp, Homo sapiens
tcgcccaccgatgagccgccgccgcccgcgcccgggtgcaggtgcgccgccgccgcgtgcaggccgcccgcgtgtgcatgtccgtgtgcgtgtccgtgggcgcccagatgcggcggcggcgacggctccagctgcgcctcgtggccatcctcgtgcagcgcgtggtgcaggcccggccccgcgccgccaccgcccgccgccagcatcccggccaggccgccgccgccgccccccgggtaggccgcctgcgcgtacagcccg

SEQ ID NO: 2805 - DNA, 201 bp, Homo sapiens
cggtgtcctgggccgagccgcttggagatcctagatcagcatgtgggtgggaaagggcgccccgtcctgggcccccccgcccctgcgcgcagagcagagacgcgcagacccgctcccactccgcttggctcccttggagcagccccggcggcggcagcgatgggctgggaggggccggcacgctggcctgcgcgggtcccc

SEQ ID NO: 2806 - DNA, 337 bp, Homo sapiens
gaattggacaacaatgtggcgcctgccattggccaggggaggcagacggcgctctgattggccgggcccgcgcccggggagccccgcattctgcagtgtccgaaagattcgaaactccaaaagctccactgcgtgcctctgggaggggagggggcgcgccaggaaaggagtggaaaaaagtgggcgaggaggagcgttgaaaatttcctgacaagtagtttccgtgcgcccgagagcgtgtgaattgctcctaattaccgtgtccggtgcgcctctctgcgtagacttgtgtaacctctcggcttctggggcgccggctcggctgcaccgctcttac

SEQ ID NO: 2807 - DNA, 201 bp, Homo sapiens
tgaagttgtttccccgggacaggaagggttaaatggctgcgcgtcaactcggcctcgactggggtgtcagggagcaagagccgcttgtctcgggggattccgcttggggggttcccaggggtcgccctggcgctccggccacaacttgggcggctctgtgcggcggccctcgcctgcgcctttgcgcgccacccaaaactt

SEQ ID NO: 2808 - DNA, 201 bp, Homo sapiens
cagtaggcagtgcgggcacagtgttgcagaccaccacctcgccaggtccgggcagcgcccactagacggacaggcgcccgcggccgcccctaccccggcgcgcccacctcgagcctctcacgccgcggcgggcgggcgcaacatattctcctacctccagccgccgaggaccacactctccgctcagccctctcgactcat

SEQ ID NO: 2809 - DNA, 201 bp, Homo sapiens
ccctgaaccgctacctgctcatcacccgggcgcccgccacctaccaggcgctgtaccagaggcgccacacggcgggcatgctggcgctgtcctgggcgctcgccctgggcctcgtgctgctgctcccgccctgggcaccgcggcccggcgccgcgccaccgcgagtccactacccggcgctgctggccgccgcggcgctgc

SEQ ID NO: 2810 - DNA, 201 bp, Homo sapiens
gctccgtgcgctcagtcctgccgggcgtcggcgacgcggcggccgctgccgttgccgccacagccgtgcccgcagtgtcccaggcgcaactgggcacccgcgccgcgggccagcactggtaacctagccggggcccgagggaagcggagatccccggcttccgacgtccttgggcaccgtcgcctccttccctcctagggc

SEQ ID NO: 2811 - DNA, 386 bp, Homo sapiens
tgcttgttgaaaaacaacattgtgatcacttccagcggcgaagggtgtgcttgggaacggtttggggaggggacagaagagagaggggtgggatggacggcggcagaagtgggaggtacacgaggagttactggaaacggcgcttctgtggaggagccgggggggatggggagtagagggagggggccctgttgcctcagcgccccgaggtcgtggagcggcagcagctgcagccggagcagcaccagcaacagcaacagcgagcgggacggagttaggaccgctcggagcgcacaggtctcgaggtagtataaggtttgctatccttccacttgctggcagttgcagaagaagatctgctttttaagtgaaacgtacatgccacc

SEQ ID NO: 2812 - DNA, 201 bp, Homo sapiens
aggccacataggggccgggtgcaggccccacgcggaaaggcgcgcagtgctcggggtccatgccggctcagggcgcacaggcctccggggctccggggctcgcgctgcccgcgccgcctgtgagcgcccgccaagggggagggacctgggcgcgggggcgcggagcccccgggagcggcgcgcgccgcggggggcgggggg

SEQ ID NO: 2813 - DNA, 201 bp, Homo sapiens
tgccagggcgcagggagggcggcactcggccccagtcttcgcaatcccgcgcgctctctccgccgtgggacctgggtccccgcgccgctcccctgagccccgagcgcgcggcgggcgggagccaggttgggactggtggtgaggcagggagtgaggagcgagcggagtcgcgtgcgccggcgcgcagctccgggtcgcccc

SEQ ID NO: 2814 - DNA, 309 bp, Homo sapiens
cctgggccgcggcggttcccacctcgccaccgccgccgccgccgcacggctgcccgtcgcgaacaagcaccggcaccaccacgcgacgcagcaggccgggcgcggcgtgcagctcggcggatgctgccaggtcaggcgactccgccgcccctggagcgcgagcgcgcttcagcttgtagcgatgattctggaaccagatcttgacctgcgtgggcgtgaggcgaagcaggctcgccagctgctcgcgctcgggcgcagacaggtaccgctgctgccggaagcgccgctccaactccagcgtctgcgcct

SEQ ID NO: 2815 - DNA, 203 bp, Homo sapiens
caccctgccctcggtcggtgacccgctgtggtccccaggccaagtgttcttcgtgcccgggcggctgacgctgtctgaagcccacgcggcgtgccggcgacgcggcgccgtggtggccaaggttgggcacctctacgccgcctggaagttttcggggctagaccagtgcgacggcggctggctggctgacggcagtgtgcgct

SEQ ID NO: 2816 - DNA, 388 bp, Homo sapiens
accgggaagcagcccggtgttccaagccttttgagattctccggacctgcgcgccgcccgctcggcagggggctcggcaggcgcgggcggcgggtgggggcgggaggctctgcccgctcggtggctgccgcggcctcctccgcgctgctctccacgcctggcttattatgcacgaggcaggcaatttgccttcctccccggggacccatctcggagacaagaaggtagtttgttctctgtaatggcttctgctggagtgcggcggggcccaggcgcgagcgggggcacgggcggggagttggcagcgaaggatgcgcccggcgccccccggcggccgcccggagcccgaggtcggcgcgggaggagcgctgactccgcgggccgagcc

SEQ ID NO: 2817 - DNA, 241 bp, Homo sapiens
gagggcggcgcgcagcggcgctccgcgaggtccccacgccgggcgatatggggtgcctgctgtttctgctgctctgggcgctcctccaggcttggggaagcgctgaaggtgggtggaacgagggcgcttgagtgcactcgcgggagggcggagagagggagctgggtagggacggggagggcaacgcctgatggggactggtgagacccgggacgcactggcgcgatctaggtagaaaact

SEQ ID NO: 2818 - DNA, 232 bp, Homo sapiens
gggctctttatctgcattttctcataaaactgccgtccgtgtgtgtttctgcgcctggcctcttgcatttctaaggggcctttgaagacagggccgaatgcgcgcgggggcttcaggcactttgcgctccacggcgggtcccgcagcccggcccgagccggccctggaagcttcgccctggactagactggcaccgacgccgcccccagcctgagcgctgagagggaaaacg

SEQ ID NO: 2819 - DNA, 214 bp, Homo sapiens
gaatcccttccagtgccgcaattaggaaagttttaaaaagtaaggaccctagacagacaagagatccatcctttcctttagcataagaaacaccccgcgccgcgccagccgaacgctgctcgcacaaggctatccgcccttcttggccgggacgcactcggtgccttccagctccccaccagaactggtccagggggcgcggaaacagagaggc

SEQ ID NO: 2820 - DNA, 250 bp, Homo sapiens
agcagggaccagctggtcgccggcccctcgggcaagatggggaaccgggagatggaggagctgatcccgctggtgaaccgtctgcaggacgcgttttcggcgctgggacagagctgcctgctggagctgccgcagatcgccgtggtgggcggccagagcgccggcaagagctcggtgctcgagaacttcgtgggcaggtaagcgcgcagggcgcggagtaaggatgcggcagtggggcgaccccgctgcg

SEQ ID NO: 2821 - DNA, 201 bp, Homo sapiens
ccaggaccctgcagacccggccgcggccgggccgagtgcctcccgccggggccttacgcccacggtccacgcttgcaacaccagggctgtacggcgggtccgcagctgggtctgcgcctgggactcggggctccctgcgctcctcgtgccgcaccccttgccttaaccccaagcggacgggtcctggggcttcaccggcca

SEQ ID NO: 2822 - DNA, 467 bp, Homo sapiens
tcgtttcttctcacgctcccccccccgccccctcccgcgtccagccccgctctccccaccttgtaaaacaaagccggggaaaatgcctgcccgtgcagctcggagcgcgcagcccgtctctgaataagaagtgagtacaatggcgtgtttgtaaaaaaaagcttcaagtccgtctttttcaaaaaacattttgaatgctgcatgcctcatgcttcccagcgcctcgcgggagagacccggctatagagcaggaggtgagaccccccctccggtacccccacccctctggccgcacgctctcctgccccagccttttctgggaggactgcaaatgccccctctcagcaagcggccgtttcccatcttcgcttcgcgtccaaagtgttgggtcataatctggatttggaggcaaacccttgccagatcctctccacgccgcttctcccccctctcccgccggtgcccgg

SEQ ID NO: 2823 - DNA, 201 bp, Homo sapiens
ctcgaggggctcacagcttggcactaatttgcaggtgttcgctgctgatttggtttcttcttcgatttgcggacggttccctccagcgactctcgacacacgttttcctgtcttcgccggagggccgggtctggggtcgccggagcctgcgggaatccagcgcttattcgctgaccctcgagtcgcttcgctagctgtgcg

SEQ ID NO: 2824 - DNA, 232 bp, Homo sapiens
ctggggtgctcccaggaagtgaaggaaaaggtccccgacgacattgtcactggaaaagtgctggccacggcctccgccttaccctctccacccacgggttcggagcccccaggagcagtcagaccgatcaccgctcctgcagcctcatttgtttccggagagacacccacaagccagcccacggagagtctggactcgcccgccccagcacccacgcctcccccgcgcccgg

SEQ ID NO: 2825 - DNA, 222 bp, Homo sapiens
ggctagggacagcaaaggagacacgggtgggtgagacgccggaccctacgagggcctgctgcccttctggcgcgggcgtggaggcactggccagagggcacgcccactagcccgagactttcgggatgaggccatttcctgagtccacatctggacatccacctctccgaatgcggtgacctcattcataccacagcggtcatcagcgggcctgagatcgtg

SEQ ID NO: 2826 - DNA, 239 bp, Homo sapiens
ggcttccaggcggagcgcgggcgcgaggtgcgggctccggggcggagcgcacgcccgggaggcgggaagtgggcagcagcgcccccgcctggcccctgtgcgccccgacccgacgcctccccgcccgaccaggtgcctcgagagcgcacagctgggagggctctcccggtcgcggcgagactcacgcctgcggtgtgctagggcggcggcgacggtgacgggcgtggggcgcggcgctg

SEQ ID NO: 2827 - DNA, 209 bp, Homo sapiens
cgccccgggggtccctgcaccctagccggggaatgctgccaccctgaggggggctgtctggctgcggggcgccggggctgggggtactgctcccccaggacgcggctccgcagtgcagagcgccgccgcctgcgtggggggatctggcagcttcaggggctgccctgagctccctggcgagcaggagtgagctgctgcggcgagtgagc

SEQ ID NO: 2828 - DNA, 380 bp, Homo sapiens
gaggccgggcctcggcgacccccgagggaggcccgggaaccacccccgacccaggcgccagacccggagtcgcacggggctcccagtccagccccgcgagcggctgctgaccgcccctcccgcgctcgccagggcccctgccccgcgtcagccaccgcgcgccttccccctgcccatgccgcagcccccgtggcttttgttctggactcgggatgccaggttgagacacgtcctgcaaacctctggcagaaatgggcgcaagggggtggatttcgttttcgcctcccgggctttttctttctccccgctcacatgccttctcattactcctcttcctctctcccattgcactttgatgaaatggttttgtctgtctaaac

SEQ ID NO: 2829 - DNA, 394 bp, Homo sapiens
cgggtcggcagggaccaagagcctgaaagggaacctgccctcccctccccgcagcccggtcattaaggcaagaaactgcaggcagagaagcccccgaatccgacctaggacgtcggcgcctgccaggatcccctcgcctgccccccgcgccccgcgcgcgctcatgccaccaccacggggagggtgcatgcggcaggtgcctggccgaggcccccgggagcgagtcgcccttacgtgctccagcttgtctttcctccgaagccagacgctggcgctgtagtcctgctgcttgacgctgctgtagaagttcgcgcccactcgggtcaggcttggggagggctccttggggcggcttttgagcctcatctgctcgaagccctcatggggggaggcc

SEQ ID NO: 2830 - DNA, 201 bp, Homo sapiens
cttcgtccgggtccctcaaacatgtcgcagcgtggctgctcactgtcccctctgggcaagaggaggccccagacatttccacgggatctgaactcccgagcgccctgcacggagcagccatcccgccagcaccccaaagtgaagctgctcacaacggacaagcccggagaccccatgagaggccggggtggagaagccggg

SEQ ID NO: 2831 - DNA, 557 bp, Homo sapiens
gtcgccatcgttcagcctcgctgcccaggtgggaggggtcacctgccgcggggtctccaagccagtgccgcttgctcccggcccccacccactgacagcacggcgtccgagtgaccctgtctagcctcgttctgcgctcctgcaaaccacgttgctgcgctaactacaaacctggccaacatgtctttgtaaccctatcatttaaaaacgcttccaggcacctggccgctgccagatcaggttcgcgggcccggaggaggtcctcccacctgcccccgccagccccggggaccgtgcgcggcctccgtgtggcccccgcccacgaggtccctcgggcaggaaccgccgcgcgacctctgttcagcggccgcgtcctggccacgggcgacccctgtcgggaaccctgttcccggctaagctgcgttcccgcattccggtggctctcacccgagctcgcgtttgctggctttccctctggctcctctgcctgaccccgattttgtctccgaactccactcccagatcctccccgccctggaacgccgacctttcccccg

SEQ ID NO: 2832 - DNA, 212 bp, Homo sapiens
agctgggttttttcccacctcaaaacctttattttcagtttttaaaagccaccttagcccgccatattgaaactggcacggtttctaaagactccttccccgcagttgtggcgcttccaagaaaacacgagtacggatcaggctctggatgagtgtccggccaccgagaatcagccacttcccaccctccaggatcccccagctccctccag

SEQ ID NO: 2833 - DNA, 201 bp, Homo sapiens
tttccaatggctcagtcgaccgtgtgcacaaacttgcgctttatccgccggggatcgctgggagcggagataaattcaatccccagggcaatcttggccccgcccgccccaccccatcctgtgcttaaatagagcctttcttgaagctgcgaacatttccaggccccttgggcagggctggaggggccgaggagagctatt

SEQ ID NO: 2834 - DNA, 201 bp, Homo sapiens
tcctggacaacaatgcgcgcccccgcccccccagaaagccagggacgcccccagtcgccgccagagctggctcggcttcccagcccctctccgtggcacccgcaggcgagacaaagttcgctcccggtgaggctgcgcgcgtccaaagcgtgcgggatgcccagcacggaggtccccaagcgggggacccctggctccccc

SEQ ID NO: 2835 - DNA, 294 bp, Homo sapiens
ggcagatgacgattcgccgagctcgccgcctgtcctcccggaggcgctcggagctgctgcgggctccggtcgccgctgccactgctgctgccgccgccgccgcgcggggtcacctgaaggttggggcgcggaagctcaactccgtgctgattgggctccaagttttctgcgccctcgcctcgtcccgagtgcccgcgaatcccccggacgcccacgcagaccacccagccacaccacaactctgcctgcggagagaggagaggagaaaaaggggccgcttcaaaaactttcaaa

SEQ ID NO: 2836 - DNA, 244 bp, Homo sapiens
tagtcttgagccggttgtcggccaggtgctgggcacacccgcgccgccgtcgccgctcgcccttggccgcgccagccgcagggtcctcggcgcccgggggcggcagcaggttggagcgcaccgtgcgcgtcctgccctctcggcgcctccgccgtcccggaggcccgggctcctcggtccccgccggctcccgctccatggccgcgtgtcgccgcgcccggctcctccgccgctcacgcccgcc

SEQ ID NO: 2837 - DNA, 303 bp, Homo sapiens
ggtctggggccatgggaacaggatcaaggccccctgagcgccgggcctggcttctgtggcttcgcaaacttttcagcctgtgtgccacggcgacgcgcagcggctgagtcggagcccacgcggcgcgcgcctcccgcgaggaacttttcggcttgtaggctgcttgtcactctcgctttccgacgcgcctccccctggctcgcgctcccggagttccctcccctcctggcgaggacctttcccggcgcccgcggctccgatccccgccgcgctgcgcccgctctcccggccccggctgccccg

SEQ ID NO: 2838 - DNA, 286 bp, Homo sapiens
aacagatccccgagctgaaaaaacaaaaacaaactggggagccagagcccctgaaagctccggtaggaaattcaatgggcctcctgttcctttaaactctcgctttcgcccccgctgacactttgcaaagccgcggcggcagcggcggggaccacgctgcggtgcaccaccttccgccaccctcccgcgctgggctggggtcgagggggcttcgcagagtcggtaaccgaaccggctctggtttgctttctccactccctagccactaccagaaccagcctccgcg

SEQ ID NO: 2839 - DNA, 261 bp, Homo sapiens
tggctgtggaattagatctgttttgaacccagtggagcgcatcgctggggctcggaagtcaccgtccgcgggcaccgggttggcgctgcccgagtggaaccgacagtttgcgagcctcggctgcaagtggcctctcctccccgcggttgttgttcagtgtcgggtgagggctgcgagtgtggcaagttgcaaagagagcctcagaggtccgaagagcgctgcgctcctactcgcgttcgcttcttcctcttctcggttccc

SEQ ID NO: 2840 - DNA, 201 bp, Homo sapiens
gaacgcgcagagagttccttggagtgccctgattttgtccccgagagggcccccaacctccgcatcctcttagtggctgtcctggcaggtgcgcgtcctgcggggagttgcgccccgggggctatcgccgagcgggagctgcctcctggaaccctgcccaccgcgaactgggtgcctactccccatttctgcctttcagtg

SEQ ID NO: 2841 - DNA, 201 bp, Homo sapiens
tcgcgtctcagcaccgagtgctccaagccctgcgcgcagcgccgggcttggaaggcggcgaatggctgcctagccgccgcccctactagtgacactcggccgccagcccccgcccaggatgtgcacatctgctggcagcactggcccgggtggcagtcaccgggccacccactccacaggtacaaccgcacccaatccaac

SEQ ID NO: 2842 - DNA, 201 bp, Homo sapiens
gcgccccgggaagtgcatggtcctaaggtccaaggcgccaggacccaggtccccagagccctcaatcagtgccattctcttccgcagcgcgggtgtcagccgcgagctcgtagcccctcgacacccgcctctctctggggtctccggggaccctttcagaggctgtaaaggtgtcagaagcccaaggcaggaggcagcttg

SEQ ID NO: 2843 - DNA, 201 bp, Homo sapiens
ccggcgccgtcgctgtcgctcgggccccgcgactcgggccgggctgtgggcgcgcggcaggcgggctgcggcggcggcgggacggggcggccgcgggttgcgtggggtttgtgcgcgcgtgtgcgcgggcgccggctgtgcgcgccgcgggcggacagggttcggccggcggcggtaaagttgggacccgcgggccgggcg

SEQ ID NO: 2844 - DNA, 201 bp, Homo sapiens
tgtcccggctgacctcgctctgcagccagcttgaggtcaggcggtcgctctctgcaggtcacaaaccctcggcgcaaaagtagggctttgaacgcgacaccgcaccagagcgcccagctaagcgagctgcctccacccccactgtgtcgggcggcgcaaactgcgggcgcaggcagaggagccgcggctctgcgccgggcg

SEQ ID NO: 2845 - DNA, 201 bp, Homo sapiens
ctgcggaggggccggtgggtcagagccaggccaggcagttgctgagccttcccctcccctcctggcgggagtgtgtgtgcaaggggccagggggcggagtcggagaaagggttgggggtgtccgtgtccagcgctcctccggacgcggctccacaatccagctgcgagaacagatggacgcagcggcggctcacctcgggg

SEQ ID NO: 2846 - DNA, 201 bp, Homo sapiens
cgcggctccccgtgggctggccgggccaatgagcgcgcggctgtaggggcggcgggcggggagggggcgccgagccctgcggatggaggcgcgggcagcgcggcgcgctcattccgcgcgggcgttgctggcggggggcggcgcagccactggacccggaccggggccgcgacccggggtggcgggtggcgtgggcggcgc

SEQ ID NO: 2847 - DNA, 201 bp, Homo sapiens
ttcgccgatccccagaggcaccggttgcgcttcctggtggcttggaacggcgcggagggcaagtttgctgtgacttgtcacgaccgcaccgcgcagcagccgcagcggcgcgagggggcccggctggggctggagcacaagcccgaggccgccgtgtccccgcccagctgggccggccggctctcggccgcggggttccgc

SEQ ID NO: 2848 - DNA, 344 bp, Homo sapiens
gccggccagagggcctacgcaagcctcgaaacccggggggacgcctcttccacccccatccctgcgctcgcccggggctgggcgcgccggggcgcacgcacgccggtttgctggcgacctggcgcatctgcccgcgcgccctggtctcagctgtcgcaggttcctcctgcacccacttccagtcttcaaagccagtgcagtcagcaccgtccacctggagccccaatcctctcctgcgattcccgcacacccactgcaccccatccaccacctccgggccgcgcaggtccgggcctgcgaagacacgcggcttacctccggccactccgttcatctggtcaaag

SEQ ID NO: 2849 - DNA, 201 bp, Homo sapiens
atccctccccgcggcgccccctcgcgcagcctccagactgttcagccggtgtccgcgggcgctcgctctctgcgagccccaggttcgcgcgagttgcctgcgggaggggtcggggacacggacagacgctgccctaccagggattcggaggacctggtgggcaagagcatgacccagcgactcccgcctcgggcaagcgcc

SEQ ID NO: 2850 - DNA, 218 bp, Homo sapiens
attattctctcccttgcccaaaggatttttcccttctttctgaccccacgaactcatctccccaacaggttcctaaagtatgggcggatgtgctccctctcgcccaccgccaggagccgagccccggcaggtgagcggtgcaaaacacgcacccagctgcccccagcttcctccgtccccgctgagttggctgtccccaccccgcaccacggcacccg

SEQ ID NO: 2851 - DNA, 234 bp, Homo sapiens
gcgcgccccgtgcgcccccgccccccgcgcgcccccggcccatccccgtccctggagagctgtcgcttgcgcccgggcgcgcggctggctgcctcctcggcggcggcggcggcggccccattagcggagcctccgcctatgattggcttcgcccgggaagctggagacgggcgatgaataattgatgtgtgcggtgcggtagccggacggcggcggcggtggcgggcagcagcg

SEQ ID NO: 2852 - DNA, 201 bp, Homo sapiens
cgggggcacccgggcaggggtgccagatacagtattgtatctggcaacctcccggggcgctcagtgtggttttcccacccgggagtctggaagggtctcccgcagcccgcaggagacgcagcgctccccgctcagggggagcaggaggacagctggccgctttcgggagccccaggcgcgaagcggcctctctccgcctca

SEQ ID NO: 2853 - DNA, 201 bp, Homo sapiens
agccatagtagtcgtactcctcgcagcgcgccggcgcccagtgcagcgcccccagcagcagcgccagcgcggccgtccgcacgcccccccccgccgccgccgcccgcatggctgcgccctctccaggtgcgcgccgcgcagccccccgacgctcggtgcccggcggcccaggtgttccggcgtgcgcccccggccctgact

SEQ ID NO: 2854 - DNA, 235 bp, Homo sapiens
ttccgcggcctgggggacgggagaatggggggtccacggccgccttgggtcctcaccgcgcaccgcgcccgcagcggagccccggagccatggccctgagcgagctggcgctggtccgctggctgcaggagagccgccgctcgcggaagctcatcctgttcatcgtgttcctggcgctgctgctggacaacatgctgctcactgtcgtgggtacgtgcggacagggcacccctgc

SEQ ID NO: 2855 - DNA, 201 bp, Homo sapiens
atccgtccaccttctacccctggctcatccaccgctaccgatatctgggtcatcgcttccaaggtacgtgccacgtcgcggaactgcagcgcgccgctcccgccgcatccttcactgcccccggcctgctccgggtgggcgcttggcaaggcctgggcggaggttcctccggctcgcgggccagcgcgccctgttgggaaa

SEQ ID NO: 2856 - DNA, 241 bp, Homo sapiens
gccaataacgggcgggctcttatagcccgaagccaaagcgccaaaatccgagggaaggcgaggagggggcggtggcggaggcggctgcggggccggggctcggctgagccttcgcctgcctaatcccatttgccattgtacgcgcccaatcgccgtatactccccgcatttaacttggatgacattttgatttcatcattagcatccggcgccggattgacgcagcctcgagccggggact

SEQ ID NO: 2857 - DNA, 201 bp, Homo sapiens
ggggcatttgcaccggggctgggcgggcgcacccagagccaggcgggcaggaacccctgcgcagccatccggtgcctgcatgtccctggcgcggaagggacgcctcaccagcctcggcgccccctccccctagatttcctccccgcccctccccactgcctgcctgctgcaccaccttccacccagatcacccagatcgtc

SEQ ID NO: 2858 - DNA, 201 bp, Homo sapiens
ggccggcgcgcgtgggccccggcgaggcggcgctgcaggagctttgcgggcagctggagcgctacctgggcgcggcggcccacggctgtggcggcgccaccgtgcgcgacgctctcttcgcggctaagggccgcgcggccgactgcgagagcccgcgcgagtttcgggagcgggccctgcgcgcctgatgggtcgaggcgg

SEQ ID NO: 2859 - DNA, 217 bp, Homo sapiens
ccggcggcgagcgctgcaccatcccacgcgggcgccgagccggggccgggcgtcgcgaccggagggatttcctgcctcggcgagtcagctccggagccctcgcgcagcgcccgcgccgccgctgagctcttctagcctttcatttttaaaaaagtttccccccgtgtgtgtgcgtgcgtgcgcgcgcgcgcgccgttctggcacaagccagccttga

SEQ ID NO: 2860 - DNA, 201 bp, Homo sapiens
cagggtcccgaccctccgtggggtacgcgcgacttcggcgcagatgtcagtccgctgccttccgggttgagggagcgaggactccagacgaccccagggccgctgtccaggcccagccccgcgttctccacctcgccacctcgctctgcggctccagcctggagatctacggacttcattgcgatctcttgcgcagtgtag

SEQ ID NO: 2861 - DNA, 201 bp, Homo sapiens
caaatgggccaaacaggttcgtaaggcccccgcgggtcccctggcccggaagttgagccgcgggtgcctggtctgaagttccgcgccccacagtggcccgcgggcctcggcggctcctgccctacgccctccaaggcaccaggcaggtggccccagggcctttgcccacgacaccccctgggtggggcaggaccacccctc

SEQ ID NO: 2862 - DNA, 201 bp, Homo sapiens
tgcagtccgcccggcggcgttttcgggcgagggtctggtgctggggagcgagcgcggagcgaggtgtctctttaaatacgctctgcagtgtgacggcggccgcccggctggaagagccatccccaccctgcggcaggagcccgcccgccgccatcgcccgccccggtccccatggttacgcgcctgcctccggccccgggt

SEQ ID NO: 2863 - DNA, 317 bp, Homo sapiens
cgcgctctgtcaccaggcgctgcagctgctggccgagctctgtgcccgtggggccctggagcacgacagctgccaggatttcatttaccacctgcgggaccgtgccagaccccggctccgcgacccaggtgagtgccgccaccgccgcctggagggacctaagggccctgggctgggacttggggccgcaccggggcctgaggcagaacagcgacgcggactgggagagggcggggggcggccaccgagccaggagagtgatcaagaaccagcgcactgtggcctgatgctgtaaccaggcggggacccgggcggtg

SEQ ID NO: 2864 - DNA, 221 bp, Homo sapiens
tctgcactgtggagtacgccatgactgctcacggtggtcgcaggtgcagacgccagccggaaccggaaccggaaccggagcacgggctgccgctcccgaccgaaccgcgggcggcgcggacggcgtcgcgcgagggacaaggtgcgcgaggcgcacgcatcttcacctccactgtcgggagttgacctgctcctcccgcgtggttacccgtcgctgtaaat

SEQ ID NO: 2865 - DNA, 201 bp, Homo sapiens
ccgagagccctgcggcgcccgccctcctgctggcggacgtgccttctgagtcgcctccgcgcaggcaagaggctgccgcccccagcgagggagagagcagcggcgaccccacccagtcaccggacgccgccccgcagtgccctgcgggtgcgaaccccaacccgatataccaggtgctctgaggggatggtggccgcccac

SEQ ID NO: 2866 - DNA, 201 bp, Homo sapiens
gcaggggagagcgagcatgttcctgccccgggcgccgtgcggtcgcagcagcagcgcggccctctccagtgcgagccgtgcctggaatgtctcgggtaagcgaagggccagcaagcgaggcgaaacggacactataaagcagagagtggtgtgagcttccccgccctctgaaaagatggcaagtctccgtttcgggaaggc

SEQ ID NO: 2867 - DNA, 201 bp, Homo sapiens
gagccccacgccgccgccgccgcgccagcggtggggggcgggctgggggcggggcggccggggctgccttcccgggcgcatatgcgagcgcagcacccggcgctgccgagccacctcccccgccgcccgctagcaagtttggcggctccaagccaggcgcgcctcaggatccaggctcatttgcttccacctagcttcggt

SEQ ID NO: 2868 - DNA, 201 bp, Homo sapiens
gggcatagccacggcaattcccagtctgctaatgccaaggcgggcgcgtaaggccgcctaaatctagacctccctcctcactcatttcaaaaaataacaacgtgccagccacctccgcagataccgccggctggtgcttgcccaggagacgccagggccagagcgccactcccagcatcgaaatggcagagagaaagcgca

SEQ ID NO: 2869 - DNA, 230 bp, Homo sapiens
ccggtgtctcctcccggccgctctacccagcaactttccgtgctttgttccccgactggaaatgctttacggaagcgtcttggacagggtctccgccaggcgacaagagctcggtgctgagatgtgttacgttctcatctccccatcaattatggatggaaacaaataaggaagagtcaattttgctgagccccttctccggcaacgagaggcgttctgcagccgggagg

SEQ ID NO: 2870 - DNA, 201 bp, Homo sapiens
gcttccccgagctggccgcccttgcagacccccacgctcagctgctacagcgccgcctcgacttcctcgccaagcacattttgcactgtaaggccaagtacggccgccggtctgggacttagtgtcaccgggaggaaaagagagagatctggggctggggtatggatgatggggggaagggcggtcgcctctgccactgtc

SEQ ID NO: 2871 - DNA, 201 bp, Homo sapiens
ccgcagacgccggaggcgccatggccgccaagcccggcgagctgatgggcatctgctccagttaccaggcggtgatgccgcacttcgtgtgcctggccgacgagttcccgcagcccgtgcggcccgccaagctgcccaagggccggggccggctgcggcggccgcgccagtctcgcttcaagacgcagccggtgaccttcg

SEQ ID NO: 2872 - DNA, 201 bp, Homo sapiens
gcagctccaggaagtcgcagtcgccgccgtcgtccaggtagagcagcagcgcgcgcgtggcgttggtgcgcaggctgaagctgagctcgccgctgctcgccgcgcccgcccagcgcgcgtagcgagcccactgcccggggccgccgccgaactccaggccgtccgcgcgcgccgccagcgccagcagcagcagcaacagca

SEQ ID NO: 2873 - DNA, 201 bp, Homo sapiens
aagctcctatcccttggacccgggcctggcgcccccgcccccggcgcgtcctcacccggcggacgcggccgcgcacaaggcccagcacggcccgcgtccccgcagcccggccgcggttgaacatctccagcgcgaagcgggtgggcgccagcagctccggggacggcggcccccaggcctgaaagctggcggctcggggct

SEQ ID NO: 2874 - DNA, 201 bp, Homo sapiens
ggttccccagcctgggccaggccggggcgcgtgtctcgggccccctgtggctgcaccgcgcgccctgtgcccacgggcgaaggcgctggaattcggcgctcggagcccgagtttctgaaggcgggaggcggcgcccgacctcaggggttgcgctgggctgccggagccaagagtgtctgcgtccccagccccgcgtcagaa

SEQ ID NO: 2875 - DNA, 201 bp, Homo sapiens
tcagagtgtgactgagcgggttggcccggcggccgttgccccccgcccccgccccttcgcgcctggccgcgccactcactgtcgcgggtgtccgcgtgcgcgccgccgatgcggccgtcggggagcgcctggaggtggaagccgatgcccacgttgcagtagagccgccgcagccgcttgatgcccagcaggtagtcgccg

SEQ ID NO: 2876 - DNA, 201 bp, Homo sapiens
cattcagaaaatggaaagctgagtggtcgatgaaccggaactgggagcagctttctatgaatcagagaaaatgcaagttaaaaggagacaccatttcccacgcattagactggtaaatatcaggaaataccaagtcttgctgaggaggaggggcccagggagttctcacaccatgtgggtgggattgtaacttggtacaac

SEQ ID NO: 2877 - DNA, 201 bp, Homo sapiens
tctccgggacggacgctccaggcgcggcgccgagtggaggcgagggggctgcggagggggaaggggccacgcgggccacggggtttaacccctgactccccgcgacgccaagaatgcaggagggcagagttgagggagacctcaggtggaactttcaggtggggaaggctgagctgtcggggctgcgggtaccgggaaggc

SEQ ID NO: 2878 - DNA, 201 bp, Homo sapiens
ccgccgccgcctgcccgggacggctccgtgaagaaggacggaggcagattgcgtgcccgcagcgggaccttcctggcccctgggatcgccgtggcccccgcggggcctgccacgtcccctcccgcgcccccagtgcccgcacctcctagcccggccgccggcgcagccacctcaccccccgccggctcggcacccccgggg

SEQ ID NO: 2879 - DNA, 268 bp, Homo sapiens
gcggccagacttcggctttgcaagctggcggccgcggcggcctgcgacgcctcccgccggggggcagccttgccgtgggccggggccgcgactgtcggggcgctaggggcggccagcggccgtttggctggcgtgtcggcggcgctcggggagggcgggccggggggcgcggcgcccatgaggccgctgcagcgcttgatctgcttctgcaggtacttgcggtggttcaccttccgcttcgacttgcccggcttgtccagcgccagct

SEQ ID NO: 2880 - DNA, 614 bp, Homo sapiens
agagtcatcctgcccgttgttctggatcttgaaacttgggagacccacaccaaaggagggaaccggttcctttaccctttaagcgcgtcgtgtcctccaccgcctcttctcttggcccgactggctctggtttccttcacgttcccagcctccaaattggcgtccgccccatggctcgtgtaggacgctaaaagcacggtaaatcccagggcgatctccagcagacgccctcgacgcatgatgccgagccgccaccggctcccgccgcctcttgccgcgcccggggctcggtctgcggccgccgctgcgccctgaagcgcaccgcgccgccggggtcccgctatcccgccgcccgtcccccgggccgggctcctcccgccttctccaggcgctgctcccacttcaggcggcccctgccagctgcaacacagagacaaatccccgaggcggggagactttcagggcatcgggatgctgaagcctcgcggtccccattcccaagcccaacccgtgcgccgcctgcgcgtggcgcagttaatttgggtaagggaagaccgtttggtccacagctggctggaaagcccaggcccccggcggcagcagccccggccgat

SEQ ID NO: 2881 - DNA, 201 bp, Homo sapiens
gggcaccagctccgagctcaggccccactcccgggcggttcgggacgaatcccctctacaggccagtgtgtgtgcagggcaagtgtagggggctgaggggcgctggcggggaggcagtagaggtggcctggaccatcttggcgcggcgcgcggtgagcgcgaggattccgccagtgggagtcgctgagctaaagtgcatct

SEQ ID NO: 2882 - DNA, 201 bp, Homo sapiens
ctcgcggcgacggtgacgcgctctggctctgacaagcctggctccccccaccctaccgggtggcgccgttgctgaccccacgcccagccgttcccactcccgcctgaaactcctccgacagggcttcgcttcgggggctcagtccccagcgcgtacacactcgcgtggtgtcggcttagcctcttgtaaaggaagcagggc

SEQ ID NO: 2883 - DNA, 201 bp, Homo sapiens
ttgcagccagccggcggtccaggtaagagacaaggtgtgagtaaaggcttctgatggccgggtggcctgacggccaggtgcgagtggggaggacagctcacgcggcctgagcagccacccctggccatagctccagcccccgcccctgcccccggcccctgccctggcttgcttgcgcgctacctcgctactccgcagtgc

SEQ ID NO: 2884 - DNA, 201 bp, Homo sapiens
cgctcggccgccgcctccagccaactcgggtccctcccacggcgaccaatcagtgcgaagctggctgggcgggaagccgcgagaggcttttattgcggcgcgggtggcggccaggagctgccaggacagtctcccggtgcttcagcctaacggtctcgctcactcaccgccaagagaaaccccgccctgcggccggtcccc

SEQ ID NO: 2885 - DNA, 201 bp, Homo sapiens
cgggtactgcgaactgccgggcgatgctgtcgctgccgccgtgatacggagagcaacagttccccagcaacacccctccccgacacaggcacacaccccccgacaggcacgcacacccaccccacagtgcccggctcggctgcggtgagtgaggggccgggaagaggcgcaccgcccagcgagcgccgcgcgccggggctt

SEQ ID NO: 2886 - DNA, 261 bp, Homo sapiens
ggaccggcggtgacaccggagctcgccgtgcgctcccggccgctctcggtgggtgccggtctctgcacctgatgcgttcgggatgcctttcccaccctggcgcgcccgccgctagctcgcacagcgcctcgcacactcccgcacgcgcttgaaatgcgcacggtcccgccggcccgcggaaccacccggacgcacggagcgctccgcaccgactcgctcgccgcctccccgagacgctcgcaccgtgcttgggccgggcgc

SEQ ID NO: 2887 - DNA, 201 bp, Homo sapiens
cggccagggcaacagccagggcaaagggagagagaagccgccccggggcgagaaggagaaaagttagagggctgaacaggtgacgctgagcttgttggagcgtgtgtgctccaccacgcaagggcgcggagttcggccgcctcatctcccgccatctgcgcgcccgggggcacgtcctctgcgatagcctggaacccagac

SEQ ID NO: 2888 - DNA, 201 bp, Homo sapiens
gggcatcggtgccgacgccgcgagggcagcgcccgcggcgggaatactaatgcaccctaaagggcacggccgccgccgcagcaggtaattagctggaccgcggcggagcgcgcggaggtggctgctggctgcaaggactgcgcccagcctccgcctcgcccctcgaggctcccgcgtgggccggcgggcagtgcgtgggcc

SEQ ID NO: 2889 - DNA, 201 bp, Homo sapiens
cctcctgtcccggcctcgtgctcccgctggggactgtttgcggtgagtctgtcgcacgcacgtcagggccgaggcagtgatgcggggcagcgtgggaggacgggctgcggagcccgcgtcatcctgcctgtggggagcgctgtgcctgctctcctgccagcgcgcccagctgtcccggccgccgccacgcgggactgcctg

SEQ ID NO: 2890 - DNA, 201 bp, Homo sapiens
ggaaaatagggcatccggagtgcaggagattcctcagggccgcccccttctccgggggtgccctgaggaaccgcggcggggactcgccgctggcagcctgcgggtcctggtgccagcgcgcatgggcgggctgtgcggacgtggctggtcctccaaaggtttcagatcccgtccgggccgctcagtcccttaaagctgtgt

SEQ ID NO: 2891 - DNA, 219 bp, Homo sapiens
ccccgggccaggaagctgtcaggcaggggagggccagcgccagctgtggacgttccgggacagcccctcaccccagtccctgtccctgccctcggcgcggcgcaaacgcaaaagcctccgtggccgcagctccagccccggtggccgcccgacccccgtcgggaccccggctgcacccactggagaagcggcggctccgactcccgaggaggcggcggc

SEQ ID NO: 2892 - DNA, 268 bp, Homo sapiens
cctaccactgcctcttcctcccgctctctacctccctgcagcgccaagccggctccccaacctggtctgctgaacgcaaaccgctgagagtttgctgcaccgccccctggggcccctggctgccgagtcccgctaaggcaaagacgccagcaagcgaggaagcgcagcggaagaaaaacaagcgggcgcgcgaggggagccccaggagggctgccgagtggctggcaggcggctcccgcccctcccgggtggcctcgccggcggctga

SEQ ID NO: 2893 - DNA, 201 bp, Homo sapiens
tccttcggccccaggattggggagtgtgccgcggggccgagggtggggaacagccagagggagacgcgaaccaggccgctggcggagggctcagggggagcgcagaggcgacggcccccatgccggcggccaacatgatggagaaccggccgctgcccgccctgcaggtgcccgagccgcagggtgcgcccgagggcagcc

SEQ ID NO: 2894 - DNA, 517 bp, Homo sapiens
cagagcgcgggcctccgggtctcaccccgggaaaagtctgggtctgctctgcgctgttgcgtgctgcgctcctgggacctgctgactgtcctagagggaacgtcccgcggtagtgtcagttccctggggaccaggaagggcgactcttgcctgggagtcagtgcttgggccgtcgggtccgggtaagcgctgggggtttggctcgagaagatgcggataggtggcctagggcgccgcggatctccgccctctgcgggcaccgggagcccagggtcgaggcgcgccgccccgaggggccccttctcctaacaatgcgcccggaatggagtccgcgccctgacagcgcgggtcagcccgaaaccgcccagaatccgcttcgatgagtgggtgagccgctctgggagtctgccgcgtctcggcagcggagggcctgagtggaaaaattcttattggatgcactttttaatggttggtttgcctcggttttcgtccgagtcttccccggcagtaggcgctg

SEQ ID NO: 2895 - DNA, 226 bp, Homo sapiens
cgcgctctcccagccgcggccccctcccccgccgcttcctcttgctctcccagccccttcccccacgtgtggatgacgtcaaaattccgcgaaaaagccgcgtggtggctccccgagcggaggcgcgattccgccgcccagcggccccctcccgggggcgcctggagggggagaagggcggaggcggccggttccttctcctcccgggaggcaggaccccccgacg

SEQ ID NO: 2896 - DNA, 201 bp, Homo sapiens
tttccgggaggcgagccgcgggctgctgggcgcggaggctggagccgcgagaggttcggctgctgaagcggccactgcctcccagagccaggctccgcgccgcgcgtccccgccgccgccggcactgtgcacccacctactcctcggagattggggtaggggaaaaaagttttgaggcgctctcatctctgcctccggggt

SEQ ID NO: 2897 - DNA, 212 bp, Homo sapiens
tcccgggcgtctggcatcctcccctaccggggccccggcggcgcgcggcgtctgcccggaggggggctcgggcatggtgctgcggcagctggacccgccgcgagctccccgcgctccgccgccgcctgcgccgcggagttggcccagctgcaaataaacagcagtccccccgcctcccccggccatcgccacctcctccgccccactgcgca

SEQ ID NO: 2898 - DNA, 388 bp, Homo sapiens
ccctcccggttacctgtgctgcttccgccctggctgcccctgtcccgagggaagatgcccgagcacttctcccactccacctggccggcgaagcacagctcggtgacgatgtgcagagccttctggcacagactgttcactccgtcctccttgtggaaactcatcgtttggcttttctttcgttttctctttttttcccagttagccgtcttttcctcttcccgtacctctaacccctctggcgccctaagccatagtccgcccgcggtgactttggctggagattgcgccgctgagagccggcaactcttaggagccccacgttggccccatggcgggagcggagggcgtaggggaaggagaggcgcgcgaggaggctgcggctgcc

SEQ ID NO: 2899 - DNA, 201 bp, Homo sapiens
ctcctggatgccaaacccggtctagggagcccaggagccgttgcagcctcagctcttctccctccctctctcgatgacccgggcaatgccaacctcctttcgggattgaaagctctaaatccaaggtgctaagttgatgggcggtctttgctctcacccctcgatttcgggcgcgtgtcttgaaagacaggagagaaaaaa

SEQ ID NO: 2900 - DNA, 201 bp, Homo sapiens
ccgtggcactctcgctagagcccaagcagtcccccaggcgtggggtctggtggacgctggcctggagcgcccggagggcggggtgggggtgggggggacgcgctgtcgtctggggtgtctccgcgtactcctgttgggcgaaccctggctctccggtgttggttgtcacttgagcaactgatgggcttccaggggaagtaa

SEQ ID NO: 2901 - DNA, 212 bp, Homo sapiens
cccgccgcttcccccccaccccgccccccaccgccgcccttagccctcccccgggatgagagagagtcgcgctgcggagcaaccccagtggatgggtccgcgggggctgagcgggcggaggacgcgggaactccgtgacaccgaccagctgacgctgcccgcgtgaaaccagagccgggcatcagggcctcatctccactgtctctgcacct

SEQ ID NO: 2902 - DNA, 250 bp, Homo sapiens
caggagggtgggtgccagcctttcttcccatctctcgagcctcctccccggcgcccacgtgggcggagcagcgcgagggtgtgcgtggcaggggccgcggcggcgtgtgccgtgcgtggggtggggtgcgggctgggcggcctcgccttcgggccccgcgccgccggggcgcggcccccagctccatcttctttgccacctgggcggagatctgggggactgtgacctaccctgcggaagacacggaggg

SEQ ID NO: 2903 - DNA, 488 bp, Homo sapiens
acacgccccccgccagcctgggcgccgggctccgaacccccggtctgcaaacttgcgcatctcccctcgccgcgcccgccagacaacttggcgaacagctcgcccgcccgcaccccgcttccttcggcccttccttcaaatcccaaacgcaccgccgtgctccaaagaaggtgtccacgtcgcccccagaccccggagcgccccctctccacccccgggacttcccaggtcgctcactcctcccgccccccgcccagatctgagagggaccgaaaacacacccccgactcgggcagccagggccgaaactgtcaagaggagaaaaggtaaagcggaaggagggtggccataaacagatttttttgccccttcttaaaaggacactgccgctttaaaagtttctttcccgggcccccactccccgcatctccgtattttgggggagcgtatttaattgaggcaacgcagctttcctccagtgtttgcag

SEQ ID NO: 2904 - DNA, 201 bp, Homo sapiens
ggctgaggagaagggagggagagcagagggaggggggaacccggccgggggaggaggagagaggcgaggaggcggctctggcagcgcgcggcggcggcggcggtagcggcagcagcagcggcggtgcggagagcttggactgggagcccaaagctcggctgggcagcgggagaggaggagccgcaggagctgcagctctgc

SEQ ID NO: 2905 - DNA, 364 bp, Homo sapiens
tctcataatcaaggagtatggtggagctgggtcaatttcaggcacagcccagccgagtcaggcgaggtccagagagacctgactcgcctggcagcctcaacggacttgtccccgcagccgttgcggacctcccggtcgtcatggcgactgtgaaatgtggggtggggcgcatgcgttggaagccattcgcgcgggcagtccctgagtgtcccctcacgtgctccccagcgcgagcagcacccccgcctctgcgcttcccagagcgtgcagcttccggtgagggcagccccacgcacagccccccacaccctccccagcgcctgcagcctccggtgcgcgcaggccccaagcccacatgcgcagt

SEQ ID NO: 2906 - DNA, 220 bp, Homo sapiens
gcccccaccccgagcgcgcagctccacgcagcctctccacactctccccagcgcctgcagcacccccagtgcgcacagctctgccagtcgcttccccgggcgccgcccctgcaccacttcggcccataaccttgcggcgactgtctgaagaacttcccgtggtttcattcttttcttcgggtttagtcttagctgtgacattttaaccaaaagattacac

SEQ ID NO: 2907 - DNA, 201 bp, Homo sapiens
ccgccctccccgcctcgagcgatctcctgcctcagccttgcaggctccgcactgcagatgcctgctggcttccctgcgctcggcggctcccgcggtgccccgtaagtccccgtgaccctccagcaccagccggctgtgcgctccctgctcccacgggccggtcagccgcagacactcacccagctccgcgagctcagccgc

SEQ ID NO: 2908 - DNA, 201 bp, Homo sapiens
ggggcaccgcgttggcacctgcagggagcgattggtctggaagggtagagggcagacgggggcctgggtggggcagcggccaccccaggcgcggagaacccgctgcttccaccctctccccgcggacccccaccctgcggcctgtgtgctcggctttctccgcgtggcggggaagtgcgggtggctgcccgggccctcaga

SEQ ID NO: 2909 - DNA, 201 bp, Homo sapiens
gtgtcggcctccgaacgcaccccgaggcggggtgagggctggcagtcgcccctgcacccgccgctgcgagccgcgcccctcaaacccaggtatgggacctcggaaaatcgacccgctgccctgagtgctcaccacgtgaggaactggagtggccgagttcgccaaggcgccggggacacctgagcagatgagaactggagc

SEQ ID NO: 2910 - DNA, 358 bp, Homo sapiens
gcgcagcgcctgagcctgcgcttcgccaagtgcaccaagtacgagatccagagcgccatggagatcgtgctgtcctggggcctggccgcgcactgtacggcggctgcgctggccgcactgtccctctacaacatgagcagcgccggcggcgaccgcctgggccgcggcaagtcggcccgctgcggcctcaccttctccgtgggccgcgtgtatcgctggatggtggacagccgcgtggcgctgcgcatccacgagcacgccgccatctacctgacagcctgcatggagagcctcttccgggacatctactcgcgggtcgtggcctccggggtgccccggagctgcagtggccctgggt

SEQ ID NO: 2911 - DNA, 201 bp, Homo sapiens
ggagcccccgggcgcgccctgggcgcattggggaggtccccgggcgggcaggcggacgccctggggcggcgggcggcggctgccggggctcgccggggctcggccgcccgctgcccatcgataggtattaggaattgatctcgccgctgctctttgttcggttcagtcatcgattagctgccgcgaccatggagaagcgct

SEQ ID NO: 2912 - DNA, 328 bp, Homo sapiens
cgcagggagggagggggcatcgcctgtttctctgctcgaaaggtggaggtaaagagggatcccggaccccagagaggcttacaaccttccataagcaaggcggggggcggaattcagagaggtaaagtgacccgcccccaaatcgcaataccaggaggacagcagggctagatggaatctttcggttcacagtccccgacctcgggcaagtgccccactcgggcgcacggtctgctcccagaccagaaccaggcgcgctcgtagccaaggaagcttggcgggagactcctccgaggctcccggctcccaggccagcggggctaaggag

SEQ ID NO: 2913 - DNA, 201 bp, Homo sapiens
cgttcggtgaagccggtgcattcaccacatcctctgctgctcctagcagggaagccggcggtgaggcgggggagcaggcatggtggctccggggtttatgcggggtttactgcttacccagaatagcggctactgctgcctactagggcgcacctaccgctggagcctccgcggcgactgcccacctccaacacacacctc

SEQ ID NO: 2914 - DNA, 319 bp, Homo sapiens
tggagccggcggccgcgtccgcgccgctgctgcctggctcgctggcggcggggtcgggggctgccggagctgactccatgttttttcccaatgtagagatcgctggagatggcgagctccgagactccctctatcttctgttttcagagcaactctatggtaccaaaaaaaaaaaaaaaaaaaaaaaaaaaaaaaaaaaaaaaaaaagaaggagaaggcgaccggcgaaagcaggagggaaaaagcaggcggcggcgggcgggcaagcaaaagcgcgagggagcgcgcggagtgtctgggtggacgtgtgtgtgcgccc

SEQ ID NO: 2915 - DNA, 201 bp, Homo sapiens
accgcgggaggagagcgcaaggaggctcctcgcaaagttggaggccaggccggagcgatgttccgggagcggagccctcccagcctcgggcccccagccgcggacagctggcagtgccaaagactccgccattacctgcggctcgcagttgcgattcggccgcagagtcgggcaccgaggaaggcgtaaagttgagcttgg

SEQ ID NO: 2916 - DNA, 370 bp, Homo sapiens
agggcggcccggggtgggggcgcctcacctttgccctccatggcgtgcacgaagtccccctggtacagctggctgcgaagcttctcctccaggctgaagccgcggacgctgacgatctcctccacgtccgacaagtcctcgttctcgtcgtatcgctggcggtcaatcgggcgctgcgaggacccaaaccagagagcccgggacattattgtgggggctggaggtcgcctctcaacctgggcccagcactaacaggtgcagcagccgagcgccccctgcaccccaccattgcaacccaagcaactttgcgcaattgccaaagatgctgaaaagcaggacaaggagaggggcccgcaccccgagggtccag

SEQ ID NO: 2917 - DNA, 201 bp, Homo sapiens
gctatgttggaacttggaggggaggggggatgctggagaggcacacggtgatggacatggaaggacccgggaggtgtggagtggtgggcccggcccgtcgcgggaaggacacagagggacataggctgccctggagaggcgctttcggacatctggaggggcgcatagtgctgggacttggcggcgcctggggcggagggg

SEQ ID NO: 2918 - DNA, 201 bp, Homo sapiens
gtcccccgcccccacgccgcagcccgggccagcggggcccgccgcggtggcgttcgcggatgctgccgcattggccgctgcggcacggacggcgcagcctcgggcgcggcccggcacaggcgccggcggtccccgccagctagcagcccggcgaggcgctggcccacccatggtcctcgggcggcggcccctgcgcccagc

SEQ ID NO: 2919 - DNA, 201 bp, Homo sapiens
atccgctcgtccgtgggtgagctgggaggggcgcggcgagggagggtgggcccggggcgggggcggcgcggggcgcgcctgcggttatgcgacactgccccgcccgcgccccgctcccctccctgggctccctgggctctctgggctgcaggatccgccgacgcggcgcgctggccgcacgggggctgggcgtcgctgcac

SEQ ID NO: 2920 - DNA, 263 bp, Homo sapiens
tgggctactcgtgtcgcatgtcggcgcagttgcccgctgtggcaaggggggggcggccgggctccggagcgggccgggagggcgcggggcgcgcactccgcggcaggtgagcggcgcggctgcaggtgagcagcagcctcggctcgcgcgcccagctttccccgccgcgcccgcccggcccacacgctccccgcgcgcgcgccgcccccgccccgcgcgcgcccggccgcccgcccgcccgcgggatccccgcgaggccgcgc

SEQ ID NO: 2921 - DNA, 201 bp, Homo sapiens
gttttgttttctttgtttttaacgaattggtaagtaaaatattagttgttcaccctgaaatctgccctaaccacttccgtaccccctgaagctcgctgggcgcgccctgggctgtccttccctgagcagccgggcctagagtcaaggcgcgatgattgccgcgcaagctagggtccacgcggccggggctcctctcccgcc

SEQ ID NO: 2922 - DNA, 201 bp, Homo sapiens
cttcctaccccggcacctccttctggtgacgtcaaggggtcccccacccctcatccgcctccccacctaccctcttcttcctcccaggctcgcttccctgcggctacggagaggggcgggggccgacgagggcgggtggcccggggccgagcgcgcgtggggaggtgctggcgacgcgggcccgggagcgcggccccggca

SEQ ID NO: 2923 - DNA, 201 bp, Homo sapiens
ttactcagctctgggggccgcccgaaactggggaagggacaaggctgaagctccgccgcctggccctaggggcggaaagtccgatccaagggaagctggccgcgcctccgcgacggtgttcttggcacggaggactgaggcgcagtccggctgtctccccttgcctgctcttcccgcgctgtcccgccgctcctgacccct

SEQ ID NO: 2924 - DNA, 201 bp, Homo sapiens
cgcggggtcgggcggggaccggccgggggcgccgcgcgcccggtcgggttgactgtcgggggcgatttccgcggggcaaggcgggggcgcgggagcagcgcgcagctgcggggccattccacctgagcgccctgaggtcagggccggggcctgaggacacggcgctgggctccgggggacgcgggttcacgccggcgcccg

SEQ ID NO: 2925 - DNA, 215 bp, Homo sapiens
ccacactcaccgtcccgggcgcgccgtccgcgcgcggctccgctccgggccggcatcccccggctcggctgcctccggtccccgctccggcctcggttcccgctccgcagggctcggctccgcgatggtggccgcggcggcgagcgcggcagggagggcgtgtgtatgcgcgtgagagcgcgcagcgtgtgcatgtgcgtgtgcgcgggagggtc

SEQ ID NO: 2926 - DNA, 201 bp, Homo sapiens
cgcgagtgctccccaatggcagcgcgggcgtccccaaccgcgaggggctgcgctactaccggcgcctgctggagcggctgcgggagctgggcgtgcagcccgtggtcaccctgtaccactgggacctgccccagcgcctgcaggacgcctacggcggctgggccaaccgcgccctggccgaccacttcagggattacgcgg

SEQ ID NO: 2927 - DNA, 201 bp, Homo sapiens
gtgccagcagccccggggccgcccgcacgcaacgcccccgggtcgggccaggctggccagggcagggcggccgcctttcgaggaactgcgggcggggcggcggggccaagctgagcgcccgccctgccctcggcgccccgcggctgcgggcggagcgggctctgcggagtcccccggccgccctccccgcagctcccgtcc

SEQ ID NO: 2928 - DNA, 201 bp, Homo sapiens
ccaggttgtctgcagcgtcgccctgttcttctatttcagagcgcaggtgagtggccaccttcccaggggatcgcggctgagagcgcccatctccttcccccgcacttggaaactgagtctggcggcagggctgggccacccagagcttgcatattccggaagggaaagtgactccagaagggagagaggaagtgttgagtt

SEQ ID NO: 2929 - DNA, 217 bp, Homo sapiens
tgtagctggtgctgctcctgggacgatgtagacgccccatatccaggcgcgggtgccaggtcgccgggcaccagctcactcccagggcctgtgagctgcgcgcattccctcggccgcgcattccctgggaggctgcagtcagagcgctcttgaagggagggcggcagaagacactccctctcggttcatgcaaatcgctgggggaacttcagccaat

SEQ ID NO: 2930 - DNA, 317 bp, Homo sapiens
aagcgagcgaccctctgagcccgggtggtccggcgggcaagggcggcgcgggagacccgcagggcgcgggcgcggatccggggaaccagggccaccgctgcgggcggatgggggtcaccgaggcggctcgtctccaggcgcacacttcgcacatctctttgctaagtgaaggggccaaaatgcacagatgggggagtctacccaggaacagaggcgcgagacgtatagccacccctgggttgggagcacgagccagcagatccccggagcgcgttaaacggacaacatgcccggtgctgcaaatagaggcttttgct

SEQ ID NO: 2931 - DNA, 201 bp, Homo sapiens
tacccctgtgggggggagggtgcagcgaaggctgccagggaccccgcgatcgcgccttaacacgtattggagcgagtgtgcgagtgatcatgagtgtgagcgggtgcgagcgctcggcggggctgaccgtcacgttggcggggccggcggggccaggcagtcttctccgcgtccccctcctcccgctccgtgcctcccctc

SEQ ID NO: 2932 - DNA, 201 bp, Homo sapiens
acggtgccaagggattcagcctggcggacatcccctaccaggagatcgcaggtaagcgcgggcgcgctgcaggggcaggctgcagccctcggctgccgcacgtcccactggccgcccggcgtccccttccttccccctgttgctgagttggtgctcactttctgccaccgctatgggactccgcgtctccgtgttgggcgg

SEQ ID NO: 2933 - DNA, 201 bp, Homo sapiens
gcgccgcagcctcccgggcaccggcggcggtgaccaacctgtaaccccagcgctcagagctgtcatggtgcccgcgggcggcggcggcggcgacagtgggcgaccggcaggatcagtgccaggcgcggcgcccagggcgggcggggacgcgggcccctcacctacggcggctcagctcaggcagcgcgctcggcccggctg

SEQ ID NO: 2934 - DNA, 201 bp, Homo sapiens
gcggtgtgcacgggagtccgccgggcacacgcggggtacacttaagtgcactgccaggaggccgggagcccagcgtgcgagcgtgaggtcagactgtgcacggtaccgaggactagttccattcctgagtatgaaagggtgaaaccgttcacctcaagtttcaccccggagttattaaataatgaatgcatcagtcacact

SEQ ID NO: 2935 - DNA, 201 bp, Homo sapiens
gggctggccgcggacccggacggtcgggagcgggcgcggcggtcgcagagacggcctctccccgcgcggctccagcgcagaccccagacctggagccgtgcgggcggagacgcgcggggctcctctccgcttcgccgccgctgggtttccagcgccctcggacccgcgggaggacaggaaccatccggagtgaagctgcgc

SEQ ID NO: 2936 - DNA, 221 bp, Homo sapiens
ccgagacacaaagaccgaggctgagaccgccaggggttgagggtgaggccgcgtcccggggccgctggagcgcgggcgtcatgcgagactgtcccggctgcgcgccgccccagaggagtccgagcgcccccttcagccgcggcgcgctggccctggccgggactgcagccaggtgggcgccgcgcgtgtgagcgccgcgcgtgtgagcgcagacctggact

SEQ ID NO: 2937 - DNA, 311 bp, Homo sapiens
gaccactgccgaacagccgctggagacccgcagagaagggcgggccctgcgcccggggcgcctcggaggtaagttcggagagcccgggccgggcggagggcgggagcgcacgagtgtgtgtgtgtgtgtgtgtgttcgcggtgtgcccgcggctcggtgcacacgcgcgcgggttgtaaagtcaggagctgcgggagcgcctccctgcctcggcttggccccggagcattgcgggccgcggaggtgtgggggcccttgtcgctgcgctcagggcagcggcggaaaaggtgtgtgcggatgcggggcggggc

SEQ ID NO: 2938 - DNA, 308 bp, Homo sapiens
ctgagccgtagaaggctttttccgcgttctcctctagtagggattcctggacggggagaccgacgggtctgtgggcgcctccccgggacacacttcggcccgctctgcctgggctgggcccacttacgttctgggtggggctcaggaactgcgtgcgggcgtagcgggtgagcatgctgatgatgaccacctggccccactcctccacgtcgatcagcaggttacagagtttccggtagtttttgtgaatcaggtcgatgcgctccgggcagacctcctcaaaggccatcaccacactgcccgccacc

SEQ ID NO: 2939 - DNA, 201 bp, Homo sapiens
aatgtgacacagacaccagctcctcgtgctcttggctcccagggtttctttcaccgcgcctcagcacctgcagcttctccactcttacagcgcccgccgtcgtcaaggcaacagagggatgcccggtgacagactcggcgccggcttccggcgccgtaagagaagcgtccgcgcgggcgttctggacccgcagagttctcg

SEQ ID NO: 2940 - DNA, 201 bp, Homo sapiens
ttattccacttgagcgtggccaaactgttgctatttagtggggagcaaaaaaaaacaatttgcaccatcgaaacgagccagcaactggttgggaggcgggcggtagctgggccccgcgtgccctcggcggccggggtcctctccggggagaggcacacacacgcatagccggatcgcgcctcgccagggccggagtcacct

SEQ ID NO: 2941 - DNA, 201 bp, Homo sapiens
ggtgggagccgcgaggagcgcctagtggcgcggtctgccgggcatggtggccggctcggcgatcgctgactcgccgggtccgggggctctggaagcgaggcgcgctctccgactccgagactttgcagggttgcaacagacggtggggaggcaaaaaaaaaaaaggaaaaggaaaaaatggtgctaaagtcaccaagtccc

SEQ ID NO: 2942 - DNA, 630 bp, Homo sapiens
ccggttagtccatccccgcgctccgcaaacttttctaaccgggtaacaaagtgagcagcggtggccgccgcgattcctttaacttcgcattccggaggctcgagggggctctgggaccgagcggcctcgcagcggcgacagaaatacatattttacgaaaaagaaaaaaaaaaaaacgagtcgcgcgaacccgtcaagtcagatgtgcgcggcttgaagcggaggaggctctgacgtcagccccacctcgcgcagcccggcctggccgcagactcgccggtcactcgccggcggctcaggccgggaggggccaggacagtcccggccgcgcggtggacggaggggccattcctccgggcgttagcaaataaattccatccgagtcaatatcgcccagcgaacggtgtttctctttagtcacccgagaacgagaggcacttttaattagaaattaattaatgagcagctgctccttcccgccccactgtaatcattcgtctcaattacaaatgagacctatgaaaggacacgctgaagatgtaatcaacagttaaaattagcccggcgctgcgcaggcggccggcccggcctcgcgctggcgcgctctgctccgagtggcaggaaggggct

SEQ ID NO: 2943 - DNA, 201 bp, Homo sapiens
aaatgggaccagagcgcggagggagcctggccaggaggcctcctaggactcagccgcgacgctgaaaagcatgaagggtcggaattaggcactcatttagcgagcgttactaatccgaagttacagcgctaattccctgatccggccgctcccacacgcagcgccgggattagaggcgcggccgccgcccgccccgccctc

SEQ ID NO: 2944 - DNA, 239 bp, Homo sapiens
gaagaaatcgggtaaatagctgctcccaggcccgtgccacgagccctggcgggatctctccctccttctgtactctccaccctccgaccccctttgtgtgcgccgcgccccgctgtagctccgctggagagatggggacggtttggcagaaggtggcggcgacaggggcccgggacggtttggggagaggagggtgggggcgcggctgctgtggggtgtccccgggcggggttcacggg

SEQ ID NO: 2945 - DNA, 201 bp, Homo sapiens
tgtccagcctcccggaggagtactatgccttgacaccttcgtttcaccgccccaaagctggcctggggctccgtagggagtggcctgcatggggagggcccgcgtgctgtgtttctgggaggggtaagagagtgggggcgcagggggcgggccaggtccctgggcgcggcgcgggctcgggggacccgcgcggctgacgtc

SEQ ID NO: 2946 - DNA, 221 bp, Homo sapiens
ggcagttggcgcgcccgccctggccgcagcccggcttggggacccgctgcgtgccctggcaccagtgcgtggtgaggaaagcggtggtggcgaacagcagcgccagcaggttcagggccacggccaggagcgctcggccgcggcggctagtcttcatgccgcccgcgccgccgggacgggactgcaccgccggggagctccgcgcgcgaagttggcagctg

SEQ ID NO: 2947 - DNA, 201 bp, Homo sapiens
cagccccacgccggtccgcctcccgcccacggctcggcctccctcccgcctggctcggcgctcctccgccccgagttctccatcccctggatcccgggctcgcgggggcgcggagaagaggatccaggaaaggtttgggaacctgatgggtttgtggctggggggaggggcagttctcccgccaccccatcccctccccgc

SEQ ID NO: 2948 - DNA, 246 bp, Homo sapiens
tgggttttcttaggactcaccttatgtagtttccacatggcccccagagccttgacttcgtggctggagtgtttgccctcctccaagcactggtagcacacgggcatcttgcattgcacgcagtacatgctgtggttctccagctcgtggtctgtgcaggtggagaccttgcgtgggctcagcctccggctcacacgaccctgggccgggggcaccaggcggtgcttggctaggggcccccggggc

SEQ ID NO: 2949 - DNA, 223 bp, Homo sapiens
tgacactgggggcaggtgatacaggagttgcggggcaccggggccagggccggtgacaagtgggtggccggtggcggcatagccgggggaaacacgcggacgccgttgggggacttctggcacggggtagtgggggcgctggcgaaccccccgtaggagccatagccgctgtccgcctcgctgtataggctcatcttgtccaggtccagatagtcatagtcgg

SEQ ID NO: 2950 - DNA, 201 bp, Homo sapiens
gggcttctcgccagcgtttgcgtttggctcccagctctgagctccgcgcccacctaccgcgggcgagtgctgcgcagcacggaggacgccccttctcttccgctgctggcagccttcgcaggcgtctcacccgggcctaggcttctgcacggcagtggggcttttctccttctccgtgaatccgctgacgccgtgccctgg

SEQ ID NO: 2951 - DNA, 244 bp, Homo sapiens
tgcgcttacccgctgcacaacgcgtcccgccccggcctccagcccactctccgcgccgcgccagcctcgaacctggatctccgcgggcgcctgggcggggcgggactccaggcccacccagcaagctaattggctgaggccctcggctggggaccaatcaccggctctgagaaagttcggcagtggccaccacatctggttctcgttaacttttctaaggcagcggccgctggagcagcggggc

SEQ ID NO: 2952 - DNA, 201 bp, Homo sapiens
tcctcacccttggctgcctggcggggcttgaaagggcaggtggccctggcggcgcgccccgcgagggatgtggcagaagggcgtgcgcctggcgccgaggcggagggaccctcgatgccgtgtggcagcggggcctgccatcgcagcccttcgcgggcactgcccccaggcccagagccagccttcagcgagccgggcaaa

SEQ ID NO: 2953 - DNA, 457 bp, Homo sapiens
cccttccaaatatacgttcccttgcccgcggcccgccactcccgcccgggcctcgggctgtgcagcttcctcctaggcctgcccgggcccatgcctcccccgaagcggcgggagtcggtgcagcctcaacttctactgcgtgtcccaggtcgccaaccagctttgctcgcgtgccgttggcccggaggctgccgcgccagtctctgcgtgcgcctgagcgcgctggagcatttgcgaggccagggctgccgacggcgagaggatactttgaggaacacggtgcttcagtcccgcccccgctctccgcccgagctggaggttggggcgcgctgagccgcagcgcctggacaagtgcgcgggccggagccgcccaggcctgcacccgggggctcgcggccgacgcatgcgcacgcgcggtggcgggtctgcaggcccgaaggcccggcccctccctcaa

SEQ ID NO: 2954 - DNA, 244 bp, Homo sapiens
gagcggtgactggaatctacgcccgggagaggcccggagtcccggccgcgggcggcgggggattcctgcaggaaggggcaggaaggcaagcagcccggcgcgccctggcggctccgagggacctgggctcgggcttgcggtcgcgtcgcctgggctttccctgggctgggagcgcgccgggtctccgccttgcacgctgtcaccgcgggagacgtctcggcctcgccgcgcgcagaggggacgc

SEQ ID NO: 2955 - DNA, 206 bp, Homo sapiens
gccccgacgctgcgggcgacagggcttggctccagcagccgccgccgtcgccgccgccgccacccggaggacccagcaaaagtttggatctgggggagggcgcggcgctgagcgggattaccaccagggctggaaggagacctcgagaacctttgcaggtaacgcgcgcccccaaccctcttcttccatgccccgccgctgcgctc

SEQ ID NO: 2956 - DNA, 203 bp, Homo sapiens
ggaagcagtggggggcgctcgaagagcagggcagctacggccaccgtggccgccggaccggccatgtgctaaagtttctggggctcggcgccccgctgggcgcgcagcgcggggagcagacgcgccgtgggtggggcagcgcggtgctgctggcgcccggcccccgcggggtgcagctctgcgcgttctcatgctgtctctct

SEQ ID NO: 2957 - DNA, 266 bp, Homo sapiens
ccaggtcactccgatcttggtcctcaggctcgggataacgtgtcagccccaagagagcgctgcccacagccccgggtgggttgggttcaactgcacggggcggggcgccaacagctcaggacttgggttgcaggctggttcttgcaccaaccagcggggcggcctcgggcctcagtttccccatcccgcccacgaagggaggcgattgcgagcgcttggggtttctgacggaccccgccccgggggtggggcggggagtggtcacg

SEQ ID NO: 2958 - DNA, 242 bp, Homo sapiens
gcctagtagagatctggagccagaagcccagagacagccgagtgcgccgtgcggtctccggacgctcgctgctcagcccgatccccgccaactgtgcaggcggctgacccgcagcggcagcggcagcagcgaggactcgagcgctggctgcagcgacaccatggatctctcctttatggccgcgcaggtaacggggcgtcccccccacgcgccccgggccgccaagtttggggaggttcggg

SEQ ID NO: 2959 - DNA, 201 bp, Homo sapiens
agctcagacccgcgcgaacgtggatgggcacacagtctcgcccttccccactctgttttcccgaggcgccagtaatctgtctcttgccggtgacctcgggcgccccctttgccgccgcctgaggaaggctctgagacccgctttgtgaccgtgacccgccaagcgtcgacgcgccgcggtcgtttgtcctgttttgctttg

SEQ ID NO: 2960 - DNA, 201 bp, Homo sapiens
tcctgctccggctcctgcggggatggatgcttcacgcagtaagcgagtaagcgagccctggagaccggggccctgggtgtgcggtcggctcagtgccacgcggtgagataggcatggttatcaacccacgccaaggcggttgtgtacctggcatagaaaacactgctgttgaatgttgtttccatagtcattcgccagcgt

SEQ ID NO: 2961 - DNA, 312 bp, Homo sapiens
ccccctaacatccggcctgcacgcctggcgggggcgcaacagtgtctcacggctcgggagctcgtttttggcttctgagcaaggtatttttttcatctgccgtgtgtttagctgaattcagtatatttttctcgcacttctcgcttttttttttttctttctgaatctgctcttctgctttgcgggcccctaatctctcccgaatctcgggcgcccggcccggcccaggcgagcgctcgcggttggggacgcgggtggggacgcggcggtctgggcgctgcaggatgcgcctggccgcggaggagacgacca

SEQ ID NO: 2962 - DNA, 203 bp, Homo sapiens
cgctggctttggctgcttgtggggtcctcttaggctccggggggcctgcggcggcctgggaggcagacccccgcgggcaggtgtggccgtgtcccgaccgcgcgaggaccgaagttggcggaagcccctgtgcggtgccttccagcccggaggaggctggcctgaagcccccaggcgttgccgaagcctccccctgccagcgc

SEQ ID NO: 2963 - DNA, 201 bp, Homo sapiens
cgcatgcgcgcgcgcaactagatcctcgccgccgcccccagcgcccctccccggggcagggactcacctaacaggttggggtccttggagtgcgcggggccgcgtggggaagcggggaccctaccccccccacgcgccgcccagcactgggcaagggcggggcactctctgggctcccgcccctcgccgcccgccccggga

SEQ ID NO: 2964 - DNA, 283 bp, Homo sapiens
agcggcggcggcgggccccaggagtcgcagaccctggccagtggcactgcgggccaccctgagcccccgaggcctcagggggacagcgcccgggcgcccccgctgcgcgccgcctccgcggagccgagcggcggtggctgcggaagcgactggggctgcgcggacaccagcgccccagagcccgcgaggagcctggggcccccgggctggagtaagagccgagcaccggcgcagcctgcgggactggcactcaccgggcctctcaatccccagaccttgccac

SEQ ID NO: 2965 - DNA, 201 bp, Homo sapiens
gttcccggggcgccctgccctgcgccaccgcgcgctcgctcgcccgcccgcccaactcacctgctgaagaccaggcagcccaggtggttgatcttgtggtcggagcggtggcggctgtagtcctcccacaggtccctgaaggccgtgatggccaggatgaagagcaccggcgccagtgccaggccgggctggaaggcgttc

SEQ ID NO: 2966 - DNA, 247 bp, Homo sapiens
ttgagcgcgtgacatggtttgccgtccctgaccaagacgggcacggccacccggcgcggcgagggcaggggcgtcacctccatacctttctcggcccgggcgcgcttcatcttgtagcggtggttctggaaccagatcttgacctgcgtgggcgtgaggcggatgaggctggccaggtgttcgcgctcgggcgccgacaggtaccgctgctgccgaaagcgccgctccagctcgtaggtctgcgcct

SEQ ID NO: 2967 - DNA, 427 bp, Homo sapiens
ggggcgccttcccaggggattgggggtggggaggagggcgcacgggtcggggagggggctaccggacctggatcccgggacaccccgggggtctggggggcgggccgcgcgcttacctgcgtcctcgtcgtcgaaggagttcatgcacgggaagtagatggcgagcgcctcgaaggaggcggacagactgaggcggctctgcgagcgctccatgcccgcgccggcgccgggcgcctcggccgcggcggcggcggcggcggcgggcggcttgggcagcttggccgccccattcttgacgcggagtacggcgcgcggcgtggtggcggcggcccggggccgggccgaggctccgctgcggggctggcgggcgcggcggggccggcgggcgggccaggagctggcggcgcgcggagcccgaggcgcgctg

SEQ ID NO: 2968 - DNA, 246 bp, Homo sapiens
cggcccacagccgggatgcgcccccgccggggtcaccgcggcggcgaacgtcccggacttcgcatcccggtgaccccttgggatgaaccgaagccggacccgcaccttggccgtaacaagcgcgctccacgccgccacgcaccagcggtgactcccgagtcctctgtcgccctggcctccccgcaggcgggtttcgaggcccccgcagggagttcagggccacggccacgtgcagccgcccccgag

SEQ ID NO: 2969 - DNA, 384 bp, Homo sapiens
tgcgcgtcggtctggcttgcctgcgggtcccagagcctcggcgcccgctgcctcctccgcctcttccttctctcccacctcctctccctcccagccgcgacgcgcagggggcgggctctacctccccctcgcccccgcttcggttttaagccgcggaggcgcccggtgggacctcgctgctgtccaatcaggggggaccgggtgagctcctcttcctggagccgggctccaccagcgccgcaggctcacaggccgggggtgggggctctggaccgaggggcggcgcggggcggcgcggggcggcgcgcgcggtcctggagcgctagtacttgcttctcgactccccggccgccgcctccggccgccccggggattccgccacca

SEQ ID NO: 2970 - DNA, 415 bp, Homo sapiens
tgggcagccccaggccgtcgaactcggcgcccagcgggggcagctcgcggaaggcgcgagccgagccagacgccgcggggaaaggctcgggcggtggctgcgggggcgctaatcccgggagcaggaggccgggctccagccgccgggccttgcgcgcctgcttcttgcggcgcggccggtacttgtagttggggtggtcgcgcaagtgctgcacgcgcagccgttcggcttcctccacgaagggccgcttctccgccgcgttcagctccttccacgctttgcctgcgggccgtgggcgccagtgagtggaacgccgtcgggcgggtgggcgccgagccctccgtgcgcccgggacgccccgcgagggtttggcgcagcccccgcaccccgcggcccgggacccctgccccccccg

SEQ ID NO: 2971 - DNA, 543 bp, Homo sapiens
tgcgccccacgttctggagcgtgaagccgggcgccaaaaagctgctgtcgggccgcagctccagatccagctgctggtcaaaggcgtgcaggcggaggcgcgtggtcccgtgtcccggggcgcgctccagctccggcaccactagctcctcgtcctcctcggaggggcgcccgagtgcgtccgacacggccagtagcgccgcggcgagcagcagcagcgtgggtactggcccaaagctccgagaccccggagcccgctccgcgttccccatgtcgctgcccagcttgcgccttccgaacccctcgggcacagctcgctgcattggagccccaggagacaccgctcgtagcagcgcacggagcgagggacctttagttcgggtcgggagagcaaagcctcgttggcctgctctggattgttaaaattaacaatttctattattcgttggaagggcgcgcagagccggctacagccgaagctcccggagtcactaaaaggaggcgctgcagttctgccggcgcgcgggaagtttttcttccagcg

SEQ ID NO: 2972 - DNA, 227 bp, Homo sapiens
ccaggagcgatggctgcaatgcctttttctttgctttgctttccggtgccgggagccttgcctcccgccgccacccctggtcagctctgcgcaagaacgtcgttctgtttggcagccaggccgagacgcagcctgaatgtgagcaggaactcggagaagggaagggagagaatcagaaagaaggcccgggagggacccgggaagcagtgggaggtctgcgccctgga

SEQ ID NO: 2973 - DNA, 323 bp, Homo sapiens
ccgtcggaagagccctgcagagtgagcccctagggccaccccgctgccttcctccccgtccccgcagccgctgtagccagcgtgggagccgggcaggtcgcgtggggcgctggacttaccgagaggttagcgccgccgtcgggggagggcgtgtcccgcacgtgtgtgtccgcgcgtgtccgcgcccgcgtgtgccagcgcgcgtgccttggccgtgcgcgccgagccgggtcgcactaactccctcggcgccgacgggctcagcccatggtgtgggcgccgggttcagggaggctccggctcccgccaatcgcggagcaggg

SEQ ID NO: 2974 - DNA, 279 bp, Homo sapiens
ggcacgagcgccagcagcccgcaaaacaggtagagcacgcctcccgtgagggccacacgcgccttggccgggcccggggccacgcaggtggtgcactgcgcgcccgccagggtcacgaagagcgcaacgaacgccagcagcacggcgctcacggtgagcgcccgcgccgcctgcacctcggtgctcagagccagcaccgagtcgtacactttgcactgcatgtgcccggtgctctgcaccacgcacgacatccacagccccttccaggtggtctgcgcc

SEQ ID NO: 2975 - DNA, 261 bp, Homo sapiens
ctcggcgcgcgctcctcggcgcacacgctccccatccccgcgccgcgcgggccgcggacttgcaggctgcgcgtcctttgcggagtctgccccggccccacggacaggccccgcagtgagcaggtaagggtcgccccgccgcggctgcccctccacgcctcggccgtcttctccccctccagaaccttcgcccagccgggacctcggatcccctcctctggcttggcggtctccgccagccgcgacctccaccgacggaga

SEQ ID NO: 2976 - DNA, 364 bp, Homo sapiens
gctcgggccctgggcggcgagggcgcagcgagggctgtcgcctcctcgggcagccccggggggcgcggcgttgggtcgcgggtccgggggctgccgtgttcgaccgtatgcgccgatttgtcgctgggcgtccgtttcctcttgctggggctgggcgcggcctcggagcctggcggcggtggtgagggcgcacggccagctgcagcggcgctgtgcttgccgtggatccaggacaccttaggcttggtggcggggtcaggtggcggcggtttcctgcgctcgggcgatggcgacagcgacaggcccccaatctcgccccgggcccgggccggccgggcctcgcgtcgggccacgcgcgcgtaca

SEQ ID NO: 2977 - DNA, 242 bp, Homo sapiens
ggcgtcccttgagtctagagaagtgggttaagacaagggaagaaaatcccttacagaagaggagatccccgttttcagtgctggggactctcggcacccgcgtccctgtgcttctggtggttccggcgcttcctcggagcgcgcggcatgtctgctcctacacgtccagcacctctgtccccagagcaaacccacctcccagggcacacgcagaggggcagtcaggcaccgcctccaccctg

SEQ ID NO: 2978 - DNA, 285 bp, Homo sapiens
acggccgcccggggccgcaccctcgctcggtggcggcgcccgaagacgccagccgcgccacgcactgcctgcgtcccgcgccccagccgccgcgcaccaacgccgccgccttcgccgggagccaagcccgccgggccggcccggtcccaggtgggcagctcggcttgcagctggttggaggtggcggccgctgcagccctggcagcgggcacacccctaagcatacgcacccaacgcctcctccctgagccacgaggatggagcagccaccccggcccgggactg

SEQ ID NO: 2979 - DNA, 222 bp, Homo sapiens
ggcactgatcctccagcttcttgcttgctccctcgctccctttctctacctcggacattcccaggacaattagggctgaagttttcgggagaagcagccccgagcccgtgggataagggggcggcccggctccgcccaggacccctcccggacctcccccccggctgccccggttggctgcagggcgcgtcactccgcggggaggcggcggcagcggtggcg

SEQ ID NO: 2980 - DNA, 201 bp, Homo sapiens
gcggcggcggcggcggcggcgggggctggggcgcgggggccggaccatgagccgctgagccgggcaaaccccaggccaccgagccagcggaccctcggagcgcagccctgcgccgcggagcaggctccaaccaggcggcgaggcggccacacgcaccgagccagcgacccccgggcgacgcgcggggccagggagcgctac

SEQ ID NO: 2981 - DNA, 298 bp, Homo sapiens
gggaccacctcccacggtgtcaccgcacccaccccgcgcccttcctccgcctcctggagttcaccgggaccaggtggcggcgggtgcctttttgggggtgcgcggccatgcaattggtggatttttttaaaccgttttggaggggggagcgcggcgttgggggcgggagagcgctcctggctgtgagctgctcctgccgcttcgctccgcgctctcctgccgctccgctccgggtctcccgcgctcctctccccggctcggccgagcgcgctgccccgacgccgccacccagagccgg

SEQ ID NO: 2982 - DNA, 272 bp, Homo sapiens
tgacagggaccgggctcagatctgccaaatgctgcggaggcagaacctgacagtgcgggagggcaggcgcctgggaggtaggagctggtggagatgacagcgtggaactcgtgagccccacgcaacgcctccctgccgcccagggtgggctcctagaagcacagaaatggtcgggctgcgggacaccacagcgaggaaccagcggagtacaggggccccaggagcgccgggacatgccaggccgggtagacagcctcgggtcggagtgagtg

SEQ ID NO: 2983 - DNA, 201 bp, Homo sapiens
gagcatgagggagagtgccatccctcagctgaaggccactgtgccttgtatttctggtttgggcaagtgaggagcctgccagcccctggcaggaagtgcacgtgaccggcggctggccaggggcacagagacgcactccacacagaaacccaggctggcggggtgggcggccggggagccagccctgcagatgttactaag

SEQ ID NO: 2984 - DNA, 251 bp, Homo sapiens
gcaggctgaaggcggagctggagatattcggggagcaggtccggagcgcccccgaggtcggggccggcgagggagaggtagggagcccgaggaagggaggcggggcgggcagggaccgagtcaggagagagcgggcgggggtcctgggagcggcccccgagagtggggtctgtggggagcagggcggccccggggacagaggaagccgcggtggaggcctagggcagacgcgggcggacgcgaggagcgta

SEQ ID NO: 2985 - DNA, 249 bp, Homo sapiens
acccgctctcggagctccgctcggcggcacctgccttggccacgcgccccagtcccgccaggcccctcggcgggcccgaacccgcagccgggaaggcacacgcgagcaggagggcgcactccatggtcaggtgcggacgcggcggctgcgggtggccagacgcggcaggcggagcgcacgggcggcgcgcattctttccgcggccccggagctcggcgccccaggtgcggctccaggtgagagccgccg

SEQ ID NO: 2986 - DNA, 249 bp, Homo sapiens
gtccccggcagacgcagggggacgtccgggcggcgcggggcgcgggtcccggagtggctgcgggaaggacgcgcggcattgtctgtgcggggacccgggacgggtcggggcatcacaggcgcgggaatccacgtgtggactctgcgttcgcgggcgcggtgacccccgcggggatttgttggtgccccgagactcactgagttgcgggggccttggagacctccaggtctgaaaagttagctctagaga

SEQ ID NO: 2987 - DNA, 201 bp, Homo sapiens
ctgcccgcggcgccgggcgcgccggccgtcgggtggtggtggtggccggcggcgtggtggtggtggtggtggtagtgcgggcccgcgccgctctgcgcggcggccgcggcgatcacggcggacaccacggcggcggcggggcccatctcctcgccgctgccgcccaaggaggcgccggcaccggccccggccgccgcggcc

SEQ ID NO: 2988 - DNA, 201 bp, Homo sapiens
acggcacttacggtcggggggtccgggggatccggcgggcggcggacggcgcacactcgcgactcggtccgggagtcgctgctccttccagcttggtccccgcctccacgactcaggggcggctgcgcgctgtcttctggcgccgcaccgggctcaggcgcgcggcggggctggggcgcgcggggcggccgcctgggccat

SEQ ID NO: 2989 - DNA, 251 bp, Homo sapiens
cggcgccgggcagcgcgtagagccagccgcgtgtgcagggccgggtgccgttgcgtgcgggcgcggggcgcgggcccggggcgggtgcagggcgcgggatcggggtagcgcaggagcaggcaggggctcgcggctcgcgtgggccccaggcgcgggatggcggcgtccagcagcgcgggtccgcgcagggcgcgcagcgctgggggcaacagcgtggggtccggtcggcagtggggcgcgggctgcgcggt

SEQ ID NO: 2990 - DNA, 201 bp, Homo sapiens
cacggtggatcctgtgggtcgctgagttttctgactcccggtttgtcttattttgctttgtcagtgggctctgcgctcgcgttaacaattcgaatgggcacgtttctgcgtttcagaacgctgttcgcttcctcacacttagattgaggtggaactcacgtcacataaaccgggtcgcaaggctcagctcagcggggcccc

SEQ ID NO: 2991 - DNA, 201 bp, Homo sapiens
tggcgcggggcgcaggtgcacgcaggttggccgcgggcgcgcggggtccggcgggagtcccggggtggtccccgcgtggggccgggggcgtccgcgcgggcggggcgaggtcggggagggcagctgcccgccctcctcggcactgggagctttcggctggtactgcgggaggagctcccgggtgacccgcgggttctgaaa

SEQ ID NO: 2992 - DNA, 201 bp, Homo sapiens
tgaggaactggacatcaggcgctggccgctccccaccctcagccgctgggtgcccagagcccatccctagcgatcagagcagaactgcagagaagacgtccgcgtccgggccccgtctggggagctagggcgcgcggggagcgcccgggccgcgcggtcactgaccgctggctgcacgggggcgccgtgcggactcggcct

SEQ ID NO: 2993 - DNA, 337 bp, Homo sapiens
ctcagggctcccgggatcggtgcccgttagtgggcacaggacgccgggtgtccgaagggctgcctggagatgcaactgaccttggcgggcatcagaatgacgagtggcagcagcaggagcggggtgacgaacaagatcacgaaggacttgaacttggagacatagctcagcgccgaggccatcgcgcgggagggagactggcgggcgagacgagtgaggggcagctagaggcgccgcgggcttaagaaggggccacagtccccggggattggggagggggcggtgacaactccgccccgcacgggggcgcctccccgcggccctggggcggggccac

SEQ ID NO: 2994 - DNA, 201 bp, Homo sapiens
ggcccgtgcagagccgtccacccctctccgtagcgccgggttgctccaaactgctcttggaccccacctgtgagccgcgtggctgggctgggctgggctgcgcgggacctgtcagcggcccccgccactctgctcgcaggcgctcaccggctgcctcctgggccgccgctggccgccgccacacgtgggacgccgagggca

SEQ ID NO: 2995 - DNA, 201 bp, Homo sapiens
acatggcgtatgatagggaattggcagggttacagcttcggaccacccggggtagggcagggaaactacggcagattgcgcagcgcatcctgtccgggtgcggtgagggttgcgctccgcttggttctcgtcacaacccacagaaagttctcgcggagcactggtgcccttgaattcatcaggcgacctcgccgcaaagaa

SEQ ID NO: 2996 - DNA, 201 bp, Homo sapiens
ccgatcctgctccgggcaaccgatgggaaacttcccgagagcgcggcctccctggggactcggcgcccctgacgcctccaggcgcttcctcgggccgctgcggcccctcctcgccgcccgccagcgcttaaggtcgcgctctccccacccccgccttcctcccttcctcggcggcttccggatctggacagagctgcagga

SEQ ID NO: 2997 - DNA, 1216 bp, Homo sapiens
gaagcgaagaggggtcccttgatttgcaacatagaggaaagcgccgcttccgcccagcctggcacccacgcgcccacacgcacccggcgccggccgggtcgctcacctgagtcctaaaagctgttgaatccacatggtcacgtttcggggagcggggcctcagacctggctcgcccaggccatctgcgcggcgcccgcgcccgctcgcttccgtcccgcggcgccggtctccggctctcggtccgccgcctcccgccgcccgccggccgcggggcgcacagcgagtcagagcgcggccgcgcggggctccatgccggccggcgcgccgccgccgttggggcgcatggctcaggctgggcggcccgcgggggcgcacatcctccggccggggcgcggggctcgcggccccctccgccggcggcacagcgaaggcggcagcgaggcggggcgtgttccggcgctgtcgcggcgcagcaaagggctggggagccgcggcttcgccctccggggcggcgaggagggaggccggcggcgctgccgctcacggtgcgtgtctcccggcgcgcggctcttgcctccagccggagctccgcgccgatggggcggcgctgcttagggtttggggtgacgcgacgcggacggacgcgagtcccctccgcgctgccgggtcggggggctctgccagaggctccgccgccgatcggcgccactcaagttgcccgggggctccgtctgagcgctcgctctgcagacggccgcggcccggagactggcaggaggcgggcacgagaggcgcgcggggcgagggcgccgtggagcgcggggcgtggggacgcgcggcggcggcgccgcgcggaggaggcgcgcggggatcccggggccccgccgcccgcgcccaccgcgcccgccgcagagccgcccgcgctgctcagccgcctccctcctcgcgtctgcctctccgcgcgctcgcccccgcctcccggagccggtcccaactccgcccgcccggcccggctcacgtcacccgccttccccgcccctcgaacgggagctcgagcccctggcctggccccggctcctgctcgccgccccaccttgcgggggccggggtcgccgcgggtggtggggggcgctgtgcccagcaggggcgacagcgcaggcggggcctcctgcagcccccttccccatccccggtcgcgtcccggtccccaccttg

SEQ ID NO: 2998 - DNA, 365 bp, Homo sapiens
ggccggtggcgttcaccccgcaccgcgctgccccgcccggggcactatggcctggggctggactatgccctccccacctcagccggcgccccccacccacgcgcgctgagggtgcggtgagctgagtgcggggccaagcatgttctggcgtcgacttcgcccaggggcccaggacctggcgcccaaggggctccctggcgacggagacttccgacgcagcagcgacccgcggctgcccaagctgaccccgcccgcgctccgagcggctctgggcgcgcggggctccggggactggaggatcccggggggcggcgccgcgtggtggccggaaggggacgccaagcccggggtgggcgtcggacgcc

SEQ ID NO: 2999 - DNA, 201 bp, Homo sapiens
gcggaaagcaaggcgcgttcacagccgccctccctcctggaagcccgcgcccacccctgcgcggcggccgctccggaggcgtcgggctgggcgtgaggacgccgcactcaccactgggcccgcgagcgccgccagctcagccgcctccccccgcaggtccgggggcagcgcaccccgcaggccccacaagccgtcacgcca

SEQ ID NO: 3000 - DNA, 201 bp, Homo sapiens
gcgctggctgggcagctcctgggagatgaagcgacgcaggcgctccaggtactggctgtagagctcgatgtcgttgtgcccggcgccctccacccacagcggctccaccgccttggggcagcgctcgtagagcgccagcccgtgcgagaagtcgatcacctcgtcctccgtgccgtggatgatgagcacgggcgacgtgat

SEQ ID NO: 3001 - DNA, 201 bp, Homo sapiens
tcgccctggccgaagcgcagtccgagcgccgcgacgcgctccacgcgcaggaagccgtcggggtcgcggccgcacacctcgaacacctcgcgcaggcggcgcacggagcgcagcagagccgcgggggcgcccgaccagcccgcgccgcccgccatccgggccggcccgcagctcagcccggacccctcgcccgccgcgccc

SEQ ID NO: 3002 - DNA, 201 bp, Homo sapiens
cgccccgcgccatgcacacccattgtggtgatgagagctcgcgccccgtgcccgtcacggtcactgtgcgtccaataaaaacaaacactgccgaggagccgccgcgatgcggggcggacgcgcggcccggaaaggggagggggccctaggaagagctacacccgcgagccgggcctgggccaggggcgaggggagagcgcc

SEQ ID NO: 3003 - DNA, 201 bp, Homo sapiens
gtggccccctggtccccctaggcagctaacaccacaatcttccctgggagggggtccgcagaagggcgcgcgctgcttctcccgcttcccaagctgtagcggggcgggtcgggagccagggttagggtctggagacttgggaggggaccggtgccagaagcgaagagctagggttagaaagttaggtcaattaaggggggg

SEQ ID NO: 3004 - DNA, 201 bp, Homo sapiens
ggagaagggggtccgtgcaaatcccaggctgacgaccgcgcacgcgcccctcgggtcaccagccctgtcgctcttggtggggcacaccgaggagaccgccgtggggaaccggggaccggattgcctgacagccgagcgctgaagactactcttcctgagcctagggaggtctggctgccctgagccccctacccctgggct

SEQ ID NO: 3005 - DNA, 213 bp, Homo sapiens
ccctgcggctggctaggaggagctcctcgccgcccccattccagccgcgccgggcgctgggcccgacccccagcacctttggcactgatgtgcctggtgcgcgctgagacgcgaacgctctgcaagatgagcccttattcattcgttccttctttccttcatttgttcatcttacaaactgagtgcctggccactttggttcaggcaagaggc

SEQ ID NO: 3006 - DNA, 201 bp, Homo sapiens
gcccagcggcttgcaccgagagccaggagaggctcagaccggatcccgacccttcgaggcgcgggagcccacggagcgcggtgggcgcggcgctcgggtcgcgcagctaggtggggagcggcgcgcagccccagactcgcaggcaggcagcggcggactgcacttgcctcgccccgcagcgccccctgcctgccgcctccc

SEQ ID NO: 3007 - DNA, 201 bp, Homo sapiens
gcgtccgaggccggcgcggtggggaccgcgggcccaccaccagccaagcccagctacttaactatttgtagagctgctgcaggcacaggtccaggctttcgccctccacctcctcgcgggtgatgcgctctgacagcggtcgcgggagcgggggcaaaggcggcagctggggcggcggcggcggcacggccgagtgccccg

SEQ ID NO: 3008 - DNA, 201 bp, Homo sapiens
ccgcaaggggcacccggctctgtgcgcgggggcggcgggggctctgcgcggggccgggctgggccgggctgagctggcccgctccggcgccggggaccacgcgcgactggttagatcttgtcgtgatctctggaaaactgtgactatctcacatgtcctgcccagctcggatcccctgcgctaacgagccaggcccccctt

SEQ ID NO: 3009 - DNA, 324 bp, Homo sapiens
cggggtccgggctgggaccgcggggtgggcggccccgagagcgtcccgcagtggctggagccctgggcgctgcaaagcgtgtcccgccgggtccccgagcgtcccgcgccctcgccccgccatgctcctgctgctggggctgtgcctggggctgtccctgtgtgtggggtcgcaggaagaggcgcagagctggggccactcttcggagcaggtaagtggagccgaggggagccgggtcccgggcgcggccgcccccttccctccgccggcccggccgcggagcttctgcccgggcccccttcgaccgtctcccaggcccccacc

SEQ ID NO: 3010 - DNA, 201 bp, Homo sapiens
gagggggcggctggaggacccggaccctcaagaacctggccttgggttttgacccgggcggccggagagaaggcgaagaagaggccgagcagacaggcgcgcggcggacgcgagagaaggacgcgggcgaagcgtccaagacgttcgtccccagggtcgccgagccctcctcctccttcgcttggcgcggcagcaccgcgg

SEQ ID NO: 3011 - DNA, 330 bp, Homo sapiens
agcccagcccagccaagcagcagagagaacaggacggaggctcccatttcccagggactgcagcgcctccaaaccgcccatctgcgacggccccgcgagcgtgcgcagcccagcccctcccggacgtcctcgcccccgcccgggcacatcgtgctccgcaccgaggcagagaggggcacgcggatcccagcccctgcgagcccctctgcccgccgccacttcacaccccgcattgcctcagctgccgttccagaagatgcatcgtctggcgcgcaaagcggtgcacggtccccagcccgcgcgcagcagcctggaggggcgccagagtcc

SEQ ID NO: 3012 - DNA, 293 bp, Homo sapiens
gcgttccagcccgtggcgctgccggcgcagaccccgcgtggggaccggcgaggctaacccctcctgcggcccggggtcggcagagcacgcaaggggccgcgggccgcgtgggtttgggcgcgccgtggtgggcaagcggggccagcggagcgggaacccgcacaccctccgagcggagccgaggacaggcccgtgcgggccgcggggtccctctggcgccaggaagcggcggccgaaggagacaacgagaacgcagccccggctcagggaggcttaaaagctgagatgctgaa

SEQ ID NO: 3013 - DNA, 201 bp, Homo sapiens
accgccggcgtcggcagctagagcgggacccagctcccaccgcgtcctccactggagcccctttcggcccctcggcgagtgcggcccgtggggagtgggcgtcggcgcgaggaagttccccggcccgggcgaccccggcttctgagcggcccctccccacgtcgccgcccgccaggccgacggaggaccggggcggggacg

SEQ ID NO: 3014 - DNA, 201 bp, Homo sapiens
cggcgccccacgctctcctcttggagcaaatccgcctcgctctcctcttggagcaaatccgccgcactctcgcctgcaccgaaatcctgagcgccgccccgcgccacccccagcccgcgcccgcgctgccctcctccccgggccgcaggctgagaggctgggccgcactctggccacgctttgtccggctttagcgggata

SEQ ID NO: 3015 - DNA, 226 bp, Homo sapiens
tcggggctgccagggcgccgggttcgtgcgcggacactgggggcgcacccggctcccgggtcaggcgcggctggagacctcgaggttggggttttgaagcgcgcaagtattcccctccccatcgcgtctttgcaagtagtttgaagccctaagtcgttgtttacggattcccgtttccaactttttaattgaaaaaacctgccgaggagagtggaggcatcgccat

SEQ ID NO: 3016 - DNA, 363 bp, Homo sapiens
cacccgggcgcgggagcacgggcgggccgggggcgcctgggtcggcctgccgtggcccgggggctcggggcggcgcgactcacctggcgccctcggggccgcgattctcctcgggaggtgtctgcgaaggcggctctgccgcggtgggggtggggaggctagggcttcggaccgctggagttggggtcgcagccagttcctggcgagtgtttcctggctgctgccgcaggggcttgctttttcggatttcccctctaatctcgccggacttcttccccttcccccccacgcccgccaagttcatggcttctgcaatgcggtgggtgtggttacctagtaaattgtaactgtggtcccttgcaa

SEQ ID NO: 3017 - DNA, 201 bp, Homo sapiens
cctctcggagtgggggactgcgagggggtctcggctttacgaggtgcggaggaagagcccgaggcctggggcgaggcgcgcgggacagtggggctgacgcgtggcttcggcgccgcgcggtctcccgaatcccgagccccgcgcccggcgcggccggggtccccaaccgccctcccgctcgccgggacccccaccgggccg

SEQ ID NO: 3018 - DNA, 201 bp, Homo sapiens
ctcgcccggcgttgcatcttcccgtggctcggctgtaaggacctgcggtggaggcttggcggaggcgggcccgcgctccagagagagcgtcacgtcacccgagaaggcgacgctgggggctgctgagcctcccaactccctttggcgcgtcctgctcagaagccggggagctcctggccggcggctggcggggaagcgcgg

SEQ ID NO: 3019 - DNA, 267 bp, Homo sapiens
ggtgagctactgggacttcgctgccagggagcaagctggcaggcaggaagtagccaagatttgggggaatccttcccagggaacgaatacagagaaggacgcatctgaaaattccgccgcagccacctccctcccatgggaaagccccgacctcggcgggcccagcgccacccggctccccggggtgtggaacactgagcgaggcaggtgcggcgggagcatgcgcgcggggcgggcagggggcggctcccgcgcccccaccccgcg

SEQ ID NO: 3020 - DNA, 707 bp, Homo sapiens
agggaatggggagggtcacgcatactctgtgcggcccgagtggtccggatggcacagcccaggtgtccgggctaaagttggcatctccaaagtccagaacgcaacttgggcgcgccagtacaaactcggccttcggcttttctgaagccagtcaagttcgcacagggcccccagcgcctggaaatctgagaggcgtggaagggtggggagtcccgcgaagtctccagtccctgggtgtcctccggctccgcgggggagcgggcctggagctaaaccggccggccgtaggctggagtagcgggcgccggagcgcgcggtggggatgtccgaaaaggagttagaggctcagtcggagagtccgagaacacgagggatgcctaccttgtaacatggcctcaagtttcttcctgtccacgcggaagcgctcctcgctccactccgggctgtgcagggtcgccccggcgaccaagtcgtcctcggagccgggcactggggagtcggtgctgcgctcgctgttggagccggggtccgactgcgccgccaggtagccgggctctccctgggcggccatggtgggcgcgcagcgctcgggctcccgctgccgccgccgctctgcctgcgctgccgcctccgctcgccggccgggctcaactggctcccagcgccgcggcgctagctcgtccccctgcagccgccgacgccaccgc

SEQ ID NO: 3021 - DNA, 201 bp, Homo sapiens
tggtgctgagtgcgggccgggccgctccccggcggcggtgggtgggcgcgcgagggcggagggggccgggagctttggttccgaggcagcgaggagagacgggtaaacagcagagcgctaagccaagcccccaaagtgccaacagttgcagaagtccgaactccagcggctccaggggcgcgggcacagggtcctgggtcc

SEQ ID NO: 3022 - DNA, 201 bp, Homo sapiens
gctgcccggggctgctgcacaagccggtgacactgccctgcgggctcacggtctgtgagcgctgcgtggagctggggcccgcgcggccacgggcgcgggcgcgggcgcgggcgcgtgaacgtagtgctgagccgcctgctggagaggttcttcccggccgagtgcccgctgcgcaggctggagggtcaggcgcggagcctg

SEQ ID NO: 3023 - DNA, 201 bp, Homo sapiens
agccagcgcggcccccgggtccctgcgcttatggcgagggtcgcgggggaacagcccctggtaggtaacttgccgggcacccacctgagttctccgcaccgcggcccgaaaacctgggagcgtcccaggacaaagggccagccctctggaattagccgtgtgtgactagtgtgtgccagctcgtatgtgggggtcccagtg

SEQ ID NO: 3024 - DNA, 201 bp, Homo sapiens
gctgcgcaggcatcgggctccgtccgggcgccggggcagggttgccggggccagtaggtctctcgcgcctttcctggcggggctctaggggctggattgcgggtcccctctgctccttcttcggggccgagcaagctcgcggggggtgtccccaggcagcaggagggtgaggcaggataactcccaggttttgcagttttc

SEQ ID NO: 3025 - DNA, 203 bp, Homo sapiens
atctccaaagaatgacaaaataaagaagcgtacgttaggctcccaaggagacaccgcccccccttccccaccattcttcatctccattagattccctaccgcggaccaaagatgaacctgctaccaatcaagttcctgcccaagttattttatttcccgcagcccctccacctgccggggcggtgctcggcgcactctaggct

SEQ ID NO: 3026 - DNA, 201 bp, Homo sapiens
tgatcgggcgccgaaacgccgggagtcgggggctaagggctcgagccaggaggccccggagcagcagccgcccgctcctcacgccgccgccgccgcccccgcggttgcctggacacgggataaccgacttggggcctcgaccgcagcagagccggaggggtgggcaggcgcgggtccgggagacgcgcggggaaacgcgcg

SEQ ID NO: 3027 - DNA, 201 bp, Homo sapiens
ttattttaaagcggcagcgcacctccagagctggcctccctccccgcctcgggttcccggaccggctgcaggagcttccttccccgggtcgggcggcggcgtctggcgtcctcgggctgggccattgtcccatgtccttctctgggcgcctggcgcgtgtcccaccgccgccaccgcgcctaaaggccaggctggaagccc

SEQ ID NO: 3028 - DNA, 208 bp, Homo sapiens
gggggcgccccactgacccttcttggcgcttgctttcctccccaggctgcgccttcctcacctactgcgagcgtgagtcagcgctgaaggcccagagcgcgctgcacgagcagaagactctgcccggggtaagtggcgcccgccgtggcgcaagcggccgacgcgccgacagggggcgacttcgggaggccgggcggcggcgcggcgc

SEQ ID NO: 3029 - DNA, 201 bp, Homo sapiens
cactgatgaatgcgcgctcggatccccgggcggactccctccaagccggctcgcttttctagtctaaataaataaataaagccagatggaagaaaaaagcgcccattccacctccgccgccgccccgcccgccatccctgcctttgcttcgcccgcctggcgccctaatagagcatagcttggtggataaagcccccctac

SEQ ID NO: 3030 - DNA, 201 bp, Homo sapiens
gaaaggaaaaagcgatacctctgtttcgcacagagccaaacactggaagcacgagatagccgacgtggaccaggaccatcctggctcctcgcgcggcggcggcggcggcggctgcgcgcgggccctttgtggcgcggctccggggcgcgggcgcgggcggcggcggggctgcgggagccgccggggcgggaggcggagcgc

SEQ ID NO: 3031 - DNA, 595 bp, Homo sapiens
cctggctctcggcgctcggggccagcgcagcccggggcgagcggggcgcgggccggggagggggagctgcccgcgcactccatccccctcccccccgggcgggcggcggcggctcgctgtatatatctcggcgcaccccgccaggtcgcgcacagcgccccgagcccaggcgcctccccgcccccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcct

SEQ ID NO: 3032 - DNA, 201 bp, Homo sapiens
ccccttccctccgtcccctcccctccccggagaagagagttggtgttaagagtcagggatcttggctgtgtgtctgcggatctgtagtggcggcggcggcggcggcggcggggaggcagcaggcgcgggagcgggcgcaggagcaggcggcggcggtggcggcggcggttagacatgaacgccgcctcggcgccggcggtg

SEQ ID NO: 3033 - DNA, 269 bp, Homo sapiens
cccaccgaccgcaccatctgaccgcgggaaacgaaatctgagctcaggaatttgaactgccccacgcacgttcgttcccggataaatctcctagaggaccgtgatttttccacttagagattatttagggagatgtcctggatgggacaagtagacaaatggcggcccgaggaaaatgcaggaaactctacattgtagacgcttaagcaccaactgtctgggccccggggcagggaacgggagacattatccaccggaaacatcacacc

SEQ ID NO: 3034 - DNA, 201 bp, Homo sapiens
cgcggccgcgaggcggggctggagggcgctgcgggctgcgcggaggctgcgggaagcgcggggagcacgcggagcccgactagcagggagatcgcgtcgcgccgggcacaggcacgggacccgcgctctaggagggcgcagcgagaggcgcactgcgcacccaggggctgcggtcccggccgccgtgcggtgacaagctga

SEQ ID NO: 3035 - DNA, 267 bp, Homo sapiens
tgaaatttagaggaaaataaaaatgcagcggttcctacggaggctcctggcttgcaggacatttgagggtggagacaaggatgccgcggagggaggactcgggagcccggccgcgccctccagcctcggcacccgcgctcagcgcgccgcgccccgcgtcccccgcgcgtggccgcctcccgcgggccgggccggggctgcgctgccatctagcggccgcgcgcccagcgccgcgccaccgcccctgcaggccgccggggctcctgc

SEQ ID NO: 3036 - DNA, 287 bp, Homo sapiens
ggtccagactccgcgagctccgggctccgcttacccggccggcggcctcctcggggcggagcgcggcgtctctggagccggcatcccggactccggcgccgccccgcgcaccgcccccgtcccagccttcagtggcgcggcgccccctcgcgacatccgcgggtccccaggagcgagccgaccctcggctgggtttggagccggggccaagtccactcggagggagcacggagcccacccagctgcccttgggggcaggaggcccaggccccactctgcacaccgcc

SEQ ID NO: 3037 - DNA, 201 bp, Homo sapiens
cgacctggcaccagcgcggaggccaccttgcgcagccgggcaggcacggcggctcccaggcactcccgcagcagttccagctcctggtccgcggcgccgcgagggcgagaacccgtgggcgccggcccctcctcccgccgccggtgccctgcaaagtggaggccggcgcccccggcgcccccgccgcgctcggggcaggcc

SEQ ID NO: 3038 - DNA, 201 bp, Homo sapiens
cggaggtctacgctgagctcgcgcagcgcgcacggcccgtcggcggcggtggcccccgcgctgcgctgtgcccgacccggcccgcgcggatcccgcccgcgccactccacgcgcaggccctgcagcgccttcaggagcagcagcgctcgcaggggatcgccgaggccgccggggccacctgggcagagcgcgagcaggcgc

SEQ ID NO: 3039 - DNA, 286 bp, Homo sapiens
gcgcgggaggcgccgggggccgcggaggcggggcggggaggggccggcggcggcggcggcgcgcggaggagaccgcagtgcggccggcgctaggacccgcgggggcctcccaggccgcggcgcctcccgctttcccccactccccgacccttcttcgcccccaaaatgaggaaacggagcaactcgctccaagttgtgcagccgggaccgcctcggggtgtgcagccggctcgcggaggccctcctgggggcgggcgcggggcgcggctcgggggcgccccctgag

SEQ ID NO: 3040 - DNA, 244 bp, Homo sapiens
aatgcttagcattatttaaaaagaaaaccacacacattagccaatgatatattctaaccctcaacaaagctggtatttttctctgattacagactttgccgtggcaaacccgggctccgacgacagaggcagcgcagaagctcgctcctaaatgagacaattttattaaaatcataattccttgcatttctatagcgccttttcagtggcggagatctcaggtgccccacgccagggtctacta

SEQ ID NO: 3041 - DNA, 201 bp, Homo sapiens
gttctaacccctctccgagaccccgggcggcggggatcttccctcgggtggctgcgtgcgcgctcagcaacccggtgggtggaggcctggagccccgcccgcggccgcccccgttgaccccccagtgtctctgtttgtcctccagagctcaggcagtcagtttcccgctaggaaggcagagcagcgagatccccggcccac

SEQ ID NO: 3042 - DNA, 372 bp, Homo sapiens
ggacccgccgcccaggcccgcgtggggaccgcagggaactcgcgccacgccgggggtcactgtccatcgcgaggtgctgaagtggctccgtgaccgccgcgggccgtggctgacatcgcggagaagttaggactttcacagtctctgccagacttgaaagcaagctggaaatcgatagctgtttcagctgtttcagattctaatctggtttgggtttttccccctttcatttgaaaatagactcagggcaatgcttaagagaattccaaccgacggaagtggccgggaaatcctgccttcggtactgagggatgttaccggagattcccctgccccaggcctgccggagtccaccacattcgctaatgccac

SEQ ID NO: 3043 - DNA, 201 bp, Homo sapiens
aaccctcccgtgctccctgcacaatctgggagagacgcagcgctgtgggtgcagagctgcccagagagggctccaggccagggcagggaagagacaggacgccgcggggcccggctgtcggcgctgttgccatcttatggctgaaggggactgaggccgaactgggcaaggagaagtcggtcgcagattgtggagctgact

SEQ ID NO: 3044 - DNA, 247 bp, Homo sapiens
ggggcaggaccttagaagttatccaatcagggacgctgggctggaaaccgtccaatcaggcacggggcaggagaggacagggcggcttccgggatgtggcggggcctttgtctctggctgcagttggagctctgcgtctcgtcttcgttcttctgtgtcctctgctgctagaggtccagcctctgtggctctgtgacctgcgggtattgggggatccacagctaagacgccaggaccccccggaagc

SEQ ID NO: 3045 - DNA, 201 bp, Homo sapiens
ccgttccctctctcgggatgtcggaccggcactctcaccatttctaggcttccagggggccctggcgtcttagctgtggatctcccaatacccgcaggtcgcagggccacacaggctgggcttctacgtgcagaggacacaaagcagacagacgaaaattggagcttcggcggcagcgagaaacaaaggccgcgccaaatc

SEQ ID NO: 3046 - DNA, 201 bp, Homo sapiens
ggaccctgagctggggaccgtccaatcaggcacgcaactggagcggacagggcggcttccgggatttggcggggcctttgtctctcgctgcagctggagcgcttggtctcgtcttccctgctttgtgtcccctgctcttagaggcccagcctctgtggccctctgacctgcaagcattgggagatccacagctaagacgcc

SEQ ID NO: 3047 - DNA, 235 bp, Homo sapiens
accccgtcccctgcaagcctgcaacaccccgcacccagacccgcaatccaggcggaggataaagggttgcagcggagggcgcagagcagatgctcagggcggggcagagggggcgggaagctggcgccacggtcgcggcgagggcgagcagccgcgcgctcccggtgctaggaggaatgcccgcagagcggaggctggcaggcgcgagaggccctaagcgcgcagtccgaccaag

SEQ ID NO: 3048 - DNA, 201 bp, Homo sapiens
gcggcacctcgctcccggctttgcgcgctcaccccggggcgcgccgaggccaccgcagggcacttacttggcacttgcttttgagtgtgcagatcgtcgcggttttcacttgggttttcaaacaagtttcagggagaaagaaggaggcaaaaaaaaaaaatccaattatgcaaatggactccggactgggaggcgcgggat

SEQ ID NO: 3049 - DNA, 201 bp, Homo sapiens
gccgcgccaacgaacgcaggcggcgggaggctcggcggcggggctcgcgttcctgcaccgcgaccgcgccagaaaacaccccggggctgggcggcgtctcggagacgcattcctttgttactcccaccgtctttggtaacgattattaatgccatcatgtcccatttcccctcaccttcccccgctcccagagccgcgccc

SEQ ID NO: 3050 - DNA, 201 bp, Homo sapiens
aaagagggagaaagagactaaaaaaagaaaaagataaggggagggggaaggaaggaaggagagaaggaggaagaagtctggggtttgctgctccaggagcgctcaggcagccggtgctggagcgcggggcgcccgccctcgccgggactgtcggcctcggggcctgcgagagcgccagagccccagccggcgcgcccgggc

SEQ ID NO: 3051 - DNA, 201 bp, Homo sapiens
gctcctgcgcgcggaaaggcgctggaggcggctttatagccggggaggccagcggcggcgcatctgcatcctgggagacgtctggacccagcccaagcccgcaggctgggcgagcggagacttttgatcttaccgtgtgggtgagatcactgtctcccggtctaaaagaaaagaaagcatgctgtgaacttttgaaacaaa

SEQ ID NO: 3052 - DNA, 201 bp, Homo sapiens
tggaacccacggcgcttcgcccgtcccgcgcccaggaatactgtgcgcctagcgcagatgcgtccccacgaccccctgcctggcccggggccatgtggccgcgcaccggcctctgaagcccccatctgactgctggggaaggcgcccagaactaggagcgggttggttggggactggtcctcgcgctgggtcgcttcgccc

SEQ ID NO: 3053 - DNA, 296 bp, Homo sapiens
ccgggggtgggggtaagcgccacgtgcgcgccaggtccttggtgtgcccggcaggcggcgctgcgtggctgcggctggctccgagggtgcggggggcggcgacccgggagggaaaacccctgcctcttcccggggcttgctctgcccgtcctttaaactcgccctacaccctccccgactcccgtccttgcaagcgttatctgcagcctcaccggccctcgcaacggtggtggtggttggtggggggtctcgaagcttgcctctggccagccggaccccggtgggagatggaggca

SEQ ID NO: 3054 - DNA, 201 bp, Homo sapiens
gccggccgagccccgggagccgaggctggaaacgctggagcgggcgctgcccaccgaaggcggcccgggaccgggacgcgggtccgagcgaccggagcgcgggctgccgtggcgctggtcgtagcccaggctgatgccgctggatcgggcgctgccgccaccgccgccgccgtcggaccccgccaggctggcccgtgggct

SEQ ID NO: 3055 - DNA, 201 bp, Homo sapiens
actcgccactgtgtacctggacgccatctgcagacccagcgcctgcggggattccggaaacgggagagcgggcttccggaaacggtgaccaatgggaaacgtgatcagatgttactaggcgaacagtccgtttccaggcaacacagaaggaagagacgctctcagtcaccctaaaatagacggagctttcagccaatggat

SEQ ID NO: 3056 - DNA, 266 bp, Homo sapiens
ggaaaccgctagctctgagcgccggactctttgtgctgggtgggagtgggggcccgcggtcctggtgccccaatctttggaggaggacgccgggcggggcgatgcctgtgcttgtggttccctgaggcagtgggagtggcgtgtgaaggactgtgagagtctggcgtgaagtgactgtcatttgccagacattcgtctggctgagtgtggccccgggatcgtgtccgtaagcggatttcgtggaggcgctttcccttttatctttc

SEQ ID NO: 3057 - DNA, 201 bp, Homo sapiens
caaagaagccgcgggtatcggcccaacaaggtgcagcgaacagtcgcccgctcccgcctcaactcacagcctcacattccacggtgccattgacttcctcgcacccagtcacacaggacgtggacaggcacacggggtgacagcctcgcactgaacggtaccaacctccactcgcaccggagtcacacagatggcctgcga

SEQ ID NO: 3058 - DNA, 228 bp, Homo sapiens
aggacacgctggacagttccgaaaagacacagtgggtggtcccgggcgtgggcaaccgggtgcggaactacagcgtacccggagctgcgaacccagacgcgggtgactgctgaccctctgccctgtcgtttccatttgtgcatgcaggtggcggttagttggggccagggaagcgtggagggtgggttccaatcgagtcaagaaaagcctggggtgtcctgaactctg

SEQ ID NO: 3059 - DNA, 248 bp, Homo sapiens
ccgggactgagcttctgcagccctgaggcctggaggcccgggcggtagtaactgtgccggaccaggttcgtgggtgcggcctgtggtgcagttggagaccgaggccccgcgcatcctcgtccgcgcttcagccacttaggctcggccgtagcgaaaaggcccaagagggaagtcagaggtgaacgccccaggatgaaggtcccctgcaaaacgctgggacctagatttggggtgggtgtctggggtct

SEQ ID NO: 3060 - DNA, 387 bp, Homo sapiens
aagccgaggtgctggaggacgtgttgcgggagcagttcgggccgctgccccagctggccgctgtctgccggctcaagcggctgccctcgggcggctactcgtccactgaaaacctccagttggtgctggagcggcggcgtgtggccaacgccaaggagcgtgagcgggtgagggatccctagggtcgacgtccgttccccccttccctgctctaccaccaaacacctggtcaacacccgggggtccgctcaccgcccacccccgctcgaggcgacttcgagctcccgaggcctcccacgcccccagcttgtcaggagaatggcagtggcctccttcttctgcacctccgtgcagctgctcgttggcggccgctgcggtggccgcctc

SEQ ID NO: 3061 - DNA, 203 bp, Homo sapiens
cgacctaggctctccagcccccgcccagtcccccgcgtgcgggcgccgggaccgcagtacctgtgacgccgaagcccagcaggccgcagacgggagccacgcgcggccctggcacagggtaaaaacctacgctcaggtaggcgggcagccacgatgtcgggcaagcccagggcagacccccggtggcgcacagggaagcagcg

SEQ ID NO: 3062 - DNA, 203 bp, Homo sapiens
tgcgaacaagaccaaggcgaggtgaggcccaggcccccgggactgacagcgccgcggcagggggctcgaggcgggagctggggaccccagcgccccccacgcgcgccccacgggggctgccgccaataaaggcggagggcaagggtgcgtccacccaagcaagggggacggtgggccgcccgggctgagcagcggagcgcagc

SEQ ID NO: 3063 - DNA, 312 bp, Homo sapiens
ggcccaggaggagccgcgccgggctcggttataagaggccggctagcaggcgctccgctagcacccgcccgaccccggcccggagcaccgggcgcccagcgcgggtgaaggcggagccgcagggttggcccccaaagggatgctctcgcccgagcggcgagaccagccccgctcgcccctcgccgcggccgcgccgcagccgcccacggccgccgacatggccctctactgcggcgacaacttcggagtgtattcgcagcccggcctgcccccgcccgccgccaccgccgccgccccgggcgcccccccggc

SEQ ID NO: 3064 - DNA, 407 bp, Homo sapiens
tctcggctcgcgggaggcagctgcaccaagaaggtgaggacgctgagcgggggcccgtgccctccgccgccgcagcccccactgccggcgcgcgccctccgcgcccgccacagcagcgcgctaggcggacgccgcgggaatttgacgctcgaggctcgcggcccctaatgagagtcccagaacacttcccgcccttgacggccagcggcagcgccgccgcctcccgcagagcgcccgcttctccgtttctagagccttagtctctcctcgagcgacctcgcagcctccctcccgtctccatccgccgccggttctgcagcccggctcctccctcagtctaggcgcgcgggctgtagtgggcgatcgcctttccccgacccctcgccgtgcccctgggcctcccgaag

SEQ ID NO: 3065 - DNA, 295 bp, Homo sapiens
attctgggccgcgggagaagtgcgtgcagcccgggcaaggccgggcggggccgggcgcgggcgggcggccgagggatgcgacagggccgggcacggctccgcatccccccgcactcggcgccgccgcctcgccgctctctcccgcttgcagggccgccccgggcaccccagggctgctgaggggcgggcgggccgtaaaagccacgagagaggggcggcagggcggcgcggcctgcgagcgccgcgggaccccgaggagcggcgcggggagtacaggggcgcgcggggcgggcgc

SEQ ID NO: 3066 - DNA, 435 bp, Homo sapiens
acaattctggccccacacatttcacatgccccgcacaaagaaacagaaagcgggcgacacgccctgggagggcgggctggcggcttctccagctcggagcgcgtggaggctgcgcgtaggggtccgggacgcgggacagggactccgcgcagcccaggcgccggggaaccggggctggagtcggggatctgagcccagcggacgcctcctccgcctggaggcccggcacggaccgggacaccagggcgtccgtggccgtggctcggcccctggctgctgcgggccgcggcctccagtgggtccccaggacccttccccacggcgggtactcaccgaggctgagaggccacgccgtgctgttggggcttctcgtcgaccacattcctgggcgtcagcccgggcagagaccgcggggactggccaggccgggccagg

SEQ ID NO: 3067 - DNA, 410 bp, Homo sapiens
tggctgtgccagccgatatgagcccctccctctctaggaaggcgcaggactcggggaagcctccgcggccaggccgcctgcctacccgcagaccccgggcgccgcccgcgttccctgcccttcacttcccaacccctgcgtggccccagggtccacattcctggagttttcctccccagtaaatagtgctgtcccccacttaacagcagaggcgcccaggagttcaggcgatgtgtccaaggccgaacagagggacagcagtgagctgctcaacctttccagctgcgcagccaggacacggctgggggcgggtggagatgtggcgcagggttagggtccgggtcccgggaagtaatgaccgagggcggtgaccactgtcttcagcttcccggcgggcttccctccaaggg

SEQ ID NO: 3068 - DNA, 392 bp, Homo sapiens
tggaagcatccgccccatcgcggggcttggcatctaggctttgggacctctgccattgccaaggatctcttcggggacccgagcccccgggctgaggaccgcgggggaccccaggtcgggacggagcctcctctggctcgctgtgcgcgcacgcctggaaaggcgggatttaaggcagcgatgctgcgggaggctctgcagtgtcaacgagcccccgaacggttccgcctcattccctctctgtgtgcctcgcaagtctctgcttagtaaaccgtcacagcttcggcgcgcgagagtggcgttggcacgtccaaaccccggggtcctcggccaggccaggggggcgggcgtgcggcggggccgggccgggccgggcgcgcccagcgggctcc

SEQ ID NO: 3069 - DNA, 203 bp, Homo sapiens
cccgaccccagtccgccgccgtcttctaggcggattccccagaggcaggtcccagtccccggcgcggggaggcggcgcgcttcagaggggcgcagggtgcgcgggggccgttggccctccgggcacttcccctttgcggtctccccgccctccttcggagctggtgcctgaggtcgctgggacctcagcctggcgtcttctct

SEQ ID NO: 3070 - DNA, 398 bp, Homo sapiens
gggttcggggataaagggtgacgtgtggtcctggggaaggtccgggatgagggagctgaacccagttgttccgcgcggtgcttagagtgtttcaccgcgcgcaataaatctccgtagacaccgcatctccaatgcggtgtccctctgtgtcagtgccccggcggctcttgcagggtgccaatgttacggctgtacaccgcttttccctcccatcatcctcacctgaacagacctggaggaggcggaaatggaaattagggcatgtccacaagctggattcgttagatcctcctgctcggcggtatgcttgtgcatgcctgcatgccggcaaggagccacggatagggaaggctcaagagctggccacctgagcgcagtagatgggctcccgcagtttt

SEQ ID NO: 3071 - DNA, 286 bp, Homo sapiens
gccggttcctccacacccacgtgcccctcgtgtgcgcgcccccggcctgcagatgctacaaggctggcgccgcctggatttccgggcggccccaccctccgcggccgctacgcctcgctccctgcattcagtctccttggcgtctccgctgcagcatccaagaccaggcgccgcctctgctagccgtgctgcccagcacgcctgagggccgctgccggcaggcctcacctcccgcccgggtcccccactcacctttccttctggacggtggggttcaagctctgca

SEQ ID NO: 3072 - DNA, 267 bp, Homo sapiens
ccccatctccttctcccctccctagtctggctgaagaacgtccttaaggaaatccgggctgctcttccccatctggaagtggctttccccacatcggctcgtaaactgattatgaaacatacgatgttaattcggagctgcatttcccagctgggcactctcgcgcgctggtccccggggcctcgccccccaccccctgcccttccctcccgcgtcctgcccccatcctccaccccccgcgctggccaccccgcctccttggcagcc

SEQ ID NO: 3073 - DNA, 260 bp, Homo sapiens
gaaatcacgataggtttgcaccaccgcccctccccctacgcccccgcccaggtctgcaaagccggttgcccctggctaataggcgcctttcctgctccacggtgaaaactagtctgtggtgcattgagatttgcaaaccattccctgaatgccaggggcgctgcaaaacagccgccgggtgcagtgggccgggcgctcggccaccctggctgcgatcatcgcagcctcccaaaggatgcgggcagatgcagacggctctg

SEQ ID NO: 3074 - DNA, 239 bp, Homo sapiens
gtgagcggggcacgagagtgcagggctccgctggtgtcctcctcccggcgcccgccggacccaccgtccccaccgctgcggtgttcgaacccgcggactcggatcggcggcagcagaagcggcagcggcaaagcacccgcagaatggggtatcgcgaaatagtttcttctcctcctcctcctgctggtggtgcagccgcgacagcccgtcttccaggcaggggtttggagcttgccttc

SEQ ID NO: 3075 - DNA, 846 bp, Homo sapiens
ggtggcctctggggcagacagagcaggacctgcttctgccccttgccctcctcgtcctcctctctccagcggcggcgaccgcagtaacagcggcagtggcggctgctgccactgctctgccgctgccgagccggtcacctgggcacccgcggagccgcgccgctgctaccgccccggcggcctcccggagtgcgcggagggggcggcggaggagcgagatatccatagtaaccgaggatgcgaggggcgcccagcagcagcgagtgcctgggagccaggaggaggcccccgcgcgccggcaacccccagtgctaggcgccctgcagcccccgcgcgccgcgcctgggcccgcatcgctctcgcagtgagggtccgcccgagcggtaagccctccccggcggccaagccgacacctcccccccgcctcgccgcccaccccgggcagcagccgcggaacaatggagagcgcagccagcagccctggagacggcgttcgggggaggacgcgccgccgccgccgccgctgccgccagggcaggcgcgcgccgcgtggagccgggcgggtgcgagggcgcgcggcggggggtggggggcacgcgccgcgcggggggcgggggcagtggggggcgcgcgcgcgggcccggggagctcgcggggagagcccggcgctcggcgcagcgcggcgcggccaagctccgcgcctctcccgcccttcctcggcgcgctcgccctcgcctcgccgctcgcattcgctgggggcgcccagaaagatgcacagaggcaacggctaggggagcggaggttcaagccacatgtctgcgtcctcgggggccagagcccgccagc

SEQ ID NO: 3076 - DNA, 526 bp, Homo sapiens
agctgtgaagaggcgtgggggccgcgggaactttcctctggccggtgcgatgaaagccgggcggacgaggtggctcaacggggctgagagtggttcggccgaggcgcgggctgagccctcagcacctggcctgagcggcgtgggcagcagcctgcaccgcggacacctccaactctgccgcgtctgcgccgcactctggccgtggcagcgattttccgggcatctctgaggccgcccttagtcccacaagcacttagccgcccatttcagagcagcggcgccgaccgttttaagaggagtcagttcccgacaccgcctcccacttacttctccacatttccaccgctggagggggtgagtgccgtggacaggcgctcccgtccggggacagctcagcggcggcagtcagcccgaccctcctccgcgcgggtcgcccaaacttgaccagcagagcgagcggctcagcgcagtagccgccttcgcggcttccagttgtagaaaagcaaagcgccgggaggaagcagca

SEQ ID NO: 3077 - DNA, 201 bp, Homo sapiens
gtttcccgcagataagtaaacaatctggacgtgaaatggaaatggtaattaatgcagtaatgctgttacacctcgagtgtgcaaatcccattgactcgccgcgccacggggggtgccgggcgtacggggaccggtggcgtgcgcccaggctgcccactccctccctcctctctccctcctccctaggtccccgggcggggc

SEQ ID NO: 3078 - DNA, 523 bp, Homo sapiens
ttctacgagaagaataagaagggctggcaaaatagcatccgccacaacctcagcctcaacgagtgcttcatcaaggtgccgcgcgagggcggcggcgagcgcaagggcaactactggacgctggacccggcctgcgaagacatgttcgagaagggcaactaccggcgccgccgccgcatgaagaggcccttccggccgccgcccgcgcacttccagcccggcaaggggctcttcggggccggaggcgccgcaggcgggtgcggcgtggcgggcgccggggccgacggctacggctacctggcgccccccaagtacctgcagtctggcttcctcaacaactcgtggccgctaccgcagcctccctcacccatgccctatgcctcctgccagatggcggcagccgcagcggctgcagcagctgcggctgcagccgcgggccccggtagccctggcgcggccgctgtggtcaaggggctggcgggcccggccgcctcgtacgggccgtacacacgcgtgcagagca

SEQ ID NO: 3079 - DNA, 276 bp, Homo sapiens
ccgcccaggcagcatcctcgcagcagccgccaacgagctgcagccgccgcctactgtccgcgccggctctcgcctcccggtgcctgccgcaccgtgggccgcctcgccgtgcccgatgggtgcgcttctagcgctgccgccgcggcgctcggcctcgggttcccgccgctgcgccgctagctcgccggcagcagccgcgctcactggcgcggacccggagcggctcaggcgctcaccccgggacggcccgtgacgtcacggagggagggaggtggc

SEQ ID NO: 3080 - DNA, 357 bp, Homo sapiens
atccttcccccaggcaggagcagacacctgcttgtccccacggcgcgccagcgccctgctctagccgtccctgggccagagctcgaaactcacccactgcgctcccaccccggcacagacagccctcaaagttgtccgtactccccagacctcgccttctgctcagcccccggaccccgcccaggggttgagttgacgtccgcgggtggacctctctggtccgctgcgcagggaactgacttcgggaatccagggcgcacagaggccaaagaagctgcggcaagggagggtgggcaaatccagcttgagcctaggtccttgccgctttcaccctcaagcctgccctgcctccctcct

SEQ ID NO: 3081 - DNA, 278 bp, Homo sapiens
tgccgcgctgccgccgcagtcagccgcgccgccgccgctgccgcagcgcgggcggccgcgcgccggtagcaggggcttggcgaggaagccgctgagcctcgcgcgctccgcgctcctggcggtcgcagcgctgcctattaattgattctcttattgatttatttaatttttaggagcggctgctcggaggcacgggtcttctcctaaacctgcagcgacgcccccggcgtgggcacaaaggctccgacggcggccggcgggggctgcccagcgcccgg

SEQ ID NO: 3082 - DNA, 336 bp, Homo sapiens
ggtgatgaagtttgggcagaaatcccctgtcggccgtccgctccacgcttccctcggggccgacactgccaacctctccgggcactgaggacacctctgcgccctggagcggtgggaggacgcggagcgccgttctctggcttccgacaccctgcccgccctctctagtgggtctgtggctgcgccctctcgaaggaagtaataaatctttctgaccttgggggtcagaggagacgcttcagttttccggaggggtgtgcgggcgggaccgtctttccgctttactggacctctggccggggctgctcttgtttcattgtgccccacatgcggagc

SEQ ID NO: 3083 - DNA, 311 bp, Homo sapiens
gggagggcggtaaggagtgcggaggtccaaacgggcatgagcacggggcggcccggccggaggcggccctgggcgcccccagctgcctccggctgcccccgctgcggcacccagcggcccatcggggttgcactgctgcagcggctccttgtgccacttgtagtccaggaggttgagcatagtgagcaccagcagcagtgcatagcccgcgcacaacaccagcgccttcctacggaacaccttcattccgagaggggacgcgggccagcggcgtcctgggcgccggggccactgcgggagcagggcacgcg

SEQ ID NO: 3084 - DNA, 201 bp, Homo sapiens
aacgccggcaccggctgggaagcttcggtgctccgggtccctcttggcgagggcggagaagtcggcggcctctgcctagaattctgtgattgtagggatcgagacatcaagggcgggggtgcagaggattacaagttccctagcgcgtctcatttgcacataaatgtgctttgcctcctaaccttgtctctgttacctgtg

SEQ ID NO: 3085 - DNA, 201 bp, Homo sapiens
ctcccacttcgcgcctctcggaattccagaactcgggtggccggcccctggaaagccgcagccggcgcgatgcattctgtagacctcaccctgctgggacggacctcctaatcttcagaaccgcgggccgcagggagttaaattgctgccttcctctccttctctcgtgcggttggtggcttgttttctaaaggaacgttt

SEQ ID NO: 3086 - DNA, 481 bp, Homo sapiens
ccggggccgcatcgccatggcgacctgctcacctgactcgctccgggtggactcgccgcgacccctgggcgttcaggcccctgagggcccaacgggcgacggccctccagctccagctgtgcgtctccgcccgggcgaggtggggctgaccgcggccgtctgcacacgtcccctctggtccgcgcccccggcctgggagggcggactcgcccaccccacgatggccccggctttggaagggactgtttccgtgacccgttctcccaacagccgctaacaaccccctctaacgtctcctgcgcggcccgctcctgagaaccctggctcgggagagcgacgcggggtcctcggggctgcgcaggctgcggcgccctgcccacgctggcccgagggcgcggctcgctccgggtcggctcacacacctacgcttcctgccgggaggcggctgggacgcggcggggctgccccaagtgcagtcgcg

SEQ ID NO: 3087 - DNA, 280 bp, Homo sapiens
gagccagccggaggggcggcggcggctccgcgcgcccagagcctcagcccatgaatgggactccaccctgagcgccccctcccgggcctggggaggcggcggcgcggcggcggggggcgccccgcaagcccgcggctctgagcggccacccgcgcagcaagttgggcgagttggcagccgcctgcacctgcctcctggccccggcccctgattccgcctccggccccaagcgcccgggttgcgccctcggctgcctcgcgaggtagccccaggaggccta

SEQ ID NO: 3088 - DNA, 252 bp, Homo sapiens
gcgtggggagcttggtatcttatccaatcagagcgctggattgagaactgcccaatcaggcgcgcagccggagaggagggggcggcatccgggatctggcgcggcttttgccttttgcgccagcgtgagctcggttagggtctccacggccgtgctttcacccctcagggaggcgtcggtgattcggtcacagcctcagcctccgtcgctctgtgacctgcgggtattggatgattcgtagctgagactccg

SEQ ID NO: 3089 - DNA, 239 bp, Homo sapiens
acaggcgatggacccctcgggctcccgggggcgccccacgtgggtgctggccgggggtctcctggcagtggccctggcgctggggggccgaggctgtctcggcgccagctcacgtccccgctggcgccccctcggcgcgcagccaccccgggatccccaggtggctcctaggtctgggcccggcctgaggatccctccggggcggagcggggcggggcccgagagcagcacgcaggtaa

SEQ ID NO: 3090 - DNA, 405 bp, Homo sapiens
agttcccaaccaggctcaaggagtcgcagagccggggctccgggcccgcaggacccagaagccacgcgccccgcgctccccgccccgccgctgtctgctcggccgacccacctggtgtcgcgtgcgctggcggcccgcgcggcagccaagccaaaggccgaggccgaggccgagcgcggcgcccagcagcacggcgggggccagcagggcgggcgccggccgcagcgcgtcccgccccagcagcagccgcgcgtcgctcttgcaggccgccccgccgcgggccatccggggcgctcaggctgccgccccgccgcatcccgccgcctgctgcaccgtccccgccagggcggcgacgcgggacttggagcccgggcgggccaggggcgcggcccgctccgcagactt

SEQ ID NO: 3091 - DNA, 237 bp, Homo sapiens
tcaagctgctgtcgcccaaggtcaccaagcagaactctctcaacgacgagggctgccagagcgacctggaggacaacgtctcgcagggtagcagcgacgcgctgctgctgcgcggggcggcggccgccgtgccctcgggcccgggagcgcacggtggtggcggcggcggcggcgcgcaggacaagcgctcgggcttcctcacgctgggctaccggggctcctacaccaccgtgcgcg

SEQ ID NO: 3092 - DNA, 204 bp, Homo sapiens
agccgagcagcagccctagagcctctcgcaagtctctctcacacttccccgccctcgccccaaaggagcagcagctccttcttgcctctccattgccgccgccgcaccggcggagctcctctctcgcgcgtctctcctccgatggagctcgggcgccgccgacgccgccgctgccccgaaccctgagcggggccgccccggtcg

SEQ ID NO: 3093 - DNA, 224 bp, Homo sapiens
ggtcggggtgcgcgcgtgtgcatgctgtgaatgcgttgcgcgatgtgcgcctctattccacacccagccggtctcttgcttgtgctgttcgagtgtggacgtgtgtacgcgttgcattcgctcggtgtggcagcgtttcgtgagctcctggaggcagggaaaggctacttgtgtttagaggttctgttgagggcgggaggggctcagccccagtggggagtcct

SEQ ID NO: 3094 - DNA, 278 bp, Homo sapiens
agcgggtttgcctcccactcccccagcctcgcgtcgccggctcacagcggcctcctctggggacagtcccccccgggtgccgcctccgcccttcctgtgcgctccttttccttcttctttcctattaaatattatttgggaattgtttaaattttttttttaaaaaaagagagaggcggggaggagtcggagttgtggagaagcagagggactcaggtaagtacctgtggatctaaacgggcgtctttggaaatcctggagaacgccggatgggagac

SEQ ID NO: 3095 - DNA, 232 bp, Homo sapiens
gggaaacaggtcggcgtgccgaaagacaccgagtaggtagaaataaggcaaactcacagaggcgcaacaggtccggtcctccgtggccagggcgagccgcggccccgcgtggcgcctcggccgttgccctcggaccctgagcggccactgttggggccctcgaaagaggtgtcggtcctctgggagtcggaagagctgtctgggtgggtttcgtcttgctttttaccccacc

SEQ ID NO: 3096 - DNA, 331 bp, Homo sapiens
tgctctgcctggactttaccgtggccgagaaggaggaatggtacaccgccttcgtgaacatcacctacgccgagcccgcgccggaccccggggccggggcggcgggcggcggcggcgcggagctgcacacggagaagacggagtgcgggcgctacggagagcactcgcccaagcaggacgcccgcggggaggtggtcatggccagctcggcccacgaccgcctggcctgcgaccccaacaccaagttcgccgccccgacccgcggcaagaactggatagccctcatccccaagggcaactgcacgtacagggataagatccggaacgcgtt

SEQ ID NO: 3097 - DNA, 231 bp, Homo sapiens
gctgcgccctgggcgcatctgcgcgcctggccccgcgccccgcggagagggcgatgggtcccggtcaggactgagccccccttcccctctccccagtcccgcctggcaccccctcctctgccccgagggcgagccacggtctgcgccgccgccttcccctccggtgcccccggctcgccgtcctcccgcgccctccctccccggacccgttcccggggccaccatggccgc

SEQ ID NO: 3098 - DNA, 201 bp, Homo sapiens
tgcccggccctgggcttagcccgccggcgctgctgggggcggcaagttccgcaccagcctctactcgcctcaccttccccggctgaatgagtgtcagcccgcgcactggggccacccagaggagacgggcaaagccgcggctccacgggctgcactactggccgcggagcccaggggagctgcaggagaaaccactgcgag

SEQ ID NO: 3099 - DNA, 201 bp, Homo sapiens
agctcgatgaccaggagctcccggccctcgaagctgcgccccaccgtgtaaatcctgctgatggcggtgcactgcagccacacggacacgagcgcctcgcgcagctcggggtagcggtggtactcgaaggagatgccgtcctcttgctgcagccgccggcgccgcctcatgcccgccgcgggcgccccgggctcctgggct

SEQ ID NO: 3100 - DNA, 219 bp, Homo sapiens
ccgctgcagccatgaggagaacccctacttccatggctggctcatcggccaccccgagatgtcgccccccgactacagcatggccctgtcctacagccccgagtatgccagcggcgccgccggcctggaccactcccattacgggggggtgccgccgggcgccgggcccccgggcctgggggggccgcgcccggtgaagcgccgaggcaccgccaaccg

SEQ ID NO: 3101 - DNA, 284 bp, Homo sapiens
gccgggggaggtggggccgccggggaggaggcgagggaaacggggagctccagggagacggcttccgagggagagtgagaggggagggcagcccgggctcggcacgctccctccctcggccgctttctctcacataagcgcaggcagagggcgcgtcagtcatgccctgcccctgcgcccgccgccgccgccgccgccgctcagcccggcgcgctctggaggatcctgcgccgcggcgctcccgggccccgccgccgccagccgccccgccgccctcctcccgc

SEQ ID NO: 3102 - DNA, 429 bp, Homo sapiens
aaagcatctctctcccaacccatgaacggatcccgacccctgctctgccaccattcatgcgtcccgcatccgaggtgtcgccttcacccacacgccccacggccccgcgaaactcggccctccagctcgcgggacgcgctgcctgccaggcgggcccggcggtacctcgggggcgggaggggtcggtcgcagggcccccagcctggcgcccgcggggcgtccgcagcgaaggggtgggtgtcgctcgtgaacgcagcagggaccagctcagcccgcgctcgcccctgggcctcggccaccgcctctccgccactttctcggcccctgcgtggaccggcccgtggcgggggctgctctgcgccctcgtccccgcagcagtcgcggacccccattaacgttgacgagtcagtgtcgcgacccggggagaga

SEQ ID NO: 3103 - DNA, 283 bp, Homo sapiens
aaaagaccgcggtggagaagatggggcgttctccgcgacactcggctgcccagaggtgcaaagccggtgggcgcacgcccggggcggccctacagccctcgggccgccagtctcagggtgtcgggctccaactaaggccccgaagcccccacgcacctgagggcattttgaccagctcttgcgggctgtcttgcggccgcagtgggttctgaaagtccattccggcgtagggtggaaaccggcgggaggcgttgctgattctcgattaaacaatagtgacgag

SEQ ID NO: 3104 - DNA, 241 bp, Homo sapiens
cgcgggtggcggcggctgtggggccgtctgggattctccgcagcactgaccctgcaacctcctgtgtctgcgcttcgtggtgaggggcggcgggatgcgcgcgatccctttttgactcagccaaacggaaaagctcgcgcgtcccggctggaaggtggaggtcaggcaggacccggcaaaggcacattccaaacgaagcagaccccattcctcacctgcagagggaaggcggtgtggacgg

SEQ ID NO: 3105 - DNA, 244 bp, Homo sapiens
gcagcagccccacgttgttggcgcaggcggcgcgcaggagggtcgccgtctccgggacgctttccgggacgccctccgggacgctctccgcgctctcgacgccgtgctcctcctcgtcctcgaaagggtagaaagagtcgtccgaggcgatgctgcgggtgtctggcagactcgagaagtcctcaaactcttcgtagtcagcggggtcctcctcgacctgcgcgccccggggtggggacggcgg

SEQ ID NO: 3106 - DNA, 225 bp, Homo sapiens
gcagggggcgctgcgctcgccgagctcggaggggccgccgggccgggcgctgcgcactcgcgtcgggagccgcctctcgcccgcggcgctcgcccctgccgcccgccagcatcccttgtcccgcggccgcgctcagacaacaaaagcggaagatgctgcagttgggcaaggtcaggaccttgccctgaagccgggcggcgccgcgcacgcctcttcccggactga

SEQ ID NO: 3107 - DNA, 249 bp, Homo sapiens
cgccgctctcgcggcggcactgggcatgctccgcacccggggccggtttcggcggcggggcggacgctccctcactagccgggcgcccgggccggccgccgaggtttaggtggaggctgaggctgccgcgcgccgcgggaggagcctcgccctcggcggctgaggcggcggcggcacaggtggcgcgggccgcgcgcggggcgcagctcgggagcgctcggcgccgggcgccgcggcggccccaggctc

SEQ ID NO: 3108 - DNA, 255 bp, Homo sapiens
cccgaccgggagcccagagccctgccagcgccgcactgtgcgccgcgcaagtcgctcgatctccccagcggtaccggctctaagcagtaaacatctgtgcgcttctgagccagggacgcgcgtggggggtgggcgtgcacgcgggtgggccagcgcagagtgggagcttgtgggtgctttccgtcgggatttccaactcagctgcctccgagagcctaagctgagcgccgcacgtgctcgtgccatctgctgtac

SEQ ID NO: 3109 - DNA, 243 bp, Homo sapiens
acgtttgcctgagccgtgttgccggggaccagcgacctttcacccctcccttcccacaggagcgccccggcccccgcccccgccccaaccgccggcgcgcgtcctcaccgcgcacgcgctcccctcgcgcgcgcacacgctcgcgcacacacgctccctcgcccccgcccgcggagttccccctcacccctcagccgccccgccggctgaagcatcggcgctgggaggcggcggcgctgctga

SEQ ID NO: 3110 - DNA, 201 bp, Homo sapiens
cggcctgctctgggctcgtgaggcgaggccgcagcgccccgacgccgggtgggcgtgtgggtggagtggagacttgggtccctcggcgcatgggagtcccgccgcctgcggtagggaaccgcctcccacccctggcccggcccgggccgggagccgtgtcccgcgttgactcggtgtaactctccagctcatttctctcca

SEQ ID NO: 3111 - DNA, 208 bp, Homo sapiens
gagaattgaaaaggaaggcgaggagcaggggctgcgggccgggcttttgttgctcgcggtccccgggggccgcgccgcgccgggccacgtgggggctctcgccttccgagcgggcgtcggtgggaaacctgcgcggcgagagacagggggatggggcgcttttgacgcgactgtggggtgcgggtagtcctggaggaggatgtccggc

SEQ ID NO: 3112 - DNA, 257 bp, Homo sapiens
tagcgctctcgccctggccatggagcggccggcgcccggcgaggtggtcatgagccaagccatccagccggcgcacgccactgcgcgcggcgagctgagcgcggggcagctgctcaagtggatcgacaccaccgcctgcctggcgggtaggcgggcgccggggctgcggggaggcgcgggaccggggctgcgggagcggcggcggctgggggctggggggggtaggaaggcgaggaaggtacttgcggagagctgaa

SEQ ID NO: 3113 - DNA, 350 bp, Homo sapiens
aaagtgcttgtaaagtctgagcagagtgcgcggggccgagcggggagaagggtgcggggtaccggggtgagatacaggaaagaggaggacggtggggagcggtagaagacagcgtccccaggaccagcgactctgtggctcactcggccactgggtctcggcgcaaaccctccctaggcagtgcgggcgatgctgactgcagacgtcgggcagggctttcgtgcgggcgggagcgggggaagccagtgcgcccgggcgtcagctagttgatgcgggaagaggctggggagctgcagggccgtccgcccccgggtgcggtgctctggcgcagggcctgggctgagccgttc

SEQ ID NO: 3114 - DNA, 216 bp, Homo sapiens
ccaccctgcccgctagtacatttcagagtctctaacccctccctgcatgcaagcccaggcagagtcctgccaggtttcacaccagagcacacccctgcacggactccccaggaccgcggcgccggctggctgcctcggccccccgcggccgcgtgagctccctcttggtggtggagggcgcatttcaatctggaaactcccagcccctaatttggt

SEQ ID NO: 3115 - DNA, 269 bp, Homo sapiens
ccgcgaagggcacaacctgagaagcccgtggcagcccctcgcagcgtcgggtgacacagggctcccccacccccaggagaagtgggcaggagagagggccgcccgctgctccccgctgcgtccagggatggagggccccaccacccatggaattgctggcccctctgcgtggcccgggacttcagccgtggcttcgcgtcaagagggtatttttcctaaacgaaaccgcttcgttcgttcgttcgttcgttcgttcgggcagcaatgcc

SEQ ID NO: 3116 - DNA, 258 bp, Homo sapiens
agcaaaactcccactaccctcccggtgcttaccagtccgctcctccaggcctctgggaccatctcactcaaaagcagttcctctcagcggggtccagatcgtccctgagatttcgctgagaaactttcagcgggttagcgcttgggcgctgggcgccgagtccgacatggctttctggatgccgttgatttgctcgccggctgttcagtctctgcctcatcccggggcgcagaaaggggacgggcaggggcccgatct

SEQ ID NO: 3117 - DNA, 224 bp, Homo sapiens
agcttccagggatatttgaggcaccatccctgccattgccgggcactcgcggcgctgctaacggcctggtcacatgctctccggagagctacgggagggcgctgggtaacctctatccgagccgcggccgcgaggaggagggaaaaggcgagcaaaaaggaagagtgggaggaggaggggaagcggcgaaggaggaagaggaggaggaggaagaggggagcaca

SEQ ID NO: 3118 - DNA, 256 bp, Homo sapiens
ggccgtgtagcccgccccgctcctccttccgaagagagatctggtgctggcatgggcaccccgcggccaccggagtggcttcccggatgagcctggcttcggcgctgacgctctggccctgggggctgcctggctggtgtcaggtagcggaagacgcctggagagtcactcgctccttcccccacccgcccccaccgctgctcgtgccaggacgcgcagtttgcagttgcagctcaggcactggcgcgggatggcg

SEQ ID NO: 3119 - DNA, 310 bp, Homo sapiens
ctccgccgctccggaggctggcggtgagggcactcgggcggcaggggcccgccgaggggtcgtggcacacgggtaagggggccaacccggaatggcttccgagcagctccacgtcctgccaaggacggtaggtgcaagggtcgggggactctctgacggggtcgtcccttcgggcacggggaggttcccaccgagccccaaccctgaacggggcagggggcagagctcttggcaggcaaggtctccggaggagggaacggctggggagtggcggagccccggagtggtggccctgttaacgccccttccc

SEQ ID NO: 3120 - DNA, 410 bp, Homo sapiens
aaggatccacccagacgcacgcccgcgcggagacgcacgctggcacacgcgctcacacacgcgagcacacacacgcgcacactacccggttcgtgcgcgcgggtcgctgttcctgttgcattatgcaaaggtggctgggaaagcgcgttgacttacatttacatagcccatcttctccccacagtatgtgactaatacgtatcccggggaggagggagcgcggctgggggtgctaatcggaagggaacagacagtgagtgccatcttgctgggaggttccagaagcaaagcgccaacgacgacagtagcggtggcctcagctccaccagtaactgccgctggcaggagcaccacacgctctaggagtttcccgggtatcaagtatgggtccagcccgtcccagttatcct

SEQ ID NO: 3121 - DNA, 274 bp, Homo sapiens
agaccgagggaacgctgctcatgcggtgagagccagcgcgggaggcggcgagggcgcggggagaccggggagggggtgggccccgcggcgcccgccgcccgcccccacgcgcgctgtcggtatttgcccgccttgctgcaacttgctgcagtgtttgaaagagtagtaggagcgcatggaggtggggccggggaaagaccaggcggagtggttgtggggtgagcgcggagtgggtggggaggcggcggcggtggggaggggggactggccccag

SEQ ID NO: 3122 - DNA, 201 bp, Homo sapiens
gccgccgccgccgctgcgccgctcttcacccagagcccggcggcgccgccctcctctcctcccgcgtggtggcggggcatggcatcaccacgggcaccgcgagggggccgccagcgcctgcggcgggggcagcggcctcatgtgcgccggcgggtttcaaggaggaagccggcggccgacggggcgcccgccagccagaga

SEQ ID NO: 3123 - DNA, 265 bp, Homo sapiens
ggccgggaggcgcggagccagccgcctacggagcccaactgtttgcatcggggaccggcgggcggggcgcgcccgagtggtctcgccgggaaagggcggcgggcgctggagaaggcgcctggcgcgaagctgggcggcgccccgagggcggaggacaggtggccgcgcgaccgcagccaggtagcgaacggctcgggggctgcgcagcgcggtcccaaagctcagcccggccccgggcccagctcgctgccgcctgccacgggag

SEQ ID NO: 3124 - DNA, 201 bp, Homo sapiens
gcgcagggggcagctgcgcataacgcgctcctggcagcgcggcggctgcgggcggggcgcgctccacgtgcttgaaggcggacgcctcttccggggggacggagagcagagggaagccgcgcagggccccagagcagggcaggccaggcggcggcggcggcggcgggtccccagcgagcaggcacttgggatggtggtggt

SEQ ID NO: 3125 - DNA, 362 bp, Homo sapiens
tttcaaaccgagtcctcgggtgtgcagacccgcagcggagtcgcgggagcgaggtgggaaatcctggccgcggcgccgggctccgcccgccggggggcgcggggcggcgggcgcatgcgcgtgcgcggtgcggccccagccctggctgccgccgcctgccgccgccgtcgcgatgcctattttagtcaaagcggctgcgggcttggggacccggcccgggcagcggagcttccggacccgccgacccgccgaggagcgcgcgtcgggctcccgtcgagcagctgagcccgtgtgccccgcgtcccgcgccccgaagctgccgctccgaactttggtcggcgctgcccaggctccccgccagg

SEQ ID NO: 3126 - DNA, 298 bp, Homo sapiens
cagcggagacggttaagtgttttttcattaactctccttccccggagctcaggggtgctgcatgggcggcgcttggacccgcgctctggagtcatcaggcggagcaaagccagcgcgctccgcggctcggaatccagctggctcgctaccctcccactcctgcgattttactcccgaccgcgctccagggcagaagcgcctgagctcccgctagtgggcatttaaagcccatgcccggcgggcgtgctgacgccactcgggggctgcggagcgggagggggcggtggggggcggggac

SEQ ID NO: 3127 - DNA, 295 bp, Homo sapiens
gaaggacacgcaaacctgccgagggctcgggggctccgggctgctgctgctgccagcgtcctgggaagtgacaggcattaggacctgctggcgcggcggcggcggcggcggcagctccagccgcgcccgccacacataccttcactcgctcggtgcacacgccgcgccgcgggcagtgccgcctgcggaggcgcgctcggggcccgcaggggcagcagcggcagcctggcagcgccgccgcgccctcgggcatctggcccgcgaagtttcgcccctgccgctctccgcgccgctc

SEQ ID NO: 3128 - DNA, 203 bp, Homo sapiens
ggatgcggccgcgcaggcgctcgctccctggcttcctggccgggtagcgggcgttcggctaccggagtccagcctaagggcccagccgaggtctccccgcgcgaggcggttgcgctaggtgagcgggtaccgcggccgcgcctcccttgtcatttactcagcggtcagaggcatcctgcgtctgggagtcccaagtgccttcg

SEQ ID NO: 3129 - DNA, 215 bp, Homo sapiens
agccccaaacctcacgccataaagccccgaagaggcgggttgggggcgggggccggggcggacttccaggggcgtggctgcgcgcctgcgaccccggaccgtgccaatctcgccgccgccccaaaacctgtgggaaaccccagtcctgccacccactcctcctggaggacgcagacaggatctgctctgcaggagcccaggccggccgatccgcg

SEQ ID NO: 3130 - DNA, 201 bp, Homo sapiens
gggcggcggcgcgcgggggacccactccgtttttatttgacctcgggtgactgcctattgtcatggtttgcgatctcgcgtggggaccgcccagggcctcggggccctggatgtcccgggtggcgccgccgtaatctccgtgccctccgcgccgcccccaccccgcccccacccgggccgactcgagcggctgcagcctcc

SEQ ID NO: 3131 - DNA, 340 bp, Homo sapiens
cccttcgagcactcgccccgggtccccctcaagcagctgtcccggccccggacccctacttgatccccccaaccgacctggcagggcacgcatacctgacgcccattttgcagtcgagcacacaaggtccgtcgaagccatcgagcaggtcctgcagctgcaggtagctttcgccgtcgcgctccaccacgccgtggaaggcaggcacgcagccgcgcagcgcgtcagccatcagccgcgccaggcagtagcgctccggctccgagcagcgcttcaggatcagcccgctggtgcccgccgccttaaaactccctgaggaccggcatccgtcagcgccgcc

SEQ ID NO: 3132 - DNA, 201 bp, Homo sapiens
ggcggagggacagagctggactcggaagccgcgggtgggagctgctcctcgcgagcccgaggctgctggcaccttgtcgcgggcagcccgcgccagcctcgggagtccctgggctccgggagagcgagccggggtcgcctggccacaaagatgcccgcgcgcccgccctgcgtacgggacccgccctgcgccctgagccct

SEQ ID NO: 3133 - DNA, 236 bp, Homo sapiens
aacgctcggccaggtcccagagttcccgcggagagcggggcgcctgctgggggcggccgggagggccgggccaggggcgcgggagaccccgcggggacgcgaggtgttgcgggttttgtgcggttggttgggaacgaggagaatgtgccatcaacagtgtccaatcgactgatcaccttgggtgctgtgtttcctcccttatctctctttacctttgggaaaatgcactgctcagg

SEQ ID NO: 3134 - DNA, 251 bp, Homo sapiens
gtgcctgaatctcccgggacacttagacggctggagcctcccgactccaaggcgggcgacggcaaagttaaacgccagcgcgctgcggtccccgggcaccgaggcgtccccgctcccgccacccacacagggcgccaagtgccccgacccgcgagtgacgaggacgcacaggctagtgacacgacccgtagccagcactgagcgggacgacggggcccgagcgcaggagggtgcgcggggagctgaggagc

SEQ ID NO: 3135 - DNA, 201 bp, Homo sapiens
tgagcagctcaggcagccgcggtggtcgtgaacggggcgggagtggggggtgcccaggccatcagaggcggccccgcggcctgcaccggctggagtgggcgactcagagtctgagtggagggggcggggggcggcgacagcggggggtcctggcagcgatggcctgaacctgcgccggtgggggatggggcgggggcgggg

SEQ ID NO: 3136 - DNA, 206 bp, Homo sapiens
gcgctggggaagggacctctcggaggcacggggcagcgtgcgggctgcggcagcgaccccgacccgggcccccgggctttgtcgggctgagcctgcgcccgctccgccgccgccaagttcctccaactttgcccgctgcgctcggatcgcgcgccaggcctgggggcgcagcaggggctgggggcgcacgctgcgcactcggggac

SEQ ID NO: 3137 - DNA, 201 bp, Homo sapiens
gctccggctccgggcgccgaccaggtccccttggcccccgccgcgcgccctccaacctgctgctgccgccgccgcgccccccaggctctgccagctacccgcgctctgagcccggggccagattcccatggaagcgccgcgatgttcgccccccggctgctggatttccagaagacgaaatacgcgaggtgagcggcggcc

SEQ ID NO: 3138 - DNA, 203 bp, Homo sapiens
tgggacttcctttccaaaaacgtaggcgttttcccgggtcgcagtcgcagtcgggagactgagggttagggcgcggccgcggggtctcctgggccggggcgcggcccacgtctcaggcctctgcggctctgaccagaagccgctgcgcctttggccgcttcccacccgtcccgtccccgcaatcccaggcccagggttacagc

SEQ ID NO: 3139 - DNA, 216 bp, Homo sapiens
taggggagacgaatcgattggctgcccggccgccggaacggcaggtcccgtcgctcccctcgcctcccgcattcccggcccggtcccctcccatcaccgcgtcccgccccaactcgcagtcagcatccccttcccatcctctccccgtccccgctgccacttccttccttggatgttggaagcgcagctggtattttcgttctcccaaccccccaa

SEQ ID NO: 3140 - DNA, 335 bp, Homo sapiens
gcccacccgccccctaggtgacccggcgtcctcgccgcgcccgctggaagtttgcaaactttctccgggggttccgccgccacgctgggaagctggggacgcggggggaggttcctggctcgccgtctccgctgccgcttgaccgcacttctggagggctccgcaccttgccaggtctctggaggcaaacacacacccccgattcataactggtccccgcgtcaggggactcgcgcgctcccacacacgcacgcacgccgggcggactcggcgccggctccacgttagcatccctccaggcgcgcggcgcggcggccaccgagcgctccggcact

SEQ ID NO: 3141 - DNA, 230 bp, Homo sapiens
ccgggcgctgacagacgacttttctcacttgtcagttttctcgcttgtcagcagagctgctggtaagtgagagaaaacagaggggcgcgaaggcaggcgcggccagggagtgagcggggcgctgggcgcggggcggagccgggtgcgcggcgtccgggtcaggccccaccgcccgcgccggctcccgctttgctcagccgccgcttttctctcccttctcactttctctc

SEQ ID NO: 3142 - DNA, 224 bp, Homo sapiens
agcgcagctatttgaaggctcccatggtccccggcgcctgcgtttgaagcccgccttcaggctttggggggtatttgcagaaaactcccagcagcggctcgccaaccagacctcagggtgcacggggggtggcgccggtaattatggcaactctcaaaataaaataatataaaataaagtaaccaacgttcaccaaccaccaccccatctcaccccctgtactg

SEQ ID NO: 3143 - DNA, 211 bp, Homo sapiens
gggacacgcagggggacacgcagggactgcccgcgcgaatggcttcgaacgcatgcgctccaccctacatttcacagtcgccatgacgaccgggaggtccgctcgtcaacggctagtcaacggctgcggggacaagtccgttgaggctgccaggcgagtcaggcctttctggacctcgcctgactcggatgggctgtgcctgaaattgacc

SEQ ID NO: 3144 - DNA, 205 bp, Homo sapiens
ggcggtgccaggtcggggcggggggcttctccacccagcacggggcaccaggccgggatgggacctttttccagaaagtcgattggatgccaggagaggcgtacggctgggggtttctttctttctctttcccctccctcccgcggttgaaccaaatcagaactgtcactcagggcttgtgagtcagaagggatcggattacacg

SEQ ID NO: 3145 - DNA, 398 bp, Homo sapiens
ggcgcgggccccggcgcgcccagcagctcggccagcgccagcgcgcccgccagcaggctgagaacggccagcgccttcagcgtggccgcctgctccagccgcagcgtgtagccgcggaacagcgcctccagctctgggcaagcgaactcctcgtcgcacgcccggagcccgcgccggcggcttgtcccggccgcccgctcggcgcccccgggctcgcccgcgccgcctccgccgccgcctccgccgcgcggcgcccccgccatctcagcgccatgcagcggccgcggccgcgggcgcgcccctcgccggcccggggcgccggggcgcgggcggcggcgccggggcgggcgggcggcgggcggcgaggcgccggggcgcggggcgcggggcgggcggag

SEQ ID NO: 3146 - DNA, 290 bp, Homo sapiens
catcgcgccgcggccccgcacgggatgcggcggccggcgctgtgtccgcgggccgggcagcccggctcggccgcggcgctgcgggacccgcgcgtaacccgtgggggcgcggcgcgggcgacacgtgcgggccgccaggagggggagggggacgcgcgccgccgggcccgccaccctgcacccggggccgctggtcggtcggggcaccctcacgctcgccccgctggcgagactggagggactcgggacatcgtaaagcactttccccagtgtctgggagcgcccgctgt

SEQ ID NO: 3147 - DNA, 307 bp, Homo sapiens
ccaccgcagccggttccggccggattcaaacagcctcttccccattctcgggacacccactccacgcactcaccatttcccagcctccagatgttccgccgtcctccctatggatctcccagtacctgcaggtcacaggataacagaagctatagtagagtcaccgaggaactccaggaacggaggagatggaacagtggagacgcgaactaggatcagagcccggaagctaggagacaaaggccccgccatattgaagaggccgcctcttcctctgtagctgcgcacttgattggacagtttcacg

SEQ ID NO: 3148 - DNA, 212 bp, Homo sapiens
gggggtggctgtgggtccgaagtggaggacgagcatggtttgggagataaggaaccgtcctgagacagagaaggctcccgggagcggacagagagtgggcgaaatcggtgcgcagtaatcgcggcgccagcttcagcgcggcccctggggcgcagtcccaccccgcctcagcagctgcggagccttctgacgagcctccgcctggcagcact

SEQ ID NO: 3149 - DNA, 375 bp, Homo sapiens
cagggcgtccccgtctggactacaggagaaagtttgggaggcaggttcaacttttcaacttggcggggaattcctctccctcttacacagtttgcagcgcgggggcggcggggtgacagtccccgtgcatgaatcagccacccctcaggctccgccccggcgggggtcggccggacgctcgccccgcataaagcgggcacccgggccgcctggagcagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagcca

SEQ ID NO: 3150 - DNA, 201 bp, Homo sapiens
ggcggcatggagcgcagtggctgggcccggcagactttcctcctagcgctgttgctgggggcgacgctgagggcgcgcgcggcggctggctattacccccgcttttcgcccttctttttcctgtgcacccaccacggggagctggaaggggatggggagcagggcgaggtgctcatttccctgcatattgcgggcaacccc

SEQ ID NO: 3151 - DNA, 356 bp, Homo sapiens
gggcggggcggcgcgcgggggcgggggagcggccgggacacgtgtggcggcggcgggggggacgcggcgcccggggctttaagaaggtgtggagcggggcgggcgctttcccaggcctggccgaggggcgtcgcgcagaggcggcggcggcgcacggaggcggcagacgacgcgctctcggcgcccgcagccccggtcccgcgctcccgcggcccaaagtaactttgggagccgccgtctcccgcggaacttctcggcgggggcccgctcccaggcccgctcccgagcccgttccgctcccgtccgccttcttctcgccttctctccgcgtggctcctccgtcccggcgtctccaa

SEQ ID NO: 3152 - DNA, 265 bp, Homo sapiens
atttccaggcaccactcgagtctgccaattccactttcgcttaatctcattttaaaatcctctacagatgaggctctgtcgctgccgcgaggggccgggcggccgcggcgggagggacagggggcctgggtgggaagggagcgcgagggcccctagcggttcgcggcctcgggcggattcccagaacgagtgcgggccgcccggactggcagactgcgagccccgaggggcgcgggacgcagccggctcagacaaagaaaccggc

SEQ ID NO: 3153 - DNA, 697 bp, Homo sapiens
gcggggaggcggcgggggcgggagcgggcgaggggccgcggtcggccggcgtccgggcctcgacccccgggccggccaggggcgcgccgagcagcaggccgtgcgccaggcggaaatgctccagcaggtccccgcgcaccgggccgttcggggggcagtaggggcaggcggcggcgggcaggccgagcgcgccgggcggtggcgcagcggggcacgagtacttcttgtgcgccaggtaggcctcgaggctgtggaagctcacgcggcaggccgtgcactcgtggtagtcggccagcgccggtgccggggctccggggagcgggcgccgcggcttcttgctcaggtcgatggggccgtcggccgcggggccgggcgagcgcgcaggggcgaggccggggccgcttccgcttccgcttccgggccgcggcgactcgggcgcgggggcgtggccgggcggcggggggggcggggcgccggccgcgtgcagctcgtagagcttgcggcgtctgcgcgtgcgcacaggcgcggcgggagagggggccgggggcgcggccggcccagggggtcccgggggcgcggccggtcggcgcggcggcgggtcgtggcgcgaggcgcagtagtaccgcttgtgcacggtgtaggtctcgtggcggctgaagcggatgttgcaggcctcgcacagcgtgcggctggggtc

SEQ ID NO: 3154 - DNA, 226 bp, Homo sapiens
gcagaggcgcgcagaaaacgcgcgggtggcgcgcgcggccacccagtgggtcccgcccgcgccgccggcgccgccgccgccgccgcacgtgcgccgccgcgagcgcgaagggcgttcggacccgcgctctgcccgcccgcctgcccgccggggccactgtggacttccaggtaacagccaagtgagaagccctccctatcaccgaaaggtgtctgcgctcctccca

SEQ ID NO: 3155 - DNA, 201 bp, Homo sapiens
tctagggaggatgggggtcgcgggggaagccgggcgcttcggggtcctcgacacccacatccccgcacggcgcacgctctgcctcgagtttgcgttctccgagttagcacggcgagcttgggatttccgtgcccctcttttgtggctttcgagaaacgccggagttccgtgtcctgctgggggttggggggatggagaaaa

SEQ ID NO: 3156 - DNA, 201 bp, Homo sapiens
cttggagatgtgatcccccaaaagtttagtcggcgaatgggagactgaagggtgacgggaagggggcaggcgcgctcggcgctctgactgggcgtgcggcggcaggattttaaagcgctctgcctcggatcgtctgccctgggtgacctcccggacctgccctggtggaatccggacttgccccgccgagatgacgaggta

SEQ ID NO: 3157 - DNA, 215 bp, Homo sapiens
agaggaggaaggaaggaggaaagaggaagacgggcggccggaggcgcggggctgcgcggcgccggccggcgcggcgctggaaggcgccggcgttaaccccgcgaggcaggcgacggagggggagcggcgctaatacataagagcactgcatcacgctaatcttctcccagaacagtatgcgtcagcagtacattcacgttctgactgaaggacaa

SEQ ID NO: 3158 - DNA, 252 bp, Homo sapiens
ccgccgctgctcgggctccggggctgggtggaggaaaggggtgttcggaatcgatccccattttccgacctttttgttggacattacgcccaccttggacgccgcaagagaagctgtcaagccccgcaggctctgattcggcgccctccgcgttcctcggctgctcccggcttccctgtgcctcggtggagtatttgcgttcggggctggggctggaggaggcagccacacgcgcgcacacgcacacgttca

SEQ ID NO: 3159 - DNA, 203 bp, Homo sapiens
ggcgggggagtgagcggagtttcccacaatgccccggtgcggtgcagccgcggatggatgctgcgggaaggggctgccatttgctgcccctgccagcggcgcgcggacctgcccgcgctcctgcagccgccgccgccgccgccgccagcccgcccggcccctgcagcggcgccgcctgcgctccctccgcggccgccggagcg

SEQ ID NO: 3160 - DNA, 201 bp, Homo sapiens
ggccggctccatgcggggcgctccgccgcgccgcgcccgcgctcctgcaccggggtgcggggcccagcccgacgcgcactcggcgctccgcgcgccctgcgggccccccaggccggcctcgggtgggctaggaccgcggcgctggcaggccggggctgagcccggctccccgcgctggagcctctgcgccgggtgccgccg

SEQ ID NO: 3161 - DNA, 201 bp, Homo sapiens
tgaaccccagagggctgggctttgatttgagtgccgatccgttaatgaggacgggaggataaggttgccgacgcagcggaaggtaggggggaagcgactcgaggacctgacgattatccccaggcaggggcttcccaagcaggcacggaaaccaacttcaccaaaccgcggagtggggactgggcccgggcggtgttcagc

SEQ ID NO: 3162 - DNA, 201 bp, Homo sapiens
ataacccccggaaggagggggttaaatgcggcagcggcgggcctgaaaagggccaggagcgtcgtaggaactggggtgcacaggccctcgcgtgcccagcgcttcgcctttccccgccccaggcctgccaggggcgcgcgtggcgcgggcagagcctggtgggtgggttggcgcggacagaagctctgccggggagcgggg

SEQ ID NO: 3163 - DNA, 213 bp, Homo sapiens
ccgaccgcgtctcctgcgctcgcccgcgctttccctgtcgcttcgcggttcaggggtgtgagtcacccggcgacagccccgccaggtcaccccggggcgcgtaggtggacacgcacaggaagatcgctatttttaagatttccatattgtttaccgtggggcgaaatcccacaattccttgcacaaaatgcataaataatattaaatgagctg

SEQ ID NO: 3164 - DNA, 385 bp, Homo sapiens
cttgcacgcatgagcaggtactcaacactttctggtccagctacatgtgacatgaggccactcacgctctttttaattaacccttatgacaatcatgtgcgttatggagaaaattaatggaggaaaaattacagagtcacccgaaacagttgcgctgcttatcacccggtgtttgagcctgtttcccctgtaattagattacatgtgaggcagccccagctaattgtctgtgccacccaccggggaactccagctctatctgtgaacacccaggccttcccgccgcaggacagatgttgggtgaggcttgcctcccacgcaaacatctgctctgttgttccgagtcagtcacgagagccagccggcttagacaagcaggggatga

SEQ ID NO: 3165 - DNA, 278 bp, Homo sapiens
agggcactaagaaaagaggggcatgcgagcctggaagctggagagagtccggggctccccagagcgggtgggacgccgcgtccccaggactccgcgccacgcgtactttctccaccccgacacccactgccactcccacagcggagcgaggggccccgccgagggcgagcgtaccccgtgcggctgagatgcccggaacgcctccccgcgccccggcttccccagaaggggccacagtcggcccgcgagtccccgggcgggggctgagccgcagtgcc

SEQ ID NO: 3166 - DNA, 248 bp, Homo sapiens
tcggcgcaggcgagtttggtccaagggctcggatcgggtttgggaaaagtttgtccctcgagggggagagcgagcggccgcgctgaggcgctcgcgctgcgcgggggcgtctcccgttgcctgcagggagcgcggcgcggacgcggcgggcggtccggccacctggaacgggcgctcgccctggctctcggggctgctcctgtcgccccgggaagtcgtcgatgggtcccaccgctggcggctcgcgt

SEQ ID NO: 3167 - DNA, 216 bp, Homo sapiens
tcgccgccgctggtgggtggcggcggtccgggtgctttctggattgcgcagtaaagaggcatcttgggagatggggccaaggttttagggggtgccactcgcgaacggttcatccgctagactaggggggctctttggctgtgcgtctggccagaactggccttgacgatggaagtttctggaaccaaagcgttgctttctctcccttgtgttata

SEQ ID NO: 3168 - DNA, 201 bp, Homo sapiens
gcacctaccagggcgtcccgtaaaaaacctcgccttcgcctgtctctgggaaccataggtaagctttgggctttcgaggtgcagttctaggtagagctccgtgctgggaggtgggaagggggcttgaccctggggactcaggcagtctggggacagttccaccaggggccggtgcctagaattggtgagggaggcacctca

SEQ ID NO: 3169 - DNA, 208 bp, Homo sapiens
cgagacggacaggaatcgaggagattcccctgtagcgctctccaccttccggacagaaatcctgtagaccacgttcacttctccactccgtgcatcgcccgtggcccgtgggcagcagctgctcccctgggatccccctcgcctgtccgcgagctctcgcacggccgcgtccctgctgctggggtcgctcgctggccctggctgctcg

SEQ ID NO: 3170 - DNA, 201 bp, Homo sapiens
acttggtttaatcgtcgccagccctaagtcacggcctcggctccctctcctcaactgtgtgggatcccgccgcctggtttcggccgggcggaggggtgacgtcagccgctcacacagtgccccctggccgctggagctcgggaaatctgtgcgctcgaacttggctccgccaagaagctgggcaaggatccgggctcctga

SEQ ID NO: 3171 - DNA, 364 bp, Homo sapiens
ggcggtcagcagggtccccgtccccggggagaagtgcccacgatccaagggctgtctgctctaggaacttcttaaagaattacagacactgagagcattcggggtctggtaggaagtgcagtgtatctcccagctttagggtaactaggacagcatgaatcttttaccttgtggtagaataaacggctagcgcctcgatgtggcgcgctcgacttttcctcacagagcctaaaagtcacgctcaaccaaactgcagcgttcccgcctcagctgggcaccggcctggaagcggcctggaatcagactggactcgaggaggtaagacctcggcagcgcgaggttaaccacaggcctcacccgcggc

SEQ ID NO: 3172 - DNA, 213 bp, Homo sapiens
ttctccaggtccttggcgctctcggcgcggctgtctccgcggctgtcctcgctcatggtcggcggcggtgcgcagcgcggcgctgcccgccgtgctgagcgctgacccgcgcgcccgctgctgcccggcccccggcggcgagaatggaaagttgccgcctccgccaactccgaggagagacagaagactttacatgctggggagaggctgggc

SEQ ID NO: 3173 - DNA, 201 bp, Homo sapiens
ggtttgcttttggaagaaccggttcctcagccccccgtcgccgcagttgtgacacaagtaagtgcagccgcgctgcccggggcccgccagggtcccccgcgcccgctccccaccgtggctcgcggcggccgcgctcccgccccgccccgctcggccgccccgccggcttctgcctccagttgggttgccgtgacgaggaga

SEQ ID NO: 3174 - DNA, 201 bp, Homo sapiens
cccacccatcgcgcccaaccactctgtacagttggcttttttttttttttaagtacagtttaagaaggcaaagggagataggaaagggtggcagcttgacgactcagcgatgcattttagaatcgcccttacctctccagtgtgaagtttcctgggagaggtgagccaaaccggacggccggcctctgcagccgcccagag

SEQ ID NO: 3175 - DNA, 296 bp, Homo sapiens
catcagccgggctggctgggcggctcgggagcccgagcggtggcggagcggcgagcagcgagcagcgcctgcgggagcggccggtcggtcgggtccccgcgccccgcacgcccgcacgcccagcggggcccgcattgagcatgggcgcggcggccgtgcgctggcacttgtgcgtgctgctggccctgggcacacgcgggcggctggccgggggcagcgggctcccaggtaagcccccgaccgaggtggggggcggcgggcgcggggggctcgggcggccgaggcgcggtcccgga

SEQ ID NO: 3176 - DNA, 201 bp, Homo sapiens
gtttccagcaggcttccatctcatcctcctcgtcgtccgccgagctgggttccaccaagggcatgcgaagccgcaaggaaggcaagatgcagcgggcgccgcgcgacagtgacgcgggccgggagggccaggaaccacagccgcggcctcaggacgaaccccgggctcagcagccccgggcgcaggagccgccaggcaggg

SEQ ID NO: 3177 - DNA, 297 bp, Homo sapiens
tgcactcccgacacggagttggtgctccgggaaggctgctctctgaagctcttcttgctctgctgtggttttgctcctccgcggactcctttcccgtgccgaggttcagtttctggttttaaggaataaattcgctggcttgaaagggagctacggcagaagtttaggggcagagcggcgggagcgcgcgatccgcgcggctggagctccgggggtatctggagagcagcgcgtccaagcggggccactggctccgcggctgcgcccctcctcctcccgcgccgcgcctccctcccc

SEQ ID NO: 3178 - DNA, 268 bp, Homo sapiens
gtgcagcggggtctggcgccggcccctcctcatcacgcgcccggcccagggtcgctcagccgccgccaccgccgccgccccttgggtcgatggagtcggcgcggaaggcccgcgcgccctgcgccgccgccgctcagtgccgccgccagcacctcctccgcccctccgcctcccgggctcatcccgcgggggcggcgtcacctcctcgctgcccaggcccgggcaccgcgggcgccccgcgggcggcagccgcccctcccgagcgcga

SEQ ID NO: 3179 - DNA, 201 bp, Homo sapiens
aaggagcgggactgcccctccggctggacgacagcgccggggactcgcagcgtgcgcgggtcggaattaaaaaagcagcccgggagcgcgagggctgagcggggcaagcatgggctgctcctcgcagcctctctcctgcccgaggctcgggctggccgtctgtctgtctatgactgtctagttgtcccttcgactgctcag

SEQ ID NO: 3180 - DNA, 201 bp, Homo sapiens
ccaactcgtccgcagctgcccgctctggattaagccgctccgcggctcgtgctaggcagtgggttcgcttcctccttccctctcttctttaaattgggacgtgcgaaggcgcagctgcctccccggggctctctccatcccccacacaccctgttttcgcttcttgtctctcaggttcgtggcggagagatgctgatcgcg

SEQ ID NO: 3181 - DNA, 201 bp, Homo sapiens
gccctggagcctagcagagctggagcgcatatccccgctctctctccttcgtctccgagtactaggcggacacatccgtacctcgaatgcctcagtgggcgcagagttcaccagaaatggatagccggattcctcggcgcctgctgggggcaccgctgccaggtgcttggggctcgctctcccggctttgctcgcacaggg

SEQ ID NO: 3182 - DNA, 201 bp, Homo sapiens
ggccgccgggcgctgcagtgggacgcgcgcggctgtgagcctgcgggacatgccccccgcgccggctccttgctggcggccatgaagaggcagaacgtgcggactctgtccctcatcgtctgcaccttcacctacctgctggtgggcgccgccgtgttcgacgccctcgagtcggaccacgagatgcgcgaggaggagaaa

SEQ ID NO: 3183 - DNA, 302 bp, Homo sapiens
cgcccggacgccggagggccccgacccccgcgcggctcatgcgcccgcgtccgccccgctgctccgcgaggcccgcgggacccctcccgccgccgccgccgcgcccgccgcccccggaggagcgggctggccgaccgccaccgcgccgtcccccggccgcccccgaagccgctccatcgcggtccctgccgtcctggggccgcgccccgctcccgcgccttgggggttgagccgagcaaacttcgcgcaccggccgacgcccggcggggaccccgctgcgcacccgcgcgcccgggtgggcg

SEQ ID NO: 3184 - DNA, 201 bp, Homo sapiens
cctccctggggcccttcatgccaggccccgcggctgtgtccgcaagcgcagatggtctcgggactcgggccaccctgacgccgcagacccagcacgctgcggaccgggcacgttggatctcgggacaagtgcggagggtcgggggctggaagggatccgagagcagagcccgcgtccccatttcacggacgcggccaccga

SEQ ID NO: 3185 - DNA, 220 bp, Homo sapiens
cggcccgccgccccgcacctgcgcccgcagccgcgcgcccgtccgcccgccgccgccaggccccgcggcccgggcgcccatgccgcgctctgcgcccgccgccgccgccgccgagagccgcggagcgcagcccgagggagcgccgggcgggggagccgagcgatcgggggcggggcggggggcgagagctggcccggggcccggcagtcgcccgccccgc

SEQ ID NO: 3186 - DNA, 347 bp, Homo sapiens
ggcggcacaccggcagggcggccggccttgctgggctctctgggcgccggccccgggggctcgggcggcccctttcggtcctcggcctggatccgcgaacgcgcgggcgcgaggggttgggacgcgggagcctcttgagtgcggagcgcggagccctggtgtcccggcgcactgcagccacactcccgggccgcgcgctcccgccgcctcttacccgcgccgcagggtcctcccctttgaggcgccgcccgcgcaccgccgggggggagggggcagcgccaacaaattggggagctcggcccgccgcgctcaggtctccgcttggagccgccgcacccgggacggtg

SEQ ID NO: 3187 - DNA, 201 bp, Homo sapiens
cgtgcacgccccgcttttattggctccgctccgtgaccacgcccccgcaaccttgatagactccacccccgaggacccttctcaggagcacagtgaccccgcctccacagggtccgctccgccacactgacccttccgtgtcgctcgcgggaccccacccctgtccgcctgctccggtgcccatggggaagcctggtgcca

SEQ ID NO: 3188 - DNA, 201 bp, Homo sapiens
cagactcgggggaattaggaaacgcgcccggcgaccctcgggcagtagcaccgggccaggtttgctttcggaaccgctgacgccactcgccgcctttcccgcctgggcctctcgcgggtcgcaggggtggaagcccgacctgggccagggcccggatttcttcctcccggcctctgcgccgccgcccccggtgccaggacg

SEQ ID NO: 3189 - DNA, 225 bp, Homo sapiens
ctgcagcctgggcaaccgagcgagactccatctaaaaaaaaaaaaaaaaaaaaaaactaaggctgaacccgggctcccgcacgcccgcacccacctgcgcggccatcacgcgctgcctctcggcgatcaggttgcacttcttgcactggcagtcgcgccacatgcagaagcgcttgtggcccttgagcggcgaggcgtagccgtggttcctgcagcgtgcgcact

SEQ ID NO: 3190 - DNA, 318 bp, Homo sapiens
ggccctggcagagcgcgcagcgagtcggggatgaggctctccaagctctcgttggcctgctgccggcgcagcgccacctgcgcagccatgacccgctgccgctcgatgatgaggatgcacttctcgcaggtgcagtccttgaagcggcagtaacgcttgtggcccttgagccaggacaggacgccatggttgcggcagcgcgcgcacttgggcgtgcgctgcaggggcgcccgtggcggctgcgacaccgggccgcccatgtacaggtagggggagccgtagccgttcatgccccgggctcccgaatgagttggcagc

SEQ ID NO: 3191 - DNA, 265 bp, Homo sapiens
gtggagggaaggagggaggaagccagtcaagtcctcagcgacctagcccagcacatcccgaactctgcaaagttctgctcggtcttctgcagcctcgggcgcctcaccttgctgaggccgctttcggcttcctctgacccaggctgggcgggaaaggtcgggccgcccccgcctggctcagatcgctggctcacccggcgggcgcgcgcagttgcattcagcgcagcgccactggcttcagtctgcagactgcgctccccttcct

SEQ ID NO: 3192 - DNA, 259 bp, Homo sapiens
gggccgcggggtcgggggcggccgccgcctggctgggggatcggggccgtgctgggcgccgcggagccgggacagcagcagtggcggcggggacagcgccgcggctggggcctcgcgcctcctggagcgccttctgcccagacacgacgacttcgctcggaggcacatcggccctggggacaaagaccagagagagatgctgcagaccttggggctggcggtaaggacctccacccggccctccgcggcctcccctccg

SEQ ID NO: 3193 - DNA, 201 bp, Homo sapiens
gagcgcagaccaggcctccagggcgcgggagcctgttgctctcccctgcaggggccgctcccggacgccccatccgccgttacgtggtcccgggatgtgcgggttgcggtagagagtgggcagcaatgctcctggtcctgcgttctcgccttagccgcggggaccccgaggcgagccgctaattggtaccggtgccccgtc

SEQ ID NO: 3194 - DNA, 323 bp, Homo sapiens
acgcgcctgccggggaagggctcgccggcgccgcgccttcgaggctcctgcggcgaaccgcgtcacgcgcgactcctggccgggggcgggaggcggcggcggcggcaggagaagcccaaggcccgagcggcccgcagcccccacgcctgcacccctccacccccgccagcccgatggttcgctccgcggcgtgcactggagcaagcaggtcccgctccgagcgcgcgcgctctgggaagtgctgcaagtttggagacctggagtgagctccgggcgctgctggcccgactgtccgcggtgtttccccggtgaggtcgcggggg

SEQ ID NO: 3195 - DNA, 201 bp, Homo sapiens
cagcggcggcggccgagcccagcccgtagggtgggaactgagacaggcgtcccacgctgcccaccgcggctgccgcggccgccgccgccgccgccgccacggccgccgcctcctgcatcttgccggggtgagacggctgctgaggctgcgactgctggggcggttgctgcgggggctgtgacgggaggtgcggaggcggct

SEQ ID NO: 3196 - DNA, 355 bp, Homo sapiens
cagcgccgtatagaagtcgcagagcagcggcgtgaagtcgcggctcggcgcgcaccgggccgccgcgaagtacagtgccaccaccttgttctgcagcgccgcctcggcctccaccgtcgcgcccttacaggtcaccaggtgccgctcgcccagaatgtcaaccatggcgcagacacgcagccacctgagacccgaggacacctgcaggaggatgatcacctgcggggaggcggcggcgagcgccgcggtgccccgcctctgtccgcaccaccgggcgctggacctctcaagacctgccccagatgcgcccacaccttggccaggcctcgcctgtggctggagcaattgtgttcgc

SEQ ID NO: 3197 - DNA, 201 bp, Homo sapiens
tgcacctgcgtcgcttttggctccttcaggaatgcgctgaagcttgtaatcagctttgtgaagccattgagtgcacggctgagtgaaacttccaaagctcgaggaaaacgggccggctgaatgggagccagcatggggcttctctccaagcctccgcgctgccaaattccagcagagcccctcacaatcgctccgcgcggg

SEQ ID NO: 3198 - DNA, 290 bp, Homo sapiens
ctgctatgcgcggcagcccgcgccggggccggcaccagcagcgcccgggcggatgcagcgagcccacggaggggcatgcttccacgcaccaagtataaccgcttcaggaatgactcggtgacatcggtcgatgaccttctccacagcctgtcggtgagcggcggcggaggcaaggtttcggcggcgcgcgcgaccccggcggcggctccctacttggtgtccggcgaggcgctgcgcaaggcgcccgacgatgggcccggcagcctgggccacctgctccacaaggtgtc

SEQ ID NO: 3199 - DNA, 201 bp, Homo sapiens
tcactcggcggaaacccgcgagccggcccttccgcgtccaagaagtttacttcctaagcctttttattatgatcttgaatgcggacaattggggccaaacgaggaaggacacagacccaaaagccagacccaggtcccagcgcgcttctgggctctaacctgggagactcgcatccagcccggcggaagctacagtctcta

SEQ ID NO: 3200 - DNA, 201 bp, Homo sapiens
ctctagcgcccaggccgactgcgccctgaccgggagccactgcgcccagcgcagcccgagggcgctgagctcggaggatgcggcgcggggcgggggtctcgggagcaacagagactgggatccgagggcccggcccgcgctgctgcccacgcagcgcttccactttggaaagagtgtctcccgcgcggcgggccggcctct

SEQ ID NO: 3201 - DNA, 288 bp, Homo sapiens
gcccaggagaacccgcaagccagcggcgcctgcgcccgagctgcagccgccctctgccgtccacgcgagctcgagagcggctcccggagtccgggctagcgccgagctgcaggcgcgcgcctaaccgctttgctgggctcacgcggtctgagaggtcggagcgcccaactgctggcacgcgagtaacggcttagttaagctcactcggtctgagaggtcggaggctgcgagtgtcgctgctgaaggctgtggtggaccgggctggatcgcggattctgagctacatcg

SEQ ID NO: 3202 - DNA, 212 bp, Homo sapiens
ccttgcgtggtagatatttagggataggccaatcaccacccccaatcatccgtctttgagaggcccaggatctgtctctatttgatggatagtggtgcacggattaaagacgacgcaggataggtaacctcctcctccaatcccccgggaccagggtagctctgaagacccccagaggcagccaagcagccccttcccgcagcggggagtga

SEQ ID NO: 3203 - DNA, 201 bp, Homo sapiens
gaggcagggaggcgggggtgcgggaggctccgcggctgcgcgggcgcgtgctggtggcctcggcggaggctcagtcccggcccgcgcccgcggcgcccccgctgcggcccgagcggcctggctgcgggatctgtgcgcacggatggcgcggccgccccggcagcacccgggggtctgggcgtcgctgctcctgctgctact

SEQ ID NO: 3204 - DNA, 246 bp, Homo sapiens
cgcccagctccgcgcacgcccctctgcgagtccggccgcccagcgcctcttcccgcccgagccgccgcctgcgctccggggcagccgctctgtctccagcgcgatgtggcctcgcctggccttttgttgctggggtctggcgctcgtttcgggctgggcgacctttcagcagatgtccccgtcgcgcaatttcagcttccgcctcttccccgagaccgcgcccggggcccccgggagtatccccgc

SEQ ID NO: 3205 - DNA, 201 bp, Homo sapiens
cctcccagggatggagcagctacgccttccgagtgtgcccattccaccgatggagcaaagtgaggctctcagctcgcccggatgtctctgcgccgctcgcggggcagctctcgcacagacacgcccgcaagcccccgacccgcccgccacccgcgcccagacacccgcgagcctctggggccgcagggacggtgcagcgcc

SEQ ID NO: 3206 - DNA, 201 bp, Homo sapiens
accccagatacacaggcagtcgggattcccgcccggtgcgcttgtctattcatccctctgcgtcaggctgggacgcgctccgtctgtaaaaggctcaaacgcatctcccgccgcggggcgggatctaggggcccaggccccggggtccagaggcgggtaactttgctaatctcccccagcggcggggaacgtcgcgcaacc

SEQ ID NO: 3207 - DNA, 358 bp, Homo sapiens
ctaacgggcccggtgcatcgccaccgcggccccggccccgcccgagctcggctgagcccccaggccgggctccgggccccgggcgctcgcggggcaggacgcctcccgccgaggcgcaggggcagctacattgcggggcgcctgggcgacggcgccaaagccagggtcacaagggcacgggacaagcggggcggggggagcaggagactaggacagaggtcggcgcccgccgcgggcgctttcacgccgcgggcatcgcccgcccggcttcagcgcccggggcgcaaagcaagggcgcaaactctgcccgaggcggcgacggctgcggtcggggttcaccctgaagccgctaggtgtc

SEQ ID NO: 3208 - DNA, 201 bp, Homo sapiens
gctgcgtgttcgccgcccacagccgcagccaaagagacgcaggcggccccacgcggcctggttcaccgccgcctgcagtgtccgcggcgcggggcgccccgaggctgggctcaccgtcctctccgcgtccttgaagatctcccgggcctcctcgaaggagcactgctcctccttgcactccctctccagggagcccggccg

SEQ ID NO: 3209 - DNA, 201 bp, Homo sapiens
cgcctccccgtccccggcccgagcggccgtcatcgcgggcgggcggcgctgcgcccgggtgcggctcctcgccggcggcggcggcgcggccgagaggtgcgggctccgcgcgggcgggacgcggggcgctgctcgcaggagcgaccaggtgggcgccgggccgaccgcagccgccgtcgcgccccctctcgcgtcccgggc

SEQ ID NO: 3210 - DNA, 201 bp, Homo sapiens
gccgaggcccagagccggctcctgcccgcaggcggcgaacggcaccttgctccgccaggcccctgcgggtgtgatccgtgacccgcagattctcccgggcgcctctggcccatgacgcgggggctgctcgctccacgcaggcggcttcgggatgctctcccgctcagatttcagcggcagaaacagcctcggattctctct

SEQ ID NO: 3211 - DNA, 277 bp, Homo sapiens
aggggagcaaaacggagcccccgggggcacgcaggcttcgtttctgggtgttggttttgcttttggttttttcagccggtgcagtgacccggaacagcgcggccgcttctccgacgcccgcggctccccactgcgccgaggcgagcgccacggctaaagcccaagcctcggcgcccgctgcgcctgccggagttctgcttgtccgagcaggcagcggggctcaggcacggcggcgacgtcgaagggccagtcggcagacagggctgggtctctgcgg

SEQ ID NO: 3212 - DNA, 201 bp, Homo sapiens
caccctgctctcagcccgatcctccctgcgcccggagcctgggctcggcgcgcaggagactgcgtgcactctggcgtccccgacctctgccagggcgcacggggactccagagcggatcctctacgagttctaataggaggccagggagccgggacatcagagacaaattcctccgaagtccccctccggttccactgact

SEQ ID NO: 3213 - DNA, 247 bp, Homo sapiens
gccgccacagtcgccccgagctcgcgcgcagccctagttgccacgcggatcccctgctcagactgcgctgctgaagccggcgcttcgcttcatacgggccgcgccaactcggtcgctgtgcacggtcgggtgcgaaactcctccgcgggctcacggggctgccgaggcggggccgcagcggccgtcggggctggggctggtcccggcctgagacagcttcatggaaggccaggctcccggcccttgc

SEQ ID NO: 3214 - DNA, 201 bp, Homo sapiens
cgccgccccgcgcgccccggccatcgccgcgccttccccgggcgccagggaaggtggccaggtggcctctgcccgccgcgccctgcgcctcgcgccgcccgccctgcgccctgccttgcccggctgcgtccctccgggctcctccgccgccaccgggaagcgccgtccggctctgagcgctgcgcgggctgcgcgcggggg

SEQ ID NO: 3215 - DNA, 201 bp, Homo sapiens
cttgaagccggcggtgtccaggagcgcgccgtcccccgcgcagggccgcctgcgggcacacgccagcgcccctcagcccgcgtcgggcgccctcgcggacgcgcgcagcccccggcccgccaggcccggcccgcgcagcgcagcccgcggccaccgcgacccaccgggcgggcgggcggccgggcgggggcgggcctggcg

SEQ ID NO: 3216 - DNA, 201 bp, Homo sapiens
caggtttggttccagaaccgccgggccaaggagaagaggctgaagaaggacgccggccggcagcgctgggggcagtatttccgcaacatgaagcgctcccgcggcggctccaagtcggacaaggacagcgttcaggaggggcaggacagcgacgctgaggtctccttccccggtaggcggagggatcgcggagctcggggg

SEQ ID NO: 3217 - DNA, 356 bp, Homo sapiens
ctgatcgtgatgataagaaggctggggaggccaagagaaaagggaagagagagtgcagctgcaaacccttctccgggcccgagaagcaccgctctcctgcgtgttcaactggcatttgccaccaacatgtctgtttttatttaaatggcccagagcaaggctctgactaaactagcattcccacgccaacactcagcagcgcctctggtttttggcagattttttccttagctgtcaaagcaaaactatagaagcgtcctggtcttacttaaggcttgttggggctttttgccttcccccggagacccgaatagctcgcagatgtgcggtacctgcttatgttcgtgctccgtgtt

SEQ ID NO: 3218 - DNA, 201 bp, Homo sapiens
agccgacacgcgcgatgcgcgagaaagcgcggtgcaccgggccgctgtcgcggcaaaactgcagtacgtggcggcacacgctgcccacgcggccgtacacgcagcgcgccttgtgggcgtcccagtcctcgcggcggcacaggcgcgagcagtagtaggtgtagcagctgtggcaggacttgaagtagaggcaggcgttga

SEQ ID NO: 3219 - DNA, 281 bp, Homo sapiens
gggctccaccggggcgcagggctggggaaccggagctccgcccgccgacccggagcaccgcccacgcagacccgccccgggcgagggaggggccgggcgcgcacccgcggggagggcggcgagcggggatcagccgaagtcgggagaggggcgcttccacggggcgggaaactggcgcgcgactctgggggaagtgcaggatggggggacaggggcgctcccgcgggggtggatgggggaccatagcggggctggcggggcaggggccggcgcacgaggct

SEQ ID NO: 3220 - DNA, 222 bp, Homo sapiens
taccgacccctcgtgcagcggcttcgccccgccggacttcaaccattgcctcaaggattgggactataatggccttcctgtgctcaccaccaacgccatcggccaggtgaggcggccaggcgggccgcgggtctgggggcgggcagagagcggcgagggcggggcctcacgcccgctgcacccttctcacatccccagtgggatctggtgtgtgacctgggc

SEQ ID NO: 3221 - DNA, 237 bp, Homo sapiens
gcggctcggaggcggccatgatcatgcacatgaaggggcggccggtgcgccggtccgtggggtagatggtggtgggcgtgaagcgcctgttggcctcgacgaactcgcaaagctgctcgtagacgcgcgggaactcgtggcgcaggaagacgccgcgcagccgcagctcgcgctggatgtggatgaaggccacctcgcgcgcgcgccggcccgcctcgccgtcctgatccaggcccg

SEQ ID NO: 3222 - DNA, 201 bp, Homo sapiens
ggcctggaacagagacctcagctgacccacaaggacggggtttgagatctggggctctttgtcacagtggcataacccagcctgtactgactaatacagccccctgtgaaccccggctccaacattcaaatcaaggtactcggctgcttcattaagctgtcacacgttcattcaaaagcactgctagattgaggaaccagg

SEQ ID NO: 3223 - DNA, 364 bp, Homo sapiens
gcgctcgggctctgcagccttctgctgctgctcgcgcccgggcacgcgtgccccgcgggctgcgcctgcaccgacccgcacaccgtggactgccgcgaccgcgggctgcccagcgtgccagaccctttccccctggacgtgcgcaagctgctggtggccggcaaccgcatccagcggatccccgaggacttcttcatcttctacggcgacctggtctacctggacttcaggaacaactcgctgcgctcgctggaggagggcacgttcagcggctcggccaagctcgtgttcctcgacctcagctacaacaacttgacccagctgggcgccggcgccttccgctcggccgggaggctggtgaagc

SEQ ID NO: 3224 - DNA, 201 bp, Homo sapiens
ccgggacacgccttagggaaaccgctcctgggcttggtagctgaacttagacgtcgagtgcagcccgcccggtgcgcgcggcgtcttactgccagatctcggaaatcagctgccagggtggggccgcgttttggcgacggccactcggccacccctgccgctcccgcctctcccaagagatttttctagcgggttaatttc

SEQ ID NO: 3225 - DNA, 201 bp, Homo sapiens
gcctcagaggggagccggggtggatctccatggaagggagacgcttgcgccagctcaggagtggagttcgtgctccaccggttccttaaactgcgagtacgaaatccccagaggggagctgagctggtgccccgcgtgcctctcactctccaccccccacccgcaggccagacctgcgctgcccaccccaggagggagcgc

SEQ ID NO: 3226 - DNA, 201 bp, Homo sapiens
ccgccccatcgatgcggagcgcgagctgcttattgtcttccatcatgctcaggattttggcctgggggcgagagaggtgacaaagagctgcatgatgcgcggggggcgcgcggccgggcacccccggctctacctgttgtgtcctccgcggcccggcttcgcccgcgccccgacccccaggcaccggcagcgccggttcct

SEQ ID NO: 3227 - DNA, 222 bp, Homo sapiens
agcgcacacacacagacacaggctcatatagacagactcggtcctaaaaatacgcactcgcagaggcaaaggctagcgcacaagcacgcacagacacaccgacaggcggcccccggacaccgcgctccctgccgcactcacggcccacgcaagggctcacacacggcctcacggaggacagtcataaaacacccagacacacgccacacacgcacgcgcgca

SEQ ID NO: 3228 - DNA, 201 bp, Homo sapiens
gttcatacatactagtgaaacggttaaatggcagtactaggtgctaagtgaccgtacaggcgtgttcttgtcagctgtgagcaagacaaggcagcttaccgctctcagggagcttagttctcatgggggtgtattcgtttgctagggctgctgtacctaagtatcaccaacccggtggcgtcaataacagatcttattgtc

SEQ ID NO: 3229 - DNA, 265 bp, Homo sapiens
ggcgggcgccggcggggcggccccccagtaagatgtgcgcggcgccgcggggcgccccccacttgcagcggcgctcgggagccgggcggctgggccaggcggcgccttcggggctgctgcgcgcccgcgcctagagctgccgccccagggagcccgccacggccgcgccccgggcacgctcggcggcgcccaacgatgaccgctccctggcggcgcctccggagtctggtttgggaatactgggccgggctcctcgtgtgcgcct

SEQ ID NO: 3230 - DNA, 242 bp, Homo sapiens
gcccccgccggcggcgctgcaccaccaccaccaccacacactgcccggctcagtgcagtgaccccgcgggccgggcccccgccggcgcgctgcagggcgcgggcgcgcagcccgcccgcgcggcctggactctttttgttcggttgctttggattttacaaaaaaaaaaaaaagcccagaaactttcgaacaaaaccaaacacccggacgaccctctccggtgagcggcgaagacagcccgg

SEQ ID NO: 3231 - DNA, 201 bp, Homo sapiens
tcctccctcgccttctctttgctccttcttttgctttgtggcctttctttcccttcccagagacacctgggagctgcccccaagctttggggcgccccgcggggccctgccaagggtgcgtgtgagagagggcggcggagccggcgccgggtgccaggggccgagggtgggagcgggagctcgtggccctgcgccctggag

SEQ ID NO: 3232 - DNA, 261 bp, Homo sapiens
cgggctgtacgcgcaggcggcctacccggggggcggcggcggcggcctggccgggatgctggcggcgggcggtggcggcgcggggccgggcctgcaccacgcgctgcacgaggatggccacgaggcgcagctggagccgtcgccgccgccgcatctgggcgcccacggacacgcacacggacatgcacacgcgggcggcctgcacgcggcggcggcgcacctgcacccgggcgcgggcggcggcggctcatcggtgggcga

SEQ ID NO: 3233 - DNA, 201 bp, Homo sapiens
ggggacccgcgcaggccagcgtgccggcccctcccagcccatcgctgccgccgccggggctgctccaagggagccaagcggagtgggagcgggtctgcgcgtctctgctctgcgcgcaggggcgggggggcccaggacggggcgccctttcccacccacatgctgatctaggatctccaagcggctcggcccaggacaccg

SEQ ID NO: 3234 - DNA, 337 bp, Homo sapiens
gtaagagcggtgcagccgagccggcgccccagaagccgagaggttacacaagtctacgcagagaggcgcaccggacacggtaattaggagcaattcacacgctctcgggcgcacggaaactacttgtcaggaaattttcaacgctcctcctcgcccacttttttccactcctttcctggcgcgccccctcccctcccagaggcacgcagtggagcttttggagtttcgaatctttcggacactgcagaatgcggggctccccgggcgcgggcccggccaatcagagcgccgtctgcctcccctggccaatggcaggcgccacattgttgtccaattc

SEQ ID NO: 3235 - DNA, 201 bp, Homo sapiens
aagttttgggtggcgcgcaaaggcgcaggcgagggccgccgcacagagccgcccaagttgtggccggagcgccagggcgacccctgggaaccccccaagcggaatcccccgagacaagcggctcttgctccctgacaccccagtcgaggccgagttgacgcgcagccatttaacccttcctgtcccggggaaacaacttca

SEQ ID NO: 3236 - DNA, 201 bp, Homo sapiens
atgagtcgagagggctgagcggagagtgtggtcctcggcggctggaggtaggagaatatgttgcgcccgcccgccgcggcgtgagaggctcgaggtgggcgcgccggggtaggggcggccgcgggcgcctgtccgtctagtgggcgctgcccggacctggcgaggtggtggtctgcaacactgtgcccgcactgcctactg

SEQ ID NO: 3237 - DNA, 201 bp, Homo sapiens
gcagcgccgcggcggccagcagcgccgggtagtggactcgcggtggcgcggcgccgggccgcggtgcccagggcgggagcagcagcacgaggcccagggcgagcgcccaggacagcgccagcatgcccgccgtgtggcgcctctggtacagcgcctggtaggtggcgggcgcccgggtgatgagcaggtagcggttcaggg

SEQ ID NO: 3238 - DNA, 201 bp, Homo sapiens
gccctaggagggaaggaggcgacggtgcccaaggacgtcggaagccggggatctccgcttccctcgggccccggctaggttaccagtgctggcccgcggcgcgggtgcccagttgcgcctgggacactgcgggcacggctgtggcggcaacggcagcggccgccgcgtcgccgacgcccggcaggactgagcgcacggagc

SEQ ID NO: 3239 - DNA, 386 bp, Homo sapiens
ggtggcatgtacgtttcacttaaaaagcagatcttcttctgcaactgccagcaagtggaaggatagcaaaccttatactacctcgagacctgtgcgctccgagcggtcctaactccgtcccgctcgctgttgctgttgctggtgctgctccggctgcagctgctgccgctccacgacctcggggcgctgaggcaacagggccccctccctctactccccatcccccccggctcctccacagaagcgccgtttccagtaactcctcgtgtacctcccacttctgccgccgtccatcccacccctctctcttctgtcccctccccaaaccgttcccaagcacacccttcgccgctggaagtgatcacaatgttgtttttcaacaagca

SEQ ID NO: 3240 - DNA, 201 bp, Homo sapiens
ccccccgccccccgcggcgcgcgccgctcccgggggctccgcgcccccgcgcccaggtccctcccccttggcgggcgctcacaggcggcgcgggcagcgcgagccccggagccccggaggcctgtgcgccctgagccggcatggaccccgagcactgcgcgcctttccgcgtggggcctgcacccggcccctatgtggcct

SEQ ID NO: 3241 - DNA, 201 bp, Homo sapiens
ggggcgacccggagctgcgcgccggcgcacgcgactccgctcgctcctcactccctgcctcaccaccagtcccaacctggctcccgcccgccgcgcgctcggggctcaggggagcggcgcggggacccaggtcccacggcggagagagcgcgcgggattgcgaagactggggccgagtgccgccctccctgcgccctggca

SEQ ID NO: 3242 - DNA, 309 bp, Homo sapiens
aggcgcagacgctggagttggagcggcgcttccggcagcagcggtacctgtctgcgcccgagcgcgagcagctggcgagcctgcttcgcctcacgcccacgcaggtcaagatctggttccagaatcatcgctacaagctgaagcgcgctcgcgctccaggggcggcggagtcgcctgacctggcagcatccgccgagctgcacgccgcgcccggcctgctgcgtcgcgtggtggtgccggtgcttgttcgcgacgggcagccgtgcggcggcggcggcggtggcgaggtgggaaccgccgcggcccagg

SEQ ID NO: 3243 - DNA, 203 bp, Homo sapiens
agcgcacactgccgtcagccagccagccgccgtcgcactggtctagccccgaaaacttccaggcggcgtagaggtgcccaaccttggccaccacggcgccgcgtcgccggcacgccgcgtgggcttcagacagcgtcagccgcccgggcacgaagaacacttggcctggggaccacagcgggtcaccgaccgagggcagggtg

SEQ ID NO: 3244 - DNA, 388 bp, Homo sapiens
ggctcggcccgcggagtcagcgctcctcccgcgccgacctcgggctccgggcggccgccggggggcgccgggcgcatccttcgctgccaactccccgcccgtgcccccgctcgcgcctgggccccgccgcactccagcagaagccattacagagaacaaactaccttcttgtctccgagatgggtccccggggaggaaggcaaattgcctgcctcgtgcataataagccaggcgtggagagcagcgcggaggaggccgcggcagccaccgagcgggcagagcctcccgcccccacccgccgcccgcgcctgccgagccccctgccgagcgggcggcgcgcaggtccggagaatctcaaaaggcttggaacaccgggctgcttcccggt

SEQ ID NO: 3245 - DNA, 241 bp, Homo sapiens
agttttctacctagatcgcgccagtgcgtcccgggtctcaccagtccccatcaggcgttgccctccccgtccctacccagctccctctctccgccctcccgcgagtgcactcaagcgccctcgttccacccaccttcagcgcttccccaagcctggaggagcgcccagagcagcagaaacagcaggcaccccatatcgcccggcgtggggacctcgcggagcgccgctgcgcgccgccctc

SEQ ID NO: 3246 - DNA, 232 bp, Homo sapiens
cgttttccctctcagcgctcaggctgggggcggcgtcggtgccagtctagtccagggcgaagcttccagggccggctcgggccgggctgcgggacccgccgtggagcgcaaagtgcctgaagcccccgcgcgcattcggccctgtcttcaaaggccccttagaaatgcaagaggccaggcgcagaaacacacacggacggcagttttatgagaaaatgcagataaagagccc

SEQ ID NO: 3247 - DNA, 214 bp, Homo sapiens
gcctctctgtttccgcgccccctggaccagttctggtggggagctggaaggcaccgagtgcgtcccggccaagaagggcggatagccttgtgcgagcagcgttcggctggcgcggcgcggggtgtttcttatgctaaaggaaaggatggatctcttgtctgtctagggtccttactttttaaaactttcctaattgcggcactggaagggattc

SEQ ID NO: 3248 - DNA, 250 bp, Homo sapiens
cgcagcggggtcgccccactgccgcatccttactccgcgccctgcgcgcttacctgcccacgaagttctcgagcaccgagctcttgccggcgctctggccgcccaccacggcgatctgcggcagctccagcaggcagctctgtcccagcgccgaaaacgcgtcctgcagacggttcaccagcgggatcagctcctccatctcccggttccccatcttgcccgaggggccggcgaccagctggtccctgct

SEQ ID NO: 3249 - DNA, 201 bp, Homo sapiens
tggccggtgaagccccaggacccgtccgcttggggttaaggcaaggggtgcggcacgaggagcgcagggagccccgagtcccaggcgcagacccagctgcggacccgccgtacagccctggtgttgcaagcgtggaccgtgggcgtaaggccccggcgggaggcactcggcccggccgcggccgggtctgcagggtcctgg

SEQ ID NO: 3250 - DNA, 467 bp, Homo sapiens
ccgggcaccggcgggagaggggggagaagcggcgtggagaggatctggcaagggtttgcctccaaatccagattatgacccaacactttggacgcgaagcgaagatgggaaacggccgcttgctgagagggggcatttgcagtcctcccagaaaaggctggggcaggagagcgtgcggccagaggggtgggggtaccggagggggggtctcacctcctgctctatagccgggtctctcccgcgaggcgctgggaagcatgaggcatgcagcattcaaaatgttttttgaaaaagacggacttgaagcttttttttacaaacacgccattgtactcacttcttattcagagacgggctgcgcgctccgagctgcacgggcaggcattttccccggctttgttttacaaggtggggagagcggggctggacgcgggagggggcgggggggggagcgtgagaagaaacga

SEQ ID NO: 3251 - DNA, 201 bp, Homo sapiens
cgcacagctagcgaagcgactcgagggtcagcgaataagcgctggattcccgcaggctccggcgaccccagacccggccctccggcgaagacaggaaaacgtgtgtcgagagtcgctggagggaaccgtccgcaaatcgaagaagaaaccaaatcagcagcgaacacctgcaaattagtgccaagctgtgagcccctcgag

SEQ ID NO: 3252 - DNA, 232 bp, Homo sapiens
ccgggcgcgggggaggcgtgggtgctggggcgggcgagtccagactctccgtgggctggcttgtgggtgtctctccggaaacaaatgaggctgcaggagcggtgatcggtctgactgctcctgggggctccgaacccgtgggtggagagggtaaggcggaggccgtggccagcacttttccagtgacaatgtcgtcggggaccttttccttcacttcctgggagcaccccag

SEQ ID NO: 3253 - DNA, 222 bp, Homo sapiens
cacgatctcaggcccgctgatgaccgctgtggtatgaatgaggtcaccgcattcggagaggtggatgtccagatgtggactcaggaaatggcctcatcccgaaagtctcgggctagtgggcgtgccctctggccagtgcctccacgcccgcgccagaagggcagcaggccctcgtagggtccggcgtctcacccacccgtgtctcctttgctgtccctagcc

SEQ ID NO: 3254 - DNA, 239 bp, Homo sapiens
cagcgccgcgccccacgcccgtcaccgtcgccgccgccctagcacaccgcaggcgtgagtctcgccgcgaccgggagagccctcccagctgtgcgctctcgaggcacctggtcgggcggggaggcgtcgggtcggggcgcacaggggccaggcgggggcgctgctgcccacttcccgcctcccgggcgtgcgctccgccccggagcccgcacctcgcgcccgcgctccgcctggaagcc

SEQ ID NO: 3255 - DNA, 209 bp, Homo sapiens
gctcactcgccgcagcagctcactcctgctcgccagggagctcagggcagcccctgaagctgccagatccccccacgcaggcggcggcgctctgcactgcggagccgcgtcctgggggagcagtacccccagccccggcgccccgcagccagacagcccccctcagggtggcagcattccccggctagggtgcagggacccccggggcg

SEQ ID NO: 3256 - DNA, 380 bp, Homo sapiens
gtttagacagacaaaaccatttcatcaaagtgcaatgggagagaggaagaggagtaatgagaaggcatgtgagcggggagaaagaaaaagcccgggaggcgaaaacgaaatccacccccttgcgcccatttctgccagaggtttgcaggacgtgtctcaacctggcatcccgagtccagaacaaaagccacgggggctgcggcatgggcagggggaaggcgcgcggtggctgacgcggggcaggggccctggcgagcgcgggaggggcggtcagcagccgctcgcggggctggactgggagccccgtgcgactccgggtctggcgcctgggtcgggggtggttcccgggcctccctcgggggtcgccgaggcccggcctc

SEQ ID NO: 3257 - DNA, 394 bp, Homo sapiens
ggcctccccccatgagggcttcgagcagatgaggctcaaaagccgccccaaggagccctccccaagcctgacccgagtgggcgcgaacttctacagcagcgtcaagcagcaggactacagcgccagcgtctggcttcggaggaaagacaagctggagcacgtaagggcgactcgctcccgggggcctcggccaggcacctgccgcatgcaccctccccgtggtggtggcatgagcgcgcgcggggcgcggggggcaggcgaggggatcctggcaggcgccgacgtcctaggtcggattcgggggcttctctgcctgcagtttcttgccttaatgaccgggctgcggggaggggagggcaggttccctttcaggctcttggtccctgccgacccg

SEQ ID NO: 3258 - DNA, 201 bp, Homo sapiens
cccggcttctccaccccggcctctcatggggtctccgggcttgtccgttgtgagcagcttcactttggggtgctggcgggatggctgctccgtgcagggcgctcgggagttcagatcccgtggaaatgtctggggcctcctcttgcccagaggggacagtgagcagccacgctgcgacatgtttgagggacccggacgaag

SEQ ID NO: 3259 - DNA, 557 bp, Homo sapiens
cgggggaaaggtcggcgttccagggcggggaggatctgggagtggagttcggagacaaaatcggggtcaggcagaggagccagagggaaagccagcaaacgcgagctcgggtgagagccaccggaatgcgggaacgcagcttagccgggaacagggttcccgacaggggtcgcccgtggccaggacgcggccgctgaacagaggtcgcgcggcggttcctgcccgagggacctcgtgggcgggggccacacggaggccgcgcacggtccccggggctggcgggggcaggtgggaggacctcctccgggcccgcgaacctgatctggcagcggccaggtgcctggaagcgtttttaaatgatagggttacaaagacatgttggccaggtttgtagttagcgcagcaacgtggtttgcaggagcgcagaacgaggctagacagggtcactcggacgccgtgctgtcagtgggtgggggccgggagcaagcggcactggcttggagaccccgcggcaggtgacccctcccacctgggcagcgaggctgaacgatggcgac

SEQ ID NO: 3260 - DNA, 212 bp, Homo sapiens
ctggagggagctgggggatcctggagggtgggaagtggctgattctcggtggccggacactcatccagagcctgatccgtactcgtgttttcttggaagcgccacaactgcggggaaggagtctttagaaaccgtgccagtttcaatatggcgggctaaggtggcttttaaaaactgaaaataaaggttttgaggtgggaaaaaacccagct

SEQ ID NO: 3261 - DNA, 201 bp, Homo sapiens
aatagctctcctcggcccctccagccctgcccaaggggcctggaaatgttcgcagcttcaagaaaggctctatttaagcacaggatggggtggggcgggcggggccaagattgccctggggattgaatttatctccgctcccagcgatccccggcggataaagcgcaagtttgtgcacacggtcgactgagccattggaaa

SEQ ID NO: 3262 - DNA, 201 bp, Homo sapiens
gggggagccaggggtcccccgcttggggacctccgtgctgggcatcccgcacgctttggacgcgcgcagcctcaccgggagcgaactttgtctcgcctgcgggtgccacggagaggggctgggaagccgagccagctctggcggcgactgggggcgtccctggctttctgggggggcgggggcgcgcattgttgtccagga

SEQ ID NO: 3263 - DNA, 294 bp, Homo sapiens
tttgaaagtttttgaagcggcccctttttctcctctcctctctccgcaggcagagttgtggtgtggctgggtggtctgcgtgggcgtccgggggattcgcgggcactcgggacgaggcgagggcgcagaaaacttggagcccaatcagcacggagttgagcttccgcgccccaaccttcaggtgaccccgcgcggcggcggcggcagcagcagtggcagcggcgaccggagcccgcagcagctccgagcgcctccgggaggacaggcggcgagctcggcgaatcgtcatctgcc

SEQ ID NO: 3264 - DNA, 244 bp, Homo sapiens
ggcgggcgtgagcggcggaggagccgggcgcggcgacacgcggccatggagcgggagccggcggggaccgaggagcccgggcctccgggacggcggaggcgccgagagggcaggacgcgcacggtgcgctccaacctgctgccgcccccgggcgccgaggaccctgcggctggcgcggccaagggcgagcggcgacggcggcgcgggtgtgcccagcacctggccgacaaccggctcaagacta

SEQ ID NO: 3265 - DNA, 303 bp, Homo sapiens
cggggcagccggggccgggagagcgggcgcagcgcggcggggatcggagccgcgggcgccgggaaaggtcctcgccaggaggggagggaactccgggagcgcgagccagggggaggcgcgtcggaaagcgagagtgacaagcagcctacaagccgaaaagttcctcgcgggaggcgcgcgccgcgtgggctccgactcagccgctgcgcgtcgccgtggcacacaggctgaaaagtttgcgaagccacagaagccaggcccggcgctcagggggccttgatcctgttcccatggccccagacc

SEQ ID NO: 3266 - DNA, 286 bp, Homo sapiens
cgcggaggctggttctggtagtggctagggagtggagaaagcaaaccagagccggttcggttaccgactctgcgaagccccctcgaccccagcccagcgcgggagggtggcggaaggtggtgcaccgcagcgtggtccccgccgctgccgccgcggctttgcaaagtgtcagcgggggcgaaagcgagagtttaaaggaacaggaggcccattgaatttcctaccggagctttcaggggctctggctccccagtttgtttttgttttttcagctcggggatctgtt

SEQ ID NO: 3267 - DNA, 261 bp, Homo sapiens
gggaaccgagaagaggaagaagcgaacgcgagtaggagcgcagcgctcttcggacctctgaggctctctttgcaacttgccacactcgcagccctcacccgacactgaacaacaaccgcggggaggagaggccacttgcagccgaggctcgcaaactgtcggttccactcgggcagcgccaacccggtgcccgcggacggtgacttccgagccccagcgatgcgctccactgggttcaaaacagatctaattccacagcca

SEQ ID NO: 3268 - DNA, 201 bp, Homo sapiens
cactgaaaggcagaaatggggagtaggcacccagttcgcggtgggcagggttccaggaggcagctcccgctcggcgatagcccccggggcgcaactccccgcaggacgcgcacctgccaggacagccactaagaggatgcggaggttgggggccctctcggggacaaaatcagggcactccaaggaactctctgcgcgttc

SEQ ID NO: 3269 - DNA, 201 bp, Homo sapiens
gttggattgggtgcggttgtacctgtggagtgggtggcccggtgactgccacccgggccagtgctgccagcagatgtgcacatcctgggcgggggctggcggccgagtgtcactagtaggggcggcggctaggcagccattcgccgccttccaagcccggcgctgcgcgcagggcttggagcactcggtgctgagacgcga

SEQ ID NO: 3270 - DNA, 201 bp, Homo sapiens
caagctgcctcctgccttgggcttctgacacctttacagcctctgaaagggtccccggagaccccagagagaggcgggtgtcgaggggctacgagctcgcggctgacacccgcgctgcggaagagaatggcactgattgagggctctggggacctgggtcctggcgccttggaccttaggaccatgcacttcccggggcgc

SEQ ID NO: 3271 - DNA, 201 bp, Homo sapiens
cgcccggcccgcgggtcccaactttaccgccgccggccgaaccctgtccgcccgcggcgcgcacagccggcgcccgcgcacacgcgcgcacaaaccccacgcaacccgcggccgccccgtcccgccgccgccgcagcccgcctgccgcgcgcccacagcccggcccgagtcgcggggcccgagcgacagcgacggcgccgg

SEQ ID NO: 3272 - DNA, 201 bp, Homo sapiens
cgcccggcgcagagccgcggctcctctgcctgcgcccgcagtttgcgccgcccgacacagtgggggtggaggcagctcgcttagctgggcgctctggtgcggtgtcgcgttcaaagccctacttttgcgccgagggtttgtgacctgcagagagcgaccgcctgacctcaagctggctgcagagcgaggtcagccgggaca

SEQ ID NO: 3273 - DNA, 201 bp, Homo sapiens
ccccgaggtgagccgccgctgcgtccatctgttctcgcagctggattgtggagccgcgtccggaggagcgctggacacggacacccccaaccctttctccgactccgccccctggccccttgcacacacactcccgccaggaggggaggggaaggctcagcaactgcctggcctggctctgacccaccggcccctccgcag

SEQ ID NO: 3274 - DNA, 201 bp, Homo sapiens
gcgccgcccacgccacccgccaccccgggtcgcggccccggtccgggtccagtggctgcgccgccccccgccagcaacgcccgcgcggaatgagcgcgccgcgctgcccgcgcctccatccgcagggctcggcgccccctccccgcccgccgcccctacagccgcgcgctcattggcccggccagcccacggggagccgcg

SEQ ID NO: 3275 - DNA, 201 bp, Homo sapiens
gcggaaccccgcggccgagagccggccggcccagctgggcggggacacggcggcctcgggcttgtgctccagccccagccgggccccctcgcgccgctgcggctgctgcgcggtgcggtcgtgacaagtcacagcaaacttgccctccgcgccgttccaagccaccaggaagcgcaaccggtgcctctggggatcggcgaa

SEQ ID NO: 3276 - DNA, 344 bp, Homo sapiens
ctttgaccagatgaacggagtggccggaggtaagccgcgtgtcttcgcaggcccggacctgcgcggcccggaggtggtggatggggtgcagtgggtgtgcgggaatcgcaggagaggattggggctccaggtggacggtgctgactgcactggctttgaagactggaagtgggtgcaggaggaacctgcgacagctgagaccagggcgcgcgggcagatgcgccaggtcgccagcaaaccggcgtgcgtgcgccccggcgcgcccagccccgggcgagcgcagggatgggggtggaagaggcgtccccccgggtttcgaggcttgcgtaggccctctggccggc

SEQ ID NO: 3277 - DNA, 201 bp, Homo sapiens
ggcgcttgcccgaggcgggagtcgctgggtcatgctcttgcccaccaggtcctccgaatccctggtagggcagcgtctgtccgtgtccccgacccctcccgcaggcaactcgcgcgaacctggggctcgcagagagcgagcgcccgcggacaccggctgaacagtctggaggctgcgcgagggggcgccgcggggagggat

SEQ ID NO: 3278 - DNA, 218 bp, Homo sapiens
cgggtgccgtggtgcggggtggggacagccaactcagcggggacggaggaagctgggggcagctgggtgcgtgttttgcaccgctcacctgccggggctcggctcctggcggtgggcgagagggagcacatccgcccatactttaggaacctgttggggagatgagttcgtggggtcagaaagaagggaaaaatcctttgggcaagggagagaataat

SEQ ID NO: 3279 - DNA, 234 bp, Homo sapiens
cgctgctgcccgccaccgccgccgccgtccggctaccgcaccgcacacatcaattattcatcgcccgtctccagcttcccgggcgaagccaatcataggcggaggctccgctaatggggccgccgccgccgccgccgaggaggcagccagccgcgcgcccgggcgcaagcgacagctctccagggacggggatgggccgggggcgcgcggggggcgggggcgcacggggcgcgc

SEQ ID NO: 3280 - DNA, 201 bp, Homo sapiens
tgaggcggagagaggccgcttcgcgcctggggctcccgaaagcggccagctgtcctcctgctccccctgagcggggagcgctgcgtctcctgcgggctgcgggagacccttccagactcccgggtgggaaaaccacactgagcgccccgggaggttgccagatacaatactgtatctggcacccctgcccgggtgcccccg

SEQ ID NO: 3281 - DNA, 201 bp, Homo sapiens
agtcagggccgggggcgcacgccggaacacctgggccgccgggcaccgagcgtcggggggctgcgcggcgcgcacctggagagggcgcagccatgcgggcggcggcggcgggggggggcgtgcggacggccgcgctggcgctgctgctgggggcgctgcactgggcgccggcgcgctgcgaggagtacgactactatggct

SEQ ID NO: 3282 - DNA, 235 bp, Homo sapiens
gcaggggtgccctgtccgcacgtacccacgacagtgagcagcatgttgtccagcagcagcgccaggaacacgatgaacaggatgagcttccgcgagcggcggctctcctgcagccagcggaccagcgccagctcgctcagggccatggctccggggctccgctgcgggcgcggtgcgcggtgaggacccaaggcggccgtggaccccccattctcccgtcccccaggccgcggaa

SEQ ID NO: 3283 - DNA, 201 bp, Homo sapiens
tttcccaacagggcgcgctggcccgcgagccggaggaacctccgcccaggccttgccaagcgcccacccggagcaggccgggggcagtgaaggatgcggcgggagcggcgcgctgcagttccgcgacgtggcacgtaccttggaagcgatgacccagatatcggtagcggtggatgagccaggggtagaaggtggacggat

SEQ ID NO: 3284 - DNA, 241 bp, Homo sapiens
agtccccggctcgaggctgcgtcaatccggcgccggatgctaatgatgaaatcaaaatgtcatccaagttaaatgcggggagtatacggcgattgggcgcgtacaatggcaaatgggattaggcaggcgaaggctcagccgagccccggccccgcagccgcctccgccaccgccccctcctcgccttccctcggattttggcgctttggcttcgggctataagagcccgcccgttattggc

SEQ ID NO: 3285 - DNA, 201 bp, Homo sapiens
gacgatctgggtgatctgggtggaaggtggtgcagcaggcaggcagtggggaggggcggggaggaaatctagggggagggggcgccgaggctggtgaggcgtcccttccgcgccagggacatgcaggcaccggatggctgcgcaggggttcctgcccgcctggctctgggtgcgcccgcccagccccggtgcaaatgcccc

SEQ ID NO: 3286 - DNA, 201 bp, Homo sapiens
ccgcctcgacccatcaggcgcgcagggcccgctcccgaaactcgcgcgggctctcgcagtcggccgcgcggcccttagccgcgaagagagcgtcgcgcacggtggcgccgccacagccgtgggccgccgcgcccaggtagcgctccagctgcccgcaaagctcctgcagcgccgcctcgccggggcccacgcgcgccggcc

SEQ ID NO: 3287 - DNA, 217 bp, Homo sapiens
tcaaggctggcttgtgccagaacggcgcgcgcgcgcgcacgcacgcacacacacggggggaaacttttttaaaaatgaaaggctagaagagctcagcggcggcgcgggcgctgcgcgagggctccggagctgactcgccgaggcaggaaatccctccggtcgcgacgcccggccccggctcggcgcccgcgtgggatggtgcagcgctcgccgccgg

SEQ ID NO: 3288 - DNA, 201 bp, Homo sapiens
ctacactgcgcaagagatcgcaatgaagtccgtagatctccaggctggagccgcagagcgaggtggcgaggtggagaacgcggggctgggcctggacagcggccctggggtcgtctggagtcctcgctccctcaacccggaaggcagcggactgacatctgcgccgaagtcgcgcgtaccccacggagggtcgggaccctg

SEQ ID NO: 3289 - DNA, 201 bp, Homo sapiens
gaggggtggtcctgccccacccagggggtgtcgtgggcaaaggccctggggccacctgcctggtgccttggagggcgtagggcaggagccgccgaggcccgcgggccactgtggggcgcggaacttcagaccaggcacccgcggctcaacttccgggccaggggacccgcgggggccttacgaacctgtttggcccatttg

SEQ ID NO: 3290 - DNA, 201 bp, Homo sapiens
acccggggccggaggcaggcgcgtaaccatggggaccggggcgggcgatggcggcgggcgggctcctgccgcagggtggggatggctcttccagccgggcggccgccgtcacactgcagagcgtatttaaagagacacctcgctccgcgctcgctccccagcaccagaccctcgcccgaaaacgccgccgggcggactgca

SEQ ID NO: 3291 - DNA, 317 bp, Homo sapiens
caccgcccgggtccccgcctggttacagcatcaggccacagtgcgctggttcttgatcactctcctggctcggtggccgccccccgccctctcccagtccgcgtcgctgttctgcctcaggccccggtgcggccccaagtcccagcccagggcccttaggtccctccaggcggcggtggcggcactcacctgggtcgcggagccggggtctggcacggtcccgcaggtggtaaatgaaatcctggcagctgtcgtgctccagggccccacgggcacagagctcggccagcagctgcagcgcctggtgacagagcgcg

SEQ ID NO: 3292 - DNA, 221 bp, Homo sapiens
atttacagcgacgggtaaccacgcgggaggagcaggtcaactcccgacagtggaggtgaagatgcgtgcgcctcgcgcaccttgtccctcgcgcgacgccgtccgcgccgcccgcggttcggtcgggagcggcagcccgtgctccggttccggttccggttccggctggcgtctgcacctgcgaccaccgtgagcagtcatggcgtactccacagtgcaga

SEQ ID NO: 3293 - DNA, 201 bp, Homo sapiens
gtgggcggccaccatcccctcagagcacctggtatatcgggttggggttcgcacccgcagggcactgcggggcggcgtccggtgactgggtggggtcgccgctgctctctccctcgctgggggcggcagcctcttgcctgcgcggaggcgactcagaaggcacgtccgccagcaggagggcgggcgccgcagggctctcgg

SEQ ID NO: 3294 - DNA, 201 bp, Homo sapiens
gccttcccgaaacggagacttgccatcttttcagagggcggggaagctcacaccactctctgctttatagtgtccgtttcgcctcgcttgctggcccttcgcttacccgagacattccaggcacggctcgcactggagagggccgcgctgctgctgcgaccgcacggcgcccggggcaggaacatgctcgctctcccctgc

SEQ ID NO: 3295 - DNA, 201 bp, Homo sapiens
accgaagctaggtggaagcaaatgagcctggatcctgaggcgcgcctggcttggagccgccaaacttgctagcgggcggcgggggaggtggctcggcagcgccgggtgctgcgctcgcatatgcgcccgggaaggcagccccggccgccccgcccccagcccgccccccaccgctggcgcggcggcggcggcgtggggctc

SEQ ID NO: 3296 - DNA, 201 bp, Homo sapiens
tgcgctttctctctgccatttcgatgctgggagtggcgctctggccctggcgtctcctgggcaagcaccagccggcggtatctgcggaggtggctggcacgttgttattttttgaaatgagtgaggagggaggtctagatttaggcggccttacgcgcccgccttggcattagcagactgggaattgccgtggctatgccc

SEQ ID NO: 3297 - DNA, 230 bp, Homo sapiens
cctcccggctgcagaacgcctctcgttgccggagaaggggctcagcaaaattgactcttccttatttgtttccatccataattgatggggagatgagaacgtaacacatctcagcaccgagctcttgtcgcctggcggagaccctgtccaagacgcttccgtaaagcatttccagtcggggaacaaagcacggaaagttgctgggtagagcggccgggaggagacaccgg

SEQ ID NO: 3298 - DNA, 201 bp, Homo sapiens
gacagtggcagaggcgaccgcccttccccccatcatccataccccagccccagatctctctcttttcctcccggtgacactaagtcccagaccggcggccgtacttggccttacagtgcaaaatgtgcttggcgaggaagtcgaggcggcgctgtagcagctgagcgtgggggtctgcaagggcggccagctcggggaagc

SEQ ID NO: 3299 - DNA, 201 bp, Homo sapiens
cgaaggtcaccggctgcgtcttgaagcgagactggcgcggccgccgcagccggccccggcccttgggcagcttggcgggccgcacgggctgcgggaactcgtcggccaggcacacgaagtgcggcatcaccgcctggtaactggagcagatgcccatcagctcgccgggcttggcggccatggcgcctccggcgtctgcgg

SEQ ID NO: 3300 - DNA, 201 bp, Homo sapiens
tgctgttgctgctgctgctggcgctggcggcgcgcgcggacggcctggagttcggcggcggccccgggcagtgggctcgctacgcgcgctgggcgggcgcggcgagcagcggcgagctcagcttcagcctgcgcaccaacgccacgcgcgcgctgctgctctacctggacgacggcggcgactgcgacttcctggagctgc

SEQ ID NO: 3301 - DNA, 201 bp, Homo sapiens
agccccgagccgccagctttcaggcctgggggccgccgtccccggagctgctggcgcccacccgcttcgcgctggagatgttcaaccgcggccgggctgcggggacgcgggccgtgctgggccttgtgcgcggccgcgtccgccgggtgaggacgcgccgggggcgggggcgccaggcccgggtccaagggataggagctt

SEQ ID NO: 3302 - DNA, 201 bp, Homo sapiens
ttctgacgcggggctggggacgcagacactcttggctccggcagcccagcgcaacccctgaggtcgggcgccgcctcccgccttcagaaactcgggctccgagcgccgaattccagcgccttcgcccgtgggcacagggcgcgcggtgcagccacagggggcccgagacacgcgccccggcctggcccaggctggggaacc

SEQ ID NO: 3303 - DNA, 201 bp, Homo sapiens
cggcgactacctgctgggcatcaagcggctgcggcggctctactgcaacgtgggcatcggcttccacctccaggcgctccccgacggccgcatcggcggcgcgcacgcggacacccgcgacagtgagtggcgcggccaggcgcgaaggggcgggggcggggggcaacggccgccgggccaacccgctcagtcacactctga

SEQ ID NO: 3304 - DNA, 201 bp, Homo sapiens
gttgtaccaagttacaatcccacccacatggtgtgagaactccctgggcccctcctcctcagcaagacttggtatttcctgatatttaccagtctaatgcgtgggaaatggtgtctccttttaacttgcattttctctgattcatagaaagctgctcccagttccggttcatcgaccactcagctttccattttctgaatg

SEQ ID NO: 3305 - DNA, 201 bp, Homo sapiens
gccttcccggtacccgcagccccgacagctcagccttccccacctgaaagttccacctgaggtctccctcaactctgccctcctgcattcttggcgtcgcggggagtcaggggttaaaccccgtggcccgcgtggccccttccccctccgcagccccctcgcctccactcggcgccgcgcctggagcgtccgtcccggaga

SEQ ID NO: 3306 - DNA, 201 bp, Homo sapiens
ccccgggggtgccgagccggcggggggtgaggtggctgcgccggcggccgggctaggaggtgcgggcactgggggcgcgggaggggacgtggcaggccccgcgggggccacggcgatcccaggggccaggaaggtcccgctgcgggcacgcaatctgcctccgtccttcttcacggagccgtcccgggcaggcggcggcgg

SEQ ID NO: 3307 - DNA, 268 bp, Homo sapiens
agctggcgctggacaagccgggcaagtcgaagcggaaggtgaaccaccgcaagtacctgcagaagcagatcaagcgctgcagcggcctcatgggcgccgcgccccccggcccgccctccccgagcgccgccgacacgccagccaaacggccgctggccgcccctagcgccccgacagtcgcggccccggcccacggcaaggctgccccccggcgggaggcgtcgcaggccgccgcggccgccagcttgcaaagccgaagtctggccgc

SEQ ID NO: 3308 - DNA, 614 bp, Homo sapiens
atcggccggggctgctgccgccgggggcctgggctttccagccagctgtggaccaaacggtcttcccttacccaaattaactgcgccacgcgcaggcggcgcacgggttgggcttgggaatggggaccgcgaggcttcagcatcccgatgccctgaaagtctccccgcctcggggatttgtctctgtgttgcagctggcaggggccgcctgaagtgggagcagcgcctggagaaggcgggaggagcccggcccgggggacgggcggcgggatagcgggaccccggcggcgcggtgcgcttcagggcgcagcggcggccgcagaccgagccccgggcgcggcaagaggcggcgggagccggtggcggctcggcatcatgcgtcgagggcgtctgctggagatcgccctgggatttaccgtgcttttagcgtcctacacgagccatggggcggacgccaatttggaggctgggaacgtgaaggaaaccagagccagtcgggccaagagaagaggcggtggaggacacgacgcgcttaaagggtaaaggaaccggttccctcctttggtgtgggtctcccaagtttcaagatccagaacaacgggcaggatgactct

SEQ ID NO: 3309 - DNA, 201 bp, Homo sapiens
agatgcactttagctcagcgactcccactggcggaatcctcgcgctcaccgcgcgccgcgccaagatggtccaggccacctctactgcctccccgccagcgcccctcagccccctacacttgccctgcacacacactggcctgtagaggggattcgtcccgaaccgcccgggagtggggcctgagctcggagctggtgccc

SEQ ID NO: 3310 - DNA, 201 bp, Homo sapiens
gccctgcttcctttacaagaggctaagccgacaccacgcgagtgtgtacgcgctggggactgagcccccgaagcgaagccctgtcggaggagtttcaggcgggagtgggaacggctgggcgtggggtcagcaacggcgccacccggtagggtggggggagccaggcttgtcagagccagagcgcgtcaccgtcgccgcgag

SEQ ID NO: 3311 - DNA, 201 bp, Homo sapiens
gcactgcggagtagcgaggtagcgcgcaagcaagccagggcaggggccgggggcaggggcgggggctggagctatggccaggggtggctgctcaggccgcgtgagctgtcctccccactcgcacctggccgtcaggccacccggccatcagaagcctttactcacaccttgtctcttacctggaccgccggctggctgcaa

SEQ ID NO: 3312 - DNA, 201 bp, Homo sapiens
ggggaccggccgcagggcggggtttctcttggcggtgagtgagcgagaccgttaggctgaagcaccgggagactgtcctggcagctcctggccgccacccgcgccgcaataaaagcctctcgcggcttcccgcccagccagcttcgcactgattggtcgccgtgggagggacccgagttggctggaggcggcggccgagcg

SEQ ID NO: 3313 - DNA, 201 bp, Homo sapiens
aagccccggcgcgcggcgctcgctgggcggtgcgcctcttcccggcccctcactcaccgcagccgagccgggcactgtggggtgggtgtgcgtgcctgtcggggggtgtgtgcctgtgtcggggaggggtgttgctggggaactgttgctctccgtatcacggcggcagcgacagcatcgcccggcagttcgcagtacccg

SEQ ID NO: 3314 - DNA, 261 bp, Homo sapiens
gcgcccggcccaagcacggtgcgagcgtctcggggaggcggcgagcgagtcggtgcggagcgctccgtgcgtccgggtggttccgcgggccggcgggaccgtgcgcatttcaagcgcgtgcgggagtgtgcgaggcgctgtgcgagctagcggcgggcgcgccagggtgggaaaggcatcccgaacgcatcaggtgcagagaccggcacccaccgagagcggccgggagcgcacggcgagctccggtgtcaccgccggtcc

SEQ ID NO: 3315 - DNA, 201 bp, Homo sapiens
gtctgggttccaggctatcgcagaggacgtgcccccgggcgcgcagatggcgggagatgaggcggccgaactccgcgcccttgcgtggtggagcacacacgctccaacaagctcagcgtcacctgttcagccctctaacttttctccttctcgccccggggcggcttctctctccctttgccctggctgttgccctggccg

SEQ ID NO: 3316 - DNA, 201 bp, Homo sapiens
ggcccacgcactgcccgccggcccacgcgggagcctcgaggggcgaggcggaggctgggcgcagtccttgcagccagcagccacctccgcgcgctccgccgcggtccagctaattacctgctgcggcggcggccgtgccctttagggtgcattagtattcccgccgcgggcgctgccctcgcggcgtcggcaccgatgccc

SEQ ID NO: 3317 - DNA, 201 bp, Homo sapiens
caggcagtcccgcgtggcggcggccgggacagctgggcgcgctggcaggagagcaggcacagcgctccccacaggcaggatgacgcgggctccgcagcccgtcctcccacgctgccccgcatcactgcctcggccctgacgtgcgtgcgacagactcaccgcaaacagtccccagcgggagcacgaggccgggacaggagg

SEQ ID NO: 3318 - DNA, 201 bp, Homo sapiens
acacagctttaagggactgagcggcccggacgggatctgaaacctttggaggaccagccacgtccgcacagcccgcccatgcgcgctggcaccaggacccgcaggctgccagcggcgagtccccgccgcggttcctcagggcacccccggagaagggggcggccctgaggaatctcctgcactccggatgccctattttcc

SEQ ID NO: 3319 - DNA, 219 bp, Homo sapiens
gccgccgcctcctcgggagtcggagccgccgcttctccagtgggtgcagccggggtcccgacgggggtcgggcggccaccggggctggagctgcggccacggaggcttttgcgtttgcgccgcgccgagggcagggacagggactggggtgaggggctgtcccggaacgtccacagctggcgctggccctcccctgcctgacagcttcctggcccgggg

SEQ ID NO: 3320 - DNA, 268 bp, Homo sapiens
tcagccgccggcgaggccacccgggaggggcgggagccgcctgccagccactcggcagccctcctggggctcccctcgcgcgcccgcttgtttttcttccgctgcgcttcctcgcttgctggcgtctttgccttagcgggactcggcagccaggggccccagggggcggtgcagcaaactctcagcggtttgcgttcagcagaccaggttggggagccggcttggcgctgcagggaggtagagagcgggaggaagaggcagtggtagg

SEQ ID NO: 3321 - DNA, 201 bp, Homo sapiens
ggctgccctcgggcgcaccctgcggctcgggcacctgcagggcgggcagcggccggttctccatcatgttggccgccggcatgggggccgtcgcctctgcgctccccctgagccctccgccagcggcctggttcgcgtctccctctggctgttccccaccctcggccccgcggcacactccccaatcctggggccgaagga

SEQ ID NO: 3322 - DNA, 517 bp, Homo sapiens
cagcgcctactgccggggaagactcggacgaaaaccgaggcaaaccaaccattaaaaagtgcatccaataagaatttttccactcaggccctccgctgccgagacgcggcagactcccagagcggctcacccactcatcgaagcggattctgggcggtttcgggctgacccgcgctgtcagggcgcggactccattccgggcgcattgttaggagaaggggcccctcggggcggcgcgcctcgaccctgggctcccggtgcccgcagagggcggagatccgcggcgccctaggccacctatccgcatcttctcgagccaaacccccagcgcttacccggacccgacggcccaagcactgactcccaggcaagagtcgcccttcctggtccccagggaactgacactaccgcgggacgttccctctaggacagtcagcaggtcccaggagcgcagcacgcaacagcgcagagcagacccagacttttcccggggtgagacccggaggcccgcgctctg

SEQ ID NO: 3323 - DNA, 226 bp, Homo sapiens
cgtcggggggtcctgcctcccgggaggagaaggaaccggccgcctccgcccttctccccctccaggcgcccccgggagggggccgctgggcggcggaatcgcgcctccgctcggggagccaccacgcggctttttcgcggaattttgacgtcatccacacgtgggggaaggggctgggagagcaagaggaagcggcgggggagggggccgcggctgggagagcgcg

SEQ ID NO: 3324 - DNA, 201 bp, Homo sapiens
accccggaggcagagatgagagcgcctcaaaacttttttcccctaccccaatctccgaggagtaggtgggtgcacagtgccggcggcggcggggacgcgcggcgcggagcctggctctgggaggcagtggccgcttcagcagccgaacctctcgcggctccagcctccgcgcccagcagcccgcggctcgcctcccggaaa

SEQ ID NO: 3325 - DNA, 212 bp, Homo sapiens
tgcgcagtggggcggaggaggtggcgatggccgggggaggcggggggactgctgtttatttgcagctgggccaactccgcggcgcaggcggcggcggagcgcggggagctcgcggcgggtccagctgccgcagcaccatgcccgagcccccctccgggcagacgccgcgcgccgccggggccccggtaggggaggatgccagacgcccggga

SEQ ID NO: 3326 - DNA, 388 bp, Homo sapiens
ggcagccgcagcctcctcgcgcgcctctccttcccctacgccctccgctcccgccatggggccaacgtggggctcctaagagttgccggctctcagcggcgcaatctccagccaaagtcaccgcgggcggactatggcttagggcgccagaggggttagaggtacgggaagaggaaaagacggctaactgggaaaaaaagagaaaacgaaagaaaagccaaacgatgagtttccacaaggaggacggagtgaacagtctgtgccagaaggctctgcacatcgtcaccgagctgtgcttcgccggccaggtggagtgggagaagtgctcgggcatcttccctcgggacaggggcagccagggcggaagcagcacaggtaaccgggaggg

SEQ ID NO: 3327 - DNA, 201 bp, Homo sapiens
ttttttctctcctgtctttcaagacacgcgcccgaaatcgaggggtgagagcaaagaccgcccatcaacttagcaccttggatttagagctttcaatcccgaaaggaggttggcattgcccgggtcatcgagagagggagggagaagagctgaggctgcaacggctcctgggctccctagaccgggtttggcatccaggag

SEQ ID NO: 3328 - DNA, 201 bp, Homo sapiens
ttacttcccctggaagcccatcagttgctcaagtgacaaccaacaccggagagccagggttcgcccaacaggagtacgcggagacaccccagacgacagcgcgtcccccccacccccaccccgccctccgggcgctccaggccagcgtccaccagaccccacgcctgggggactgcttgggctctagcgagagtgccacgg

SEQ ID NO: 3329 - DNA, 212 bp, Homo sapiens
aggtgcagagacagtggagatgaggccctgatgcccggctctggtttcacgcgggcagcgtcagctggtcggtgtcacggagttcccgcgtcctccgcccgctcagcccccgcggacccatccactggggttgctccgcagcgcgactctctctcatcccgggggagggctaagggcggcggtggggggcggggtgggggggaagcggcggg

SEQ ID NO: 3330 - DNA, 250 bp, Homo sapiens
ccctccgtgtcttccgcagggtaggtcacagtcccccagatctccgcccaggtggcaaagaagatggagctgggggccgcgccccggcggcgcggggcccgaaggcgaggccgcccagcccgcaccccaccccacgcacggcacacgccgccgcggcccctgccacgcacaccctcgcgctgctccgcccacgtgggcgccggggaggaggctcgagagatgggaagaaaggctggcacccaccctcctg

SEQ ID NO: 3331 - DNA, 488 bp, Homo sapiens
ctgcaaacactggaggaaagctgcgttgcctcaattaaatacgctcccccaaaatacggagatgcggggagtgggggcccgggaaagaaacttttaaagcggcagtgtccttttaagaaggggcaaaaaaatctgtttatggccaccctccttccgctttaccttttctcctcttgacagtttcggccctggctgcccgagtcgggggtgtgttttcggtccctctcagatctgggcggggggcgggaggagtgagcgacctgggaagtcccgggggtggagagggggcgctccggggtctgggggcgacgtggacaccttctttggagcacggcggtgcgtttgggatttgaaggaagggccgaaggaagcggggtgcgggcgggcgagctgttcgccaagttgtctggcgggcgcggcgaggggagatgcgcaagtttgcagaccgggggttcggagcccggcgcccaggctggcggggggcgtgt

SEQ ID NO: 3332 - DNA, 201 bp, Homo sapiens
gcagagctgcagctcctgcggctcctcctctcccgctgcccagccgagctttgggctcccagtccaagctctccgcaccgccgctgctgctgccgctaccgccgccgccgccgcgcgctgccagagccgcctcctcgcctctctcctcctcccccggccgggttcccccctccctctgctctccctcccttctcctcagcc

SEQ ID NO: 3333 - DNA, 364 bp, Homo sapiens
actgcgcatgtgggcttggggcctgcgcgcaccggaggctgcaggcgctggggagggtgtggggggctgtgcgtggggctgccctcaccggaagctgcacgctctgggaagcgcagaggcgggggtgctgctcgcgctggggagcacgtgaggggacactcagggactgcccgcgcgaatggcttccaacgcatgcgccccaccccacatttcacagtcgccatgacgaccgggaggtccgcaacggctgcggggacaagtccgttgaggctgccaggcgagtcaggtctctctggacctcgcctgactcggctgggctgtgcctgaaattgacccagctccaccatactccttgattatgaga

SEQ ID NO: 3334 - DNA, 220 bp, Homo sapiens
gtgtaatcttttggttaaaatgtcacagctaagactaaacccgaagaaaagaatgaaaccacgggaagttcttcagacagtcgccgcaaggttatgggccgaagtggtgcaggggcggcgcccggggaagcgactggcagagctgtgcgcactgggggtgctgcaggcgctggggagagtgtggagaggctgcgtggagctgcgcgctcggggtgggggc

SEQ ID NO: 3335 - DNA, 201 bp, Homo sapiens
gcggctgagctcgcggagctgggtgagtgtctgcggctgaccggcccgtgggagcagggagcgcacagccggctggtgctggagggtcacggggacttacggggcaccgcgggagccgccgagcgcagggaagccagcaggcatctgcagtgcggagcctgcaaggctgaggcaggagatcgctcgaggcggggagggcgg

SEQ ID NO: 3336 - DNA, 201 bp, Homo sapiens
tctgagggcccgggcagccacccgcacttccccgccacgcggagaaagccgagcacacaggccgcagggtgggggtccgcggggagagggtggaagcagcgggttctccgcgcctggggtggccgctgccccacccaggcccccgtctgccctctacccttccagaccaatcgctccctgcaggtgccaacgcggtgcccc

SEQ ID NO: 3337 - DNA, 201 bp, Homo sapiens
gctccagttctcatctgctcaggtgtccccggcgccttggcgaactcggccactccagttcctcacgtggtgagcactcagggcagcgggtcgattttccgaggtcccatacctgggtttgaggggcgcggctcgcagcggcgggtgcaggggcgactgccagccctcaccccgcctcggggtgcgttcggaggccgacac

SEQ ID NO: 3338 - DNA, 358 bp, Homo sapiens
acccagggccactgcagctccggggcaccccggaggccacgacccgcgagtagatgtcccggaagaggctctccatgcaggctgtcaggtagatggcggcgtgctcgtggatgcgcagcgccacgcggctgtccaccatccagcgatacacgcggcccacggagaaggtgaggccgcagcgggccgacttgccgcggcccaggcggtcgccgccggcgctgctcatgttgtagagggacagtgcggccagcgcagccgccgtacagtgcgcggccaggccccaggacagcacgatctccatggcgctctggatctcgtacttggtgcacttggcgaagcgcaggctcaggcgctgcgc

SEQ ID NO: 3339 - DNA, 201 bp, Homo sapiens
agcgcttctccatggtcgcggcagctaatcgatgactgaaccgaacaaagagcagcggcgagatcaattcctaatacctatcgatgggcagcgggcggccgagccccggcgagccccggcagccgccgcccgccgccccagggcgtccgcctgcccgcccggggacctccccaatgcgcccagggcgcgcccgggggctcc

SEQ ID NO: 3340 - DNA, 328 bp, Homo sapiens
ctccttagccccgctggcctgggagccgggagcctcggaggagtctcccgccaagcttccttggctacgagcgcgcctggttctggtctgggagcagaccgtgcgcccgagtggggcacttgcccgaggtcggggactgtgaaccgaaagattccatctagccctgctgtcctcctggtattgcgatttgggggcgggtcactttacctctctgaattccgccccccgccttgcttatggaaggttgtaagcctctctggggtccgggatccctctttacctccacctttcgagcagagaaacaggcgatgccccctccctccctgcg

SEQ ID NO: 3341 - DNA, 201 bp, Homo sapiens
gaggtgtgtgttggaggtgggcagtcgccgcggaggctccagcggtaggtgcgccctagtaggcagcagtagccgctattctgggtaagcagtaaaccccgcataaaccccggagccaccatgcctgctcccccgcctcaccgccggcttccctgctaggagcagcagaggatgtggtgaatgcaccggcttcaccgaacg

SEQ ID NO: 3342 - DNA, 319 bp, Homo sapiens
gggcgcacacacacgtccacccagacactccgcgcgctccctcgcgcttttgcttgcccgcccgccgccgcctgctttttccctcctgctttcgccggtcgccttctccttctttttttttttttttttttttttttttttttttttttttttttggtaccatagagttgctctgaaaacagaagatagagggagtctcggagctcgccatctccagcgatctctacattgggaaaaaacatggagtcagctccggcagcccccgaccccgccgccagcgagccaggcagcagcggcgcggacgcggccgccggctcca

SEQ ID NO: 3343 - DNA, 201 bp, Homo sapiens
ccaagctcaactttacgccttcctcggtgcccgactctgcggccgaatcgcaactgcgagccgcaggtaatggcggagtctttggcactgccagctgtccgcggctgggggcccgaggctgggagggctccgctcccggaacatcgctccggcctggcctccaactttgcgaggagcctccttgcgctctcctcccgcggt

SEQ ID NO: 3344 - DNA, 370 bp, Homo sapiens
ctggaccctcggggtgcgggcccctctccttgtcctgcttttcagcatctttggcaattgcgcaaagttgcttgggttgcaatggtggggtgcagggggcgctcggctgctgcacctgttagtgctgggcccaggttgagaggcgacctccagcccccacaataatgtcccgggctctctggtttgggtcctcgcagcgcccgattgaccgccagcgatacgacgagaacgaggacttgtcggacgtggaggagatcgtcagcgtccgcggcttcagcctggaggagaagcttcgcagccagctgtaccagggggacttcgtgcacgccatggagggcaaaggtgaggcgcccccaccccgggccgccct

SEQ ID NO: 3345 - DNA, 201 bp, Homo sapiens
cccctccgccccaggcgccgccaagtcccagcactatgcgcccctccagatgtccgaaagcgcctctccagggcagcctatgtccctctgtgtccttcccgcgacgggccgggcccaccactccacacctcccgggtccttccatgtccatcaccgtgtgcctctccagcatcccccctcccctccaagttccaacatagc

SEQ ID NO: 3346 - DNA, 201 bp, Homo sapiens
gctgggcgcaggggccgccgcccgaggaccatgggtgggccagcgcctcgccgggctgctagctggcggggaccgccggcgcctgtgccgggccgcgcccgaggctgcgccgtccgtgccgcagcggccaatgcggcagcatccgcgaacgccaccgcggcgggccccgctggcccgggctgcggcgtgggggcgggggac

SEQ ID NO: 3347 - DNA, 201 bp, Homo sapiens
gtgcagcgacgcccagcccccgtgcggccagcgcgccgcgtcggcggatcctgcagcccagagagcccagggagcccagggaggggagcggggcgcgggcggggcagtgtcgcataaccgcaggcgcgccccgcgccgcccccgccccgggcccaccctccctcgccgcgcccctcccagctcacccacggacgagcggat

SEQ ID NO: 3348 - DNA, 263 bp, Homo sapiens
gcgcggcctcgcggggatcccgcgggcgggcgggcggccgggcgcgcgcggggcgggggcggcgcgcgcgcggggagcgtgtgggccgggcgggcgcggcggggaaagctgggcgcgcgagccgaggctgctgctcacctgcagccgcgccgctcacctgccgcggagtgcgcgccccgcgccctcccggcccgctccggagcccggccgccccccccttgccacagcgggcaactgcgccgacatgcgacacgagtagccca

SEQ ID NO: 3349 - DNA, 201 bp, Homo sapiens
ggcgggagaggagccccggccgcgtggaccctagcttgcgcggcaatcatcgcgccttgactctaggcccggctgctcagggaaggacagcccagggcgcgcccagcgagcttcagggggtacggaagtggttagggcagatttcagggtgaacaactaatattttacttaccaattcgttaaaaacaaagaaaacaaaac

SEQ ID NO: 3350 - DNA, 201 bp, Homo sapiens
tgccggggccgcgctcccgggcccgcgtcgccagcacctccccacgcgcgctcggccccgggccacccgccctcgtcggcccccgcccctctccgtagccgcagggaagcgagcctgggaggaagaagagggtaggtggggaggcggatgaggggtgggggaccccttgacgtcaccagaaggaggtgccggggtaggaag

SEQ ID NO: 3351 - DNA, 201 bp, Homo sapiens
aggggtcaggagcggcgggacagcgcgggaagagcaggcaaggggagacagccggactgcgcctcagtcctccgtgccaagaacaccgtcgcggaggcgcggccagcttcccttggatcggactttccgcccctagggccaggcggcggagcttcagccttgtcccttccccagtttcgggcggcccccagagctgagtaa

SEQ ID NO: 3352 - DNA, 201 bp, Homo sapiens
cgggcgccggcgtgaacccgcgtcccccggagcccagcgccgtgtcctcaggccccggccctgacctcagggcgctcaggtggaatggccccgcagctgcgcgctgctcccgcgcccccgccttgccccgcggaaatcgcccccgacagtcaacccgaccgggcgcgcggcgcccccggccggtccccgcccgaccccgcg

SEQ ID NO: 3353 - DNA, 215 bp, Homo sapiens
gaccctcccgcgcacacgcacatgcacacgctgcgcgctctcacgcgcatacacacgccctccctgccgcgctcgccgccgcggccaccatcgcggagccgagccctgcggagcgggaaccgaggccggagcggggaccggaggcagccgagccgggggatgccggcccggagcggagccgcgcgcggacggcgcgcccgggacggtgagtgtgg

SEQ ID NO: 3354 - DNA, 201 bp, Homo sapiens
ccgcgtaatccctgaagtggtcggccagggcgcggttggcccagccgccgtaggcgtcctgcaggcgctggggcaggtcccagtggtacagggtgaccacgggctgcacgcccagctcccgcagccgctccagcaggcgccggtagtagcgcagcccctcgcggttggggacgcccgcgctgccattggggagcactcgcg

SEQ ID NO: 3355 - DNA, 201 bp, Homo sapiens
ggacgggagctgcggggagggcggccgggggactccgcagagcccgctccgcccgcagccgcggggcgccgagggcagggcgggcgctcagcttggccccgccgccccgcccgcagttcctcgaaaggcggccgccctgccctggccagcctggcccgacccgggggcgttgcgtgcgggcggccccggggctgctggcac

SEQ ID NO: 3356 - DNA, 201 bp, Homo sapiens
aactcaacacttcctctctcccttctggagtcactttcccttccggaatatgcaagctctgggtggcccagccctgccgccagactcagtttccaagtgcgggggaaggagatgggcgctctcagccgcgatcccctgggaaggtggccactcacctgcgctctgaaatagaagaacagggcgacgctgcagacaacctgg

SEQ ID NO: 3357 - DNA, 217 bp, Homo sapiens
attggctgaagttcccccagcgatttgcatgaaccgagagggagtgtcttctgccgccctcccttcaagagcgctctgactgcagcctcccagggaatgcgcggccgagggaatgcgcgcagctcacaggccctgggagtgagctggtgcccggcgacctggcacccgcgcctggatatggggcgtctacatcgtcccaggagcagcaccagctaca

SEQ ID NO: 3358 - DNA, 317 bp, Homo sapiens
agcaaaagcctctatttgcagcaccgggcatgttgtccgtttaacgcgctccggggatctgctggctcgtgctcccaacccaggggtggctatacgtctcgcgcctctgttcctgggtagactcccccatctgtgcattttggccccttcacttagcaaagagatgtgcgaagtgtgcgcctggagacgagccgcctcggtgacccccatccgcccgcagcggtggccctggttccccggatccgcgcccgcgccctgcgggtctcccgcgccgcccttgcccgccggaccacccgggctcagagggtcgctcgctt

SEQ ID NO: 3359 - DNA, 201 bp, Homo sapiens
gaggggaggcacggagcgggaggagggggacgcggagaagactgcctggccccgccggccccgccaacgtgacggtcagccccgccgagcgctcgcacccgctcacactcatgatcactcgcacactcgctccaatacgtgttaaggcgcgatcgcggggtccctggcagccttcgctgcaccctcccccccacaggggta

SEQ ID NO: 3360 - DNA, 201 bp, Homo sapiens
ccgcccaacacggagacgcggagtcccatagcggtggcagaaagtgagcaccaactcagcaacagggggaaggaaggggacgccgggcggccagtgggacgtgcggcagccgagggctgcagcctgcccctgcagcgcgcccgcgcttacctgcgatctcctggtaggggatgtccgccaggctgaatcccttggcaccgt

SEQ ID NO: 3361 - DNA, 201 bp, Homo sapiens
cagccgggccgagcgcgctgcctgagctgagccgccgtaggtgaggggcccgcgtccccgcccgccctgggcgccgcgcctggcactgatcctgccggtcgcccactgtcgccgccgccgccgcccgcgggcaccatgacagctctgagcgctggggttacaggttggtcaccgccgccggtgcccgggaggctgcggcgc

SEQ ID NO: 3362 - DNA, 201 bp, Homo sapiens
agtgtgactgatgcattcattatttaataactccggggtgaaacttgaggtgaacggtttcaccctttcatactcaggaatggaactagtcctcggtaccgtgcacagtctgacctcacgctcgcacgctgggctcccggcctcctggcagtgcacttaagtgtaccccgcgtgtgcccggcggactcccgtgcacaccgc

SEQ ID NO: 3363 - DNA, 201 bp, Homo sapiens
gcgcagcttcactccggatggttcctgtcctcccgcgggtccgagggcgctggaaacccagcggcggcgaagcggagaggagccccgcgcgtctccgcccgcacggctccaggtctggggtctgcgctggagccgcgcggggagaggccgtctctgcgaccgccgcgcccgctcccgaccgtccgggtccgcggccagccc

SEQ ID NO: 3364 - DNA, 221 bp, Homo sapiens
agtccaggtctgcgctcacacgcgcggcgctcacacgcgcggcgcccacctggctgcagtcccggccagggccagcgcgccgcggctgaagggggcgctcggactcctctggggcggcgcgcagccgggacagtctcgcatgacgcccgcgctccagcggccccgggacgcggcctcaccctcaacccctggcggtctcagcctcggtctttgtgtctcgg

SEQ ID NO: 3365 - DNA, 311 bp, Homo sapiens
gccccgccccgcatccgcacacaccttttccgccgctgccctgagcgcagcgacaagggcccccacacctccgcggcccgcaatgctccggggccaagccgaggcagggaggcgctcccgcagctcctgactttacaacccgcgcgcgtgtgcaccgagccgcgggcacaccgcgaacacacacacacacacacacactcgtgcgctcccgccctccgcccggcccgggctctccgaacttacctccgaggcgccccgggcgcagggcccgcccttctctgcgggtctccagcggctgttcggcagtggtc

SEQ ID NO: 3366 - DNA, 308 bp, Homo sapiens
ggtggcgggcagtgtggtgatggcctttgaggaggtctgcccggagcgcatcgacctgattcacaaaaactaccggaaactctgtaacctgctgatcgacgtggaggagtggggccaggtggtcatcatcagcatgctcacccgctacgcccgcacgcagttcctgagccccacccagaacgtaagtgggcccagcccaggcagagcgggccgaagtgtgtcccggggaggcgcccacagacccgtcggtctccccgtccaggaatccctactagaggagaacgcggaaaaagccttctacggctcag

SEQ ID NO: 3367 - DNA, 201 bp, Homo sapiens
cgagaactctgcgggtccagaacgcccgcgcggacgcttctcttacggcgccggaagccggcgccgagtctgtcaccgggcatccctctgttgccttgacgacggcgggcgctgtaagagtggagaagctgcaggtgctgaggcgcggtgaaagaaaccctgggagccaagagcacgaggagctggtgtctgtgtcacatt

SEQ ID NO: 3368 - DNA, 201 bp, Homo sapiens
aggtgactccggccctggcgaggcgcgatccggctatgcgtgtgtgtgcctctccccggagaggaccccggccgccgagggcacgcggggcccagctaccgcccgcctcccaaccagttgctggctcgtttcgatggtgcaaattgtttttttttgctccccactaaatagcaacagtttggccacgctcaagtggaataa

SEQ ID NO: 3369 - DNA, 201 bp, Homo sapiens
gggacttggtgactttagcaccattttttccttttccttttttttttttgcctccccaccgtctgttgcaaccctgcaaagtctcggagtcggagagcgcgcctcgcttccagagcccccggacccggcgagtcagcgatcgccgagccggccaccatgcccggcagaccgcgccactaggcgctcctcgcggctcccacc

SEQ ID NO: 3370 - DNA, 630 bp, Homo sapiens
agccccttcctgccactcggagcagagcgcgccagcgcgaggccgggccggccgcctgcgcagcgccgggctaattttaactgttgattacatcttcagcgtgtcctttcataggtctcatttgtaattgagacgaatgattacagtggggcgggaaggagcagctgctcattaattaatttctaattaaaagtgcctctcgttctcgggtgactaaagagaaacaccgttcgctgggcgatattgactcggatggaatttatttgctaacgcccggaggaatggcccctccgtccaccgcgcggccgggactgtcctggcccctcccggcctgagccgccggcgagtgaccggcgagtctgcggccaggccgggctgcgcgaggtggggctgacgtcagagcctcctccgcttcaagccgcgcacatctgacttgacgggttcgcgcgactcgtttttttttttttctttttcgtaaaatatgtatttctgtcgccgctgcgaggccgctcggtcccagagccccctcgagcctccggaatgcgaagttaaaggaatcgcggcggccaccgctgctcactttgttacccggttagaaaagtttgcggagcgcggggatggactaaccgg

SEQ ID NO: 3371 - DNA, 201 bp, Homo sapiens
gagggcggggcgggcggcggccgcgcctctaatcccggcgctgcgtgtgggagcggccggatcagggaattagcgctgtaacttcggattagtaacgctcgctaaatgagtgcctaattccgacccttcatgcttttcagcgtcgcggctgagtcctaggaggcctcctggccaggctccctccgcgctctggtcccattt

SEQ ID NO: 3372 - DNA, 239 bp, Homo sapiens
cccgtgaaccccgcccggggacaccccacagcagccgcgcccccaccctcctctccccaaaccgtcccgggcccctgtcgccgccaccttctgccaaaccgtccccatctctccagcggagctacagcggggcgcggcgcacacaaagggggtcggagggtggagagtacagaaggagggagagatcccgccagggctcgtggcacgggcctgggagcagctatttacccgatttcttc

SEQ ID NO: 3373 - DNA, 201 bp, Homo sapiens
gacgtcagccgcgcgggtcccccgagcccgcgccgcgcccagggacctggcccgccccctgcgcccccactctcttacccctcccagaaacacagcacgcgggccctccccatgcaggccactccctacggagccccaggccagctttggggcggtgaaacgaaggtgtcaaggcatagtactcctccgggaggctggaca

SEQ ID NO: 3374 - DNA, 221 bp, Homo sapiens
cagctgccaacttcgcgcgcggagctccccggcggtgcagtcccgtcccggcggcgcgggcggcatgaagactagccgccgcggccgagcgctcctggccgtggccctgaacctgctggcgctgctgttcgccaccaccgctttcctcaccacgcactggtgccagggcacgcagcgggtccccaagccgggctgcggccagggcgggcgcgccaactgcc

SEQ ID NO: 3375 - DNA, 201 bp, Homo sapiens
gcggggaggggatggggtggcgggagaactgcccctccccccagccacaaacccatcaggttcccaaacctttcctggatcctcttctccgcgcccccgcgagcccgggatccaggggatggagaactcggggcggaggagcgccgagccaggcgggagggaggccgagccgtgggcgggaggcggaccggcgtggggctg

SEQ ID NO: 3376 - DNA, 246 bp, Homo sapiens
gccccgggggcccctagccaagcaccgcctggtgcccccggcccagggtcgtgtgagccggaggctgagcccacgcaaggtctccacctgcacagaccacgagctggagaaccacagcatgtactgcgtgcaatgcaagatgcccgtgtgctaccagtgcttggaggagggcaaacactccagccacgaagtcaaggctctgggggccatgtggaaactacataaggtgagtcctaagaaaaccca

SEQ ID NO: 3377 - DNA, 223 bp, Homo sapiens
ccgactatgactatctggacctggacaagatgagcctatacagcgaggcggacagcggctatggctcctacggggggttcgccagcgcccccactaccccgtgccagaagtcccccaacggcgtccgcgtgtttcccccggctatgccgccaccggccacccacttgtcaccggccctggccccggtgccccgcaactcctgtatcacctgcccccagtgtca

SEQ ID NO: 3378 - DNA, 201 bp, Homo sapiens
ccagggcacggcgtcagcggattcacggagaaggagaaaagccccactgccgtgcagaagcctaggcccgggtgagacgcctgcgaaggctgccagcagcggaagagaaggggcgtcctccgtgctgcgcagcactcgcccgcggtaggtgggcgcggagctcagagctgggagccaaacgcaaacgctggcgagaagccc

SEQ ID NO: 3379 - DNA, 244 bp, Homo sapiens
gccccgctgctccagcggccgctgccttagaaaagttaacgagaaccagatgtggtggccactgccgaactttctcagagccggtgattggtccccagccgagggcctcagccaattagcttgctgggtgggcctggagtcccgccccgcccaggcgcccgcggagatccaggttcgaggctggcgcggcgcggagagtgggctggaggccggggcgggacgcgttgtgcagcgggtaagcgca

SEQ ID NO: 3380 - DNA, 201 bp, Homo sapiens
tttgcccggctcgctgaaggctggctctgggcctgggggcagtgcccgcgaagggctgcgatggcaggccccgctgccacacggcatcgagggtccctccgcctcggcgccaggcgcacgcccttctgccacatccctcgcggggcgcgccgccagggccacctgccctttcaagccccgccaggcagccaagggtgagga

SEQ ID NO: 3381 - DNA, 457 bp, Homo sapiens
ttgagggaggggccgggccttcgggcctgcagacccgccaccgcgcgtgcgcatgcgtcggccgcgagcccccgggtgcaggcctgggcggctccggcccgcgcacttgtccaggcgctgcggctcagcgcgccccaacctccagctcgggcggagagcgggggcgggactgaagcaccgtgttcctcaaagtatcctctcgccgtcggcagccctggcctcgcaaatgctccagcgcgctcaggcgcacgcagagactggcgcggcagcctccgggccaacggcacgcgagcaaagctggttggcgacctgggacacgcagtagaagttgaggctgcaccgactcccgccgcttcgggggaggcatgggcccgggcaggcctaggaggaagctgcacagcccgaggcccgggcgggagtggcgggccgcgggcaagggaacgtatatttggaaggg

SEQ ID NO: 3382 - DNA, 244 bp, Homo sapiens
gcgtcccctctgcgcgcggcgaggccgagacgtctcccgcggtgacagcgtgcaaggcggagacccggcgcgctcccagcccagggaaagcccaggcgacgcgaccgcaagcccgagcccaggtccctcggagccgccagggcgcgccgggctgcttgccttcctgccccttcctgcaggaatcccccgccgcccgcggccgggactccgggcctctcccgggcgtagattccagtcaccgctc

SEQ ID NO: 3383 - DNA, 206 bp, Homo sapiens
gagcgcagcggcggggcatggaagaagagggttgggggcgcgcgttacctgcaaaggttctcgaggtctccttccagccctggtggtaatcccgctcagcgccgcgccctcccccagatccaaacttttgctgggtcctccgggtggcggcggcggcgacggcggcggctgctggagccaagccctgtcgcccgcagcgtcggggc

SEQ ID NO: 3384 - DNA, 203 bp, Homo sapiens
agagagacagcatgagaacgcgcagagctgcaccccgcgggggccgggcgccagcagcaccgcgctgccccacccacggcgcgtctgctccccgcgctgcgcgcccagcggggcgccgagccccagaaactttagcacatggccggtccggcggccacggtggccgtagctgccctgctcttcgagcgccccccactgcttcc

SEQ ID NO: 3385 - DNA, 266 bp, Homo sapiens
cgtgaccactccccgccccacccccggggcggggtccgtcagaaaccccaagcgctcgcaatcgcctcccttcgtgggcgggatggggaaactgaggcccgaggccgccccgctggttggtgcaagaaccagcctgcaacccaagtcctgagctgttggcgccccgccccgtgcagttgaacccaacccacccggggctgtgggcagcgctctcttggggctgacacgttatcccgagcctgaggaccaagatcggagtgacctgg

SEQ ID NO: 3386 - DNA, 242 bp, Homo sapiens
cccgaacctccccaaacttggcggcccggggcgcgtgggggggacgccccgttacctgcgcggccataaaggagagatccatggtgtcgctgcagccagcgctcgagtcctcgctgctgccgctgccgctgcgggtcagccgcctgcacagttggcggggatcgggctgagcagcgagcgtccggagaccgcacggcgcactcggctgtctctgggcttctggctccagatctctactaggc

SEQ ID NO: 3387 - DNA, 201 bp, Homo sapiens
caaagcaaaacaggacaaacgaccgcggcgcgtcgacgcttggcgggtcacggtcacaaagcgggtctcagagccttcctcaggcggcggcaaagggggcgcccgaggtcaccggcaagagacagattactggcgcctcgggaaaacagagtggggaagggcgagactgtgtgcccatccacgttcgcgcgggtctgagct

SEQ ID NO: 3388 - DNA, 201 bp, Homo sapiens
acgctggcgaatgactatggaaacaacattcaacagcagtgttttctatgccaggtacacaaccgccttggcgtgggttgataaccatgcctatctcaccgcgtggcactgagccgaccgcacacccagggccccggtctccagggctcgcttactcgcttactgcgtgaagcatccatccccgcaggagccggagcagga

SEQ ID NO: 3389 - DNA, 312 bp, Homo sapiens
tggtcgtctcctccgcggccaggcgcatcctgcagcgcccagaccgccgcgtccccacccgcgtccccaaccgcgagcgctcgcctgggccgggccgggcgcccgagattcgggagagattaggggcccgcaaagcagaagagcagattcagaaagaaaaaaaaaaaagcgagaagtgcgagaaaaatatactgaattcagctaaacacacggcagatgaaaaaaataccttgctcagaagccaaaaacgagctcccgagccgtgagacactgttgcgcccccgccaggcgtgcaggccggatgttaggggg

SEQ ID NO: 3390 - DNA, 203 bp, Homo sapiens
gcgctggcagggggaggcttcggcaacgcctgggggcttcaggccagcctcctccgggctggaaggcaccgcacaggggcttccgccaacttcggtcctcgcgcggtcgggacacggccacacctgcccgcgggggtctgcctcccaggccgccgcaggccccccggagcctaagaggaccccacaagcagccaaagccagcg

SEQ ID NO: 3391 - DNA, 201 bp, Homo sapiens
tcccggggcgggcggcgaggggcgggagcccagagagtgccccgcccttgcccagtgctgggcggcgcgtggggggggtagggtccccgcttccccacgcggccccgcgcactccaaggaccccaacctgttaggtgagtccctgccccggggaggggcgctgggggcggcggcgaggatctagttgcgcgcgcgcatgcg

SEQ ID NO: 3392 - DNA, 283 bp, Homo sapiens
gtggcaaggtctggggattgagaggcccggtgagtgccagtcccgcaggctgcgccggtgctcggctcttactccagcccgggggccccaggctcctcgcgggctctggggcgctggtgtccgcgcagccccagtcgcttccgcagccaccgccgctcggctccgcggaggcggcgcgcagcgggggcgcccgggcgctgtccccctgaggcctcgggggctcagggtggcccgcagtgccactggccagggtctgcgactcctggggcccgccgccgccgct

SEQ ID NO: 3393 - DNA, 201 bp, Homo sapiens
gaacgccttccagcccggcctggcactggcgccggtgctcttcatcctggccatcacggccttcagggacctgtgggaggactacagccgccaccgctccgaccacaagatcaaccacctgggctgcctggtcttcagcaggtgagttgggcgggcgggcgagcgagcgcgcggtggcgcagggcagggcgccccgggaac

SEQ ID NO: 3394 - DNA, 247 bp, Homo sapiens
aggcgcagacctacgagctggagcggcgctttcggcagcagcggtacctgtcggcgcccgagcgcgaacacctggccagcctcatccgcctcacgcccacgcaggtcaagatctggttccagaaccaccgctacaagatgaagcgcgcccgggccgagaaaggtatggaggtgacgcccctgccctcgccgcgccgggtggccgtgcccgtcttggtcagggacggcaaaccatgtcacgcgctcaa

SEQ ID NO: 3395 - DNA, 427 bp, Homo sapiens
cagcgcgcctcgggctccgcgcgccgccagctcctggcccgcccgccggccccgccgcgcccgccagccccgcagcggagcctcggcccggccccgggccgccgccaccacgccgcgcgccgtactccgcgtcaagaatggggcggccaagctgcccaagccgcccgccgccgccgccgccgccgcggccgaggcgcccggcgccggcgcgggcatggagcgctcgcagagccgcctcagtctgtccgcctccttcgaggcgctcgccatctacttcccgtgcatgaactccttcgacgacgaggacgcaggtaagcgcgcggcccgccccccagacccccggggtgtcccgggatccaggtccggtagccccctccccgacccgtgcgccctcctccccacccccaatcccctgggaaggcgcccc

SEQ ID NO: 3396 - DNA, 246 bp, Homo sapiens
ctcgggggcggctgcacgtggccgtggccctgaactccctgcgggggcctcgaaacccgcctgcggggaggccagggcgacagaggactcgggagtcaccgctggtgcgtggcggcgtggagcgcgcttgttacggccaaggtgcgggtccggcttcggttcatcccaaggggtcaccgggatgcgaagtccgggacgttcgccgccgcggtgaccccggcgggggcgcatcccggctgtgggccg

SEQ ID NO: 3397 - DNA, 384 bp, Homo sapiens
tggtggcggaatccccggggcggccggaggcggcggccggggagtcgagaagcaagtactagcgctccaggaccgcgcgcgccgccccgcgccgccccgcgccgcccctcggtccagagcccccacccccggcctgtgagcctgcggcgctggtggagcccggctccaggaagaggagctcacccggtcccccctgattggacagcagcgaggtcccaccgggcgcctccgcggcttaaaaccgaagcgggggcgagggggaggtagagcccgccccctgcgcgtcgcggctgggagggagaggaggtgggagagaaggaagaggcggaggaggcagcgggcgccgaggctctgggacccgcaggcaagccagaccgacgcgca

SEQ ID NO: 3398 - DNA, 415 bp, Homo sapiens
cggggggggcaggggtcccgggccgcggggtgcgggggctgcgccaaaccctcgcggggcgtcccgggcgcacggagggctcggcgcccacccgcccgacggcgttccactcactggcgcccacggcccgcaggcaaagcgtggaaggagctgaacgcggcggagaagcggcccttcgtggaggaagccgaacggctgcgcgtgcagcacttgcgcgaccaccccaactacaagtaccggccgcgccgcaagaagcaggcgcgcaaggcccggcggctggagcccggcctcctgctcccgggattagcgcccccgcagccaccgcccgagcctttccccgcggcgtctggctcggctcgcgccttccgcgagctgcccccgctgggcgccgagttcgacggcctggggctgccca

SEQ ID NO: 3399 - DNA, 543 bp, Homo sapiens
cgctggaagaaaaacttcccgcgcgccggcagaactgcagcgcctccttttagtgactccgggagcttcggctgtagccggctctgcgcgcccttccaacgaataatagaaattgttaattttaacaatccagagcaggccaacgaggctttgctctcccgacccgaactaaaggtccctcgctccgtgcgctgctacgagcggtgtctcctggggctccaatgcagcgagctgtgcccgaggggttcggaaggcgcaagctgggcagcgacatggggaacgcggagcgggctccggggtctcggagctttgggccagtacccacgctgctgctgctcgccgcggcgctactggccgtgtcggacgcactcgggcgcccctccgaggaggacgaggagctagtggtgccggagctggagcgcgccccgggacacgggaccacgcgcctccgcctgcacgcctttgaccagcagctggatctggagctgcggcccgacagcagctttttggcgcccggcttcacgctccagaacgtggggcgca

SEQ ID NO: 3400 - DNA, 227 bp, Homo sapiens
tccagggcgcagacctcccactgcttcccgggtccctcccgggccttctttctgattctctcccttcccttctccgagttcctgctcacattcaggctgcgtctcggcctggctgccaaacagaacgacgttcttgcgcagagctgaccaggggtggcggcgggaggcaaggctcccggcaccggaaagcaaagcaaagaaaaaggcattgcagccatcgctcctgg

SEQ ID NO: 3401 - DNA, 323 bp, Homo sapiens
ccctgctccgcgattggcgggagccggagcctccctgaacccggcgcccacaccatgggctgagcccgtcggcgccgagggagttagtgcgacccggctcggcgcgcacggccaaggcacgcgcgctggcacacgcgggcgcggacacgcgcggacacacacgtgcgggacacgccctcccccgacggcggcgctaacctctcggtaagtccagcgccccacgcgacctgcccggctcccacgctggctacagcggctgcggggacggggaggaaggcagcggggtggccctaggggctcactctgcagggctcttccgacgg

SEQ ID NO: 3402 - DNA, 279 bp, Homo sapiens
ggcgcagaccacctggaaggggctgtggatgtcgtgcgtggtgcagagcaccgggcacatgcagtgcaaagtgtacgactcggtgctggctctgagcaccgaggtgcaggcggcgcgggcgctcaccgtgagcgccgtgctgctggcgttcgttgcgctcttcgtgaccctggcgggcgcgcagtgcaccacctgcgtggccccgggcccggccaaggcgcgtgtggccctcacgggaggcgtgctctacctgttttgcgggctgctggcgctcgtgcc

SEQ ID NO: 3403 - DNA, 261 bp, Homo sapiens
tctccgtcggtggaggtcgcggctggcggagaccgccaagccagaggaggggatccgaggtcccggctgggcgaaggttctggagggggagaagacggccgaggcgtggaggggcagccgcggcggggcgacccttacctgctcactgcggggcctgtccgtggggccggggcagactccgcaaaggacgcgcagcctgcaagtccgcggcccgcgcggcgcggggatggggagcgtgtgcgccgaggagcgcgcgccgag

SEQ ID NO: 3404 - DNA, 364 bp, Homo sapiens
tgtacgcgcgcgtggcccgacgcgaggcccggccggcccgggcccggggcgagattgggggcctgtcgctgtcgccatcgcccgagcgcaggaaaccgccgccacctgaccccgccaccaagcctaaggtgtcctggatccacggcaagcacagcgccgctgcagctggccgtgcgccctcaccaccgccgccaggctccgaggccgcgcccagccccagcaagaggaaacggacgcccagcgacaaatcggcgcatacggtcgaacacggcagcccccggacccgcgacccaacgccgcgccccccggggctgcccgaggaggcgacagccctcgctgcgccctcgccgcccagggcccgagc

SEQ ID NO: 3405 - DNA, 242 bp, Homo sapiens
cagggtggaggcggtgcctgactgcccctctgcgtgtgccctgggaggtgggtttgctctggggacagaggtgctggacgtgtaggagcagacatgccgcgcgctccgaggaagcgccggaaccaccagaagcacagggacgcgggtgccgagagtccccagcactgaaaacggggatctcctcttctgtaagggattttcttcccttgtcttaacccacttctctagactcaagggacgcc

SEQ ID NO: 3406 - DNA, 285 bp, Homo sapiens
cagtcccgggccggggtggctgctccatcctcgtggctcagggaggaggcgttgggtgcgtatgcttaggggtgtgcccgctgccagggctgcagcggccgccacctccaaccagctgcaagccgagctgcccacctgggaccgggccggcccggcgggcttggctcccggcgaaggcggcggcgttggtgcgcggcggctggggcgcgggacgcaggcagtgcgtggcgcggctggcgtcttcgggcgccgccaccgagcgagggtgcggccccgggcggccgt

SEQ ID NO: 3407 - DNA, 222 bp, Homo sapiens
cgccaccgctgccgccgcctccccgcggagtgacgcgccctgcagccaaccggggcagccgggggggaggtccgggaggggtcctgggcggagccgggccgcccccttatcccacgggctcggggctgcttctcccgaaaacttcagccctaattgtcctgggaatgtccgaggtagagaaagggagcgagggagcaagcaagaagctggaggatcagtgcc

SEQ ID NO: 3408 - DNA, 201 bp, Homo sapiens
gtagcgctccctggccccgcgcgtcgcccgggggtcgctggctcggtgcgtgtggccgcctcgccgcctggttggagcctgctccgcggcgcagggctgcgctccgagggtccgctggctcggtggcctggggtttgcccggctcagcggctcatggtccggcccccgcgccccagcccccgccgccgccgccgccgccgc

SEQ ID NO: 3409 - DNA, 298 bp, Homo sapiens
ccggctctgggtggcggcgtcggggcagcgcgctcggccgagccggggagaggagcgcgggagacccggagcggagcggcaggagagcgcggagcgaagcggcaggagcagctcacagccaggagcgctctcccgcccccaacgccgcgctcccccctccaaaacggtttaaaaaaatccaccaattgcatggccgcgcacccccaaaaaggcacccgccgccacctggtcccggtgaactccaggaggcggaggaagggcgcggggtgggtgcggtgacaccgtgggaggtggtccc

SEQ ID NO: 3410 - DNA, 272 bp, Homo sapiens
cactcactccgacccgaggctgtctacccggcctggcatgtcccggcgctcctggggcccctgtactccgctggttcctcgctgtggtgtcccgcagcccgaccatttctgtgcttctaggagcccaccctgggcggcagggaggcgttgcgtggggctcacgagttccacgctgtcatctccaccagctcctacctcccaggcgcctgccctcccgcactgtcaggttctgcctccgcagcatttggcagatctgagcccggtccctgtca

SEQ ID NO: 3411 - DNA, 201 bp, Homo sapiens
cttagtaacatctgcagggctggctccccggccgcccaccccgccagcctgggtttctgtgtggagtgcgtctctgtgcccctggccagccgccggtcacgtgcacttcctgccaggggctggcaggctcctcacttgcccaaaccagaaatacaaggcacagtggccttcagctgagggatggcactctccctcatgctc

SEQ ID NO: 3412 - DNA, 251 bp, Homo sapiens
tacgctcctcgcgtccgcccgcgtctgccctaggcctccaccgcggcttcctctgtccccggggccgccctgctccccacagaccccactctcgggggccgctcccaggacccccgcccgctctctcctgactcggtccctgcccgccccgcctcccttcctcgggctccctacctctccctcgccggccccgacctcgggggcgctccggacctgctccccgaatatctccagctccgccttcagcctgc

SEQ ID NO: 3413 - DNA, 249 bp, Homo sapiens
cggcggctctcacctggagccgcacctggggcgccgagctccggggccgcggaaagaatgcgcgccgcccgtgcgctccgcctgccgcgtctggccacccgcagccgccgcgtccgcacctgaccatggagtgcgccctcctgctcgcgtgtgccttcccggctgcgggttcgggcccgccgaggggcctggcgggactggggcgcgtggccaaggcaggtgccgccgagcggagctccgagagcgggt

SEQ ID NO: 3414 - DNA, 249 bp, Homo sapiens
tctctagagctaacttttcagacctggaggtctccaaggcccccgcaactcagtgagtctcggggcaccaacaaatccccgcgggggtcaccgcgcccgcgaacgcagagtccacacgtggattcccgcgcctgtgatgccccgacccgtcccgggtccccgcacagacaatgccgcgcgtccttcccgcagccactccgggacccgcgccccgcgccgcccggacgtccccctgcgtctgccggggac

SEQ ID NO: 3415 - DNA, 201 bp, Homo sapiens
ggccgcggcggccggggccggtgccggcgcctccttgggcggcagcggcgaggagatgggccccgccgccgccgtggtgtccgccgtgatcgccgcggccgccgcgcagagcggcgcgggcccgcactaccaccaccaccaccaccacgccgccggccaccaccaccacccgacggccggcgcgcccggcgccgcgggcag

SEQ ID NO: 3416 - DNA, 201 bp, Homo sapiens
atggcccaggcggccgccccgcgcgccccagccccgccgcgcgcctgagcccggtgcggcgccagaagacagcgcgcagccgcccctgagtcgtggaggcggggaccaagctggaaggagcagcgactcccggaccgagtcgcgagtgtgcgccgtccgccgcccgccggatcccccggaccccccgaccgtaagtgccgt

SEQ ID NO: 3417 - DNA, 251 bp, Homo sapiens
accgcgcagcccgcgccccactgccgaccggaccccacgctgttgcccccagcgctgcgcgccctgcgcggacccgcgctgctggacgccgccatcccgcgcctggggcccacgcgagccgcgagcccctgcctgctcctgcgctaccccgatcccgcgccctgcacccgccccgggcccgcgccccgcgcccgcacgcaacggcacccggccctgcacacgcggctggctctacgcgctgcccggcgccg

SEQ ID NO: 3418 - DNA, 201 bp, Homo sapiens
ggggccccgctgagctgagccttgcgacccggtttatgtgacgtgagttccacctcaatctaagtgtgaggaagcgaacagcgttctgaaacgcagaaacgtgcccattcgaattgttaacgcgagcgcagagcccactgacaaagcaaaataagacaaaccgggagtcagaaaactcagcgacccacaggatccaccgtg

SEQ ID NO: 3419 - DNA, 201 bp, Homo sapiens
tttcagaacccgcgggtcacccgggagctcctcccgcagtaccagccgaaagctcccagtgccgaggagggcgggcagctgccctccccgacctcgccccgcccgcgcggacgcccccggccccacgcggggaccaccccgggactcccgccggaccccgcgcgcccgcggccaacctgcgtgcacctgcgccccgcgcca

SEQ ID NO: 3420 - DNA, 201 bp, Homo sapiens
aggccgagtccgcacggcgcccccgtgcagccagcggtcagtgaccgcgcggcccgggcgctccccgcgcgccctagctccccagacggggcccggacgcggacgtcttctctgcagttctgctctgatcgctagggatgggctctgggcacccagcggctgagggtggggagcggccagcgcctgatgtccagttcctca

SEQ ID NO: 3421 - DNA, 337 bp, Homo sapiens
gtggccccgccccagggccgcggggaggcgcccccgtgcggggcggagttgtcaccgccccctccccaatccccggggactgtggccccttcttaagcccgcggcgcctctagctgcccctcactcgtctcgcccgccagtctccctcccgcgcgatggcctcggcgctgagctatgtctccaagttcaagtccttcgtgatcttgttcgtcaccccgctcctgctgctgccactcgtcattctgatgcccgccaaggtcagttgcatctccaggcagcccttcggacacccggcgtcctgtgcccactaacgggcaccgatcccgggagccctgag

SEQ ID NO: 3422 - DNA, 201 bp, Homo sapiens
tgccctcggcgtcccacgtgtggcggcggccagcggcggcccaggaggcagccggtgagcgcctgcgagcagagtggcgggggccgctgacaggtcccgcgcagcccagcccagcccagccacgcggctcacaggtggggtccaagagcagtttggagcaacccggcgctacggagaggggtggacggctctgcacgggcc

SEQ ID NO: 3423 - DNA, 201 bp, Homo sapiens
ttctttgcggcgaggtcgcctgatgaattcaagggcaccagtgctccgcgagaactttctgtgggttgtgacgagaaccaagcggagcgcaaccctcaccgcacccggacaggatgcgctgcgcaatctgccgtagtttccctgccctaccccgggtggtccgaagctgtaaccctgccaattccctatcatacgccatgt

SEQ ID NO: 3424 - DNA, 201 bp, Homo sapiens
tcctgcagctctgtccagatccggaagccgccgaggaagggaggaaggcgggggtggggagagcgcgaccttaagcgctggcgggcggcgaggaggggccgcagcggcccgaggaagcgcctggaggcgtcaggggcgccgagtccccagggaggccgcgctctcgggaagtttcccatcggttgcccggagcaggatcgg

SEQ ID NO: 3425 - DNA, 1216 bp, Artificial Sequence
  Description of Artificial Sequence: Synthetic polynucleotide
taaggtggggatygggaygygatyggggatggggaagggggttgtaggaggtttygtttgygttgtygtttttgttgggtatagygttttttattattygyggygatttyggttttygtaaggtggggyggygagtaggagtyggggttaggttaggggttygagttttygttygaggggyggggaaggygggtgaygtgagtygggtygggygggyggagttgggatyggtttygggaggygggggygagygygyggagaggtagaygygaggagggaggyggttgagtagygygggyggttttgyggygggygyggtgggygygggyggyggggtttygggattttygygygtttttttygygyggygtygtygtygygygtttttaygtttygygttttayggygttttygtttygygygtttttygtgttygttttttgttagttttygggtygyggtygtttgtagagygagygtttagayggagttttygggtaatttgagtggygtygatyggyggyggagtttttggtagagtttttygattyggtagygyggaggggattygygttygttygygtygygttattttaaattttaagtagygtygttttatyggygyggagtttyggttggaggtaagagtygygygtygggagataygtatygtgagyggtagygtygtyggttttttttttygtygtttyggagggygaagtygyggttttttagttttttgttgygtygygatagygtyggaataygtttygtttygttgtygttttygttgtgtygtyggyggagggggtygygagtttygygtttyggtyggaggatgtgygttttygygggtygtttagtttgagttatgygttttaayggyggyggygygtyggtyggtatggagtttygygyggtygygttttgattygttgtgygtttygyggtyggygggyggygggaggyggyggatygagagtyggagatyggygtygygggayggaagygagygggygygggygtygygtagatggtttgggygagttaggtttgaggtttygtttttygaaaygtgattatgtggatttaatagtttttaggatttaggtgagygattyggtyggygtygggtgygtgtgggygygtgggtgttaggttgggyggaagyggygtttttttttatgttgtaaattaagggattttttttygtttt

SEQ ID NO: 3426 - DNA, 365 bp, Artificial Sequence
  Description of Artificial Sequence: Synthetic polynucleotide
ggygttygaygtttatttygggtttggygttttttttyggttattaygyggygtygtttttygggattttttagttttyggagtttygygygtttagagtygttyggagygygggyggggttagtttgggtagtygygggtygttgttgygtyggaagttttygtygttagggagttttttgggygttaggttttgggtttttgggygaagtygaygttagaatatgtttggtttygtatttagtttatygtatttttagygygygtgggtggggggygtyggttgaggtggggagggtatagtttagttttaggttatagtgtttygggyggggtagygyggtgyggggtgaaygttatyggtt

SEQ ID NO: 3427 - DNA, 201 bp, Artificial Sequence
  Description of Artificial Sequence: Synthetic polynucleotide
tggygtgayggtttgtggggtttgyggggtgygttgttttyggatttgyggggggaggyggttgagttggyggygttygygggtttagtggtgagtgyggygtttttaygtttagttygaygttttyggagyggtygtygygtaggggtgggygygggtttttaggagggagggyggttgtgaaygygttttgtttttygc

SEQ ID NO: 3428 - DNA, 201 bp, Artificial Sequence
  Description of Artificial Sequence: Synthetic polynucleotide
attaygtygttygtgtttattatttayggtayggaggaygaggtgatygatttttygtaygggttggygttttaygagygttgttttaaggyggtggagtygttgtgggtggagggygtygggtataaygatatygagttttatagttagtatttggagygtttgygtygttttattttttaggagttgtttagttagygc

SEQ ID NO: 3429 - DNA, 201 bp, Artificial Sequence
  Description of Artificial Sequence: Synthetic polynucleotide
gggygyggygggygaggggttygggttgagttgygggtyggttyggatggygggyggygygggttggtygggygttttygyggttttgttgygtttygtgygtygtttgygygaggtgttygaggtgtgyggtygygatttygayggttttttgygygtggagygygtygyggygttyggattgygtttyggttagggyga

SEQ ID NO: 3430 - DNA, 201 bp, Artificial Sequence
  Description of Artificial Sequence: Synthetic polynucleotide
ggygtttttttttygtttttggtttaggttyggttygygggtgtagttttttttagggttttttttttttttygggtygygygttygtttygtatygyggyggtttttyggtagtgtttgtttttattggaygtatagtgatygtgaygggtayggggygygagtttttattattataatgggtgtgtatggygyggggyg

SEQ ID NO: 3431 - DNA, 201 bp, Artificial Sequence
  Description of Artificial Sequence: Synthetic polynucleotide
tttttttttaattgatttaattttttaattttagtttttygtttttggtatyggtttttttttaagtttttagattttaattttggttttygattygtttygttatagtttgggaagygggagaagtagygygygtttttttgyggatttttttttagggaagattgtggtgttagttgtttagggggattagggggttat

SEQ ID NO: 3432 - DNA, 201 bp, Artificial Sequence
  Description of Artificial Sequence: Synthetic polynucleotide
agtttaggggtagggggtttagggtagttagatttttttaggtttaggaagagtagtttttagygttyggttgttaggtaattyggttttyggttttttayggyggttttttyggtgtgttttattaagagygatagggttggtgattygaggggygygtgygyggtygttagtttgggatttgtayggattttttttttt

SEQ ID NO: 3433 - DNA, 213 bp, Artificial Sequence
  Description of Artificial Sequence: Synthetic polynucleotide
gttttttgtttgaattaaagtggttaggtatttagtttgtaagatgaataaatgaaggaaagaaggaaygaatgaataagggtttattttgtagagygttygygttttagygygtattaggtatattagtgttaaaggtgttgggggtygggtttagygttyggygyggttggaatgggggyggygaggagttttttttagttagtygtaggg

SEQ ID NO: 3434 - DNA, 201 bp, Artificial Sequence
  Description of Artificial Sequence: Synthetic polynucleotide
gggaggyggtaggtagggggygttgyggggygaggtaagtgtagttygtygttgtttgtttgygagtttggggttgygygtygttttttatttagttgygygattygagygtygygtttatygygtttygtgggttttygygtttygaagggtygggattyggtttgagttttttttggttttyggtgtaagtygttgggt

SEQ ID NO: 3435 - DNA, 201 bp, Artificial Sequence
  Description of Artificial Sequence: Synthetic polynucleotide
yggggtattyggtygtgtygtygtygtygttttagttgtygtttttgttttygttttygygatygttgttagagygtattattygygaggaggtggagggygaaagtttggatttgtgtttgtagtagttttataaatagttaagtagttgggtttggttggtggtgggttygyggtttttatygygtyggtttyggaygc

SEQ ID NO: 3436 - DNA, 201 bp, Artificial Sequence
  Description of Artificial Sequence: Synthetic polynucleotide
aaggggggtttggttygttagygtaggggattygagttgggtaggatatgtgagatagttatagttttttagagattaygataagatttaattagtygygygtggttttyggygtyggagygggttagtttagttyggtttagttyggtttygygtagagttttygtygttttygygtatagagtygggtgttttttgygg

SEQ ID NO: 3437 - DNA, 324 bp, Artificial Sequence
  Description of Artificial Sequence: Synthetic polynucleotide
ggtgggggtttgggagayggtygaagggggttygggtagaagtttygyggtygggtyggyggagggaagggggyggtygygttygggattyggtttttttyggttttatttatttgtttygaagagtggttttagttttgygtttttttttgygattttatatatagggatagttttaggtatagttttagtagtaggagtatggyggggygagggygygggaygttyggggattyggygggataygttttgtagygtttagggttttagttattgygggaygttttyggggtygtttatttygyggttttagttyggatttyg

SEQ ID NO: 3438 - DNA, 201 bp, Artificial Sequence
  Description of Artificial Sequence: Synthetic polynucleotide
tygyggtgttgtygygttaagygaaggaggaggagggttyggygattttggggaygaaygttttggaygtttygttygygtttttttttygygttygtygygygtttgtttgttyggtttttttttygtttttttttyggtygttygggttaaaatttaaggttaggtttttgagggttygggttttttagtygttttttt

SEQ ID NO: 3439 - DNA, 330 bp, Artificial Sequence
  Description of Artificial Sequence: Synthetic polynucleotide
ggattttggygtttttttaggttgttgygygygggttggggatygtgtatygttttgygygttagaygatgtattttttggaayggtagttgaggtaatgyggggtgtgaagtggyggygggtagaggggttygtaggggttgggattygygtgtttttttttgtttyggtgyggagtaygatgtgttygggygggggygaggaygttygggaggggttgggttgygtaygttygyggggtygtygtagatgggyggtttggaggygttgtagtttttgggaaatgggagttttygttttgttttttttgttgtttggttgggttgggtt

SEQ ID NO: 3440 - DNA, 293 bp, Artificial Sequence
  Description of Artificial Sequence: Synthetic polynucleotide
tttagtattttagtttttaagtttttttgagtyggggttgygttttygttgtttttttyggtygtygttttttggygttagagggatttygyggttygtaygggtttgttttyggtttygttyggagggtgtgygggttttygtttygttggtttygtttgtttattayggygygtttaaatttaygyggttygyggttttttgygtgttttgtygatttygggtygtaggaggggttagtttygtyggtttttaygyggggtttgygtyggtagygttaygggttggaaygc

SEQ ID NO: 3441 - DNA, 201 bp, Artificial Sequence
  Description of Artificial Sequence: Synthetic polynucleotide
ygttttygtttyggtttttygtyggtttggygggyggygaygtggggaggggtygtttagaagtyggggtygttygggtyggggaattttttygygtygaygtttattttttaygggtygtattygtygaggggtygaaaggggttttagtggaggaygyggtgggagttgggtttygttttagttgtygaygtyggyggt

SEQ ID NO: 3442 - DNA, 201 bp, Artificial Sequence
  Description of Artificial Sequence: Synthetic polynucleotide
tatttygttaaagtyggataaagygtggttagagtgyggtttagttttttagtttgyggttyggggaggagggtagygygggygygggttgggggtggygyggggyggygtttaggatttyggtgtaggygagagtgyggyggatttgttttaagaggagagygaggyggatttgttttaagaggagagygtggggygtyg

SEQ ID NO: 3443 - DNA, 226 bp, Artificial Sequence
  Description of Artificial Sequence: Synthetic polynucleotide
atggygatgtttttatttttttyggtaggtttttttaattaaaaagttggaaaygggaattygtaaataaygatttagggttttaaattatttgtaaagaygygatggggaggggaatatttgygygttttaaaattttaatttygaggtttttagtygygtttgattygggagtygggtgygtttttagtgttygygtaygaattyggygttttggtagtttyga

SEQ ID NO: 3444 - DNA, 363 bp, Artificial Sequence
  Description of Artificial Sequence: Synthetic polynucleotide
ttgtaagggattatagttataatttattaggtaattatatttatygtattgtagaagttatgaatttggygggygtgggggggaaggggaagaagttyggygagattagaggggaaattygaaaaagtaagtttttgyggtagtagttaggaaatattygttaggaattggttgygattttaattttagyggttygaagttttagtttttttatttttatygyggtagagtygttttygtagatatttttygaggagaatygyggtttygagggygttaggtgagtygygtygtttygagttttygggttayggtaggtygatttaggygttttyggttygttygtgttttygygttygggtg

SEQ ID NO: 3445 - DNA, 201 bp, Artificial Sequence
  Description of Artificial Sequence: Synthetic polynucleotide
yggttyggtgggggtttyggygagygggagggyggttggggatttyggtygygtygggygyggggttygggattygggagatygygyggygtygaagttaygygttagttttattgtttygygygtttygttttaggtttygggtttttttttygtatttygtaaagtygagattttttygtagttttttatttygagagg

SEQ ID NO: 3446 - DNA, 201 bp, Artificial Sequence
  Description of Artificial Sequence: Synthetic polynucleotide
tygygttttttygttagtygtyggttaggagtttttyggtttttgagtaggaygygttaaagggagttgggaggtttagtagtttttagygtygttttttygggtgaygtgaygttttttttggagygygggttygttttygttaagtttttatygtaggtttttatagtygagttaygggaagatgtaaygtygggygag

SEQ ID NO: 3447 - DNA, 267 bp, Artificial Sequence
  Description of Artificial Sequence: Synthetic polynucleotide
ygyggggtgggggygygggagtygttttttgttygtttygygygtatgttttygtygtatttgtttygtttagtgttttatatttyggggagtygggtggygttgggttygtygaggtyggggtttttttatgggagggaggtggttgyggyggaatttttagatgygtttttttttgtattygttttttgggaaggatttttttaaattttggttattttttgtttgttagtttgttttttggtagygaagttttagtagtttatt

SEQ ID NO: 3448 - DNA, 707 bp, Artificial Sequence
  Description of Artificial Sequence: Synthetic polynucleotide
gyggtggygtyggyggttgtagggggaygagttagygtygyggygttgggagttagttgagttyggtyggygagyggaggyggtagygtaggtagagyggyggyggtagygggagttygagygttgygygtttattatggtygtttagggagagttyggttatttggyggygtagtyggatttyggttttaatagygagygtagtatygattttttagtgttyggtttygaggaygatttggtygtyggggygattttgtatagttyggagtggagygaggagygttttygygtggataggaagaaatttgaggttatgttataaggtaggtatttttygtgttttyggatttttygattgagtttttaattttttttyggatatttttatygygygtttyggygttygttattttagtttayggtyggtyggtttagttttaggttygttttttygyggagtyggaggatatttagggattggagatttygygggattttttatttttttaygttttttagatttttaggygttgggggttttgtgygaatttgattggttttagaaaagtygaaggtygagtttgtattggygygtttaagttgygttttggattttggagatgttaattttagttyggatatttgggttgtgttattyggattattygggtygtatagagtatgygtgattttttttatttttt

SEQ ID NO: 3449 - DNA, 201 bp, Artificial Sequence
  Description of Artificial Sequence: Synthetic polynucleotide
ggatttaggattttgtgttygygtttttggagtygttggagttyggatttttgtaattgttggtattttgggggtttggtttagygttttgttgtttattygttttttttygttgtttyggaattaaagttttyggtttttttygttttygygygtttatttatygtygtyggggagyggttyggttygtatttagtatta

SEQ ID NO: 3450 - DNA, 201 bp, Artificial Sequence
  Description of Artificial Sequence: Synthetic polynucleotide
taggtttygygtttgattttttagtttgygtagygggtattyggtygggaagaatttttttagtaggyggtttagtattaygtttaygygttygygttygygttygygttygtggtygygygggttttagttttaygtagygtttatagatygtgagttygtagggtagtgttatyggtttgtgtagtagtttygggtagt

SEQ ID NO: 3451 - DNA, 201 bp, Artificial Sequence
  Description of Artificial Sequence: Synthetic polynucleotide
tattgggatttttatataygagttggtatatattagttatatayggttaattttagagggttggttttttgttttgggaygtttttaggttttygggtygyggtgyggagaatttaggtgggtgttyggtaagttatttattaggggttgttttttygygattttygttataagygtagggattygggggtygygttggtt

SEQ ID NO: 3452 - DNA, 201 bp, Artificial Sequence
  Description of Artificial Sequence: Synthetic polynucleotide
gaaaattgtaaaatttgggagttattttgttttatttttttgttgtttggggatatttttygygagtttgttyggtttygaagaaggagtagaggggattygtaatttagtttttagagtttygttaggaaaggygygagagatttattggtttyggtaattttgtttyggygttyggayggagttygatgtttgygtagt

SEQ ID NO: 3453 - DNA, 203 bp, Artificial Sequence
  Description of Artificial Sequence: Synthetic polynucleotide
agtttagagtgygtygagtatygtttyggtaggtggaggggttgygggaaataaaataatttgggtaggaatttgattggtagtaggtttatttttggttygyggtagggaatttaatggagatgaagaatggtggggaagggggggyggtgtttttttgggagtttaaygtaygtttttttattttgttattttttggagat

SEQ ID NO: 3454 - DNA, 201 bp, Artificial Sequence
  Description of Artificial Sequence: Synthetic polynucleotide
ygygygttttttygygygtttttyggattygygtttgtttattttttyggttttgttgyggtygaggttttaagtyggttatttygtgtttaggtaatygygggggyggyggyggyggygtgaggagygggyggttgttgtttyggggttttttggttygagtttttagttttygattttyggygtttyggygttygatta

SEQ ID NO: 3455 - DNA, 201 bp, Artificial Sequence
  Description of Artificial Sequence: Synthetic polynucleotide
gggtttttagtttggtttttaggygyggtggyggyggtgggataygygttaggygtttagagaaggatatgggataatggtttagttygaggaygttagaygtygtygttygattyggggaaggaagtttttgtagtyggttygggaattygaggyggggagggaggttagttttggaggtgygttgtygttttaaaataa

SEQ ID NO: 3456 - DNA, 208 bp, Artificial Sequence
  Description of Artificial Sequence: Synthetic polynucleotide
gygtygygtygtygttyggtttttygaagtygttttttgtyggygygtyggtygtttgygttayggygggygttatttatttygggtagagttttttgttygtgtagygygttttgggtttttagygttgatttaygttygtagtaggtgaggaaggygtagtttggggaggaaagtaagygttaagaagggttagtggggygttttc

SEQ ID NO: 3457 - DNA, 201 bp, Artificial Sequence
  Description of Artificial Sequence: Synthetic polynucleotide
gtaggggggttttatttattaagttatgttttattagggygttaggygggygaagtaaaggtagggatggygggyggggyggyggyggaggtggaatgggygttttttttttttatttggttttatttatttatttagattagaaaagygagtyggtttggagggagttygttyggggattygagygygtatttattagtg

SEQ ID NO: 3458 - DNA, 201 bp, Artificial Sequence
  Description of Artificial Sequence: Synthetic polynucleotide
gygtttygtttttygtttyggyggttttygtagtttygtygtygttygygttygygttttggagtygygttataaagggttygygygtagtygtygtygtygtygtygtgygaggagttaggatggttttggtttaygtyggttatttygtgtttttagtgtttggttttgtgygaaatagaggtatygtttttttttttc

SEQ ID NO: 3459 - DNA, 595 bp, Artificial Sequence
  Description of Artificial Sequence: Synthetic polynucleotide
aggaggttaggaaagtttattatatgygttggtttyggttgtygtayggtatttttatggttatygggatgatgagygtatttattttgggttygtggattgaggaygaggaggaagaggaggaggaagaagaagaagaggaagaggaggaggaggaggaggaggaygygtttaggttgagatggttygygtggatattgttatttattttaagattgttgttttygtygtygtygtygtygtygttgttgtygtygtygtygtygttattatttgttatagttagtaaygggtagtyggygtaggggttygggggagtttttttygtygttagygttattttaaatatttattaatagttatattgttgttattgttgtygtygtygtygtygtygtggagygygggaggggggyggggaggygtttgggttyggggygttgtgygygatttggyggggtgygtygagatatatatagygagtygtygtygttygttygggggggagggggatggagtgygygggtagtttttttttttyggttygygtttygttygtttygggttgygttggtttygagygtygagagttagg

SEQ ID NO: 3460 - DNA, 201 bp, Artificial Sequence
  Description of Artificial Sequence: Synthetic polynucleotide
tatygtyggygtygaggyggygtttatgtttaatygtygtygttatygtygtygtttgtttttgygttygttttygygtttgttgttttttygtygtygtygtygtygtygttattatagattygtagatatatagttaagatttttgatttttaatattaatttttttttttggggaggggaggggayggagggaagggg

SEQ ID NO: 3461 - DNA, 269 bp, Artificial Sequence
  Description of Artificial Sequence: Synthetic polynucleotide
ggtgtgatgttttyggtggataatgtttttygttttttgtttyggggtttagatagttggtgtttaagygtttataatgtagagttttttgtatttttttygggtygttatttgtttatttgttttatttaggatatttttttaaataatttttaagtggaaaaattayggttttttaggagatttattygggaaygaaygtgygtggggtagtttaaatttttgagtttagatttygtttttygyggttagatggtgyggtyggtggg

SEQ ID NO: 3462 - DNA, 201 bp, Artificial Sequence
  Description of Artificial Sequence: Synthetic polynucleotide
ttagtttgttatygtayggyggtygggatygtagtttttgggtgygtagtgygtttttygttgygtttttttagagygygggtttygtgtttgtgttyggygygaygygatttttttgttagtygggtttygygtgtttttygygtttttygtagttttygygtagttygtagygttttttagtttygtttygyggtygyg

SEQ ID NO: 3463 - DNA, 267 bp, Artificial Sequence
  Description of Artificial Sequence: Synthetic polynucleotide
gtaggagtttyggyggtttgtaggggyggtggygyggygttgggygygyggtygttagatggtagygtagtttyggttyggttygygggaggyggttaygygygggggaygyggggygyggygygttgagygygggtgtygaggttggagggygyggtygggttttygagtttttttttygyggtatttttgtttttatttttaaatgttttgtaagttaggagttttygtaggaatygttgtatttttatttttttttaaatttta

SEQ ID NO: 3464 - DNA, 287 bp, Artificial Sequence
  Description of Artificial Sequence: Synthetic polynucleotide
ggyggtgtgtagagtggggtttgggttttttgtttttaagggtagttgggtgggtttygtgtttttttygagtggatttggtttyggttttaaatttagtygagggtyggttygtttttggggattygyggatgtygygagggggygtygygttattgaaggttgggaygggggyggtgygyggggyggygtyggagttygggatgtyggttttagagaygtygygtttygtttygaggaggtygtyggtygggtaagyggagttyggagttygyggagtttggatc

SEQ ID NO: 3465 - DNA, 201 bp, Artificial Sequence
  Description of Artificial Sequence: Synthetic polynucleotide
ggtttgtttygagygyggygggggygtygggggygtyggtttttattttgtagggtatyggyggygggaggaggggtyggygtttaygggttttygttttygyggygtygyggattaggagttggaattgttgygggagtgtttgggagtygtygtgtttgttyggttgygtaaggtggttttygygttggtgttaggtyg

SEQ ID NO: 3466 - DNA, 201 bp, Artificial Sequence
  Description of Artificial Sequence: Synthetic polynucleotide
gygtttgttygygttttgtttaggtggtttyggyggtttyggygattttttgygagygttgttgtttttgaaggygttgtagggtttgygygtggagtggygygggygggattygygygggtygggtygggtatagygtagygygggggttatygtygtygaygggtygtgygygttgygygagtttagygtagattttyg

SEQ ID NO: 3467 - DNA, 286 bp, Artificial Sequence
  Description of Artificial Sequence: Synthetic polynucleotide
tttagggggygttttygagtygygtttygygttygtttttaggagggttttygygagtyggttgtatatttygaggyggtttyggttgtataatttggagygagttgtttygtttttttattttgggggygaagaagggtyggggagtgggggaaagygggaggygtygyggtttgggaggttttygygggttttagygtyggtygtattgyggtttttttygygygtygtygtygtygtyggttttttttygtttygttttygyggttttyggygtttttygygc

SEQ ID NO: 3468 - DNA, 244 bp, Artificial Sequence
  Description of Artificial Sequence: Synthetic polynucleotide
tagtagattttggygtggggtatttgagattttygttattgaaaaggygttatagaaatgtaaggaattatgattttaataaaattgttttatttaggagygagtttttgygttgtttttgtygtyggagttygggtttgttayggtaaagtttgtaattagagaaaaatattagttttgttgagggttagaatatattattggttaatgtgtgtggttttttttttaaataatgttaagtatt

SEQ ID NO: 3469 - DNA, 201 bp, Artificial Sequence
  Description of Artificial Sequence: Synthetic polynucleotide
gtgggtyggggatttygttgttttgtttttttagygggaaattgattgtttgagttttggaggataaatagagatattggggggttaaygggggyggtygygggyggggttttaggtttttatttatygggttgttgagygygtaygtagttattygagggaagattttygtygttyggggtttyggagaggggttagaat

SEQ ID NO: 3470 - DNA, 372 bp, Artificial Sequence
  Description of Artificial Sequence: Synthetic polynucleotide
gtggtattagygaatgtggtggatttyggtaggtttggggtaggggaattttyggtaatattttttagtatygaaggtaggatttttyggttattttygtyggttggaatttttttaagtattgttttgagtttatttttaaatgaaagggggaaaaatttaaattagattagaatttgaaatagttgaaatagttatygatttttagtttgtttttaagtttggtagagattgtgaaagttttaattttttygygatgttagttayggttygyggyggttayggagttattttagtatttygygatggatagtgattttyggygtggygygagttttttgyggtttttaygygggtttgggyggygggttt

SEQ ID NO: 3471 - DNA, 201 bp, Artificial Sequence
  Description of Artificial Sequence: Synthetic polynucleotide
agttagttttataatttgygatygatttttttttgtttagttyggttttagttttttttagttataagatggtaatagygtygatagtygggtttygyggygttttgttttttttttgttttggtttggagttttttttgggtagttttgtatttatagygttgygttttttttagattgtgtagggagtaygggagggtt

SEQ ID NO: 3472 - DNA, 247 bp, Artificial Sequence
  Description of Artificial Sequence: Synthetic polynucleotide
gttttyggggggttttggygttttagttgtggattttttaatattygtaggttatagagttatagaggttggatttttagtagtagaggatatagaagaaygaagaygagaygtagagttttaattgtagttagagataaaggtttygttatatttyggaagtygttttgtttttttttgtttygtgtttgattggayggtttttagtttagygtttttgattggataatttttaaggttttgtttt

SEQ ID NO: 3473 - DNA, 201 bp, Artificial Sequence
  Description of Artificial Sequence: Synthetic polynucleotide
gatttggygyggtttttgtttttygttgtygtygaagttttaattttygtttgtttgttttgtgttttttgtaygtagaagtttagtttgtgtggttttgygatttgygggtattgggagatttatagttaagaygttagggttttttggaagtttagaaatggtgagagtgtyggttygatatttygagagagggaaygg

SEQ ID NO: 3474 - DNA, 201 bp, Artificial Sequence
  Description of Artificial Sequence: Synthetic polynucleotide
ggygttttagttgtggattttttaatgtttgtaggttagagggttatagaggttgggtttttaagagtaggggatataaagtagggaagaygagattaagygttttagttgtagygagagataaaggtttygttaaatttyggaagtygttttgttygttttagttgygtgtttgattggayggtttttagtttagggttt

SEQ ID NO: 3475 - DNA, 235 bp, Artificial Sequence
  Description of Artificial Sequence: Synthetic polynucleotide
tttggtyggattgygygtttagggtttttygygtttgttagttttygttttgygggtattttttttagtatygggagygygyggttgttygttttygtygygatygtggygttagtttttygttttttttgtttygttttgagtatttgttttgygtttttygttgtaattttttatttttygtttggattgygggtttgggtgyggggtgttgtaggtttgtaggggayggggt

SEQ ID NO: 3476 - DNA, 201 bp, Artificial Sequence
  Description of Artificial Sequence: Synthetic polynucleotide
atttygygttttttagttyggagtttatttgtataattggattttttttttttgtttttttttttttttttgaaatttgtttgaaaatttaagtgaaaatygygaygatttgtatatttaaaagtaagtgttaagtaagtgttttgyggtggtttyggygygtttyggggtgagygygtaaagtygggagygaggtgtygc

SEQ ID NO: 3477 - DNA, 201 bp, Artificial Sequence
  Description of Artificial Sequence: Synthetic polynucleotide
gggygyggttttgggagygggggaaggtgaggggaaatgggatatgatggtattaataatygttattaaagayggtgggagtaataaaggaatgygttttygagaygtygtttagtttyggggtgttttttggygyggtygyggtgtaggaaygygagtttygtygtygagtttttygtygtttgygttygttggygyggc

SEQ ID NO: 3478 - DNA, 201 bp, Artificial Sequence
  Description of Artificial Sequence: Synthetic polynucleotide
gttygggygygtyggttggggttttggygttttygtaggtttygaggtygatagtttyggygagggygggygtttygygttttagtatyggttgtttgagygtttttggagtagtaaattttagatttttttttttttttttttttttttttttttttttttttttatttttttttttttttagttttttttttttttttt

SEQ ID NO: 3479 - DNA, 201 bp, Artificial Sequence
  Description of Artificial Sequence: Synthetic polynucleotide
tttgttttaaaagtttatagtatgttttttttttttttagatygggagatagtgattttatttatayggtaagattaaaagttttygttygtttagtttgygggtttgggttgggtttagaygttttttaggatgtagatgygtygtygttggttttttyggttataaagtygtttttagygttttttygygygtaggagc

SEQ ID NO: 3480 - DNA, 201 bp, Artificial Sequence
  Description of Artificial Sequence: Synthetic polynucleotide
gggygaagygatttagygygaggattagtttttaattaattygtttttagttttgggygttttttttagtagttagatgggggttttagaggtyggtgygyggttatatggtttygggttaggtagggggtygtggggaygtatttgygttaggygtatagtatttttgggygygggaygggygaagygtygtgggtttta

SEQ ID NO: 3481 - DNA, 296 bp, Artificial Sequence
  Description of Artificial Sequence: Synthetic polynucleotide
tgtttttattttttatyggggttyggttggttagaggtaagtttygagattttttattaattattattatygttgygagggtyggtgaggttgtagataaygtttgtaaggaygggagtyggggagggtgtagggygagtttaaaggaygggtagagtaagtttygggaagaggtaggggttttttttttygggtygtygtttttygtattttyggagttagtygtagttaygtagygtygtttgtygggtatattaaggatttggygygtaygtggygtttatttttattttygg

SEQ ID NO: 3482 - DNA, 201 bp, Artificial Sequence
  Description of Artificial Sequence: Synthetic polynucleotide
agtttaygggttagtttggyggggttygayggyggyggyggtggyggtagygttygatttagyggtattagtttgggttaygattagygttayggtagttygygtttyggtygttyggattygygtttyggtttygggtygttttyggtgggtagygttygttttagygtttttagtttyggttttyggggttyggtyggc

SEQ ID NO: 3483 - DNA, 201 bp, Artificial Sequence
  Description of Artificial Sequence: Synthetic polynucleotide
atttattggttgaaagtttygtttattttagggtgattgagagygttttttttttttgtgttgtttggaaayggattgttygtttagtaatatttgattaygttttttattggttatygttttyggaagttygttttttygttttyggaattttygtaggygttgggtttgtagatggygtttaggtatatagtggygagt

SEQ ID NO: 3484 - DNA, 266 bp, Artificial Sequence
  Description of Artificial Sequence: Synthetic polynucleotide
gaaagataaaagggaaagygtttttaygaaattygtttayggataygatttyggggttatatttagttagaygaatgtttggtaaatgatagttattttaygttagatttttatagttttttataygttatttttattgttttagggaattataagtataggtatygtttygttyggygtttttttttaaagattggggtattaggatygygggtttttatttttatttagtataaagagttyggygtttagagttagyggttttt

SEQ ID NO: 3485 - DNA, 201 bp, Artificial Sequence
  Description of Artificial Sequence: Synthetic polynucleotide
tygtaggttatttgtgtgatttyggtgygagtggaggttggtatygtttagtgygaggttgttatttygtgtgtttgtttaygttttgtgtgattgggtgygaggaagttaatggtatygtggaatgtgaggttgtgagttgaggygggagygggygattgttygttgtattttgttgggtygatattygyggtttttttg

SEQ ID NO: 3486 - DNA, 228 bp, Artificial Sequence
  Description of Artificial Sequence: Synthetic polynucleotide
tagagtttaggatattttaggttttttttgattygattggaatttattttttaygtttttttggttttaattaatygttatttgtatgtataaatggaaaygatagggtagagggttagtagttattygygtttgggttygtagtttygggtaygttgtagtttygtattyggttgtttaygttygggattatttattgtgttttttyggaattgtttagygtgtttt

SEQ ID NO: 3487 - DNA, 248 bp, Artificial Sequence
  Description of Artificial Sequence: Synthetic polynucleotide
agattttagatatttattttaaatttaggttttagygttttgtaggggatttttattttggggygtttatttttgattttttttttgggttttttygttayggtygagtttaagtggttgaagygyggaygaggatgygyggggtttyggtttttaattgtattataggtygtatttaygaatttggttyggtatagttattatygttygggtttttaggttttagggttgtagaagtttagtttygg

SEQ ID NO: 3488 - DNA, 387 bp, Artificial Sequence
  Description of Artificial Sequence: Synthetic polynucleotide
gaggyggttatygtagyggtygttaaygagtagttgtayggaggtgtagaagaaggaggttattgttatttttttgataagttgggggygtgggaggtttygggagttygaagtygtttygagygggggtgggyggtgagyggattttygggtgttgattaggtgtttggtggtagagtagggaaggggggaayggaygtygattttagggattttttattygtttaygttttttggygttggttataygtygtygttttagtattaattggaggtttttagtggaygagtagtygttygagggtagtygtttgagtyggtagatagyggttagttggggtagyggttygaattgttttygtaataygttttttagtatttyggttt

SEQ ID NO: 3489 - DNA, 203 bp, Artificial Sequence
  Description of Artificial Sequence: Synthetic polynucleotide
ygttgtttttttgtgygttatygggggtttgttttgggtttgttygatatygtggttgttygtttatttgagygtaggtttttattttgtgttagggtygygygtggttttygtttgyggtttgttgggtttyggygttataggtattgyggtttyggygttygtaygygggggattgggygggggttggagagtttaggtyg

SEQ ID NO: 3490 - DNA, 203 bp, Artificial Sequence
  Description of Artificial Sequence: Synthetic polynucleotide
gttgygtttygttgtttagttygggyggtttatygttttttttgtttgggtggaygtatttttgtttttygtttttattggyggtagttttygtggggygygygtggggggygttggggtttttagttttygtttygagttttttgtygyggygttgttagtttygggggtttgggttttatttygttttggttttgttygta

SEQ ID NO: 3491 - DNA, 312 bp, Artificial Sequence
  Description of Artificial Sequence: Synthetic polynucleotide
gtygggggggygttyggggyggyggyggtggyggygggygggggtaggtygggttgygaatatatttygaagttgtygtygtagtagagggttatgtyggyggtygtgggyggttgyggygyggtygyggygaggggygagyggggttggtttygtygttygggygagagtatttttttgggggttaattttgyggtttygtttttattygygttgggygttyggtgtttygggtyggggtygggygggtgttagyggagygtttgttagtyggttttttataatygagttyggygyggttttttttgggtc

SEQ ID NO: 3492 - DNA, 407 bp, Artificial Sequence
  Description of Artificial Sequence: Synthetic polynucleotide
tttygggaggtttaggggtayggygaggggtyggggaaaggygatygtttattatagttygygygtttagattgagggaggagtygggttgtagaatyggyggyggatggagaygggagggaggttgygaggtygttygaggagagattaaggttttagaaayggagaagygggygttttgygggaggyggyggygttgtygttggtygttaagggygggaagtgttttgggatttttattaggggtygygagtttygagygttaaattttygyggygttygtttagygygttgttgtggygggygyggagggygygygtyggtagtgggggttgyggyggyggagggtaygggttttygtttagygtttttatttttttggtgtagttgtttttygygagtygaga

SEQ ID NO: 3493 - DNA, 295 bp, Artificial Sequence
  Description of Artificial Sequence: Synthetic polynucleotide
gygttygtttygygygtttttgtatttttygygtygtttttyggggtttygyggygttygtaggtygygtygttttgtygtttttttttygtggtttttayggttygttygttttttagtagttttggggtgttyggggyggttttgtaagygggagagagyggygaggyggyggygtygagtgyggggggatgyggagtygtgttyggttttgtygtatttttyggtygttygttygygttyggtttygttyggttttgttygggttgtaygtatttttttygyggtttagaat

SEQ ID NO: 3494 - DNA, 435 bp, Artificial Sequence
  Description of Artificial Sequence: Synthetic polynucleotide
tttggttyggtttggttagttttygyggtttttgttygggttgaygtttaggaatgtggtygaygagaagttttaatagtayggygtggttttttagtttyggtgagtattygtygtggggaagggttttggggatttattggaggtygyggttygtagtagttaggggtygagttayggttayggaygttttggtgtttyggttygtgtygggtttttaggyggaggaggygttygttgggtttagattttygattttagtttyggtttttyggygtttgggttgygyggagtttttgtttygygtttyggatttttaygygtagtttttaygygtttygagttggagaagtygttagttygtttttttagggygtgtygttygttttttgtttttttgtgyggggtatgtgaaatgtgtggggttagaattgt

SEQ ID NO: 3495 - DNA, 410 bp, Artificial Sequence
  Description of Artificial Sequence: Synthetic polynucleotide
tttttggagggaagttygtygggaagttgaagatagtggttatygttttyggttattatttttygggattyggattttaattttgygttatatttttattygtttttagtygtgttttggttgygtagttggaaaggttgagtagtttattgttgtttttttgttyggttttggatatatygtttgaatttttgggygtttttgttgttaagtgggggatagtattatttattggggaggaaaattttaggaatgtggattttggggttaygtaggggttgggaagtgaagggtagggaaygygggyggygttyggggtttgygggtaggtaggyggtttggtygyggaggttttttygagttttgygtttttttagagagggaggggtttatatyggttggtatagtta

SEQ ID NO: 3496 - DNA, 392 bp, Artificial Sequence
  Description of Artificial Sequence: Synthetic polynucleotide
ggagttygttgggygtgttyggttyggttyggtttygtygtaygttygtttttttggtttggttgaggatttyggggtttggaygtgttaaygttattttygygygtygaagttgtgayggtttattaagtagagatttgygaggtatatagagagggaatgaggyggaatygttygggggttygttgatattgtagagtttttygtagtatygttgttttaaatttygtttttttaggygtgygygtatagygagttagaggaggtttygtttygatttggggtttttygyggtttttagttygggggttygggttttygaagagatttttggtaatggtagaggttttaaagtttagatgttaagtttygygatggggyggatgttttta

SEQ ID NO: 3497 - DNA, 203 bp, Artificial Sequence
  Description of Artificial Sequence: Synthetic polynucleotide
agagaagaygttaggttgaggttttagygattttaggtattagtttygaaggagggyggggagatygtaaaggggaagtgttyggagggttaayggttttygygtattttgygtttttttgaagygygtygttttttygygtyggggattgggatttgtttttggggaattygtttagaagayggyggyggattggggtyggg

SEQ ID NO: 3498 - DNA, 398 bp, Artificial Sequence
  Description of Artificial Sequence: Synthetic polynucleotide
aaaattgygggagtttatttattgygtttaggtggttagtttttgagttttttttattygtggttttttgtyggtatgtaggtatgtataagtatatygtygagtaggaggatttaaygaatttagtttgtggatatgttttaatttttattttygttttttttaggtttgtttaggtgaggatgatgggagggaaaagyggtgtatagtygtaatattggtattttgtaagagtygtyggggtattgatatagagggatatygtattggagatgyggtgtttayggagatttattgygygyggtgaaatattttaagtatygygyggaataattgggtttagtttttttatttyggattttttttaggattataygttattttttattttygaattt

SEQ ID NO: 3499 - DNA, 286 bp, Artificial Sequence
  Description of Artificial Sequence: Synthetic polynucleotide
tgtagagtttgaattttatygtttagaaggaaaggtgagtgggggattygggygggaggtgaggtttgtyggtagyggtttttaggygtgttgggtagtayggttagtagaggyggygtttggttttggatgttgtagyggagaygttaaggagattgaatgtagggagygaggygtagyggtygyggagggtggggtygttyggaaatttaggyggygttagttttgtagtatttgtaggtygggggygygtataygaggggtaygtgggtgtggaggaatyggc

SEQ ID NO: 3500 - DNA, 267 bp, Artificial Sequence
  Description of Artificial Sequence: Synthetic polynucleotide
ggttgttaaggaggyggggtggttagygyggggggtggaggatgggggtaggaygygggagggaagggtagggggtggggggygaggtttyggggattagygygygagagtgtttagttgggaaatgtagtttygaattaatatygtatgttttataattagtttaygagtygatgtggggaaagttatttttagatggggaagagtagttyggatttttttaaggaygttttttagttagattagggaggggagaaggagatgggg

SEQ ID NO: 3501 - DNA, 260 bp, Artificial Sequence
  Description of Artificial Sequence: Synthetic polynucleotide
tagagtygtttgtatttgttygtattttttgggaggttgygatgatygtagttagggtggtygagygttyggtttattgtattyggyggttgttttgtagygtttttggtatttagggaatggtttgtaaattttaatgtattatagattagtttttatygtggagtaggaaaggygtttattagttaggggtaatyggttttgtagatttgggygggggygtagggggaggggyggtggtgtaaatttatygtgatttt

SEQ ID NO: 3502 - DNA, 239 bp, Artificial Sequence
  Description of Artificial Sequence: Synthetic polynucleotide
gaaggtaagttttaaatttttgtttggaagaygggttgtygyggttgtattattagtaggaggaggaggagaagaaattatttygygatattttattttgygggtgttttgtygttgtygtttttgttgtygtygattygagttygygggttygaatatygtagyggtggggayggtgggttyggygggygtygggaggaggatattagyggagttttgtattttygtgtttygtttat

SEQ ID NO: 3503 - DNA, 846 bp, Artificial Sequence
  Description of Artificial Sequence: Synthetic polynucleotide
gttggygggttttggttttygaggaygtagatatgtggtttgaattttygtttttttagtygttgtttttgtgtatttttttgggygtttttagygaatgygagyggygaggygagggygagygygtygaggaagggygggagaggygyggagtttggtygygtygygttgygtygagygtygggtttttttygygagtttttygggttygygygygygttttttattgttttygtttttygygyggygygtgttttttatttttygtygygygttttygtattygttyggttttaygyggygygygtttgttttggyggtagyggyggyggyggyggygygttttttttygaaygtygtttttagggttgttggttgygttttttattgtttygyggttgttgttyggggtgggyggygaggygggggggaggtgtyggtttggtygtyggggagggtttatygttygggyggatttttattgygagagygatgygggtttaggygyggygygygggggttgtagggygtttagtattgggggttgtyggygygygggggtttttttttggtttttaggtattygttgttgttgggygtttttygtattttyggttattatggatatttygttttttygtygtttttttygygtatttygggaggtygtyggggyggtagtagyggygyggtttygygggtgtttaggtgatyggttyggtagyggtagagtagtggtagtagtygttattgtygttgttattgyggtygtygtygttggagagaggaggaygaggagggtaaggggtagaagtaggttttgttttgtttgttttagaggttatt

SEQ ID NO: 3504 - DNA, 526 bp, Artificial Sequence
  Description of Artificial Sequence: Synthetic polynucleotide
tgttgttttttttyggygttttgtttttttataattggaagtygygaaggyggttattgygttgagtygttygttttgttggttaagtttgggygattygygyggaggagggtygggttgattgtygtygttgagttgttttyggaygggagygtttgtttayggtatttattttttttagyggtggaaatgtggagaagtaagtgggaggyggtgtygggaattgattttttttaaaayggtyggygtygttgttttgaaatgggyggttaagtgtttgtgggattaagggyggttttagagatgttyggaaaatygttgttayggttagagtgyggygtagaygyggtagagttggaggtgttygyggtgtaggttgttgtttaygtygtttaggttaggtgttgagggtttagttygygtttyggtygaattatttttagtttygttgagttatttygttygttyggtttttatygtatyggttagaggaaagttttygyggtttttaygtttttttatagtt

SEQ ID NO: 3505 - DNA, 201 bp, Artificial Sequence
  Description of Artificial Sequence: Synthetic polynucleotide
gtttygttyggggatttagggaggagggagagaggagggagggagtgggtagtttgggygtaygttatyggttttygtaygttyggtatttttygtggygyggygagttaatgggatttgtatattygaggtgtaatagtattattgtattaattattatttttattttaygtttagattgtttatttatttgygggaaat

SEQ ID NO: 3506 - DNA, 523 bp, Artificial Sequence
  Description of Artificial Sequence: Synthetic polynucleotide
tgttttgtaygygtgtgtayggttygtaygaggyggtygggttygttagttttttgattatagyggtygygttagggttatyggggttygyggttgtagtygtagttgttgtagtygttgyggttgtygttatttggtaggaggtatagggtatgggtgagggaggttgyggtagyggttaygagttgttgaggaagttagattgtaggtatttggggggygttaggtagtygtagtygtyggtttyggygttygttaygtygtattygtttgyggygttttyggtttygaagagttttttgtygggttggaagtgygygggyggyggtyggaagggtttttttatgyggyggyggygtyggtagttgtttttttygaatatgttttygtaggtygggtttagygtttagtagttgtttttgygttygtygtygttttygygyggtattttgatgaagtattygttgaggttgaggttgtggyggatgttattttgttagttttttttatttttttygtagaa

SEQ ID NO: 3507 - DNA, 276 bp, Artificial Sequence
  Description of Artificial Sequence: Synthetic polynucleotide
gttattttttttttttygtgaygttaygggtygtttyggggtgagygtttgagtygtttygggttygygttagtgagygyggttgttgtyggygagttagyggygtagyggygggaattygaggtygagygtygyggyggtagygttagaagygtatttatygggtayggygaggyggtttayggtgyggtaggtatygggaggygagagtyggygyggatagtaggyggyggttgtagttygttggyggttgttgygaggatgttgtttgggygg

SEQ ID NO: 3508 - DNA, 357 bp, Artificial Sequence
  Description of Artificial Sequence: Synthetic polynucleotide
aggagggaggtagggtaggtttgagggtgaaagyggtaaggatttaggtttaagttggatttgtttatttttttttgtygtagtttttttggtttttgtgygttttggattttygaagttagttttttgygtagyggattagagaggtttattygyggaygttaatttaatttttgggyggggttygggggttgagtagaaggygaggtttggggagtayggataattttgagggttgtttgtgtyggggtgggagygtagtgggtgagtttygagttttggtttagggayggttagagtagggygttggygygtygtggggataagtaggtgtttgtttttgtttgggggaaggat

SEQ ID NO: 3509 - DNA, 278 bp, Artificial Sequence
  Description of Artificial Sequence: Synthetic polynucleotide
tygggygttgggtagttttygtyggtygtygtyggagtttttgtgtttaygtygggggygtygttgtaggtttaggagaagattygtgttttygagtagtygtttttaaaaattaaataaattaataagagaattaattaataggtagygttgygatygttaggagygyggagygygygaggtttagyggttttttygttaagtttttgttatyggygygyggtygttygygttgyggtagyggyggyggygyggttgattgyggyggtagygyggta

SEQ ID NO: 3510 - DNA, 336 bp, Artificial Sequence
  Description of Artificial Sequence: Synthetic polynucleotide
gtttygtatgtggggtataatgaaataagagtagtttyggttagaggtttagtaaagyggaaagayggtttygttygtatattttttyggaaaattgaagygttttttttgatttttaaggttagaaagatttattatttttttygagagggygtagttatagatttattagagagggygggtagggtgtyggaagttagagaayggygtttygygtttttttatygttttagggygtagaggtgtttttagtgttyggagaggttggtagtgtyggtttygagggaagygtggagyggayggtygataggggatttttgtttaaattttattatt

SEQ ID NO: 3511 - DNA, 311 bp, Artificial Sequence
  Description of Artificial Sequence: Synthetic polynucleotide
ygygtgttttgttttygtagtggtttyggygtttaggaygtygttggttygygttttttttyggaatgaaggtgtttygtaggaaggygttggtgttgtgygygggttatgtattgttgttggtgtttattatgtttaattttttggattataagtggtataaggagtygttgtagtagtgtaatttygatgggtygttgggtgtygtagygggggtagtyggaggtagttgggggygtttagggtygttttyggtygggtygtttygtgtttatgttygtttggattttygtattttttatygttttttc

SEQ ID NO: 3512 - DNA, 201 bp, Artificial Sequence
  Description of Artificial Sequence: Synthetic polynucleotide
tataggtaatagagataaggttaggaggtaaagtatatttatgtgtaaatgagaygygttagggaatttgtaattttttgtattttygtttttgatgtttygatttttataattatagaattttaggtagaggtygtygattttttygttttygttaagagggattyggagtatygaagttttttagtyggtgtyggygtt

SEQ ID NO: 3513 - DNA, 201 bp, Artificial Sequence
  Description of Artificial Sequence: Synthetic polynucleotide
aaaygtttttttagaaaataagttattaatygtaygagagaaggagaggaaggtagtaatttaattttttgyggttygyggttttgaagattaggaggttygttttagtagggtgaggtttatagaatgtatygygtyggttgyggttttttaggggtyggttattygagttttggaatttygagaggygygaagtgggag

SEQ ID NO: 3514 - DNA, 481 bp, Artificial Sequence
  Description of Artificial Sequence: Synthetic polynucleotide
ygygattgtatttggggtagtttygtygygttttagtygtttttyggtaggaagygtaggtgtgtgagtygattyggagygagtygygttttygggttagygtgggtagggygtygtagtttgygtagtttygaggatttygygtygttttttygagttagggtttttaggagygggtygygtaggagaygttagagggggttgttagyggttgttgggagaaygggttayggaaatagttttttttaaagtyggggttatygtggggtgggygagttygtttttttaggtygggggygyggattagaggggaygtgtgtagayggtygyggttagttttatttygttygggyggagaygtatagttggagttggagggtygtygttygttgggtttttaggggtttgaaygtttaggggtygyggygagtttattyggagygagttaggtgagtaggtygttatggygatgyggtttygg

SEQ ID NO: 3515 - DNA, 280 bp, Artificial Sequence
  Description of Artificial Sequence: Synthetic polynucleotide
taggttttttggggttatttygygaggtagtygagggygtaattygggygtttggggtyggaggyggaattaggggtyggggttaggaggtaggtgtaggyggttgttaattygtttaatttgttgygygggtggtygtttagagtygygggtttgyggggygtttttygtygtygygtygtygtttttttaggttygggagggggygtttagggtggagttttatttatgggttgaggttttgggygygyggagtygtygtygttttttyggttggttt

SEQ ID NO: 3516 - DNA, 252 bp, Artificial Sequence
  Description of Artificial Sequence: Synthetic polynucleotide
yggagttttagttaygaattatttaatattygtaggttatagagygayggaggttgaggttgtgatygaattatygaygtttttttgaggggtgaaagtayggtygtggagattttaatygagtttaygttggygtaaaaggtaaaagtygygttagatttyggatgtygttttttttttttyggttgygygtttgattgggtagtttttaatttagygttttgattggataagatattaagttttttaygt

SEQ ID NO: 3517 - DNA, 239 bp, Artificial Sequence
  Description of Artificial Sequence: Synthetic polynucleotide
ttatttgygtgttgttttygggtttygtttygtttygtttyggagggatttttaggtygggtttagatttaggagttatttggggatttyggggtggttgygygtygagggggygttagyggggaygtgagttggygtygagatagtttyggttttttagygttagggttattgttaggagattttyggttagtatttaygtggggygttttygggagttygaggggtttatygtttgt

SEQ ID NO: 3518 - DNA, 405 bp, Artificial Sequence
  Description of Artificial Sequence: Synthetic polynucleotide
aagtttgyggagygggtygygtttttggttygttygggttttaagtttygygtygtygttttggyggggayggtgtagtaggyggygggatgyggyggggyggtagtttgagygtttyggatggttygyggyggggyggtttgtaagagygaygygyggttgttgttggggygggaygygttgyggtyggygttygttttgttggttttygtygtgttgttgggygtygygttyggtttyggtttyggtttttggtttggttgtygygygggtygttagygtaygygatattaggtgggtyggtygagtagatagyggyggggyggggagygyggggygygtggtttttgggttttgygggttyggagtttyggttttgygattttttgagtttggttgggaatt

SEQ ID NO: 3519 - DNA, 237 bp, Artificial Sequence
  Description of Artificial Sequence: Synthetic polynucleotide
ygygtayggtggtgtaggagtttyggtagtttagygtgaggaagttygagygtttgttttgygygtygtygtygtygttattatygtgygttttygggttygagggtayggyggtygtygtttygygtagtagtagygygtygttgttattttgygagaygttgttttttaggtygttttggtagttttygtygttgagagagttttgtttggtgattttgggygatagtagtttga

SEQ ID NO: 3520 - DNA, 204 bp, Artificial Sequence
  Description of Artificial Sequence: Synthetic polynucleotide
ygatyggggyggtttygtttagggttyggggtagyggyggygtyggyggygttygagttttatyggaggagagaygygygagagaggagtttygtyggtgyggyggyggtaatggagaggtaagaaggagttgttgtttttttggggygagggyggggaagtgtgagagagatttgygagaggttttagggttgttgttyggtt

SEQ ID NO: 3521 - DNA, 224 bp, Artificial Sequence
  Description of Artificial Sequence: Synthetic polynucleotide
aggattttttattggggttgagtttttttygtttttaatagaatttttaaatataagtagtttttttttgtttttaggagtttaygaaaygttgttatatygagygaatgtaaygygtatataygtttatattygaatagtataagtaagagatyggttgggtgtggaatagaggygtatatygygtaaygtatttatagtatgtataygygygtatttygatt

SEQ ID NO: 3522 - DNA, 278 bp, Artificial Sequence
  Description of Artificial Sequence: Synthetic polynucleotide
gttttttattyggygttttttaggatttttaaagaygttygtttagatttataggtatttatttgagtttttttgtttttttataatttygattttttttygtttttttttttttttaaaaaaaaaatttaaataatttttaaataatatttaataggaaagaagaaggaaaaggagygtataggaagggyggaggyggtattygggggggattgtttttagaggaggtygttgtgagtyggygaygygaggttgggggagtgggaggtaaattygtt

SEQ ID NO: 3523 - DNA, 232 bp, Artificial Sequence
  Description of Artificial Sequence: Synthetic polynucleotide
ggtggggtaaaaagtaagaygaaatttatttagatagttttttygatttttagaggatygatatttttttygagggttttaatagtggtygtttagggttygagggtaayggtygaggygttaygyggggtygyggttygttttggttayggaggatyggatttgttgygtttttgtgagtttgttttatttttatttattyggtgtttttyggtaygtygatttgtttttt

SEQ ID NO: 3524 - DNA, 331 bp, Artificial Sequence
  Description of Artificial Sequence: Synthetic polynucleotide
aaygygtttyggattttatttttgtaygtgtagttgtttttggggatgagggttatttagtttttgtygygggtyggggyggygaatttggtgttggggtygtaggttaggyggtygtgggtygagttggttatgattattttttygygggygttttgtttgggygagtgtttttygtagygttygtatttygtttttttygtgtgtagtttygygtygtygtygttygtygtttyggtttyggggttyggygygggttyggygtaggtgatgtttaygaaggyggtgtattatttttttttttyggttayggtaaagtttaggtagagta

SEQ ID NO: 3525 - DNA, 231 bp, Artificial Sequence
  Description of Artificial Sequence: Synthetic polynucleotide
gyggttatggtggtttygggaaygggttyggggagggagggygygggaggayggygagtygggggtatyggaggggaaggyggyggygtagatygtggttygttttyggggtagaggagggggtgttaggygggattggggagaggggaaggggggtttagttttgatygggatttatygtttttttygyggggygyggggttaggygygtagatgygtttagggygtagt

SEQ ID NO: 3526 - DNA, 201 bp, Artificial Sequence
  Description of Artificial Sequence: Synthetic polynucleotide
ttygtagtggttttttttgtagtttttttgggtttygyggttagtagtgtagttygtggagtygyggttttgttygttttttttgggtggttttagtgygygggttgatatttatttagtyggggaaggtgaggygagtagaggttggtgyggaatttgtygtttttagtagygtyggygggttaagtttagggtygggta

SEQ ID NO: 3527 - DNA, 201 bp, Artificial Sequence
  Description of Artificial Sequence: Synthetic polynucleotide
agtttaggagttyggggygttygyggygggtatgaggyggygtyggyggttgtagtaagaggayggtatttttttygagtattatygttatttygagttgygygaggygttygtgttygtgtggttgtagtgtatygttattagtaggatttatayggtggggygtagtttygagggtygggagtttttggttatygagtt

SEQ ID NO: 3528 - DNA, 219 bp, Artificial Sequence
  Description of Artificial Sequence: Synthetic polynucleotide
yggttggyggtgtttyggygttttatygggygyggtttttttaggttygggggttyggygttyggyggtattttttygtaatgggagtggtttaggtyggyggygtygttggtatattyggggttgtaggatagggttatgttgtagtyggggggygatatttyggggtggtygatgagttagttatggaagtaggggttttttttatggttgtagygg

SEQ ID NO: 3529 - DNA, 284 bp, Artificial Sequence
  Description of Artificial Sequence: Synthetic polynucleotide
gygggaggagggyggyggggyggttggyggyggyggggttygggagygtygyggygtaggattttttagagygygtygggttgagyggyggyggyggyggyggygggygtaggggtagggtatgattgaygygttttttgtttgygtttatgtgagagaaagyggtygagggagggagygtgtygagttygggttgttttttttttttattttttttyggaagtygtttttttggagtttttygtttttttygtttttttttyggyggttttatttttttyggt

SEQ ID NO: 3530 - DNA, 429 bp, Artificial Sequence
  Description of Artificial Sequence: Synthetic polynucleotide
ttttttttygggtygygatattgattygttaaygttaatgggggttygygattgttgyggggaygagggygtagagtagttttygttaygggtyggtttaygtaggggtygagaaagtggyggagaggyggtggtygaggtttaggggygagygygggttgagttggtttttgttgygtttaygagygatatttattttttygttgyggaygtttygygggygttaggttgggggttttgygatygatttttttygttttygaggtatygtygggttygtttggtaggtagygygtttygygagttggagggtygagtttygyggggtygtggggygtgtgggtgaaggygatatttyggatgygggaygtatgaatggtggtagagtaggggtygggattygtttatgggttgggagagagatgtttt

SEQ ID NO: 3531 - DNA, 283 bp, Artificial Sequence
  Description of Artificial Sequence: Synthetic polynucleotide
ttygttattattgtttaatygagaattagtaaygtttttygtyggtttttattttaygtyggaatggatttttagaatttattgyggtygtaagatagttygtaagagttggttaaaatgtttttaggtgygtgggggtttyggggttttagttggagttygatattttgagattggyggttygagggttgtagggtygtttygggygtgygtttatyggttttgtatttttgggtagtygagtgtygyggagaaygttttattttttttatygyggtttttt

SEQ ID NO: 3532 - DNA, 241 bp, Artificial Sequence
  Description of Artificial Sequence: Synthetic polynucleotide
tygtttatatygttttttttttgtaggtgaggaatggggtttgtttygtttggaatgtgtttttgtygggttttgtttgatttttattttttagtygggaygygygagttttttygtttggttgagttaaaaagggatygygygtatttygtygttttttattaygaagygtagatataggaggttgtagggttagtgttgyggagaattttagayggttttatagtygtygttattygyg

SEQ ID NO: 3533 - DNA, 244 bp, Artificial Sequence
  Description of Artificial Sequence: Synthetic polynucleotide
tygtygtttttatttyggggygygtaggtygaggaggatttygttgattaygaagagtttgaggatttttygagtttgttagatattygtagtatygtttyggaygattttttttattttttygaggaygaggaggagtayggygtygagagygyggagagygtttyggagggygtttyggaaagygtttyggagayggygatttttttgygygtygtttgygttaataaygtggggttgttgc

SEQ ID NO: 3534 - DNA, 225 bp, Artificial Sequence
  Description of Artificial Sequence: Synthetic polynucleotide
ttagttygggaagaggygtgygyggygtygttyggttttagggtaaggttttgattttgtttaattgtagtatttttygtttttgttgtttgagygyggtygygggataagggatgttggygggyggtaggggygagygtygygggygagaggyggttttygaygygagtgygtagygttyggttyggyggttttttygagttyggygagygtagygttttttgt

SEQ ID NO: 3535 - DNA, 249 bp, Artificial Sequence
  Description of Artificial Sequence: Synthetic polynucleotide
gagtttggggtygtygyggygttyggygtygagygttttygagttgygtttygygygyggttygygttatttgtgtygtygtygttttagtygtygagggygaggtttttttygyggygygyggtagttttagtttttatttaaatttyggyggtyggttygggygttyggttagtgagggagygttygtttygtygtygaaatyggtttygggtgyggagtatgtttagtgtygtygygagagyggyg

SEQ ID NO: 3536 - DNA, 255 bp, Artificial Sequence
  Description of Artificial Sequence: Synthetic polynucleotide
gtatagtagatggtaygagtaygtgyggygtttagtttaggttttyggaggtagttgagttggaaatttygayggaaagtatttataagtttttattttgygttggtttattygygtgtaygtttattttttaygygygtttttggtttagaagygtatagatgtttattgtttagagtyggtatygttggggagatygagygatttgygyggygtatagtgyggygttggtagggttttgggttttyggtyggg

SEQ ID NO: 3537 - DNA, 243 bp, Artificial Sequence
  Description of Artificial Sequence: Synthetic polynucleotide
ttagtagygtygtygttttttagygtygatgttttagtyggyggggyggttgaggggtgagggggaatttygygggygggggygagggagygtgtgtgygygagygtgtgygygygygaggggagygygtgygyggtgaggaygygygtyggyggttggggygggggygggggtyggggygtttttgtgggaagggaggggtgaaaggtygttggttttyggtaatayggtttaggtaaaygt

SEQ ID NO: 3538 - DNA, 201 bp, Artificial Sequence
  Description of Artificial Sequence: Synthetic polynucleotide
tggagagaaatgagttggagagttatatygagttaaygygggatayggttttyggttygggtygggttaggggtgggaggyggttttttatygtaggyggygggatttttatgygtygagggatttaagtttttattttatttataygtttattyggygtyggggygttgyggtttygttttaygagtttagagtaggtyg

SEQ ID NO: 3539 - DNA, 208 bp, Artificial Sequence
  Description of Artificial Sequence: Synthetic polynucleotide
gtyggatatttttttttaggattattygtattttatagtygygttaaaagygttttatttttttgtttttygtygygtaggttttttatygaygttygttyggaaggygagagtttttaygtggttyggygyggygyggttttyggggatygygagtaataaaagttyggttygtagtttttgtttttygtttttttttttaattttt

SEQ ID NO: 3540 - DNA, 257 bp, Artificial Sequence
  Description of Artificial Sequence: Synthetic polynucleotide
tttagtttttygtaagtatttttttygtttttttattttttttagtttttagtygtygtygttttygtagtttyggtttygygttttttygtagtttyggygttygtttattygttaggtaggyggtggtgtygatttatttgagtagttgtttygygtttagttygtygygygtagtggygtgygtyggttggatggtttggtttatgattatttygtygggygtyggtygttttatggttagggygagagygtta

SEQ ID NO: 3541 - DNA, 350 bp, Artificial Sequence
  Description of Artificial Sequence: Synthetic polynucleotide
gaayggtttagtttaggttttgygttagagtatygtattygggggyggayggttttgtagttttttagttttttttygtattaattagttgaygttygggygtattggtttttttygttttygttygtaygaaagttttgttygaygtttgtagttagtatygttygtattgtttagggagggtttgygtygagatttagtggtygagtgagttatagagtygttggttttggggaygttgttttttatygttttttatygttttttttttttttgtattttatttyggtatttygtattttttttttygttyggtttygygtattttgtttagattttataagtatttt

SEQ ID NO: 3542 - DNA, 216 bp, Artificial Sequence
  Description of Artificial Sequence: Synthetic polynucleotide
attaaattaggggttgggagtttttagattgaaatgygttttttattattaagagggagtttaygyggtygyggggggtygaggtagttagtyggygtygyggttttggggagttygtgtaggggtgtgttttggtgtgaaatttggtaggattttgtttgggtttgtatgtagggaggggttagagattttgaaatgtattagygggtagggtgg

SEQ ID NO: 3543 - DNA, 269 bp, Artificial Sequence
  Description of Artificial Sequence: Synthetic polynucleotide
ggtattgttgttygaaygaaygaaygaaygaaygaaygaagyggtttygtttaggaaaaatatttttttgaygygaagttayggttgaagtttygggttaygtagaggggttagtaattttatgggtggtggggttttttatttttggaygtagyggggagtagygggyggtttttttttttgtttattttttttgggggtgggggagttttgtgttattygaygttgygaggggttgttaygggttttttaggttgtgtttttygygg

SEQ ID NO: 3544 - DNA, 258 bp, Artificial Sequence
  Description of Artificial Sequence: Synthetic polynucleotide
agatygggtttttgttygttttttttttgygtttygggatgaggtagagattgaatagtyggygagtaaattaayggtatttagaaagttatgtyggattyggygtttagygtttaagygttaattygttgaaagttttttagygaaattttagggaygatttggatttygttgagaggaattgtttttgagtgagatggttttagaggtttggaggagyggattggtaagtatygggagggtagtgggagttttgtt

SEQ ID NO: 3545 - DNA, 224 bp, Artificial Sequence
  Description of Artificial Sequence: Synthetic polynucleotide
tgtgttttttttttttttttttttttttttttttttygtygtttttttttttttttttattttttttttttgttygttttttttttttttttygyggtygyggttyggatagaggttatttagygttttttygtagtttttyggagagtatgtgattaggtygttagtagygtygygagtgttyggtaatggtagggatggtgttttaaatatttttggaagtt

SEQ ID NO: 3546 - DNA, 256 bp, Artificial Sequence
  Description of Artificial Sequence: Synthetic polynucleotide
ygttatttygygttagtgtttgagttgtaattgtaaattgygygttttggtaygagtagyggtgggggygggtgggggaaggagygagtgattttttaggygtttttygttatttgatattagttaggtagtttttagggttagagygttagygtygaagttaggtttattygggaagttatttyggtggtygyggggtgtttatgttagtattagattttttttyggaaggaggagyggggygggttatayggtt

SEQ ID NO: 3547 - DNA, 310 bp, Artificial Sequence
  Description of Artificial Sequence: Synthetic polynucleotide
gggaaggggygttaatagggttattatttyggggtttygttattttttagtygttttttttttyggagattttgtttgttaagagttttgttttttgtttygtttagggttggggttyggtgggaattttttygtgttygaagggaygatttygttagagagtttttygatttttgtatttatygtttttggtaggaygtggagttgttyggaagttatttygggttggtttttttattygtgtgttaygatttttyggygggtttttgtygttygagtgtttttatygttagttttyggagyggyggag

SEQ ID NO: 3548 - DNA, 410 bp, Artificial Sequence
  Description of Artificial Sequence: Synthetic polynucleotide
aggataattgggaygggttggatttatatttgatattygggaaatttttagagygtgtggtgtttttgttagyggtagttattggtggagttgaggttatygttattgtygtygttggygttttgtttttggaattttttagtaagatggtatttattgtttgttttttttygattagtatttttagtygygttttttttttttygggataygtattagttatatattgtggggagaagatgggttatgtaaatgtaagttaaygygtttttttagttatttttgtataatgtaataggaatagygattygygygtaygaatygggtagtgtgygygtgtgtgtgttygygtgtgtgagygygtgtgttagygtgygttttygygygggygtgygtttgggtggattttt

SEQ ID NO: 3549 - DNA, 274 bp, Artificial Sequence
  Description of Artificial Sequence: Synthetic polynucleotide
ttggggttagttttttttttttatygtygtygtttttttatttatttygygtttattttataattatttygtttggttttttttyggttttatttttatgygtttttattatttttttaaatattgtagtaagttgtagtaaggygggtaaatatygatagygygygtgggggygggyggygggygtygyggggtttatttttttttyggttttttygygttttygtygtttttygygttggtttttatygtatgagtagygttttttyggttt

SEQ ID NO: 3550 - DNA, 201 bp, Artificial Sequence
  Description of Artificial Sequence: Synthetic polynucleotide
tttttggttggygggygtttygtyggtygtyggttttttttttgaaattygtyggygtatatgaggtygttgttttygtygtaggygttggyggttttttygyggtgttygtggtgatgttatgtttygttattaygygggaggagaggagggyggygtygtygggttttgggtgaagagyggygtagyggyggyggyggc

SEQ ID NO: 3551 - DNA, 265 bp, Artificial Sequence
  Description of Artificial Sequence: Synthetic polynucleotide
ttttygtggtaggyggtagygagttgggttyggggtygggttgagttttgggatygygttgygtagttttygagtygttygttatttggttgyggtygygyggttatttgtttttygttttyggggygtygtttagtttygygttaggygttttttttagygttygtygttttttttyggygagattattygggygygtttygttygtyggttttygatgtaaatagttgggtttygtaggyggttggtttygygtttttyggtt

SEQ ID NO: 3552 - DNA, 201 bp, Artificial Sequence
  Description of Artificial Sequence: Synthetic polynucleotide
attattattattttaagtgtttgttygttggggattygtygtygtygtygtygtttggtttgttttgttttggggttttgygyggtttttttttgtttttygttttttyggaagaggygttygtttttaagtaygtggagygygtttygttygtagtygtygygttgttaggagygygttatgygtagttgttttttgygt

SEQ ID NO: 3553 - DNA, 362 bp, Artificial Sequence
  Description of Artificial Sequence: Synthetic polynucleotide
tttggyggggagtttgggtagygtygattaaagttyggagyggtagtttyggggygygggaygyggggtataygggtttagttgttygaygggagttygaygygygtttttyggygggtyggygggttyggaagtttygttgttygggtygggtttttaagttygtagtygttttgattaaaataggtatygygayggyggyggtaggyggyggtagttagggttggggtygtatygygtaygygtatgygttygtygtttygygtttttyggygggyggagttyggygtygyggttaggattttttatttygttttygygatttygttgygggtttgtatattygaggattyggtttgaaa

SEQ ID NO: 3554 - DNA, 298 bp, Artificial Sequence
  Description of Artificial Sequence: Synthetic polynucleotide
gttttygttttttatygttttttttygtttygtagttttygagtggygttagtaygttygtygggtatgggttttaaatgtttattagygggagtttaggygtttttgttttggagygyggtygggagtaaaatygtaggagtgggagggtagygagttagttggatttygagtygyggagygygttggttttgtttygtttgatgattttagagygygggtttaagygtygtttatgtagtatttttgagtttyggggaaggagagttaatgaaaaaatatttaatygttttygttg

SEQ ID NO: 3555 - DNA, 295 bp, Artificial Sequence
  Description of Artificial Sequence: Synthetic polynucleotide
gagyggygyggagagyggtaggggygaaatttygygggttagatgttygagggygyggyggygttgttaggttgtygttgttgtttttgygggtttygagygygttttygtaggyggtattgttygyggygyggygtgtgtatygagygagtgaaggtatgtgtggygggygyggttggagttgtygtygtygtygtygtygtgttagtaggttttaatgtttgttattttttaggaygttggtagtagtagtagttyggagttttygagttttyggtaggtttgygtgtttttt

SEQ ID NO: 3556 - DNA, 203 bp, Artificial Sequence
  Description of Artificial Sequence: Synthetic polynucleotide
ygaaggtatttgggatttttagaygtaggatgtttttgatygttgagtaaatgataagggaggygyggtygyggtattygtttatttagygtaatygtttygygyggggagatttyggttgggtttttaggttggatttyggtagtygaaygttygttattyggttaggaagttagggagygagygtttgygyggtygtattt

SEQ ID NO: 3557 - DNA, 215 bp, Artificial Sequence
  Description of Artificial Sequence: Synthetic polynucleotide
ygyggatyggtyggtttgggtttttgtagagtagattttgtttgygttttttaggaggagtgggtggtaggattggggttttttataggttttggggyggyggygagattggtayggttyggggtygtaggygygtagttaygtttttggaagttygtttyggttttygtttttaattygttttttyggggttttatggygtgaggtttggggtt

SEQ ID NO: 3558 - DNA, 201 bp, Artificial Sequence
  Description of Artificial Sequence: Synthetic polynucleotide
ggaggttgtagtygttygagtyggttygggtgggggyggggtgggggyggygyggagggtayggagattayggyggygttattygggatatttagggtttygaggttttgggyggtttttaygygagatygtaaattatgataataggtagttattygaggttaaataaaaayggagtgggtttttygygygtygtygttt

SEQ ID NO: 3559 - DNA, 340 bp, Artificial Sequence
  Description of Artificial Sequence: Synthetic polynucleotide
ggyggygttgayggatgtyggtttttagggagttttaaggyggygggtattagygggttgattttgaagygttgttyggagtyggagygttattgtttggygyggttgatggttgaygygttgygyggttgygtgtttgttttttayggygtggtggagygygayggygaaagttatttgtagttgtaggatttgttygatggtttygayggattttgtgtgttygattgtaaaatgggygttaggtatgygtgttttgttaggtyggttggggggattaagtaggggttyggggtygggatagttgtttgagggggattyggggygagtgttygaaggg

SEQ ID NO: 3560 - DNA, 201 bp, Artificial Sequence
  Description of Artificial Sequence: Synthetic polynucleotide
agggtttagggygtagggygggtttygtaygtagggygggygygygggtatttttgtggttaggygatttyggttygttttttyggagtttagggattttygaggttggygygggttgttygygataaggtgttagtagtttygggttygygaggagtagtttttattygyggttttygagtttagttttgttttttygtt

SEQ ID NO: 3561 - DNA, 236 bp, Artificial Sequence
  Description of Artificial Sequence: Synthetic polynucleotide
tttgagtagtgtatttttttaaaggtaaagagagataagggaggaaatatagtatttaaggtgattagtygattggatattgttgatggtatatttttttygtttttaattaatygtataaaattygtaatatttygygttttygyggggtttttygygtttttggttyggttttttyggtygtttttagtaggygtttygtttttygygggaattttgggatttggtygagygtt

SEQ ID NO: 3562 - DNA, 251 bp, Artificial Sequence
  Description of Artificial Sequence: Synthetic polynucleotide
gttttttagtttttygygtatttttttgygttygggtttygtygtttygtttagtgttggttaygggtygtgttattagtttgtgygttttygttattygygggtyggggtatttggygttttgtgtgggtggygggagyggggaygtttyggtgttyggggatygtagygygttggygtttaattttgtygtygttygttttggagtygggaggttttagtygtttaagtgtttygggagatttaggtat

SEQ ID NO: 3563 - DNA, 201 bp, Artificial Sequence
  Description of Artificial Sequence: Synthetic polynucleotide
tttygttttygttttattttttattggygtaggtttaggttatygttgttaggatttttygttgtygtygtttttygttttttttatttagattttgagtygtttattttagtyggtgtaggtygyggggtygtttttgatggtttgggtattttttattttygtttygtttaygattatygyggttgtttgagttgttta

SEQ ID NO: 3564 - DNA, 206 bp, Artificial Sequence
  Description of Artificial Sequence: Synthetic polynucleotide
gttttygagtgygtagygtgygtttttagtttttgttgygtttttaggtttggygygygattygagygtagygggtaaagttggaggaatttggyggyggyggagygggygtaggtttagttygataaagttygggggttygggtyggggtygttgtygtagttygtaygttgtttygtgttttygagaggttttttttttagygt

SEQ ID NO: 3565 - DNA, 201 bp, Artificial Sequence
  Description of Artificial Sequence: Synthetic polynucleotide
ggtygtygtttatttygygtatttygttttttggaaatttagtagtyggggggygaatatygyggygtttttatgggaatttggtttygggtttagagygygggtagttggtagagtttggggggygyggyggyggtagtagtaggttggagggygygyggygggggttaaggggatttggtyggygttyggagtyggagt

SEQ ID NO: 3566 - DNA, 203 bp, Artificial Sequence
  Description of Artificial Sequence: Synthetic polynucleotide
gttgtaattttgggtttgggattgyggggaygggaygggtgggaagyggttaaaggygtagyggtttttggttagagtygtagaggtttgagaygtgggtygygtttyggtttaggagatttygyggtygygttttaatttttagtttttygattgygattgygattygggaaaaygtttaygtttttggaaaggaagtttta

SEQ ID NO: 3567 - DNA, 216 bp, Artificial Sequence
  Description of Artificial Sequence: Synthetic polynucleotide
ttggggggttgggagaaygaaaatattagttgygtttttaatatttaaggaaggaagtggtagyggggayggggagaggatgggaaggggatgttgattgygagttggggygggaygyggtgatgggaggggatygggtygggaatgygggaggygaggggagygaygggatttgtygtttyggyggtygggtagttaatygattygtttttttta

SEQ ID NO: 3568 - DNA, 335 bp, Artificial Sequence
  Description of Artificial Sequence: Synthetic polynucleotide
agtgtyggagygttyggtggtygtygygtygygygtttggagggatgttaaygtggagtyggygtygagttygttyggygtgygtgygtgtgtgggagygygygagttttttgaygyggggattagttatgaatygggggtgtgtgtttgtttttagagatttggtaaggtgyggagttttttagaagtgyggttaagyggtagyggagayggygagttaggaattttttttygygtttttagttttttagygtggyggyggaattttyggagaaagtttgtaaatttttagygggygyggygaggaygtygggttatttagggggygggtgggc

SEQ ID NO: 3569 - DNA, 230 bp, Artificial Sequence
  Description of Artificial Sequence: Synthetic polynucleotide
gagagaaagtgagaagggagagaaaagyggyggttgagtaaagygggagtyggygygggyggtggggtttgattyggaygtygygtattyggtttygtttygygtttagygtttygtttattttttggtygygtttgttttygygtttttttgtttttttttatttattagtagttttgttgataagygagaaaattgataagtgagaaaagtygtttgttagygttygg

SEQ ID NO: 3570 - DNA, 224 bp, Artificial Sequence
  Description of Artificial Sequence: Synthetic polynucleotide
tagtatagggggtgagatggggtggtggttggtgaaygttggttattttattttatattattttattttgagagttgttataattatyggygttatttttygtgtattttgaggtttggttggygagtygttgttgggagttttttgtaaatattttttaaagtttgaaggygggttttaaaygtaggygtyggggattatgggagtttttaaatagttgygtt

SEQ ID NO: 3571 - DNA, 211 bp, Artificial Sequence
  Description of Artificial Sequence: Synthetic polynucleotide
ggttaattttaggtatagtttattygagttaggygaggtttagaaaggtttgattygtttggtagttttaayggatttgttttygtagtygttgattagtygttgaygagyggatttttyggtygttatggygattgtgaaatgtagggtggagygtatgygttygaagttattygygygggtagtttttgygtgtttttttgygtgtttt

SEQ ID NO: 3572 - DNA, 205 bp, Artificial Sequence
  Description of Artificial Sequence: Synthetic polynucleotide
ygtgtaattygattttttttgatttataagttttgagtgatagttttgatttggtttaatygygggagggaggggaaagagaaagaaagaaatttttagtygtaygttttttttggtatttaatygattttttggaaaaaggttttatttyggtttggtgtttygtgttgggtggagaagtttttygtttygatttggtatygtt

SEQ ID NO: 3573 - DNA, 398 bp, Artificial Sequence
  Description of Artificial Sequence: Synthetic polynucleotide
tttygttygtttygygtttygygtttyggygtttygtygttygtygttygttygtttyggygtygtygttygygtttyggygtttygggtyggygaggggygygttygyggtygyggtygttgtatggygttgagatggygggggygtygygyggyggaggyggyggyggaggyggygygggygagttygggggygtygagygggyggtygggataagtygtyggygygggtttygggygtgygaygaggagttygtttgtttagagttggaggygttgtttygyggttataygttgyggttggagtaggyggttaygttgaaggygttggtygtttttagtttgttggygggygygttggygttggtygagttgttgggygygtyggggttygygtt

SEQ ID NO: 3574 - DNA, 290 bp, Artificial Sequence
  Description of Artificial Sequence: Synthetic polynucleotide
atagygggygtttttagatattggggaaagtgttttaygatgtttygagtttttttagtttygttagyggggygagygtgagggtgtttygatygattagyggtttygggtgtagggtggygggttyggyggygygygttttttttttttttttggyggttygtaygtgtygttygygtygygtttttaygggttaygygygggtttygtagygtygyggtygagtygggttgttyggttygyggatatagygtyggtygtygtatttygtgyggggtygyggygygatg

SEQ ID NO: 3575 - DNA, 307 bp, Artificial Sequence
  Description of Artificial Sequence: Synthetic polynucleotide
ygtgaaattgtttaattaagtgygtagttatagaggaagaggyggtttttttaatatggyggggtttttgttttttagttttygggttttgattttagttygygtttttattgttttatttttttygtttttggagtttttyggtgattttattatagtttttgttattttgtgatttgtaggtattgggagatttatagggaggayggyggaatatttggaggttgggaaatggtgagtgygtggagtgggtgtttygagaatggggaagaggttgtttgaattyggtyggaatyggttgyggtgg

SEQ ID NO: 3576 - DNA, 212 bp, Artificial Sequence
  Description of Artificial Sequence: Synthetic polynucleotide
agtgttgttaggyggaggttygttagaaggtttygtagttgttgaggyggggtgggattgygttttaggggtygygttgaagttggygtygygattattgygtatygatttygtttattttttgttygttttygggagttttttttgttttaggayggttttttattttttaaattatgttygttttttatttyggatttatagttattttt

SEQ ID NO: 3577 - DNA, 375 bp, Artificial Sequence
  Description of Artificial Sequence: Synthetic polynucleotide
tggtttttgagtagtatygtttagtgtagttttygttaggaaaagtagtagaatygatagttttagggggygagyggggtttatggtgtagggggtygggyggttygttgggtaaggygttygagaaagygtttggygggaggaggtgygyggttttttgttttaggyggttygggtgttygttttatgyggggygagygttyggtygattttygtyggggyggagtttgaggggtggttgatttatgtayggggattgttatttygtygttttygygttgtaaattgtgtaagagggagaggaatttttygttaagttgaaaagttgaatttgttttttaaatttttttttgtagtttagayggggaygttttg

SEQ ID NO: 3578 - DNA, 201 bp, Artificial Sequence
  Description of Artificial Sequence: Synthetic polynucleotide
ggggttgttygtaatatgtagggaaatgagtatttygttttgttttttatttttttttagtttttygtggtgggtgtataggaaaaagaagggygaaaagygggggtaatagttagtygtygygygygtttttagygtygtttttagtaatagygttaggaggaaagtttgtygggtttagttattgygttttatgtygtc

SEQ ID NO: 3579 - DNA, 356 bp, Artificial Sequence
  Description of Artificial Sequence: Synthetic polynucleotide
ttggagaygtygggayggaggagttaygyggagagaaggygagaagaaggyggaygggagyggaaygggttygggagygggtttgggagygggttttygtygagaagtttygygggagayggyggtttttaaagttattttgggtygygggagygygggatyggggttgygggygtygagagygygtygtttgtygttttygtgygtygtygtygtttttgygygaygtttttyggttaggtttgggaaagygttygtttygttttatatttttttaaagtttygggygtygygtttttttygtygtygttataygtgtttyggtygttttttygttttygygygtygtttygttc

SEQ ID NO: 3580 - DNA, 265 bp, Artificial Sequence
  Description of Artificial Sequence: Synthetic polynucleotide
gtyggtttttttgtttgagtyggttgygtttygygtttttyggggttygtagtttgttagttygggyggttygtattygttttgggaattygttygaggtygygaatygttaggggttttygygttttttttttatttaggttttttgtttttttygtygyggtygttyggtttttygyggtagygatagagttttatttgtagaggattttaaaatgagattaagygaaagtggaattggtagattygagtggtgtttggaaat

SEQ ID NO: 3581 - DNA, 697 bp, Artificial Sequence
  Description of Artificial Sequence: Synthetic polynucleotide
gattttagtygtaygttgtgygaggtttgtaatattygttttagtygttaygagatttatatygtgtataagyggtattattgygtttygygttaygattygtygtygygtygatyggtygygttttygggattttttgggtyggtygygttttyggttttttttttygtygygtttgtgygtaygygtagaygtygtaagttttaygagttgtaygyggtyggygtttygtttttttygtygttyggttaygttttygygttygagtygtygyggttyggaagyggaagyggaagyggtttyggtttygtttttgygygttygttyggtttygyggtygayggttttatygatttgagtaagaagtygyggygttygtttttyggagtttyggtatyggygttggtygattattaygagtgtayggtttgtygygtgagtttttatagtttygaggtttatttggygtataagaagtattygtgtttygttgygttatygttyggygygttyggtttgttygtygtygtttgtttttattgtttttygaayggttyggtgygyggggatttgttggagtattttygtttggygtayggtttgttgttyggygygtttttggtyggttygggggtygaggttyggaygtyggtygatygyggtttttygttygttttygttttygtygttttttygt

SEQ ID NO: 3582 - DNA, 226 bp, Artificial Sequence
  Description of Artificial Sequence: Synthetic polynucleotide
tgggaggagygtagatatttttyggtgatagggagggttttttatttggttgttatttggaagtttatagtggtttyggygggtaggygggygggtagagygygggttygaaygtttttygygtttgyggyggygtaygtgyggyggyggyggyggygtyggyggygygggygggatttattgggtggtygygygygttattygygygttttttgygygtttttgt

SEQ ID NO: 3583 - DNA, 201 bp, Artificial Sequence
  Description of Artificial Sequence: Synthetic polynucleotide
ttttttttatttttttaatttttagtaggatayggaatttyggygtttttygaaagttataaaagaggggtayggaaattttaagttygtygtgttaattyggagaaygtaaattygaggtagagygtgygtygtgyggggatgtgggtgtygaggatttygaagygttyggtttttttygygatttttattttttttaga

SEQ ID NO: 3584 - DNA, 201 bp, Artificial Sequence
  Description of Artificial Sequence: Synthetic polynucleotide
tatttygttatttyggyggggtaagttyggattttattagggtaggttygggaggttatttagggtagaygattygaggtagagygttttaaaattttgtygtygtaygtttagttagagygtygagygygtttgtttttttttygttattttttagttttttattygtygattaaatttttgggggattatatttttaag

SEQ ID NO: 3585 - DNA, 215 bp, Artificial Sequence
  Description of Artificial Sequence: Synthetic polynucleotide
ttgttttttagttagaaygtgaatgtattgttgaygtatattgttttgggagaagattagygtgatgtagtgtttttatgtattagygtygtttttttttygtygtttgtttygyggggttaaygtyggygttttttagygtygygtyggtyggygtygygtagtttygygttttyggtygttygtttttttttttttttttttttttttttttt

SEQ ID NO: 3586 - DNA, 252 bp, Artificial Sequence
  Description of Artificial Sequence: Synthetic polynucleotide
tgaaygtgtgygtgtgygygygtgtggttgttttttttagttttagtttygaaygtaaatattttatygaggtatagggaagtygggagtagtygaggaaygyggagggygtygaattagagtttgyggggtttgatagttttttttgyggygtttaaggtgggygtaatgtttaataaaaaggtyggaaaatggggatygatttygaatattttttttttttatttagtttyggagttygagtagyggygg

SEQ ID NO: 3587 - DNA, 203 bp, Artificial Sequence
  Description of Artificial Sequence: Synthetic polynucleotide
ygtttyggyggtygyggagggagygtaggyggygtygttgtaggggtygggygggttggyggyggyggyggyggyggttgtaggagygygggtaggttygygygtygttggtaggggtagtaaatggtagttttttttygtagtatttattygyggttgtatygtatyggggtattgtgggaaatttygtttattttttygtt

SEQ ID NO: 3588 - DNA, 201 bp, Artificial Sequence
  Description of Artificial Sequence: Synthetic polynucleotide
yggyggtattyggygtagaggttttagygyggggagtygggtttagtttyggtttgttagygtygyggttttagtttattygaggtyggtttggggggttygtagggygygyggagygtygagtgygygtygggttgggtttygtatttyggtgtaggagygygggygyggygyggyggagygtttygtatggagtyggtt

SEQ ID NO: 3589 - DNA, 201 bp, Artificial Sequence
  Description of Artificial Sequence: Synthetic polynucleotide
gttgaatatygttygggtttagtttttatttygyggtttggtgaagttggttttygtgtttgtttgggaagtttttgtttggggataatygttaggttttygagtygttttttttttatttttygttgygtyggtaattttattttttygtttttattaayggatyggtatttaaattaaagtttagttttttggggttta

SEQ ID NO: 3590 - DNA, 201 bp, Artificial Sequence
  Description of Artificial Sequence: Synthetic polynucleotide
tttygtttttyggtagagtttttgttygygttaatttatttattaggttttgttygygttaygygygtttttggtaggtttggggyggggaaaggygaagygttgggtaygygagggtttgtgtattttagtttttaygaygtttttggttttttttaggttygtygttgtygtatttaatttttttttttygggggttat

SEQ ID NO: 3591 - DNA, 213 bp, Artificial Sequence
  Description of Artificial Sequence: Synthetic polynucleotide
tagtttatttaatattatttatgtattttgtgtaaggaattgtgggatttygttttayggtaaataatatggaaattttaaaaatagygatttttttgtgygtgtttatttaygygtttyggggtgatttggyggggttgtygtygggtgatttatatttttgaatygygaagygatagggaaagygygggygagygtaggagaygyggtygg

SEQ ID NO: 3592 - DNA, 385 bp, Artificial Sequence
  Description of Artificial Sequence: Synthetic polynucleotide
ttattttttgtttgtttaagtyggttggttttygtgattgattyggaataatagagtagatgtttgygtgggaggtaagttttatttaatatttgttttgyggygggaaggtttgggtgtttatagatagagttggagtttttyggtgggtggtatagataattagttggggttgttttatatgtaatttaattataggggaaataggtttaaatatygggtgataagtagygtaattgtttygggtgattttgtaattttttttttattaattttttttataaygtatatgattgttataagggttaattaaaaagagygtgagtggttttatgttatatgtagttggattagaaagtgttgagtatttgtttatgygtgtaag

SEQ ID NO: 3593 - DNA, 278 bp, Artificial Sequence
  Description of Artificial Sequence: Synthetic polynucleotide
ggtattgyggtttagttttygttyggggattygygggtygattgtggttttttttggggaagtyggggygyggggaggygtttygggtattttagtygtayggggtaygttygttttyggyggggtttttygtttygttgtgggagtggtagtgggtgtyggggtggagaaagtaygygtggygyggagttttggggaygyggygttttattygttttggggagtttyggattttttttagtttttaggttygtatgtttttttttttttagtgtttt

SEQ ID NO: 3594 - DNA, 248 bp, Artificial Sequence
  Description of Artificial Sequence: Synthetic polynucleotide
aygygagtygttagyggtgggatttatygaygatttttyggggygataggagtagtttygagagttagggygagygttygttttaggtggtyggatygttygtygygttygygtygygttttttgtaggtaaygggagaygttttygygtagygygagygttttagygyggtygttygttttttttttygagggataaattttttttaaattygattygagtttttggattaaattygtttgygtyga

SEQ ID NO: 3595 - DNA, 216 bp, Artificial Sequence
  Description of Artificial Sequence: Synthetic polynucleotide
tataatataagggagagaaagtaaygttttggttttagaaatttttatygttaaggttagttttggttagaygtatagttaaagagtttttttagtttagyggatgaatygttygygagtggtattttttaaaattttggttttattttttaagatgtttttttattgygtaatttagaaagtattyggatygtygttatttattagyggyggyga

SEQ ID NO: 3596 - DNA, 201 bp, Artificial Sequence
  Description of Artificial Sequence: Synthetic polynucleotide
tgaggtgttttttttattaattttaggtatyggtttttggtggaattgtttttagattgtttgagtttttagggttaagttttttttttattttttagtayggagttttatttagaattgtatttygaaagtttaaagtttatttatggtttttagagataggygaaggygaggttttttaygggaygttttggtaggtgt

SEQ ID NO: 3597 - DNA, 208 bp, Artificial Sequence
  Description of Artificial Sequence: Synthetic polynucleotide
ygagtagttagggttagygagygattttagtagtagggaygyggtygtgygagagttygyggataggygagggggattttaggggagtagttgttgtttaygggttaygggygatgtayggagtggagaagtgaaygtggtttataggatttttgttyggaaggtggagagygttataggggaattttttygatttttgttygtttyg

SEQ ID NO: 3598 - DNA, 201 bp, Artificial Sequence
  Description of Artificial Sequence: Synthetic polynucleotide
ttaggagttyggatttttgtttagttttttggyggagttaagttygagygtatagatttttygagttttagyggttagggggtattgtgtgagyggttgaygttattttttygttyggtygaaattaggyggygggattttatatagttgaggagagggagtygaggtygtgatttagggttggygaygattaaattaagt

SEQ ID NO: 3599 - DNA, 364 bp, Artificial Sequence
  Description of Artificial Sequence: Synthetic polynucleotide
gtygygggtgaggtttgtggttaatttygygttgtygaggttttattttttygagtttagtttgattttaggtygtttttaggtyggtgtttagttgaggygggaaygttgtagtttggttgagygtgatttttaggttttgtgaggaaaagtygagygygttatatygaggygttagtygtttattttattataaggtaaaagatttatgttgttttagttattttaaagttgggagatatattgtattttttattagatttygaatgtttttagtgtttgtaattttttaagaagtttttagagtagatagtttttggatygtgggtattttttttyggggayggggattttgttgatygtt

SEQ ID NO: 3600 - DNA, 213 bp, Artificial Sequence
  Description of Artificial Sequence: Synthetic polynucleotide
gtttagtttttttttagtatgtaaagttttttgttttttttyggagttggyggaggyggtaattttttattttygtygtygggggtygggtagtagygggygygygggttagygtttagtayggygggtagygtygygttgygtatygtygtygattatgagygaggatagtygyggagatagtygygtygagagygttaaggatttggagaa

SEQ ID NO: 3601 - DNA, 201 bp, Artificial Sequence
  Description of Artificial Sequence: Synthetic polynucleotide
ttttttygttayggtaatttaattggaggtagaagtyggyggggyggtygagyggggyggggygggagygyggtygtygygagttayggtggggagygggygygggggattttggygggtttygggtagygyggttgtatttatttgtgttataattgyggygayggggggttgaggaatyggtttttttaaaagtaaatc

SEQ ID NO: 3602 - DNA, 201 bp, Artificial Sequence
  Description of Artificial Sequence: Synthetic polynucleotide
ttttgggyggttgtagaggtyggtygttyggtttggtttattttttttaggaaattttatattggagaggtaagggygattttaaaatgtatygttgagtygttaagttgttatttttttttatttttttttgtttttttaaattgtatttaaaaaaaaaaaaaagttaattgtatagagtggttgggygygatgggtggg

SEQ ID NO: 3603 - DNA, 296 bp, Artificial Sequence
  Description of Artificial Sequence: Synthetic polynucleotide
ttygggatygygtttyggtygttygagtttttygygttygtygttttttatttyggtygggggtttatttgggagttygttgttttyggttagtygttygygtgtgtttagggttagtagtaygtataagtgttagygtayggtygtygygtttatgtttaatgygggtttygttgggygtgygggygtgyggggygyggggattygatygatyggtygttttygtaggygttgttygttgttygtygtttygttatygttygggttttygagtygtttagttagttyggttgatg

SEQ ID NO: 3604 - DNA, 201 bp, Artificial Sequence
  Description of Artificial Sequence: Synthetic polynucleotide
ttttgtttggyggtttttgygttyggggttgttgagttyggggttygttttgaggtygyggttgtggtttttggttttttyggttygygttattgtygygyggygttygttgtattttgttttttttgyggtttygtatgtttttggtggaatttagttyggyggaygaygaggaggatgagatggaagtttgttggaaat

SEQ ID NO: 3605 - DNA, 297 bp, Artificial Sequence
  Description of Artificial Sequence: Synthetic polynucleotide
ggggagggaggygyggygygggaggaggaggggygtagtygyggagttagtggtttygtttggaygygttgttttttagatattttyggagttttagtygygyggatygygygttttygtygttttgtttttaaatttttgtygtagtttttttttaagttagygaatttattttttaaaattagaaattgaatttyggtaygggaaaggagttygyggaggagtaaaattatagtagagtaagaagagttttagagagtagttttttyggagtattaatttygtgtygggagtgta

SEQ ID NO: 3606 - DNA, 268 bp, Artificial Sequence
  Description of Artificial Sequence: Synthetic polynucleotide
tygygttygggaggggyggttgtygttygyggggygttygyggtgttygggtttgggtagygaggaggtgaygtygttttygygggatgagttygggaggyggaggggyggaggaggtgttggyggyggtattgagyggyggyggygtagggygygygggtttttygygtygattttatygatttaaggggyggyggyggtggyggyggttgagygattttgggtygggygygtgatgaggaggggtyggygttagatttygttgtac

SEQ ID NO: 3607 - DNA, 201 bp, Artificial Sequence
  Description of Artificial Sequence: Synthetic polynucleotide
ttgagtagtygaagggataattagatagttatagatagatagayggttagttygagtttygggtaggagagaggttgygaggagtagtttatgtttgtttygtttagttttygygttttygggttgtttttttaatttygattygygtaygttgygagttttyggygttgtygtttagtyggaggggtagtttygtttttt

SEQ ID NO: 3608 - DNA, 201 bp, Artificial Sequence
  Description of Artificial Sequence: Synthetic polynucleotide
ygygattagtattttttygttaygaatttgagagataagaagygaaaatagggtgtgtgggggatggagagagtttyggggaggtagttgygttttygtaygttttaatttaaagaagagagggaaggaggaagygaatttattgtttagtaygagtygyggagyggtttaatttagagygggtagttgyggaygagttgg

SEQ ID NO: 3609 - DNA, 201 bp, Artificial Sequence
  Description of Artificial Sequence: Synthetic polynucleotide
ttttgtgygagtaaagtygggagagygagttttaagtatttggtagyggtgtttttagtaggygtygaggaattyggttatttatttttggtgaattttgygtttattgaggtattygaggtayggatgtgttygtttagtattyggagaygaaggagagagagyggggatatgygttttagttttgttaggttttagggt

SEQ ID NO: 3610 - DNA, 201 bp, Artificial Sequence
  Description of Artificial Sequence: Synthetic polynucleotide
tttttttttttygygtatttygtggttygattygagggygtygaatayggyggygtttattagtaggtaggtgaaggtgtagaygatgagggatagagttygtaygttttgtttttttatggtygttagtaaggagtyggygyggggggtatgtttygtaggtttatagtygygygygttttattgtagygttyggyggtc

SEQ ID NO: 3611 - DNA, 302 bp, Artificial Sequence
  Description of Artificial Sequence: Synthetic polynucleotide
ygtttattygggygygygggtgygtagyggggttttygtygggygtyggtyggtgygygaagtttgttyggtttaatttttaaggygygggagyggggygyggttttaggayggtagggatygygatggagyggtttygggggyggtygggggayggygyggtggyggtyggttagttygttttttygggggyggygggygyggyggyggyggygggaggggtttygygggtttygyggagtagyggggyggaygygggygtatgagtygygygggggtyggggtttttyggygttygggyg

SEQ ID NO: 3612 - DNA, 201 bp, Artificial Sequence
  Description of Artificial Sequence: Synthetic polynucleotide
tyggtggtygygttygtgaaatggggaygygggttttgttttyggattttttttagttttygatttttygtatttgtttygagatttaaygtgttyggttygtagygtgttgggtttgyggygttagggtggttygagtttygagattatttgygtttgyggatatagtygyggggtttggtatgaagggttttagggagg

SEQ ID NO: 3613 - DNA, 220 bp, Artificial Sequence
  Description of Artificial Sequence: Synthetic polynucleotide
gyggggygggygattgtygggtttygggttagttttygtttttygtttygttttygatygttyggttttttygttyggygttttttygggttgygtttygyggtttttggyggyggyggyggygggygtagagygyggtatgggygttygggtygyggggtttggyggyggygggyggaygggygygyggttgygggygtaggtgyggggyggygggtyg

SEQ ID NO: 3614 - DNA, 347 bp, Artificial Sequence
  Description of Artificial Sequence: Synthetic polynucleotide
tatygtttygggtgyggyggttttaagyggagatttgagygyggygggtygagttttttaatttgttggygttgttttttttttttyggyggtgygygggyggygttttaaaggggaggattttgyggygygggtaagaggyggygggagygygyggttygggagtgtggttgtagtgygtygggatattagggtttygygtttygtatttaagaggttttygygttttaatttttygygttygygygttygyggatttaggtygaggatygaaaggggtygttygagttttyggggtyggygtttagagagtttagtaaggtyggtygttttgtyggtgtgtygtc

SEQ ID NO: 3615 - DNA, 201 bp, Artificial Sequence
  Description of Artificial Sequence: Synthetic polynucleotide
tggtattaggtttttttatgggtatyggagtaggyggataggggtggggtttygygagygatayggaagggttagtgtggyggagyggattttgtggaggyggggttattgtgtttttgagaagggttttygggggtggagtttattaaggttgygggggygtggttayggagyggagttaataaaagyggggygtgtayg

SEQ ID NO: 3616 - DNA, 201 bp, Artificial Sequence
  Description of Artificial Sequence: Synthetic polynucleotide
ygttttggtatygggggyggyggygtagaggtygggaggaagaaattygggttttggtttaggtygggtttttatttttgygattygygagaggtttaggygggaaaggyggygagtggygttagyggtttygaaagtaaatttggttyggtgttattgttygagggtygtygggygygttttttaattttttygagtttg

SEQ ID NO: 3617 - DNA, 225 bp, Artificial Sequence
  Description of Artificial Sequence: Synthetic polynucleotide
agtgygtaygttgtaggaattayggttaygtttygtygtttaagggttataagygtttttgtatgtggygygattgttagtgtaagaagtgtaatttgatygtygagaggtagygygtgatggtygygtaggtgggtgygggygtgygggagttygggtttagttttagtttttttttttttttttttttttagatggagtttygttyggttgtttaggttgtag

SEQ ID NO: 3618 - DNA, 318 bp, Artificial Sequence
  Description of Artificial Sequence: Synthetic polynucleotide
gttgttaatttattygggagttyggggtatgaayggttayggttttttttatttgtatatgggyggttyggtgtygtagtygttaygggygtttttgtagygtaygtttaagtgygygygttgtygtaattatggygttttgttttggtttaagggttataagygttattgtygttttaaggattgtatttgygagaagtgtatttttattatygagyggtagygggttatggttgygtaggtggygttgygtyggtagtaggttaaygagagtttggagagttttattttygattygttgygygttttgttagggtt

SEQ ID NO: 3619 - DNA, 265 bp, Artificial Sequence
  Description of Artificial Sequence: Synthetic polynucleotide
aggaaggggagygtagtttgtagattgaagttagtggygttgygttgaatgtaattgygygygttygtygggtgagttagygatttgagttaggygggggyggttygatttttttygtttagtttgggttagaggaagtygaaagyggttttagtaaggtgaggygttygaggttgtagaagatygagtagaattttgtagagttygggatgtgttgggttaggtygttgaggatttgattggttttttttttttttttttttat

SEQ ID NO: 3620 - DNA, 259 bp, Artificial Sequence
  Description of Artificial Sequence: Synthetic polynucleotide
yggaggggaggtygyggagggtygggtggaggtttttatygttagttttaaggtttgtagtatttttttttggtttttgtttttagggtygatgtgttttygagygaagtygtygtgtttgggtagaaggygttttaggaggygygaggttttagtygyggygttgttttygtygttattgttgttgtttyggtttygyggygtttagtayggtttygattttttagttaggyggyggtygttttygatttygyggttt

SEQ ID NO: 3621 - DNA, 201 bp, Artificial Sequence
  Description of Artificial Sequence: Synthetic polynucleotide
gayggggtatyggtattaattagyggttygtttyggggttttygyggttaaggygagaaygtaggattaggagtattgttgtttattttttatygtaattygtatatttygggattaygtaayggyggatggggygttygggagyggtttttgtaggggagagtaataggttttygygttttggaggtttggtttgygttt

SEQ ID NO: 3622 - DNA, 323 bp, Artificial Sequence
  Description of Artificial Sequence: Synthetic polynucleotide
ttttygygattttatyggggaaatatygyggatagtygggttagtagygttyggagtttattttaggtttttaaatttgtagtattttttagagygygygygttyggagygggatttgtttgttttagtgtaygtygyggagygaattatygggttggygggggtggaggggtgtaggygtgggggttgygggtygttygggttttgggttttttttgtygtygtygtygtttttygttttyggttaggagtygygygtgaygyggttygtygtaggagtttygaaggygyggygtyggygagttttttttyggtaggygygt

SEQ ID NO: 3623 - DNA, 201 bp, Artificial Sequence
  Description of Artificial Sequence: Synthetic polynucleotide
agtygttttygtatttttygttatagttttygtagtaatygttttagtagtygtagttttagtagtygttttatttyggtaagatgtaggaggyggyggtygtggyggyggyggyggyggyggtygyggtagtygyggtgggtagygtgggaygtttgttttagtttttattttaygggttgggttyggtygtygtygttg

SEQ ID NO: 3624 - DNA, 355 bp, Artificial Sequence
  Description of Artificial Sequence: Synthetic polynucleotide
gygaatataattgttttagttataggygaggtttggttaaggtgtgggygtatttggggtaggttttgagaggtttagygttyggtggtgyggatagaggyggggtatygyggygttygtygtygttttttygtaggtgattatttttttgtaggtgttttygggttttaggtggttgygtgtttgygttatggttgatattttgggygagyggtatttggtgatttgtaagggygygayggtggaggtygaggyggygttgtagaataaggtggtggtattgtatttygyggyggttyggtgygygtygagtygygattttaygtygttgttttgygatttttatayggygttg

SEQ ID NO: 3625 - DNA, 201 bp, Artificial Sequence
  Description of Artificial Sequence: Synthetic polynucleotide
ttygygyggagygattgtgaggggttttgttggaatttggtagygyggaggtttggagagaagttttatgttggtttttatttagtyggttygtttttttygagttttggaagttttatttagtygtgtatttaatggttttataaagttgattataagttttagygtatttttgaaggagttaaaagygaygtaggtgta

SEQ ID NO: 3626 - DNA, 290 bp, Artificial Sequence
  Description of Artificial Sequence: Synthetic polynucleotide
gatattttgtggagtaggtggtttaggttgtygggtttatygtygggygttttgygtagygtttygtyggatattaagtagggagtygtygtyggggtygygygygtygtygaaattttgttttygtygtygtttatygataggttgtggagaaggttatygatygatgttatygagttatttttgaagyggttatatttggtgygtggaagtatgttttttygtgggttygttgtattygttygggygttgttggtgtyggtttyggygygggttgtygygtatagtag

SEQ ID NO: 3627 - DNA, 201 bp, Artificial Sequence
  Description of Artificial Sequence: Synthetic polynucleotide
tagagattgtagttttygtygggttggatgygagttttttaggttagagtttagaagygygttgggatttgggtttggtttttgggtttgtgttttttttygtttggttttaattgttygtatttaagattataataaaaaggtttaggaagtaaattttttggaygyggaagggtyggttygygggttttygtygagtga

SEQ ID NO: 3628 - DNA, 201 bp, Artificial Sequence
  Description of Artificial Sequence: Synthetic polynucleotide
agaggtyggttygtygygygggagatattttttttaaagtggaagygttgygtgggtagtagygygggtygggttttyggattttagtttttgttgttttygagattttygtttygygtygtatttttygagtttagygttttygggttgygttgggygtagtggttttyggttagggygtagtyggtttgggygttagag

SEQ ID NO: 3629 - DNA, 288 bp, Artificial Sequence
  Description of Artificial Sequence: Synthetic polynucleotide
ygatgtagtttagaattygygatttagttyggtttattatagtttttagtagygatattygtagttttygattttttagatygagtgagtttaattaagtygttattygygtgttagtagttgggygtttygattttttagatygygtgagtttagtaaagyggttaggygygygtttgtagttyggygttagttyggatttygggagtygttttygagttygygtggayggtagagggyggttgtagttygggygtaggygtygttggtttgygggtttttttgggt

SEQ ID NO: 3630 - DNA, 212 bp, Artificial Sequence
  Description of Artificial Sequence: Synthetic polynucleotide
ttatttttygttgygggaaggggttgtttggttgtttttgggggtttttagagttattttggtttygggggattggaggaggaggttatttattttgygtygtttttaattygtgtattattatttattaaatagagatagattttgggttttttaaagayggatgattgggggtggtgattggtttatttttaaatatttattaygtaagg

SEQ ID NO: 3631 - DNA, 201 bp, Artificial Sequence
  Description of Artificial Sequence: Synthetic polynucleotide
agtagtagtaggagtagygaygtttagattttygggtgttgtyggggyggtygygttattygtgygtatagatttygtagttaggtygttygggtygtagygggggygtygygggygygggtygggattgagttttygtygaggttattagtaygygttygygtagtygyggagtttttygtattttygtttttttgtttc

SEQ ID NO: 3632 - DNA, 246 bp, Artificial Sequence
  Description of Artificial Sequence: Synthetic polynucleotide
gyggggatattttygggggtttygggygyggtttyggggaagaggyggaagttgaaattgygygayggggatatttgttgaaaggtygtttagttygaaaygagygttagattttagtaataaaaggttaggygaggttatatygygttggagatagagyggttgtttyggagygtaggyggyggttygggygggaagaggygttgggyggtyggattygtagaggggygtgygyggagttgggyg

SEQ ID NO: 3633 - DNA, 201 bp, Artificial Sequence
  Description of Artificial Sequence: Synthetic polynucleotide
ggygttgtatygtttttgyggttttagaggttygygggtgtttgggygygggtggygggygggtygggggtttgygggygtgtttgtgygagagttgtttygygagyggygtagagatattygggygagttgagagttttattttgttttatyggtggaatgggtatattyggaaggygtagttgttttatttttgggagg

SEQ ID NO: 3634 - DNA, 201 bp, Artificial Sequence
  Description of Artificial Sequence: Synthetic polynucleotide
ggttgygygaygtttttygtygttgggggagattagtaaagttattygtttttggatttyggggtttgggtttttagatttygtttygyggygggagatgygtttgagttttttatagayggagygygttttagtttgaygtagagggatgaatagataagygtatygggygggaatttygattgtttgtgtatttggggt

SEQ ID NO: 3635 - DNA, 358 bp, Artificial Sequence
  Description of Artificial Sequence: Synthetic polynucleotide
gatatttagyggttttagggtgaatttygatygtagtygtygtygtttygggtagagtttgygtttttgttttgygtttygggygttgaagtygggygggygatgttygyggygtgaaagygttygyggygggygtygatttttgttttagttttttgtttttttygtttygtttgtttygtgtttttgtgattttggttttggygtygtygtttaggygtttygtaatgtagttgtttttgygtttyggygggaggygttttgtttygygagygttyggggttyggagttyggtttgggggtttagtygagttygggyggggtyggggtygyggtggygatgtatygggttygttag

SEQ ID NO: 3636 - DNA, 201 bp, Artificial Sequence
  Description of Artificial Sequence: Synthetic polynucleotide
yggtygggttttttggagagggagtgtaaggaggagtagtgttttttygaggaggttygggagatttttaaggaygyggagaggayggtgagtttagtttyggggygtttygygtygyggatattgtaggyggyggtgaattaggtygygtggggtygtttgygtttttttggttgyggttgtgggyggygaataygtagc

SEQ ID NO: 3637 - DNA, 201 bp, Artificial Sequence
  Description of Artificial Sequence: Synthetic polynucleotide
gttygggaygygagagggggygygayggyggttgyggtyggttyggygtttatttggtygtttttgygagtagygtttygygtttygttygygyggagttygtatttttyggtygygtygtygtygtyggygaggagtygtattygggygtagygtygttygttygygatgayggtygttygggtyggggayggggaggyg

SEQ ID NO: 3638 - DNA, 201 bp, Artificial Sequence
  Description of Artificial Sequence: Synthetic polynucleotide
agagagaattygaggttgtttttgtygttgaaatttgagygggagagtatttygaagtygtttgygtggagygagtagttttygygttatgggttagaggygttygggagaatttgygggttayggattatattygtaggggtttggyggagtaaggtgtygttygtygtttgygggtaggagtyggttttgggtttyggt

SEQ ID NO: 3639 - DNA, 277 bp, Artificial Sequence
  Description of Artificial Sequence: Synthetic polynucleotide
tygtagagatttagttttgtttgtygattggtttttygaygtygtygtygtgtttgagtttygttgtttgttyggataagtagaatttyggtaggygtagygggygtygaggtttgggttttagtygtggygttygtttyggygtagtggggagtygygggygtyggagaagyggtygygttgtttygggttattgtatyggttgaaaaaattaaaagtaaaattaatatttagaaaygaagtttgygtgttttygggggtttygttttgttttttt

SEQ ID NO: 3640 - DNA, 201 bp, Artificial Sequence
  Description of Artificial Sequence: Synthetic polynucleotide
agttagtggaatyggagggggatttyggaggaatttgtttttgatgtttyggttttttggttttttattagaattygtagaggattygttttggagttttygtgygttttggtagaggtyggggaygttagagtgtaygtagttttttgygygtygagtttaggtttygggygtagggaggatygggttgagagtagggtg

SEQ ID NO: 3641 - DNA, 247 bp, Artificial Sequence
  Description of Artificial Sequence: Synthetic polynucleotide
gtaagggtygggagtttggttttttatgaagttgttttaggtygggattagttttagtttygayggtygttgyggtttygtttyggtagtttygtgagttygyggaggagtttygtattygatygtgtatagygatygagttggygyggttygtatgaagygaagygtyggttttagtagygtagtttgagtaggggattygygtggtaattagggttgygygygagttyggggygattgtggyggt

SEQ ID NO: 3642 - DNA, 201 bp, Artificial Sequence
  Description of Artificial Sequence: Synthetic polynucleotide
ttttygygygtagttygygtagygtttagagtyggayggygtttttyggtggyggyggaggagttyggagggaygtagtygggtaaggtagggygtagggygggyggygygaggygtagggygyggygggtagaggttatttggttattttttttggygttyggggaaggtgyggygatggtyggggygygyggggyggyg

SEQ ID NO: 3643 - DNA, 201 bp, Artificial Sequence
  Description of Artificial Sequence: Synthetic polynucleotide
ygttaggttygttttygttyggtygttygttygttyggtgggtygyggtggtygygggttgygttgygygggtygggtttggygggtygggggttgygygygttygygagggygttygaygygggttgaggggygttggygtgtgttygtaggyggttttgygygggggayggygygtttttggatatygtyggttttaag

SEQ ID NO: 3644 - DNA, 201 bp, Artificial Sequence
  Description of Artificial Sequence: Synthetic polynucleotide
ttttygagtttygygattttttygtttatyggggaaggagattttagygtygttgttttgttttttttgaaygttgtttttgttygatttggagtygtygygggagygttttatgttgyggaaatattgtttttagygttgtyggtyggygtttttttttagttttttttttttggttyggyggttttggaattaaatttg

SEQ ID NO: 3645 - DNA, 356 bp, Artificial Sequence
  Description of Artificial Sequence: Synthetic polynucleotide
aatayggagtaygaatataagtaggtatygtatatttgygagttattygggttttygggggaaggtaaaaagttttaataagttttaagtaagattaggaygtttttatagttttgttttgatagttaaggaaaaaatttgttaaaaattagaggygttgttgagtgttggygtgggaatgttagtttagttagagttttgttttgggttatttaaataaaaatagatatgttggtggtaaatgttagttgaataygtaggagagyggtgtttttygggttyggagaagggtttgtagttgtatttttttttttttttttttttggtttttttagtttttttattattaygattag

SEQ ID NO: 3646 - DNA, 201 bp, Artificial Sequence
  Description of Artificial Sequence: Synthetic polynucleotide
ttaaygtttgtttttattttaagttttgttatagttgttatatttattattgttygygtttgtgtygtygygaggattgggaygtttataaggygygttgygtgtayggtygygtgggtagygtgtgtygttaygtattgtagttttgtygygatagyggttyggtgtatygygttttttygygtatygygygtgtyggtt

SEQ ID NO: 3647 - DNA, 281 bp, Artificial Sequence
  Description of Artificial Sequence: Synthetic polynucleotide
agtttygtgygtyggtttttgtttygttagtttygttatggttttttatttattttygygggagygtttttgtttttttattttgtattttttttagagtygygygttagtttttygtttygtggaagygtttttttttygatttyggttgattttygttygtygtttttttygygggtgygygttyggtttttttttygttyggggygggtttgygtgggyggtgtttygggtyggygggyggagtttyggttttttagttttgygtttyggtggagttc

SEQ ID NO: 3648 - DNA, 222 bp, Artificial Sequence
  Description of Artificial Sequence: Synthetic polynucleotide
gtttaggttatatattagattttattggggatgtgagaagggtgtagygggygtgaggtttygttttygtygttttttgttygtttttagattygyggttygtttggtygttttatttggtygatggygttggtggtgagtataggaaggttattatagttttaatttttgaggtaatggttgaagttyggyggggygaagtygttgtaygaggggtyggta

SEQ ID NO: 3649 - DNA, 237 bp, Artificial Sequence
  Description of Artificial Sequence: Synthetic polynucleotide
ygggtttggattaggayggygaggygggtyggygygygygygaggtggtttttatttatatttagygygagttgyggttgygyggygtttttttgygttaygagttttygygygtttaygagtagttttgygagttygtygaggttaataggygttttaygtttattattatttattttayggatyggygtatyggtygtttttttatgtgtatgattatggtygttttygagtygc

SEQ ID NO: 3650 - DNA, 201 bp, Artificial Sequence
  Description of Artificial Sequence: Synthetic polynucleotide
tttggttttttaatttagtagtgtttttgaatgaaygtgtgatagtttaatgaagtagtygagtattttgatttgaatgttggagtyggggtttatagggggttgtattagttagtataggttgggttatgttattgtgataaagagttttagattttaaatttygtttttgtgggttagttgaggtttttgttttaggtt

SEQ ID NO: 3651 - DNA, 364 bp, Artificial Sequence
  Description of Artificial Sequence: Synthetic polynucleotide
gttttattagtttttyggtygagyggaaggygtyggygtttagttgggttaagttgttgtagttgaggtygaggaataygagtttggtygagtygttgaaygtgtttttttttagygagygtagygagttgtttttgaagtttaggtagattaggtygtygtagaagatgaagaagttttyggggattygttggatgyggttgtyggttattagtagtttgygtaygtttagggggaaagggtttggtaygttgggtagttygyggtygyggtagtttayggtgtgygggtyggtgtaggygtagttygyggggtaygygtgttygggygygagtagtagtagaaggttgtagagttygagygt

SEQ ID NO: 3652 - DNA, 201 bp, Artificial Sequence
  Description of Artificial Sequence: Synthetic polynucleotide
gaaattaattygttagaaaaattttttgggagaggygggagyggtaggggtggtygagtggtygtygttaaaaygyggttttattttggtagttgattttygagatttggtagtaagaygtygygygtatygggygggttgtattygaygtttaagtttagttattaagtttaggagyggtttttttaaggygtgtttygg

SEQ ID NO: 3653 - DNA, 201 bp, Artificial Sequence
  Description of Artificial Sequence: Synthetic polynucleotide
gygtttttttttggggtgggtagygtaggtttggtttgygggtggggggtggagagtgagaggtaygyggggtattagtttagtttttttttggggatttygtattygtagtttaaggaatyggtggagtaygaattttatttttgagttggygtaagygttttttttttatggagatttatttyggtttttttttgaggt

SEQ ID NO: 3654 - DNA, 201 bp, Artificial Sequence
  Description of Artificial Sequence: Synthetic polynucleotide
aggaatyggygttgtyggtgtttgggggtyggggygygggygaagtygggtygyggaggatataataggtagagtygggggtgttyggtygygygtttttygygtattatgtagttttttgttatttttttygtttttaggttaaaattttgagtatgatggaagataataagtagttygygtttygtatygatggggygg

SEQ ID NO: 3655 - DNA, 222 bp, Artificial Sequence
  Description of Artificial Sequence: Synthetic polynucleotide
tgygygygtgygtgtgtggygtgtgtttgggtgttttatgattgtttttygtgaggtygtgtgtgagtttttgygtgggtygtgagtgyggtagggagygyggtgttygggggtygtttgtyggtgtgtttgtgygtgtttgtgygttagtttttgtttttgygagtgygtatttttaggatygagtttgtttatatgagtttgtgtttgtgtgtgtgygtt

SEQ ID NO: 3656 - DNA, 201 bp, Artificial Sequence
  Description of Artificial Sequence: Synthetic polynucleotide
gataataagatttgttattgaygttatygggttggtgatatttaggtatagtagttttagtaaaygaatatatttttatgagaattaagttttttgagagyggtaagttgttttgttttgtttatagttgataagaataygtttgtayggttatttagtatttagtattgttatttaatygttttattagtatgtatgaat

SEQ ID NO: 3657 - DNA, 265 bp, Artificial Sequence
  Description of Artificial Sequence: Synthetic polynucleotide
aggygtataygaggagttyggtttagtatttttaaattagatttyggaggygtygttagggagyggttatygttgggygtygtygagygtgttyggggygyggtygtggygggttttttggggyggtagttttaggygygggygygtagtagtttygaaggygtygtttggtttagtygttyggttttygagygtygttgtaagtggggggygtttygyggygtygygtatattttattggggggtygtttygtyggygttygtt

SEQ ID NO: 3658 - DNA, 242 bp, Artificial Sequence
  Description of Artificial Sequence: Synthetic polynucleotide
tygggttgttttygtygtttatyggagagggtygttygggtgtttggttttgttygaaagtttttgggtttttttttttttttgtaaaatttaaagtaatygaataaaaagagtttaggtygygygggygggttgygygttygygttttgtagygygtyggygggggttyggttygyggggttattgtattgagtygggtagtgtgtggtggtggtggtggtgtagygtygtyggygggggc

SEQ ID NO: 3659 - DNA, 201 bp, Artificial Sequence
  Description of Artificial Sequence: Synthetic polynucleotide
ttttagggygtagggttaygagttttygtttttattttyggtttttggtattyggygtyggtttygtygtttttttttataygtatttttggtagggtttygyggggygttttaaagtttgggggtagtttttaggtgtttttgggaagggaaagaaaggttataaagtaaaagaaggagtaaagagaaggygagggagga

SEQ ID NO: 3660 - DNA, 261 bp, Artificial Sequence
  Description of Artificial Sequence: Synthetic polynucleotide
tygtttatygatgagtygtygtygttygygttygggtgtaggtgygtygtygtygygtgtaggtygttygygtgtgtatgttygtgtgygtgttygtgggygtttagatgyggyggyggygayggttttagttgygtttygtggttattttygtgtagygygtggtgtaggttyggtttygygtygttatygttygtygttagtatttyggttaggtygtygtygtygtttttygggtaggtygtttgygygtatagttyg

SEQ ID NO: 3661 - DNA, 201 bp, Artificial Sequence
  Description of Artificial Sequence: Synthetic polynucleotide
yggtgttttgggtygagtygtttggagattttagattagtatgtgggtgggaaagggygtttygttttgggttttttygtttttgygygtagagtagagaygygtagattygtttttatttygtttggtttttttggagtagtttyggyggyggtagygatgggttgggaggggtyggtaygttggtttgygygggttttt

SEQ ID NO: 3662 - DNA, 337 bp, Artificial Sequence
  Description of Artificial Sequence: Synthetic polynucleotide
gaattggataataatgtggygtttgttattggttaggggaggtagayggygttttgattggtygggttygygttyggggagtttygtattttgtagtgttygaaagattygaaattttaaaagttttattgygtgtttttgggaggggagggggygygttaggaaaggagtggaaaaaagtgggygaggaggagygttgaaaattttttgataagtagttttygtgygttygagagygtgtgaattgtttttaattatygtgttyggtgygtttttttgygtagatttgtgtaatttttyggtttttggggygtyggttyggttgtatygtttttat

SEQ ID NO: 3663 - DNA, 201 bp, Artificial Sequence
  Description of Artificial Sequence: Synthetic polynucleotide
tgaagttgttttttygggataggaagggttaaatggttgygygttaattyggtttygattggggtgttagggagtaagagtygtttgtttygggggatttygtttggggggtttttaggggtygttttggygtttyggttataatttgggyggttttgtgyggyggttttygtttgygtttttgygygttatttaaaattt

SEQ ID NO: 3664 - DNA, 201 bp, Artificial Sequence
  Description of Artificial Sequence: Synthetic polynucleotide
tagtaggtagtgygggtatagtgttgtagattattatttygttaggttygggtagygtttattagayggataggygttygyggtygtttttatttyggygygtttatttygagttttttaygtygyggygggygggygtaatatatttttttatttttagtygtygaggattatatttttygtttagttttttygatttat

SEQ ID NO: 3665 - DNA, 201 bp, Artificial Sequence
  Description of Artificial Sequence: Synthetic polynucleotide
ttttgaatygttatttgtttattattygggygttygttatttattaggygttgtattagaggygttatayggygggtatgttggygttgttttgggygttygttttgggtttygtgttgttgttttygttttgggtatygyggttyggygtygygttatygygagtttattattyggygttgttggtygtygyggygttgt

SEQ ID NO: 3666 - DNA, 201 bp, Artificial Sequence
  Description of Artificial Sequence: Synthetic polynucleotide
gtttygtgygtttagttttgtygggygtyggygaygyggyggtygttgtygttgtygttatagtygtgttygtagtgttttaggygtaattgggtattygygtygygggttagtattggtaatttagtyggggttygagggaagyggagattttyggttttygaygtttttgggtatygtygttttttttttttttagggt

SEQ ID NO: 3667 - DNA, 386 bp, Artificial Sequence
  Description of Artificial Sequence: Synthetic polynucleotide
tgtttgttgaaaaataatattgtgattatttttagyggygaagggtgtgtttgggaayggtttggggaggggatagaagagagaggggtgggatggayggyggtagaagtgggaggtataygaggagttattggaaayggygtttttgtggaggagtygggggggatggggagtagagggagggggttttgttgttttagygtttygaggtygtggagyggtagtagttgtagtyggagtagtattagtaatagtaatagtgagygggayggagttaggatygttyggagygtataggtttygaggtagtataaggtttgttatttttttatttgttggtagttgtagaagaagatttgttttttaagtgaaaygtatatgttatt

SEQ ID NO: 3668 - DNA, 201 bp, Artificial Sequence
  Description of Artificial Sequence: Synthetic polynucleotide
aggttatataggggtygggtgtaggttttaygyggaaaggygygtagtgttyggggtttatgtyggtttagggygtataggttttyggggtttyggggttygygttgttygygtygtttgtgagygttygttaagggggagggatttgggygygggggygyggagttttygggagyggygygygtygyggggggygggggg

SEQ ID NO: 3669 - DNA, 201 bp, Artificial Sequence
  Description of Artificial Sequence: Synthetic polynucleotide
tgttagggygtagggagggyggtattyggttttagttttygtaatttygygygtttttttygtygtgggatttgggttttygygtygtttttttgagtttygagygygyggygggygggagttaggttgggattggtggtgaggtagggagtgaggagygagyggagtygygtgygtyggygygtagtttygggtygtttt

SEQ ID NO: 3670 - DNA, 309 bp, Artificial Sequence
  Description of Artificial Sequence: Synthetic polynucleotide
tttgggtygyggyggtttttatttygttatygtygtygtygtygtayggttgttygtygygaataagtatyggtattattaygygaygtagtaggtygggygyggygtgtagttyggyggatgttgttaggttaggygatttygtygtttttggagygygagygygttttagtttgtagygatgattttggaattagattttgatttgygtgggygtgaggygaagtaggttygttagttgttygygttygggygtagataggtatygttgttgtyggaagygtygttttaattttagygtttgygttt

SEQ ID NO: 3671 - DNA, 203 bp, Artificial Sequence
  Description of Artificial Sequence: Synthetic polynucleotide
tattttgttttyggtyggtgattygttgtggtttttaggttaagtgtttttygtgttygggyggttgaygttgtttgaagtttaygyggygtgtyggygaygyggygtygtggtggttaaggttgggtatttttaygtygtttggaagttttyggggttagattagtgygayggyggttggttggttgayggtagtgtgygtt

SEQ ID NO: 3672 - DNA, 388 bp, Artificial Sequence
  Description of Artificial Sequence: Synthetic polynucleotide
atygggaagtagttyggtgttttaagttttttgagatttttyggatttgygygtygttygttyggtagggggttyggtaggygygggyggygggtgggggygggaggttttgttygttyggtggttgtygyggtttttttygygttgttttttaygtttggtttattatgtaygaggtaggtaatttgttttttttttyggggatttatttyggagataagaaggtagtttgttttttgtaatggtttttgttggagtgyggyggggtttaggygygagygggggtaygggyggggagttggtagygaaggatgygttyggygtttttyggyggtygttyggagttygaggtyggygygggaggagygttgatttygygggtygagtt

SEQ ID NO: 3673 - DNA, 241 bp, Artificial Sequence
  Description of Artificial Sequence: Synthetic polynucleotide
gagggyggygygtagyggygtttygygaggtttttaygtygggygatatggggtgtttgttgtttttgttgttttgggygtttttttaggtttggggaagygttgaaggtgggtggaaygagggygtttgagtgtattygygggagggyggagagagggagttgggtagggayggggagggtaaygtttgatggggattggtgagattygggaygtattggygygatttaggtagaaaatt

SEQ ID NO: 3674 - DNA, 232 bp, Artificial Sequence
  Description of Artificial Sequence: Synthetic polynucleotide
gggttttttatttgtatttttttataaaattgtygttygtgtgtgtttttgygtttggttttttgtatttttaaggggtttttgaagatagggtygaatgygygygggggttttaggtattttgygttttayggygggtttygtagttyggttygagtyggttttggaagtttygttttggattagattggtatygaygtygtttttagtttgagygttgagagggaaaayg

SEQ ID NO: 3675 - DNA, 214 bp, Artificial Sequence
  Description of Artificial Sequence: Synthetic polynucleotide
gaattttttttagtgtygtaattaggaaagttttaaaaagtaaggattttagatagataagagatttatttttttttttagtataagaaatatttygygtygygttagtygaaygttgttygtataaggttattygttttttttggtygggaygtattyggtgttttttagttttttattagaattggtttagggggygyggaaatagagaggt

SEQ ID NO: 3676 - DNA, 250 bp, Artificial Sequence
  Description of Artificial Sequence: Synthetic polynucleotide
agtagggattagttggtygtyggtttttygggtaagatggggaatygggagatggaggagttgatttygttggtgaatygtttgtaggaygygttttyggygttgggatagagttgtttgttggagttgtygtagatygtygtggtgggyggttagagygtyggtaagagttyggtgttygagaatttygtgggtaggtaagygygtagggygyggagtaaggatgyggtagtggggygatttygttgyg

SEQ ID NO: 3677 - DNA, 201 bp, Artificial Sequence
  Description of Artificial Sequence: Synthetic polynucleotide
ttaggattttgtagattyggtygyggtygggtygagtgtttttygtyggggttttaygtttayggtttaygtttgtaatattagggttgtayggygggttygtagttgggtttgygtttgggattyggggttttttgygtttttygtgtygtattttttgttttaattttaagyggaygggttttggggttttatyggtta

SEQ ID NO: 3678 - DNA, 467 bp, Artificial Sequence
  Description of Artificial Sequence: Synthetic polynucleotide
tygtttttttttaygttttttttttygttttttttygygtttagtttygttttttttattttgtaaaataaagtyggggaaaatgtttgttygtgtagttyggagygygtagttygtttttgaataagaagtgagtataatggygtgtttgtaaaaaaaagttttaagttygttttttttaaaaaatattttgaatgttgtatgttttatgttttttagygtttygygggagagattyggttatagagtaggaggtgagatttttttttyggtatttttatttttttggtygtaygtttttttgttttagttttttttgggaggattgtaaatgtttttttttagtaagyggtygttttttattttygtttygygtttaaagtgttgggttataatttggatttggaggtaaatttttgttagattttttttaygtygttttttttttttttttygtyggtgttygg

SEQ ID NO: 3679 - DNA, 201 bp, Artificial Sequence
  Description of Artificial Sequence: Synthetic polynucleotide
ttygaggggtttatagtttggtattaatttgtaggtgttygttgttgatttggtttttttttygatttgyggayggttttttttagygattttygatataygtttttttgttttygtyggagggtygggtttggggtygtyggagtttgygggaatttagygtttattygttgattttygagtygtttygttagttgtgyg

SEQ ID NO: 3680 - DNA, 232 bp, Artificial Sequence
  Description of Artificial Sequence: Synthetic polynucleotide
ttggggtgtttttaggaagtgaaggaaaaggttttygaygatattgttattggaaaagtgttggttayggttttygttttattttttttatttaygggttyggagtttttaggagtagttagatygattatygtttttgtagttttatttgttttyggagagatatttataagttagtttayggagagtttggattygttygttttagtatttaygtttttttygygttygg

SEQ ID NO: 3681 - DNA, 222 bp, Artificial Sequence
  Description of Artificial Sequence: Synthetic polynucleotide
ggttagggatagtaaaggagataygggtgggtgagaygtyggattttaygagggtttgttgtttttttggygygggygtggaggtattggttagagggtaygtttattagttygagattttygggatgaggttattttttgagtttatatttggatatttattttttygaatgyggtgattttatttatattatagyggttattagygggtttgagatygtg

SEQ ID NO: 3682 - DNA, 239 bp, Artificial Sequence
  Description of Artificial Sequence: Synthetic polynucleotide
ggtttttaggyggagygygggygygaggtgygggtttyggggyggagygtaygttygggaggygggaagtgggtagtagygttttygtttggtttttgtgygtttygattygaygttttttygttygattaggtgtttygagagygtatagttgggagggttttttyggtygyggygagatttaygtttgyggtgtgttagggyggyggygayggtgaygggygtggggygyggygttg

SEQ ID NO: 3683 - DNA, 209 bp, Artificial Sequence
  Description of Artificial Sequence: Synthetic polynucleotide
ygtttygggggtttttgtattttagtyggggaatgttgttattttgaggggggttgtttggttgyggggygtyggggttgggggtattgtttttttaggaygyggtttygtagtgtagagygtygtygtttgygtggggggatttggtagttttaggggttgttttgagttttttggygagtaggagtgagttgttgyggygagtgagt

SEQ ID NO: 3684 - DNA, 380 bp, Artificial Sequence
  Description of Artificial Sequence: Synthetic polynucleotide
gaggtygggtttyggygattttygagggaggttygggaattattttygatttaggygttagattyggagtygtayggggtttttagtttagtttygygagyggttgttgatygtttttttygygttygttagggtttttgtttygygttagttatygygygttttttttttgtttatgtygtagttttygtggtttttgttttggattygggatgttaggttgagataygttttgtaaatttttggtagaaatgggygtaagggggtggatttygttttygtttttygggtttttttttttttttygtttatatgtttttttattattttttttttttttttttattgtattttgatgaaatggttttgtttgtttaaat

SEQ ID NO: 3685 - DNA, 394 bp, Artificial Sequence
  Description of Artificial Sequence: Synthetic polynucleotide
ygggtyggtagggattaagagtttgaaagggaatttgttttttttttttygtagttyggttattaaggtaagaaattgtaggtagagaagttttygaattygatttaggaygtyggygtttgttaggattttttygtttgtttttygygtttygygygygtttatgttattattayggggagggtgtatgyggtaggtgtttggtygaggttttygggagygagtygtttttaygtgttttagtttgtttttttttygaagttagaygttggygttgtagttttgttgtttgaygttgttgtagaagttygygtttattygggttaggtttggggagggttttttggggyggtttttgagttttatttgttygaagtttttatggggggaggtc

SEQ ID NO: 3686 - DNA, 201 bp, Artificial Sequence
  Description of Artificial Sequence: Synthetic polynucleotide
tttygttygggttttttaaatatgtygtagygtggttgtttattgttttttttgggtaagaggaggttttagatatttttaygggatttgaattttygagygttttgtayggagtagttatttygttagtattttaaagtgaagttgtttataayggataagttyggagattttatgagaggtyggggtggagaagtyggg

SEQ ID NO: 3687 - DNA, 557 bp, Artificial Sequence
  Description of Artificial Sequence: Synthetic polynucleotide
gtygttatygtttagtttygttgtttaggtgggaggggttatttgtygyggggtttttaagttagtgtygtttgttttyggtttttatttattgatagtayggygttygagtgattttgtttagtttygttttgygtttttgtaaattaygttgttgygttaattataaatttggttaatatgtttttgtaattttattatttaaaaaygtttttaggtatttggtygttgttagattaggttygygggttyggaggaggtttttttatttgttttygttagtttyggggatygtgygyggttttygtgtggttttygtttaygaggtttttygggtaggaatygtygygygatttttgtttagyggtygygttttggttaygggygatttttgtygggaattttgttttyggttaagttgygttttygtatttyggtggtttttattygagttygygtttgttggttttttttttggtttttttgtttgatttygattttgttttygaattttatttttagatttttttygttttggaaygtygatttttttttyg

SEQ ID NO: 3688 - DNA, 212 bp, Artificial Sequence
  Description of Artificial Sequence: Synthetic polynucleotide
agttgggtttttttttattttaaaatttttatttttagtttttaaaagttattttagttygttatattgaaattggtayggtttttaaagatttttttttygtagttgtggygtttttaagaaaataygagtayggattaggttttggatgagtgttyggttatygagaattagttattttttattttttaggattttttagttttttttag

SEQ ID NO: 3689 - DNA, 201 bp, Artificial Sequence
  Description of Artificial Sequence: Synthetic polynucleotide
tttttaatggtttagtygatygtgtgtataaatttgygttttattygtyggggatygttgggagyggagataaatttaatttttagggtaattttggtttygttygttttattttattttgtgtttaaatagagttttttttgaagttgygaatatttttaggttttttgggtagggttggaggggtygaggagagttatt

SEQ ID NO: 3690 - DNA, 201 bp, Artificial Sequence
  Description of Artificial Sequence: Synthetic polynucleotide
ttttggataataatgygygttttygtttttttagaaagttagggaygtttttagtygtygttagagttggttyggttttttagttttttttygtggtattygtaggygagataaagttygttttyggtgaggttgygygygtttaaagygtgygggatgtttagtayggaggtttttaagygggggatttttggttttttt

SEQ ID NO: 3691 - DNA, 294 bp, Artificial Sequence
  Description of Artificial Sequence: Synthetic polynucleotide
ggtagatgaygattygtygagttygtygtttgttttttyggaggygttyggagttgttgygggtttyggtygtygttgttattgttgttgtygtygtygtygtgyggggttatttgaaggttggggygyggaagtttaatttygtgttgattgggttttaagttttttgygttttygtttygtttygagtgttygygaatttttyggaygtttaygtagattatttagttatattataattttgtttgyggagagaggagaggagaaaaaggggtygttttaaaaatttttaaa

SEQ ID NO: 3692 - DNA, 244 bp, Artificial Sequence
  Description of Artificial Sequence: Synthetic polynucleotide
tagttttgagtyggttgtyggttaggtgttgggtatattygygtygtygtygtygttygtttttggtygygttagtygtagggttttyggygttygggggyggtagtaggttggagygtatygtgygygttttgttttttyggygttttygtygtttyggaggttygggtttttyggttttygtyggttttygttttatggtygygtgtygtygygttyggttttttygtygtttaygttygtt

SEQ ID NO: 3693 - DNA, 303 bp, Artificial Sequence
  Description of Artificial Sequence: Synthetic polynucleotide
ggtttggggttatgggaataggattaaggttttttgagygtygggtttggtttttgtggtttygtaaattttttagtttgtgtgttayggygaygygtagyggttgagtyggagtttaygyggygygygtttttygygaggaatttttyggtttgtaggttgtttgttattttygtttttygaygygtttttttttggttygygttttyggagttttttttttttttggygaggatttttttyggygttygyggtttygattttygtygygttgygttygttttttyggtttyggttgtttyg

SEQ ID NO: 3694 - DNA, 286 bp, Artificial Sequence
  Description of Artificial Sequence: Synthetic polynucleotide
aatagattttygagttgaaaaaataaaaataaattggggagttagagtttttgaaagtttyggtaggaaatttaatgggttttttgtttttttaaattttygttttygttttygttgatattttgtaaagtygyggyggtagyggyggggattaygttgyggtgtattatttttygttattttttygygttgggttggggtygagggggtttygtagagtyggtaatygaatyggttttggtttgttttttttattttttagttattattagaattagttttygyg

SEQ ID NO: 3695 - DNA, 261 bp, Artificial Sequence
  Description of Artificial Sequence: Synthetic polynucleotide
tggttgtggaattagatttgttttgaatttagtggagygtatygttggggttyggaagttatygttygygggtatygggttggygttgttygagtggaatygatagtttgygagtttyggttgtaagtggtttttttttttygyggttgttgtttagtgtygggtgagggttgygagtgtggtaagttgtaaagagagttttagaggttygaagagygttgygtttttattygygttygttttttttttttttyggttttt

SEQ ID NO: 3696 - DNA, 201 bp, Artificial Sequence
  Description of Artificial Sequence: Synthetic polynucleotide
gaaygygtagagagttttttggagtgttttgattttgttttygagagggtttttaattttygtatttttttagtggttgttttggtaggtgygygttttgyggggagttgygtttygggggttatygtygagygggagttgttttttggaattttgtttatygygaattgggtgtttattttttatttttgttttttagtg

SEQ ID NO: 3697 - DNA, 201 bp, Artificial Sequence
  Description of Artificial Sequence: Synthetic polynucleotide
tygygttttagtatygagtgttttaagttttgygygtagygtygggtttggaaggyggygaatggttgtttagtygtygtttttattagtgatattyggtygttagttttygtttaggatgtgtatatttgttggtagtattggttygggtggtagttatygggttatttattttataggtataatygtatttaatttaat

SEQ ID NO: 3698 - DNA, 201 bp, Artificial Sequence
  Description of Artificial Sequence: Synthetic polynucleotide
gygtttygggaagtgtatggttttaaggtttaaggygttaggatttaggtttttagagtttttaattagtgttattttttttygtagygygggtgttagtygygagttygtagtttttygatattygtttttttttggggttttyggggatttttttagaggttgtaaaggtgttagaagtttaaggtaggaggtagtttg

SEQ ID NO: 3699 - DNA, 201 bp, Artificial Sequence
  Description of Artificial Sequence: Synthetic polynucleotide
tyggygtygtygttgtygttygggtttygygattygggtygggttgtgggygygyggtaggygggttgyggyggyggygggayggggyggtygygggttgygtggggtttgtgygygygtgtgygygggygtyggttgtgygygtygygggyggatagggttyggtyggyggyggtaaagttgggattygygggtygggyg

SEQ ID NO: 3700 - DNA, 201 bp, Artificial Sequence
  Description of Artificial Sequence: Synthetic polynucleotide
tgtttyggttgatttygttttgtagttagtttgaggttaggyggtygttttttgtaggttataaattttyggygtaaaagtagggttttgaaygygatatygtattagagygtttagttaagygagttgtttttatttttattgtgtygggyggygtaaattgygggygtaggtagaggagtygyggttttgygtygggyg

SEQ ID NO: 3701 - DNA, 201 bp, Artificial Sequence
  Description of Artificial Sequence: Synthetic polynucleotide
ttgyggaggggtyggtgggttagagttaggttaggtagttgttgagtttttttttttttttttggygggagtgtgtgtgtaaggggttagggggyggagtyggagaaagggttgggggtgttygtgtttagygttttttyggaygyggttttataatttagttgygagaatagatggaygtagyggyggtttatttygggg

SEQ ID NO: 3702 - DNA, 201 bp, Artificial Sequence
  Description of Artificial Sequence: Synthetic polynucleotide
ygyggtttttygtgggttggtygggttaatgagygygyggttgtaggggyggygggyggggagggggygtygagttttgyggatggaggygygggtagygyggygygtttatttygygygggygttgttggyggggggyggygtagttattggattyggatyggggtygygattyggggtggygggtggygtgggyggygt

SEQ ID NO: 3703 - DNA, 201 bp, Artificial Sequence
  Description of Artificial Sequence: Synthetic polynucleotide
ttygtygatttttagaggtatyggttgygttttttggtggtttggaayggygyggagggtaagtttgttgtgatttgttaygatygtatygygtagtagtygtagyggygygagggggttyggttggggttggagtataagttygaggtygtygtgttttygtttagttgggtyggtyggttttyggtygyggggtttygc

SEQ ID NO: 3704 - DNA, 344 bp, Artificial Sequence
  Description of Artificial Sequence: Synthetic polynucleotide
gtyggttagagggtttaygtaagtttygaaattyggggggaygttttttttatttttatttttgygttygttyggggttgggygygtyggggygtaygtaygtyggtttgttggygatttggygtatttgttygygygttttggttttagttgtygtaggttttttttgtatttatttttagtttttaaagttagtgtagttagtatygtttatttggagttttaatttttttttgygattttygtatatttattgtattttatttattattttygggtygygtaggttygggtttgygaagataygyggtttattttyggttatttygtttatttggttaaag

SEQ ID NO: 3705 - DNA, 201 bp, Artificial Sequence
  Description of Artificial Sequence: Synthetic polynucleotide
attttttttygyggygttttttygygtagtttttagattgtttagtyggtgttygygggygttygttttttgygagttttaggttygygygagttgtttgygggaggggtyggggatayggatagaygttgttttattagggattyggaggatttggtgggtaagagtatgatttagygattttygtttygggtaagygtt

SEQ ID NO: 3706 - DNA, 218 bp, Artificial Sequence
  Description of Artificial Sequence: Synthetic polynucleotide
attatttttttttttgtttaaaggattttttttttttttttgattttaygaatttatttttttaataggtttttaaagtatgggyggatgtgttttttttygtttatygttaggagtygagtttyggtaggtgagyggtgtaaaataygtatttagttgtttttagtttttttygttttygttgagttggttgtttttatttygtattayggtattyg

SEQ ID NO: 3707 - DNA, 234 bp, Artificial Sequence
  Description of Artificial Sequence: Synthetic polynucleotide
gygygtttygtgygttttygtttttygygygttttyggtttattttygtttttggagagttgtygtttgygttygggygygyggttggttgttttttyggyggyggyggyggyggttttattagyggagttttygtttatgattggtttygttygggaagttggagaygggygatgaataattgatgtgtgyggtgyggtagtyggayggyggyggyggtggygggtagtagyg

SEQ ID NO: 3708 - DNA, 201 bp, Artificial Sequence
  Description of Artificial Sequence: Synthetic polynucleotide
ygggggtattygggtaggggtgttagatatagtattgtatttggtaatttttyggggygtttagtgtggtttttttattygggagtttggaagggtttttygtagttygtaggagaygtagygtttttygtttagggggagtaggaggatagttggtygttttygggagttttaggygygaagyggttttttttygtttta

SEQ ID NO: 3709 - DNA, 201 bp, Artificial Sequence
  Description of Artificial Sequence: Synthetic polynucleotide
agttatagtagtygtatttttygtagygygtyggygtttagtgtagygtttttagtagtagygttagygyggtygttygtaygttttttttygtygtygtygttygtatggttgygttttttttaggtgygygtygygtagtttttygaygttyggtgttyggyggtttaggtgtttyggygtgygttttyggttttgatt

SEQ ID NO: 3710 - DNA, 235 bp, Artificial Sequence
  Description of Artificial Sequence: Synthetic polynucleotide
tttygyggtttgggggaygggagaatggggggtttayggtygttttgggtttttatygygtatygygttygtagyggagtttyggagttatggttttgagygagttggygttggttygttggttgtaggagagtygtygttygyggaagtttattttgtttatygtgtttttggygttgttgttggataatatgttgtttattgtygtgggtaygtgyggatagggtatttttgt

SEQ ID NO: 3711 - DNA, 201 bp, Artificial Sequence
  Description of Artificial Sequence: Synthetic polynucleotide
attygtttattttttatttttggtttatttatygttatygatatttgggttatygtttttaaggtaygtgttaygtygyggaattgtagygygtygttttygtygtattttttattgttttyggtttgtttygggtgggygtttggtaaggtttgggyggaggttttttyggttygygggttagygygttttgttgggaaa

SEQ ID NO: 3712 - DNA, 241 bp, Artificial Sequence
  Description of Artificial Sequence: Synthetic polynucleotide
gttaataaygggygggtttttatagttygaagttaaagygttaaaattygagggaaggygaggagggggyggtggyggaggyggttgyggggtyggggttyggttgagttttygtttgtttaattttatttgttattgtaygygtttaatygtygtatatttttygtatttaatttggatgatattttgattttattattagtattyggygtyggattgaygtagtttygagtyggggatt

SEQ ID NO: 3713 - DNA, 201 bp, Artificial Sequence
  Description of Artificial Sequence: Synthetic polynucleotide
ggggtatttgtatyggggttgggygggygtatttagagttaggygggtaggaatttttgygtagttattyggtgtttgtatgtttttggygyggaagggaygttttattagtttyggygttttttttttttagatttttttttygtttttttttattgtttgtttgttgtattattttttatttagattatttagatygtt

SEQ ID NO: 3714 - DNA, 201 bp, Artificial Sequence
  Description of Artificial Sequence: Synthetic polynucleotide
ggtyggygygygtgggtttyggygaggyggygttgtaggagttttgygggtagttggagygttatttgggygyggyggtttayggttgtggyggygttatygtgygygaygtttttttygyggttaagggtygygyggtygattgygagagttygygygagtttygggagygggttttgygygtttgatgggtygaggygg

SEQ ID NO: 3715 - DNA, 217 bp, Artificial Sequence
  Description of Artificial Sequence: Synthetic polynucleotide
tyggyggygagygttgtattattttaygygggygtygagtyggggtygggygtygygatyggagggattttttgtttyggygagttagtttyggagttttygygtagygttygygtygtygttgagtttttttagttttttatttttaaaaaagttttttttygtgtgtgtgygtgygtgygygygygygygtygttttggtataagttagttttga

SEQ ID NO: 3716 - DNA, 201 bp, Artificial Sequence
  Description of Artificial Sequence: Synthetic polynucleotide
tagggtttygatttttygtggggtaygygygatttyggygtagatgttagttygttgtttttygggttgagggagygaggattttagaygattttagggtygttgtttaggtttagtttygygttttttatttygttatttygttttgyggttttagtttggagatttayggattttattgygattttttgygtagtgtag

SEQ ID NO: 3717 - DNA, 201 bp, Artificial Sequence
  Description of Artificial Sequence: Synthetic polynucleotide
taaatgggttaaataggttygtaaggttttygygggttttttggttyggaagttgagtygygggtgtttggtttgaagtttygygttttatagtggttygygggtttyggyggtttttgttttaygttttttaaggtattaggtaggtggttttagggtttttgtttaygatattttttgggtggggtaggattatttttt

SEQ ID NO: 3718 - DNA, 201 bp, Artificial Sequence
  Description of Artificial Sequence: Synthetic polynucleotide
tgtagttygttyggyggygttttygggygagggtttggtgttggggagygagygyggagygaggtgtttttttaaataygttttgtagtgtgayggyggtygttyggttggaagagttatttttattttgyggtaggagttygttygtygttatygttygtttyggtttttatggttaygygtttgttttyggtttygggt

SEQ ID NO: 3719 - DNA, 317 bp, Artificial Sequence
  Description of Artificial Sequence: Synthetic polynucleotide
ygygttttgttattaggygttgtagttgttggtygagttttgtgttygtggggttttggagtaygatagttgttaggattttatttattatttgygggatygtgttagatttyggtttygygatttaggtgagtgtygttatygtygtttggagggatttaagggttttgggttgggatttggggtygtatyggggtttgaggtagaatagygaygyggattgggagagggyggggggyggttatygagttaggagagtgattaagaattagygtattgtggtttgatgttgtaattaggyggggattygggyggtg

SEQ ID NO: 3720 - DNA, 221 bp, Artificial Sequence
  Description of Artificial Sequence: Synthetic polynucleotide
tttgtattgtggagtaygttatgattgtttayggtggtygtaggtgtagaygttagtyggaatyggaatyggaatyggagtaygggttgtygttttygatygaatygygggyggygyggayggygtygygygagggataaggtgygygaggygtaygtatttttatttttattgtygggagttgatttgtttttttygygtggttattygtygttgtaaat

SEQ ID NO: 3721 - DNA, 201 bp, Artificial Sequence
  Description of Artificial Sequence: Synthetic polynucleotide
tygagagttttgyggygttygtttttttgttggyggaygtgttttttgagtygttttygygtaggtaagaggttgtygtttttagygagggagagagtagyggygattttatttagttatyggaygtygtttygtagtgttttgygggtgygaattttaattygatatattaggtgttttgaggggatggtggtygtttat

SEQ ID NO: 3722 - DNA, 201 bp, Artificial Sequence
  Description of Artificial Sequence: Synthetic polynucleotide
gtaggggagagygagtatgtttttgtttygggygtygtgyggtygtagtagtagygyggttttttttagtgygagtygtgtttggaatgtttygggtaagygaagggttagtaagygaggygaaayggatattataaagtagagagtggtgtgagttttttygttttttgaaaagatggtaagttttygtttygggaaggt

SEQ ID NO: 3723 - DNA, 201 bp, Artificial Sequence
  Description of Artificial Sequence: Synthetic polynucleotide
gagttttaygtygtygtygtygygttagyggtggggggygggttgggggyggggyggtyggggttgttttttygggygtatatgygagygtagtattyggygttgtygagttatttttttygtygttygttagtaagtttggyggttttaagttaggygygttttaggatttaggtttatttgtttttatttagtttyggt

SEQ ID NO: 3724 - DNA, 201 bp, Artificial Sequence
  Description of Artificial Sequence: Synthetic polynucleotide
gggtatagttayggtaatttttagtttgttaatgttaaggygggygygtaaggtygtttaaatttagatttttttttttatttattttaaaaaataataaygtgttagttattttygtagatatygtyggttggtgtttgtttaggagaygttagggttagagygttatttttagtatygaaatggtagagagaaagygta

SEQ ID NO: 3725 - DNA, 230 bp, Artificial Sequence
  Description of Artificial Sequence: Synthetic polynucleotide
tyggtgttttttttyggtygttttatttagtaatttttygtgttttgtttttygattggaaatgttttayggaagygttttggatagggttttygttaggygataagagttyggtgttgagatgtgttaygtttttatttttttattaattatggatggaaataaataaggaagagttaattttgttgagtttttttttyggtaaygagaggygttttgtagtygggagg

SEQ ID NO: 3726 - DNA, 201 bp, Artificial Sequence
  Description of Artificial Sequence: Synthetic polynucleotide
gttttttygagttggtygtttttgtagatttttaygtttagttgttatagygtygtttygattttttygttaagtatattttgtattgtaaggttaagtayggtygtyggtttgggatttagtgttatygggaggaaaagagagagatttggggttggggtatggatgatggggggaagggyggtygtttttgttattgtt

SEQ ID NO: 3727 - DNA, 201 bp, Artificial Sequence
  Description of Artificial Sequence: Synthetic polynucleotide
tygtagaygtyggaggygttatggtygttaagttyggygagttgatgggtatttgttttagttattaggyggtgatgtygtatttygtgtgtttggtygaygagttttygtagttygtgyggttygttaagttgtttaagggtyggggtyggttgyggyggtygygttagtttygttttaagaygtagtyggtgattttyg

SEQ ID NO: 3728 - DNA, 201 bp, Artificial Sequence
  Description of Artificial Sequence: Synthetic polynucleotide
gtagttttaggaagtygtagtygtygtygtygtttaggtagagtagtagygygygygtggygttggtgygtaggttgaagttgagttygtygttgttygtygygttygtttagygygygtagygagtttattgttyggggtygtygtygaattttaggtygttygygygygtygttagygttagtagtagtagtaatagta

SEQ ID NO: 3729 - DNA, 201 bp, Artificial Sequence
  Description of Artificial Sequence: Synthetic polynucleotide
aagtttttattttttggattygggtttggygttttygttttyggygygtttttattyggyggaygyggtygygtataaggtttagtayggttygygttttygtagttyggtygyggttgaatatttttagygygaagygggtgggygttagtagtttyggggayggyggtttttaggtttgaaagttggyggttyggggtt

SEQ ID NO: 3730 - DNA, 201 bp, Artificial Sequence
  Description of Artificial Sequence: Synthetic polynucleotide
ggttttttagtttgggttaggtyggggygygtgtttygggttttttgtggttgtatygygygttttgtgtttaygggygaaggygttggaattyggygttyggagttygagtttttgaaggygggaggyggygttygattttaggggttgygttgggttgtyggagttaagagtgtttgygtttttagtttygygttagaa

SEQ ID NO: 3731 - DNA, 201 bp, Artificial Sequence
  Description of Artificial Sequence: Synthetic polynucleotide
ttagagtgtgattgagygggttggttyggyggtygttgtttttygttttygttttttygygtttggtygygttatttattgtygygggtgttygygtgygygtygtygatgyggtygtyggggagygtttggaggtggaagtygatgtttaygttgtagtagagtygtygtagtygtttgatgtttagtaggtagtygtyg

SEQ ID NO: 3732 - DNA, 201 bp, Artificial Sequence
  Description of Artificial Sequence: Synthetic polynucleotide
tatttagaaaatggaaagttgagtggtygatgaatyggaattgggagtagttttttatgaattagagaaaatgtaagttaaaaggagatattattttttaygtattagattggtaaatattaggaaatattaagttttgttgaggaggaggggtttagggagtttttatattatgtgggtgggattgtaatttggtataat

SEQ ID NO: 3733 - DNA, 201 bp, Artificial Sequence
  Description of Artificial Sequence: Synthetic polynucleotide
ttttygggayggaygttttaggygyggygtygagtggaggygagggggttgyggagggggaaggggttaygygggttayggggtttaatttttgatttttygygaygttaagaatgtaggagggtagagttgagggagattttaggtggaatttttaggtggggaaggttgagttgtyggggttgygggtatygggaaggt

SEQ ID NO: 3734 - DNA, 201 bp, Artificial Sequence
  Description of Artificial Sequence: Synthetic polynucleotide
tygtygtygtttgttygggayggtttygtgaagaaggayggaggtagattgygtgttygtagygggatttttttggtttttgggatygtygtggttttygyggggtttgttaygttttttttygygtttttagtgttygtattttttagttyggtygtyggygtagttattttatttttygtyggttyggtattttygggg

SEQ ID NO: 3735 - DNA, 268 bp, Artificial Sequence
  Description of Artificial Sequence: Synthetic polynucleotide
gyggttagatttyggttttgtaagttggyggtygyggyggtttgygaygtttttygtyggggggtagttttgtygtgggtyggggtygygattgtyggggygttaggggyggttagyggtygtttggttggygtgtyggyggygttyggggagggygggtyggggggygyggygtttatgaggtygttgtagygtttgatttgtttttgtaggtatttgyggtggtttatttttygtttygatttgttyggtttgtttagygttagtt

SEQ ID NO: 3736 - DNA, 614 bp, Artificial Sequence
  Description of Artificial Sequence: Synthetic polynucleotide
agagttattttgttygttgttttggattttgaaatttgggagatttatattaaaggagggaatyggtttttttattttttaagygygtygtgttttttatygtttttttttttggttygattggttttggttttttttaygtttttagtttttaaattggygttygttttatggttygtgtaggaygttaaaagtayggtaaattttagggygatttttagtagaygttttygaygtatgatgtygagtygttatyggttttygtygttttttgtygygttyggggttyggtttgyggtygtygttgygttttgaagygtatygygtygtyggggtttygttatttygtygttygtttttygggtygggtttttttygttttttttaggygttgtttttattttaggyggtttttgttagttgtaatatagagataaattttygaggyggggagatttttagggtatygggatgttgaagtttygyggtttttatttttaagtttaattygtgygtygtttgygygtggygtagttaatttgggtaagggaagatygtttggtttatagttggttggaaagtttaggttttyggyggtagtagtttyggtygat

SEQ ID NO: 3737 - DNA, 201 bp, Artificial Sequence
  Description of Artificial Sequence: Synthetic polynucleotide
gggtattagtttygagtttaggttttattttygggyggttygggaygaattttttttataggttagtgtgtgtgtagggtaagtgtagggggttgaggggygttggyggggaggtagtagaggtggtttggattattttggygyggygygyggtgagygygaggatttygttagtgggagtygttgagttaaagtgtattt

SEQ ID NO: 3738 - DNA, 201 bp, Artificial Sequence
  Description of Artificial Sequence: Synthetic polynucleotide
ttygyggygayggtgaygygttttggttttgataagtttggttttttttattttatygggtggygtygttgttgattttaygtttagtygtttttattttygtttgaaattttttygatagggtttygtttygggggtttagtttttagygygtatatattygygtggtgtyggtttagttttttgtaaaggaagtagggt

SEQ ID NO: 3739 - DNA, 201 bp, Artificial Sequence
  Description of Artificial Sequence: Synthetic polynucleotide
ttgtagttagtyggyggtttaggtaagagataaggtgtgagtaaaggtttttgatggtygggtggtttgayggttaggtgygagtggggaggatagtttaygyggtttgagtagttatttttggttatagttttagttttygtttttgttttyggtttttgttttggtttgtttgygygttatttygttatttygtagtgt

SEQ ID NO: 3740 - DNA, 201 bp, Artificial Sequence
  Description of Artificial Sequence: Synthetic polynucleotide
ygttyggtygtygtttttagttaattygggttttttttayggygattaattagtgygaagttggttgggygggaagtygygagaggtttttattgyggygygggtggyggttaggagttgttaggatagtttttyggtgttttagtttaayggtttygtttatttatygttaagagaaatttygttttgyggtyggttttt

SEQ ID NO: 3741 - DNA, 201 bp, Artificial Sequence
  Description of Artificial Sequence: Synthetic polynucleotide
ygggtattgygaattgtygggygatgttgtygttgtygtygtgatayggagagtaatagttttttagtaatattttttttygatataggtatatatttttygataggtaygtatatttattttatagtgttyggttyggttgyggtgagtgaggggtygggaagaggygtatygtttagygagygtygygygtyggggttt

SEQ ID NO: 3742 - DNA, 261 bp, Artificial Sequence
  Description of Artificial Sequence: Synthetic polynucleotide
ggatyggyggtgatatyggagttygtygtgygttttyggtygttttyggtgggtgtyggtttttgtatttgatgygttygggatgttttttttattttggygygttygtygttagttygtatagygtttygtatattttygtaygygtttgaaatgygtayggtttygtyggttygyggaattattyggaygtayggagygtttygtatygattygttygtygttttttygagaygttygtatygtgtttgggtygggygc

SEQ ID NO: 3743 - DNA, 201 bp, Artificial Sequence
  Description of Artificial Sequence: Synthetic polynucleotide
yggttagggtaatagttagggtaaagggagagagaagtygtttyggggygagaaggagaaaagttagagggttgaataggtgaygttgagtttgttggagygtgtgtgttttattaygtaagggygyggagttyggtygttttatttttygttatttgygygttygggggtaygttttttgygatagtttggaatttagat

SEQ ID NO: 3744 - DNA, 201 bp, Artificial Sequence
  Description of Artificial Sequence: Synthetic polynucleotide
gggtatyggtgtygaygtygygagggtagygttygyggygggaatattaatgtattttaaagggtayggtygtygtygtagtaggtaattagttggatygyggyggagygygyggaggtggttgttggttgtaaggattgygtttagttttygtttygtttttygaggttttygygtgggtyggygggtagtgygtgggtt

SEQ ID NO: 3745 - DNA, 201 bp, Artificial Sequence
  Description of Artificial Sequence: Synthetic polynucleotide
ttttttgtttyggtttygtgttttygttggggattgtttgyggtgagtttgtygtaygtaygttagggtygaggtagtgatgyggggtagygtgggaggaygggttgyggagttygygttattttgtttgtggggagygttgtgtttgtttttttgttagygygtttagttgtttyggtygtygttaygygggattgtttg

SEQ ID NO: 3746 - DNA, 201 bp, Artificial Sequence
  Description of Artificial Sequence: Synthetic polynucleotide
ggaaaatagggtattyggagtgtaggagattttttagggtygttttttttttygggggtgttttgaggaatygyggyggggattygtygttggtagtttgygggttttggtgttagygygtatgggygggttgtgyggaygtggttggttttttaaaggttttagatttygttygggtygtttagttttttaaagttgtgt

SEQ ID NO: 3747 - DNA, 219 bp, Artificial Sequence
  Description of Artificial Sequence: Synthetic polynucleotide
tttygggttaggaagttgttaggtaggggagggttagygttagttgtggaygtttygggatagttttttattttagtttttgtttttgttttyggygyggygtaaaygtaaaagttttygtggtygtagttttagtttyggtggtygttygattttygtygggatttyggttgtatttattggagaagyggyggtttygattttygaggaggyggyggc

SEQ ID NO: 3748 - DNA, 268 bp, Artificial Sequence
  Description of Artificial Sequence: Synthetic polynucleotide
tttattattgtttttttttttygttttttatttttttgtagygttaagtyggttttttaatttggtttgttgaaygtaaatygttgagagtttgttgtatygttttttggggtttttggttgtygagtttygttaaggtaaagaygttagtaagygaggaagygtagyggaagaaaaataagygggygygygaggggagttttaggagggttgtygagtggttggtaggyggttttygtttttttygggtggtttygtyggyggttga

SEQ ID NO: 3749 - DNA, 201 bp, Artificial Sequence
  Description of Artificial Sequence: Synthetic polynucleotide
tttttyggttttaggattggggagtgtgtygyggggtygagggtggggaatagttagagggagaygygaattaggtygttggyggagggtttagggggagygtagaggygayggtttttatgtyggyggttaatatgatggagaatyggtygttgttygttttgtaggtgttygagtygtagggtgygttygagggtagtt

SEQ ID NO: 3750 - DNA, 517 bp, Artificial Sequence
  Description of Artificial Sequence: Synthetic polynucleotide
tagagygygggttttygggttttatttygggaaaagtttgggtttgttttgygttgttgygtgttgygtttttgggatttgttgattgttttagagggaaygtttygyggtagtgttagttttttggggattaggaagggygatttttgtttgggagttagtgtttgggtygtygggttygggtaagygttgggggtttggttygagaagatgyggataggtggtttagggygtygyggattttygttttttgygggtatygggagtttagggtygaggygygtygtttygaggggtttttttttttaataatgygttyggaatggagttygygttttgatagygygggttagttygaaatygtttagaattygtttygatgagtgggtgagtygttttgggagtttgtygygtttyggtagyggagggtttgagtggaaaaatttttattggatgtattttttaatggttggtttgtttyggttttygttygagtttttttyggtagtaggygttg

SEQ ID NO: 3751 - DNA, 226 bp, Artificial Sequence
  Description of Artificial Sequence: Synthetic polynucleotide
ygygtttttttagtygyggttttttttttygtygtttttttttgtttttttagtttttttttttaygtgtggatgaygttaaaatttygygaaaaagtygygtggtggtttttygagyggaggygygatttygtygtttagyggttttttttygggggygtttggagggggagaagggyggaggyggtyggtttttttttttttygggaggtaggatttttygayg

SEQ ID NO: 3752 - DNA, 201 bp, Artificial Sequence
  Description of Artificial Sequence: Synthetic polynucleotide
ttttygggaggygagtygygggttgttgggygyggaggttggagtygygagaggttyggttgttgaagyggttattgttttttagagttaggtttygygtygygygttttygtygtygtyggtattgtgtatttatttatttttyggagattggggtaggggaaaaaagttttgaggygtttttatttttgttttyggggt

SEQ ID NO: 3753 - DNA, 212 bp, Artificial Sequence
  Description of Artificial Sequence: Synthetic polynucleotide
tttygggygtttggtatttttttttatyggggtttyggyggygygyggygtttgttyggaggggggttygggtatggtgttgyggtagttggattygtygygagtttttygygtttygtygtygtttgygtygyggagttggtttagttgtaaataaatagtagttttttygtttttttyggttatygttatttttttygttttattgygta

SEQ ID NO: 3754 - DNA, 388 bp, Artificial Sequence
  Description of Artificial Sequence: Synthetic polynucleotide
ttttttyggttatttgtgttgttttygttttggttgtttttgtttygagggaagatgttygagtattttttttattttatttggtyggygaagtatagttyggtgaygatgtgtagagttttttggtatagattgtttatttygttttttttgtggaaatttatygtttggtttttttttygtttttttttttttttttagttagtygttttttttttttttygtatttttaatttttttggygttttaagttatagttygttygyggtgattttggttggagattgygtygttgagagtyggtaatttttaggagttttaygttggttttatggygggagyggagggygtaggggaaggagaggygygygaggaggttgyggttgtc

SEQ ID NO: 3755 - DNA, 201 bp, Artificial Sequence
  Description of Artificial Sequence: Synthetic polynucleotide
tttttggatgttaaattyggtttagggagtttaggagtygttgtagttttagtttttttttttttttttttygatgattygggtaatgttaattttttttygggattgaaagttttaaatttaaggtgttaagttgatgggyggtttttgtttttatttttygatttygggygygtgttttgaaagataggagagaaaaaa

SEQ ID NO: 3756 - DNA, 201 bp, Artificial Sequence
  Description of Artificial Sequence: Synthetic polynucleotide
tygtggtattttygttagagtttaagtagttttttaggygtggggtttggtggaygttggtttggagygttyggagggyggggtgggggtgggggggaygygttgtygtttggggtgttttygygtatttttgttgggygaattttggtttttyggtgttggttgttatttgagtaattgatgggtttttaggggaagtaa

SEQ ID NO: 3757 - DNA, 212 bp, Artificial Sequence
  Description of Artificial Sequence: Synthetic polynucleotide
ttygtygttttttttttatttygttttttatygtygtttttagttttttttygggatgagagagagtygygttgyggagtaattttagtggatgggttygygggggttgagygggyggaggaygygggaatttygtgatatygattagttgaygttgttygygtgaaattagagtygggtattagggttttatttttattgtttttgtattt

SEQ ID NO: 3758 - DNA, 250 bp, Artificial Sequence
  Description of Artificial Sequence: Synthetic polynucleotide
taggagggtgggtgttagtttttttttttatttttygagtttttttttyggygtttaygtgggyggagtagygygagggtgtgygtggtaggggtygyggyggygtgtgtygtgygtggggtggggtgygggttgggyggtttygttttygggtttygygtygtyggggygyggtttttagttttattttttttgttatttgggyggagatttgggggattgtgatttattttgyggaagatayggaggg

SEQ ID NO: 3759 - DNA, 488 bp, Artificial Sequence
  Description of Artificial Sequence: Synthetic polynucleotide
ataygtttttygttagtttgggygtygggtttygaattttyggtttgtaaatttgygtattttttttygtygygttygttagataatttggygaatagttygttygttygtatttygtttttttyggttttttttttaaattttaaaygtatygtygtgttttaaagaaggtgtttaygtygtttttagatttyggagygttttttttttattttygggattttttaggtygtttatttttttygtttttygtttagatttgagagggatygaaaatatattttygattygggtagttagggtygaaattgttaagaggagaaaaggtaaagyggaaggagggtggttataaatagatttttttgtttttttttaaaaggatattgtygttttaaaagtttttttttygggtttttatttttygtattttygtattttgggggagygtatttaattgaggtaaygtagtttttttttagtgtttgtag

SEQ ID NO: 3760 - DNA, 201 bp, Artificial Sequence
  Description of Artificial Sequence: Synthetic polynucleotide
ggttgaggagaagggagggagagtagagggaggggggaattyggtygggggaggaggagagaggygaggaggyggttttggtagygygyggyggyggyggyggtagyggtagtagtagyggyggtgyggagagtttggattgggagtttaaagttyggttgggtagygggagaggaggagtygtaggagttgtagttttgt

SEQ ID NO: 3761 - DNA, 364 bp, Artificial Sequence
  Description of Artificial Sequence: Synthetic polynucleotide
ttttataattaaggagtatggtggagttgggttaattttaggtatagtttagtygagttaggygaggtttagagagatttgattygtttggtagttttaayggatttgttttygtagtygttgyggatttttyggtygttatggygattgtgaaatgtggggtggggygtatgygttggaagttattygygygggtagtttttgagtgtttttttaygtgttttttagygygagtagtattttygtttttgygttttttagagygtgtagttttyggtgagggtagttttaygtatagttttttatattttttttagygtttgtagttttyggtgygygtaggttttaagtttatatgygtagt

SEQ ID NO: 3762 - DNA, 220 bp, Artificial Sequence
  Description of Artificial Sequence: Synthetic polynucleotide
gtttttatttygagygygtagttttaygtagtttttttatattttttttagygtttgtagtatttttagtgygtatagttttgttagtygttttttygggygtygtttttgtattatttyggtttataattttgyggygattgtttgaagaatttttygtggttttattttttttttygggtttagttttagttgtgatattttaattaaaagattatac

SEQ ID NO: 3763 - DNA, 201 bp, Artificial Sequence
  Description of Artificial Sequence: Synthetic polynucleotide
tygtttttttygtttygagygattttttgttttagttttgtaggtttygtattgtagatgtttgttggtttttttgygttyggyggttttygyggtgtttygtaagttttygtgattttttagtattagtyggttgtgygttttttgtttttaygggtyggttagtygtagatatttatttagtttygygagtttagtygt

SEQ ID NO: 3764 - DNA, 201 bp, Artificial Sequence
  Description of Artificial Sequence: Synthetic polynucleotide
ggggtatygygttggtatttgtagggagygattggtttggaagggtagagggtagaygggggtttgggtggggtagyggttattttaggygyggagaattygttgtttttatttttttttygyggatttttattttgyggtttgtgtgttyggtttttttygygtggyggggaagtgygggtggttgttygggtttttaga

SEQ ID NO: 3765 - DNA, 201 bp, Artificial Sequence
  Description of Artificial Sequence: Synthetic polynucleotide
gtgtyggttttygaaygtatttygaggyggggtgagggttggtagtygtttttgtattygtygttgygagtygygttttttaaatttaggtatgggatttyggaaaatygattygttgttttgagtgtttattaygtgaggaattggagtggtygagttygttaaggygtyggggatatttgagtagatgagaattggagt

SEQ ID NO: 3766 - DNA, 358 bp, Artificial Sequence
  Description of Artificial Sequence: Synthetic polynucleotide
gygtagygtttgagtttgygtttygttaagtgtattaagtaygagatttagagygttatggagatygtgttgttttggggtttggtygygtattgtayggyggttgygttggtygtattgtttttttataatatgagtagygtyggyggygatygtttgggtygyggtaagtyggttygttgyggttttatttttttygtgggtygygtgtatygttggatggtggatagtygygtggygttgygtatttaygagtaygtygttatttatttgatagtttgtatggagagtttttttygggatatttattygygggtygtggttttyggggtgtttyggagttgtagtggttttgggt

SEQ ID NO: 3767 - DNA, 201 bp, Artificial Sequence
  Description of Artificial Sequence: Synthetic polynucleotide
ggagttttygggygygttttgggygtattggggaggttttygggygggtaggyggaygttttggggyggygggyggyggttgtyggggttygtyggggttyggtygttygttgtttatygataggtattaggaattgatttygtygttgttttttgttyggtttagttatygattagttgtygygattatggagaagygtt

SEQ ID NO: 3768 - DNA, 328 bp, Artificial Sequence
  Description of Artificial Sequence: Synthetic polynucleotide
ygtagggagggagggggtatygtttgtttttttgttygaaaggtggaggtaaagagggatttyggattttagagaggtttataattttttataagtaaggyggggggyggaatttagagaggtaaagtgattygtttttaaatygtaatattaggaggatagtagggttagatggaatttttyggtttatagttttygatttygggtaagtgttttattygggygtayggtttgtttttagattagaattaggygygttygtagttaaggaagtttggygggagattttttygaggttttyggtttttaggttagyggggttaaggag

SEQ ID NO: 3769 - DNA, 201 bp, Artificial Sequence
  Description of Artificial Sequence: Synthetic polynucleotide
ygttyggtgaagtyggtgtatttattatattttttgttgtttttagtagggaagtyggyggtgaggygggggagtaggtatggtggtttyggggtttatgyggggtttattgtttatttagaatagyggttattgttgtttattagggygtatttatygttggagttttygyggygattgtttatttttaatatatatttt

SEQ ID NO: 3770 - DNA, 319 bp, Artificial Sequence
  Description of Artificial Sequence: Synthetic polynucleotide
tggagtyggyggtygygttygygtygttgttgtttggttygttggyggyggggtygggggttgtyggagttgattttatgtttttttttaatgtagagatygttggagatggygagtttygagattttttttattttttgtttttagagtaattttatggtattaaaaaaaaaaaaaaaaaaaaaaaaaaaaaaaaaaaaaaaaaaagaaggagaaggygatyggygaaagtaggagggaaaaagtaggyggyggygggygggtaagtaaaagygygagggagygygyggagtgtttgggtggaygtgtgtgtgygttc

SEQ ID NO: 3771 - DNA, 201 bp, Artificial Sequence
  Description of Artificial Sequence: Synthetic polynucleotide
atygygggaggagagygtaaggaggtttttygtaaagttggaggttaggtyggagygatgtttygggagyggagtttttttagtttygggtttttagtygyggatagttggtagtgttaaagatttygttattatttgyggttygtagttgygattyggtygtagagtygggtatygaggaaggygtaaagttgagtttgg

SEQ ID NO: 3772 - DNA, 370 bp, Artificial Sequence
  Description of Artificial Sequence: Synthetic polynucleotide
agggyggttyggggtgggggygttttatttttgttttttatggygtgtaygaagtttttttggtatagttggttgygaagttttttttttaggttgaagtygyggaygttgaygattttttttaygttygataagttttygttttygtygtatygttggyggttaatygggygttgygaggatttaaattagagagttygggatattattgtgggggttggaggtygttttttaatttgggtttagtattaataggtgtagtagtygagygttttttgtattttattattgtaatttaagtaattttgygtaattgttaaagatgttgaaaagtaggataaggagaggggttygtatttygagggtttag

SEQ ID NO: 3773 - DNA, 201 bp, Artificial Sequence
  Description of Artificial Sequence: Synthetic polynucleotide
gttatgttggaatttggaggggaggggggatgttggagaggtatayggtgatggatatggaaggattygggaggtgtggagtggtgggttyggttygtygygggaaggatatagagggatataggttgttttggagaggygttttyggatatttggaggggygtatagtgttgggatttggyggygtttggggyggagggg

SEQ ID NO: 3774 - DNA, 201 bp, Artificial Sequence
  Description of Artificial Sequence: Synthetic polynucleotide
gtttttygtttttaygtygtagttygggttagyggggttygtygyggtggygttygyggatgttgtygtattggtygttgyggtayggayggygtagtttygggygyggttyggtataggygtyggyggttttygttagttagtagttyggygaggygttggtttatttatggttttygggyggyggtttttgygtttagt

SEQ ID NO: 3775 - DNA, 201 bp, Artificial Sequence
  Description of Artificial Sequence: Synthetic polynucleotide
attygttygttygtgggtgagttgggaggggygyggygagggagggtgggttyggggygggggyggygyggggygygtttgyggttatgygatattgtttygttygygtttygtttttttttttgggttttttgggttttttgggttgtaggattygtygaygyggygygttggtygtaygggggttgggygtygttgtat

SEQ ID NO: 3776 - DNA, 263 bp, Artificial Sequence
  Description of Artificial Sequence: Synthetic polynucleotide
tgggttattygtgtygtatgtyggygtagttgttygttgtggtaaggggggggyggtygggtttyggagygggtygggagggygyggggygygtatttygyggtaggtgagyggygyggttgtaggtgagtagtagtttyggttygygygtttagtttttttygtygygttygttyggtttataygtttttygygygygygtygttttygtttygygygygttyggtygttygttygttygtgggattttygygaggtygygc

SEQ ID NO: 3777 - DNA, 201 bp, Artificial Sequence
  Description of Artificial Sequence: Synthetic polynucleotide
gttttgttttttttgtttttaaygaattggtaagtaaaatattagttgtttattttgaaatttgttttaattattttygtattttttgaagttygttgggygygttttgggttgtttttttttgagtagtygggtttagagttaaggygygatgattgtygygtaagttagggtttaygyggtyggggtttttttttygtt

SEQ ID NO: 3778 - DNA, 201 bp, Artificial Sequence
  Description of Artificial Sequence: Synthetic polynucleotide
ttttttatttyggtatttttttttggtgaygttaaggggttttttattttttattygtttttttatttattttttttttttttttaggttygtttttttgyggttayggagaggggygggggtygaygagggygggtggttyggggtygagygygygtggggaggtgttggygaygygggttygggagygyggtttyggta

SEQ ID NO: 3779 - DNA, 201 bp, Artificial Sequence
  Description of Artificial Sequence: Synthetic polynucleotide
ttatttagttttgggggtygttygaaattggggaagggataaggttgaagtttygtygtttggttttaggggyggaaagttygatttaagggaagttggtygygttttygygayggtgtttttggtayggaggattgaggygtagttyggttgtttttttttgtttgtttttttygygttgtttygtygtttttgattttt

SEQ ID NO: 3780 - DNA, 201 bp, Artificial Sequence
  Description of Artificial Sequence: Synthetic polynucleotide
ygyggggtygggyggggatyggtygggggygtygygygttyggtygggttgattgtygggggygattttygyggggtaaggygggggygygggagtagygygtagttgyggggttattttatttgagygttttgaggttagggtyggggtttgaggatayggygttgggtttygggggaygygggtttaygtyggygttyg

SEQ ID NO: 3781 - DNA, 215 bp, Artificial Sequence
  Description of Artificial Sequence: Synthetic polynucleotide
ttatatttatygtttygggygygtygttygygygyggtttygtttygggtyggtatttttyggttyggttgttttyggttttygtttyggtttyggttttygtttygtagggttyggtttygygatggtggtygyggyggygagygyggtagggagggygtgtgtatgygygtgagagygygtagygtgtgtatgtgygtgtgygygggagggtt

SEQ ID NO: 3782 - DNA, 201 bp, Artificial Sequence
  Description of Artificial Sequence: Synthetic polynucleotide
ygygagtgttttttaatggtagygygggygtttttaatygygaggggttgygttattatyggygtttgttggagyggttgygggagttgggygtgtagttygtggttattttgtattattgggatttgttttagygtttgtaggaygtttayggyggttgggttaatygygttttggtygattattttagggattaygygg

SEQ ID NO: 3783 - DNA, 201 bp, Artificial Sequence
  Description of Artificial Sequence: Synthetic polynucleotide
gtgttagtagtttyggggtygttygtaygtaaygttttygggtygggttaggttggttagggtagggyggtygtttttygaggaattgygggyggggyggyggggttaagttgagygttygttttgttttyggygtttygyggttgygggyggagygggttttgyggagtttttyggtygtttttttygtagttttygttt

SEQ ID NO: 3784 - DNA, 201 bp, Artificial Sequence
  Description of Artificial Sequence: Synthetic polynucleotide
ttaggttgtttgtagygtygttttgtttttttattttagagygtaggtgagtggttatttttttaggggatygyggttgagagygtttatttttttttttygtatttggaaattgagtttggyggtagggttgggttatttagagtttgtatatttyggaagggaaagtgattttagaagggagagaggaagtgttgagtt

SEQ ID NO: 3785 - DNA, 217 bp, Artificial Sequence
  Description of Artificial Sequence: Synthetic polynucleotide
tgtagttggtgttgtttttgggaygatgtagaygttttatatttaggygygggtgttaggtygtygggtattagtttatttttagggtttgtgagttgygygtattttttyggtygygtattttttgggaggttgtagttagagygtttttgaagggagggyggtagaagatattttttttyggtttatgtaaatygttgggggaattttagttaat

SEQ ID NO: 3786 - DNA, 317 bp, Artificial Sequence
  Description of Artificial Sequence: Synthetic polynucleotide
aagygagygattttttgagttygggtggttyggygggtaagggyggygygggagattygtagggygygggygyggattyggggaattagggttatygttgygggyggatgggggttatygaggyggttygtttttaggygtatatttygtatatttttttgttaagtgaaggggttaaaatgtatagatgggggagtttatttaggaatagaggygygagaygtatagttatttttgggttgggagtaygagttagtagattttyggagygygttaaayggataatatgttyggtgttgtaaatagaggtttttgtt

SEQ ID NO: 3787 - DNA, 201 bp, Artificial Sequence
  Description of Artificial Sequence: Synthetic polynucleotide
tatttttgtgggggggagggtgtagygaaggttgttagggatttygygatygygttttaataygtattggagygagtgtgygagtgattatgagtgtgagygggtgygagygttyggyggggttgatygttaygttggyggggtyggyggggttaggtagtttttttygygttttttttttttygtttygtgttttttttt

SEQ ID NO: 3788 - DNA, 201 bp, Artificial Sequence
  Description of Artificial Sequence: Synthetic polynucleotide
ayggtgttaagggatttagtttggyggatattttttattaggagatygtaggtaagygygggygygttgtaggggtaggttgtagttttyggttgtygtaygttttattggtygttyggygtttttttttttttttttgttgttgagttggtgtttattttttgttatygttatgggatttygygttttygtgttgggygg

SEQ ID NO: 3789 - DNA, 201 bp, Artificial Sequence
  Description of Artificial Sequence: Synthetic polynucleotide
gygtygtagtttttygggtatyggyggyggtgattaatttgtaattttagygtttagagttgttatggtgttygygggyggyggyggyggygatagtgggygatyggtaggattagtgttaggygyggygtttagggygggyggggaygygggttttttatttayggyggtttagtttaggtagygygttyggttyggttg

SEQ ID NO: 3790 - DNA, 201 bp, Artificial Sequence
  Description of Artificial Sequence: Synthetic polynucleotide
gyggtgtgtaygggagttygtygggtataygyggggtatatttaagtgtattgttaggaggtygggagtttagygtgygagygtgaggttagattgtgtayggtatygaggattagttttatttttgagtatgaaagggtgaaatygtttattttaagttttatttyggagttattaaataatgaatgtattagttatatt

SEQ ID NO: 3791 - DNA, 201 bp, Artificial Sequence
  Description of Artificial Sequence: Synthetic polynucleotide
gggttggtygyggattyggayggtygggagygggygyggyggtygtagagayggttttttttygygyggttttagygtagattttagatttggagtygtgygggyggagaygygyggggttttttttygtttygtygtygttgggtttttagygttttyggattygygggaggataggaattattyggagtgaagttgygt

SEQ ID NO: 3792 - DNA, 221 bp, Artificial Sequence
  Description of Artificial Sequence: Synthetic polynucleotide
tygagatataaagatygaggttgagatygttaggggttgagggtgaggtygygtttyggggtygttggagygygggygttatgygagattgtttyggttgygygtygttttagaggagttygagygttttttttagtygyggygygttggttttggtygggattgtagttaggtgggygtygygygtgtgagygtygygygtgtgagygtagatttggatt

SEQ ID NO: 3793 - DNA, 311 bp, Artificial Sequence
  Description of Artificial Sequence: Synthetic polynucleotide
gattattgtygaatagtygttggagattygtagagaagggygggttttgygttyggggygtttyggaggtaagttyggagagttygggtygggyggagggygggagygtaygagtgtgtgtgtgtgtgtgtgtgttygyggtgtgttygyggttyggtgtataygygygygggttgtaaagttaggagttgygggagygtttttttgtttyggtttggtttyggagtattgygggtygyggaggtgtgggggtttttgtygttgygtttagggtagyggyggaaaaggtgtgtgyggatgyggggyggggt

SEQ ID NO: 3794 - DNA, 308 bp, Artificial Sequence
  Description of Artificial Sequence: Synthetic polynucleotide
ttgagtygtagaaggtttttttygygtttttttttagtagggatttttggayggggagatygaygggtttgtgggygttttttygggatatatttyggttygttttgtttgggttgggtttatttaygttttgggtggggtttaggaattgygtgygggygtagygggtgagtatgttgatgatgattatttggttttatttttttaygtygattagtaggttatagagttttyggtagtttttgtgaattaggtygatgygtttygggtagatttttttaaaggttattattatattgttygttatt

SEQ ID NO: 3795 - DNA, 201 bp, Artificial Sequence
  Description of Artificial Sequence: Synthetic polynucleotide
aatgtgatatagatattagtttttygtgtttttggtttttagggttttttttatygygttttagtatttgtagtttttttatttttatagygttygtygtygttaaggtaatagagggatgttyggtgatagattyggygtyggttttyggygtygtaagagaagygttygygygggygttttggattygtagagttttyg

SEQ ID NO: 3796 - DNA, 201 bp, Artificial Sequence
  Description of Artificial Sequence: Synthetic polynucleotide
ttattttatttgagygtggttaaattgttgttatttagtggggagtaaaaaaaaataatttgtattatygaaaygagttagtaattggttgggaggygggyggtagttgggtttygygtgttttyggyggtyggggtttttttyggggagaggtatatataygtatagtyggatygygtttygttagggtyggagttattt

SEQ ID NO: 3797 - DNA, 201 bp, Artificial Sequence
  Description of Artificial Sequence: Synthetic polynucleotide
ggtgggagtygygaggagygtttagtggygyggtttgtygggtatggtggtyggttyggygatygttgattygtygggttygggggttttggaagygaggygygtttttygatttygagattttgtagggttgtaatagayggtggggaggtaaaaaaaaaaaaggaaaaggaaaaaatggtgttaaagttattaagtttt

SEQ ID NO: 3798 - DNA, 630 bp, Artificial Sequence
  Description of Artificial Sequence: Synthetic polynucleotide
tyggttagtttattttygygtttygtaaatttttttaatygggtaataaagtgagtagyggtggtygtygygatttttttaatttygtatttyggaggttygagggggttttgggatygagyggtttygtagyggygatagaaatatatattttaygaaaaagaaaaaaaaaaaaaygagtygygygaattygttaagttagatgtgygyggtttgaagyggaggaggttttgaygttagttttatttygygtagttyggtttggtygtagattygtyggttattygtyggyggtttaggtygggaggggttaggatagtttyggtygygyggtggayggaggggttattttttygggygttagtaaataaattttattygagttaatatygtttagygaayggtgtttttttttagttattygagaaygagaggtatttttaattagaaattaattaatgagtagttgttttttttygttttattgtaattattygttttaattataaatgagatttatgaaaggataygttgaagatgtaattaatagttaaaattagttyggygttgygtaggyggtyggttyggtttygygttggygygttttgtttygagtggtaggaaggggtt

SEQ ID NO: 3799 - DNA, 201 bp, Artificial Sequence
  Description of Artificial Sequence: Synthetic polynucleotide
aaatgggattagagygyggagggagtttggttaggaggttttttaggatttagtygygaygttgaaaagtatgaagggtyggaattaggtatttatttagygagygttattaattygaagttatagygttaattttttgattyggtygtttttataygtagygtygggattagaggygyggtygtygttygtttygttttt

SEQ ID NO: 3800 - DNA, 239 bp, Artificial Sequence
  Description of Artificial Sequence: Synthetic polynucleotide
gaagaaatygggtaaatagttgtttttaggttygtgttaygagttttggygggatttttttttttttttgtattttttatttttygattttttttgtgtgygtygygtttygttgtagtttygttggagagatggggayggtttggtagaaggtggyggygataggggttygggayggtttggggagaggagggtgggggygyggttgttgtggggtgttttygggyggggtttayggg

SEQ ID NO: 3801 - DNA, 201 bp, Artificial Sequence
  Description of Artificial Sequence: Synthetic polynucleotide
tgtttagtttttyggaggagtattatgttttgatattttygttttatygttttaaagttggtttggggtttygtagggagtggtttgtatggggagggttygygtgttgtgtttttgggaggggtaagagagtgggggygtagggggygggttaggtttttgggygyggygygggttygggggattygygyggttgaygtt

SEQ ID NO: 3802 - DNA, 221 bp, Artificial Sequence
  Description of Artificial Sequence: Synthetic polynucleotide
ggtagttggygygttygttttggtygtagttyggtttggggattygttgygtgttttggtattagtgygtggtgaggaaagyggtggtggygaatagtagygttagtaggtttagggttayggttaggagygttyggtygyggyggttagtttttatgtygttygygtygtygggaygggattgtatygtyggggagtttygygygygaagttggtagttg

SEQ ID NO: 3803 - DNA, 201 bp, Artificial Sequence
  Description of Artificial Sequence: Synthetic polynucleotide
tagttttaygtyggttygtttttygtttayggttyggtttttttttygtttggttyggygttttttygtttygagttttttattttttggatttygggttygygggggygyggagaagaggatttaggaaaggtttgggaatttgatgggtttgtggttggggggaggggtagttttttygttattttatttttttttygt

SEQ ID NO: 3804 - DNA, 246 bp, Artificial Sequence
  Description of Artificial Sequence: Synthetic polynucleotide
tgggtttttttaggatttattttatgtagtttttatatggtttttagagttttgatttygtggttggagtgtttgtttttttttaagtattggtagtataygggtattttgtattgtaygtagtatatgttgtggttttttagttygtggtttgtgtaggtggagattttgygtgggtttagttttyggtttataygattttgggtygggggtattaggyggtgtttggttaggggttttyggggc

SEQ ID NO: 3805 - DNA, 223 bp, Artificial Sequence
  Description of Artificial Sequence: Synthetic polynucleotide
tgatattgggggtaggtgatataggagttgyggggtatyggggttagggtyggtgataagtgggtggtyggtggyggtatagtygggggaaataygyggaygtygttgggggatttttggtayggggtagtgggggygttggygaatttttygtaggagttatagtygttgttygtttygttgtataggtttattttgtttaggtttagatagttatagtygg

SEQ ID NO: 3806 - DNA, 201 bp, Artificial Sequence
  Description of Artificial Sequence: Synthetic polynucleotide
gggtttttygttagygtttgygtttggtttttagttttgagtttygygtttatttatygygggygagtgttgygtagtayggaggaygttttttttttttygttgttggtagttttygtaggygttttattygggtttaggtttttgtayggtagtggggttttttttttttttygtgaattygttgaygtygtgttttgg

SEQ ID NO: 3807 - DNA, 244 bp, Artificial Sequence
  Description of Artificial Sequence: Synthetic polynucleotide
tgygtttattygttgtataaygygtttygtttyggtttttagtttatttttygygtygygttagtttygaatttggattttygygggygtttgggyggggygggattttaggtttatttagtaagttaattggttgaggttttyggttggggattaattatyggttttgagaaagttyggtagtggttattatatttggttttygttaatttttttaaggtagyggtygttggagtagyggggt

SEQ ID NO: 3808 - DNA, 201 bp, Artificial Sequence
  Description of Artificial Sequence: Synthetic polynucleotide
tttttatttttggttgtttggyggggtttgaaagggtaggtggttttggyggygygtttygygagggatgtggtagaagggygtgygtttggygtygaggyggagggattttygatgtygtgtggtagyggggtttgttatygtagtttttygygggtattgtttttaggtttagagttagtttttagygagtygggtaaa

SEQ ID NO: 3809 - DNA, 457 bp, Artificial Sequence
  Description of Artificial Sequence: Synthetic polynucleotide
tttttttaaatataygtttttttgttygyggttygttattttygttygggtttygggttgtgtagtttttttttaggtttgttygggtttatgtttttttygaagyggygggagtyggtgtagttttaatttttattgygtgttttaggtygttaattagttttgttygygtgtygttggttyggaggttgtygygttagtttttgygtgygtttgagygygttggagtatttgygaggttagggttgtygayggygagaggatattttgaggaatayggtgttttagtttygttttygtttttygttygagttggaggttggggygygttgagtygtagygtttggataagtgygygggtyggagtygtttaggtttgtattygggggttygyggtygaygtatgygtaygygyggtggygggtttgtaggttygaaggttyggttttttttttaa

SEQ ID NO: 3810 - DNA, 244 bp, Artificial Sequence
  Description of Artificial Sequence: Synthetic polynucleotide
gagyggtgattggaatttaygttygggagaggttyggagtttyggtygygggyggygggggatttttgtaggaaggggtaggaaggtaagtagttyggygygttttggyggtttygagggatttgggttygggtttgyggtygygtygtttgggttttttttgggttgggagygygtygggttttygttttgtaygttgttatygygggagaygtttyggtttygtygygygtagaggggaygc

SEQ ID NO: 3811 - DNA, 206 bp, Artificial Sequence
  Description of Artificial Sequence: Synthetic polynucleotide
gtttygaygttgygggygatagggtttggttttagtagtygtygtygtygtygtygtygttattyggaggatttagtaaaagtttggatttgggggagggygyggygttgagygggattattattagggttggaaggagatttygagaatttttgtaggtaaygygygtttttaattttttttttttatgtttygtygttgygttt

SEQ ID NO: 3812 - DNA, 203 bp, Artificial Sequence
  Description of Artificial Sequence: Synthetic polynucleotide
ggaagtagtggggggygttygaagagtagggtagttayggttatygtggtygtyggatyggttatgtgttaaagtttttggggttyggygtttygttgggygygtagygyggggagtagaygygtygtgggtggggtagygyggtgttgttggygttyggttttygyggggtgtagttttgygygtttttatgttgttttttt

SEQ ID NO: 3813 - DNA, 266 bp, Artificial Sequence
  Description of Artificial Sequence: Synthetic polynucleotide
ttaggttatttygattttggtttttaggttygggataaygtgttagttttaagagagygttgtttatagtttygggtgggttgggtttaattgtayggggyggggygttaatagtttaggatttgggttgtaggttggtttttgtattaattagyggggyggtttygggttttagtttttttatttygtttaygaagggaggygattgygagygtttggggtttttgayggatttygtttygggggtggggyggggagtggttayg

SEQ ID NO: 3814 - DNA, 242 bp, Artificial Sequence
  Description of Artificial Sequence: Synthetic polynucleotide
gtttagtagagatttggagttagaagtttagagatagtygagtgygtygtgyggttttyggaygttygttgtttagttygattttygttaattgtgtaggyggttgattygtagyggtagyggtagtagygaggattygagygttggttgtagygatattatggattttttttttatggtygygtaggtaayggggygttttttttaygygtttygggtygttaagtttggggaggttyggg

SEQ ID NO: 3815 - DNA, 201 bp, Artificial Sequence
  Description of Artificial Sequence: Synthetic polynucleotide
agtttagattygygygaaygtggatgggtatatagtttygtttttttttattttgttttttygaggygttagtaatttgttttttgtyggtgatttygggygttttttttgtygtygtttgaggaaggttttgagattygttttgtgatygtgattygttaagygtygaygygtygyggtygtttgttttgttttgttttg

SEQ ID NO: 3816 - DNA, 201 bp, Artificial Sequence
  Description of Artificial Sequence: Synthetic polynucleotide
ttttgtttyggtttttgyggggatggatgttttaygtagtaagygagtaagygagttttggagatyggggttttgggtgtgyggtyggtttagtgttaygyggtgagataggtatggttattaatttaygttaaggyggttgtgtatttggtatagaaaatattgttgttgaatgttgtttttatagttattygttagygt

SEQ ID NO: 3817 - DNA, 312 bp, Artificial Sequence
  Description of Artificial Sequence: Synthetic polynucleotide
ttttttaatattyggtttgtaygtttggygggggygtaatagtgttttayggttygggagttygtttttggtttttgagtaaggtattttttttatttgtygtgtgtttagttgaatttagtatatttttttygtatttttygtttttttttttttttttttgaatttgtttttttgttttgygggtttttaatttttttygaatttygggygttyggttyggtttaggygagygttygyggttggggaygygggtggggaygyggyggtttgggygttgtaggatgygtttggtygyggaggagaygatta

SEQ ID NO: 3818 - DNA, 203 bp, Artificial Sequence
  Description of Artificial Sequence: Synthetic polynucleotide
ygttggttttggttgtttgtggggtttttttaggtttyggggggtttgyggyggtttgggaggtagattttygygggtaggtgtggtygtgtttygatygygygaggatygaagttggyggaagtttttgtgyggtgttttttagttyggaggaggttggtttgaagtttttaggygttgtygaagtttttttttgttagygt

SEQ ID NO: 3819 - DNA, 201 bp, Artificial Sequence
  Description of Artificial Sequence: Synthetic polynucleotide
ygtatgygygygygtaattagattttygtygtygtttttagygttttttttyggggtagggatttatttaataggttggggtttttggagtgygyggggtygygtggggaagyggggattttattttttttaygygtygtttagtattgggtaagggyggggtattttttgggttttygtttttygtygttygtttyggga

SEQ ID NO: 3820 - DNA, 283 bp, Artificial Sequence
  Description of Artificial Sequence: Synthetic polynucleotide
agyggyggyggygggttttaggagtygtagattttggttagtggtattgygggttattttgagttttygaggttttagggggatagygttygggygttttygttgygygtygttttygyggagtygagyggyggtggttgyggaagygattggggttgygyggatattagygttttagagttygygaggagtttggggttttygggttggagtaagagtygagtatyggygtagtttgygggattggtatttatygggttttttaatttttagattttgttat

SEQ ID NO: 3821 - DNA, 201 bp, Artificial Sequence
  Description of Artificial Sequence: Synthetic polynucleotide
gttttyggggygttttgttttgygttatygygygttygttygttygttygtttaatttatttgttgaagattaggtagtttaggtggttgattttgtggtyggagyggtggyggttgtagtttttttataggtttttgaaggtygtgatggttaggatgaagagtatyggygttagtgttaggtygggttggaaggygttt

SEQ ID NO: 3822 - DNA, 247 bp, Artificial Sequence
  Description of Artificial Sequence: Synthetic polynucleotide
ttgagygygtgatatggtttgtygtttttgattaagaygggtayggttattyggygyggygagggtaggggygttatttttatatttttttyggttygggygygttttattttgtagyggtggttttggaattagattttgatttgygtgggygtgaggyggatgaggttggttaggtgttygygttygggygtygataggtatygttgttgtygaaagygtygttttagttygtaggtttgygttt

SEQ ID NO: 3823 - DNA, 427 bp, Artificial Sequence
  Description of Artificial Sequence: Synthetic polynucleotide
ggggygtttttttaggggattgggggtggggaggagggygtaygggtyggggagggggttatyggatttggatttygggatatttygggggtttggggggygggtygygygtttatttgygttttygtygtygaaggagtttatgtaygggaagtagatggygagygtttygaaggaggyggatagattgaggyggttttgygagygttttatgttygygtyggygtygggygtttyggtygyggyggyggyggyggyggygggyggtttgggtagtttggtygttttatttttgaygyggagtayggygygyggygtggtggyggyggttyggggtygggtygaggtttygttgyggggttggygggygyggyggggtyggygggygggttaggagttggyggygygyggagttygaggygygttg

SEQ ID NO: 3824 - DNA, 246 bp, Artificial Sequence
  Description of Artificial Sequence: Synthetic polynucleotide
yggtttatagtygggatgygttttygtyggggttatygyggyggygaaygtttyggatttygtatttyggtgattttttgggatgaatygaagtyggattygtattttggtygtaataagygygttttaygtygttaygtattagyggtgattttygagttttttgtygttttggttttttygtaggygggtttygaggttttygtagggagtttagggttayggttaygtgtagtygttttygag

SEQ ID NO: 3825 - DNA, 384 bp, Artificial Sequence
  Description of Artificial Sequence: Synthetic polynucleotide
tgygygtyggtttggtttgtttgygggttttagagtttyggygttygttgtttttttygtttttttttttttttttatttttttttttttttagtygygaygygtagggggygggttttatttttttttygttttygtttyggttttaagtygyggaggygttyggtgggatttygttgttgtttaattaggggggatygggtgagtttttttttttggagtygggttttattagygtygtaggtttataggtygggggtgggggttttggatygaggggyggygyggggyggygyggggyggygygygyggttttggagygttagtatttgtttttygatttttyggtygtygttttyggtygtttyggggatttygttatta

SEQ ID NO: 3826 - DNA, 415 bp, Artificial Sequence
  Description of Artificial Sequence: Synthetic polynucleotide
tgggtagttttaggtygtygaattyggygtttagygggggtagttygyggaaggygygagtygagttagaygtygyggggaaaggttygggyggtggttgygggggygttaatttygggagtaggaggtygggttttagtygtygggttttgygygtttgttttttgyggygyggtyggtatttgtagttggggtggtygygtaagtgttgtaygygtagtygttyggttttttttaygaagggtygttttttygtygygtttagttttttttaygttttgtttgygggtygtgggygttagtgagtggaaygtygtygggygggtgggygtygagtttttygtgygttygggaygtttygygagggtttggygtagttttygtatttygyggttygggatttttgtttttttyg

SEQ ID NO: 3827 - DNA, 543 bp, Artificial Sequence
  Description of Artificial Sequence: Synthetic polynucleotide
tgygttttaygttttggagygtgaagtygggygttaaaaagttgttgtygggtygtagttttagatttagttgttggttaaaggygtgtaggyggaggygygtggtttygtgtttyggggygygttttagtttyggtattattagtttttygtttttttyggaggggygttygagtgygttygatayggttagtagygtygyggygagtagtagtagygtgggtattggtttaaagtttygagatttyggagttygtttygygttttttatgtygttgtttagtttgygtttttygaatttttygggtatagttygttgtattggagttttaggagatatygttygtagtagygtayggagygagggatttttagttygggtygggagagtaaagtttygttggtttgttttggattgttaaaattaataatttttattattygttggaagggygygtagagtyggttatagtygaagttttyggagttattaaaaggaggygttgtagttttgtyggygygygggaagttttttttttagyg

SEQ ID NO: 3828 - DNA, 227 bp, Artificial Sequence
  Description of Artificial Sequence: Synthetic polynucleotide
ttaggagygatggttgtaatgtttttttttttgttttgtttttyggtgtygggagttttgtttttygtygttatttttggttagttttgygtaagaaygtygttttgtttggtagttaggtygagaygtagtttgaatgtgagtaggaattyggagaagggaagggagagaattagaaagaaggttygggagggattygggaagtagtgggaggtttgygttttgga

SEQ ID NO: 3829 - DNA, 323 bp, Artificial Sequence
  Description of Artificial Sequence: Synthetic polynucleotide
tygtyggaagagttttgtagagtgagtttttagggttatttygttgttttttttttygttttygtagtygttgtagttagygtgggagtygggtaggtygygtggggygttggatttatygagaggttagygtygtygtygggggagggygtgtttygtaygtgtgtgttygygygtgttygygttygygtgtgttagygygygtgttttggtygtgygygtygagtygggtygtattaattttttyggygtygaygggtttagtttatggtgtgggygtygggtttagggaggtttyggttttygttaatygyggagtaggg

SEQ ID NO: 3830 - DNA, 279 bp, Artificial Sequence
  Description of Artificial Sequence: Synthetic polynucleotide
ggtaygagygttagtagttygtaaaataggtagagtaygtttttygtgagggttataygygttttggtygggttyggggttaygtaggtggtgtattgygygttygttagggttaygaagagygtaaygaaygttagtagtayggygtttayggtgagygttygygtygtttgtatttyggtgtttagagttagtatygagtygtatattttgtattgtatgtgttyggtgttttgtattaygtaygatatttatagttttttttaggtggtttgygtc

SEQ ID NO: 3831 - DNA, 261 bp, Artificial Sequence
  Description of Artificial Sequence: Synthetic polynucleotide
ttyggygygygtttttyggygtataygttttttattttygygtygygygggtygyggatttgtaggttgygygttttttgyggagtttgtttyggttttayggataggtttygtagtgagtaggtaagggtygtttygtygyggttgtttttttaygtttyggtygttttttttttttttagaattttygtttagtygggatttyggatttttttttttggtttggyggttttygttagtygygatttttatygayggaga

SEQ ID NO: 3832 - DNA, 364 bp, Artificial Sequence
  Description of Artificial Sequence: Synthetic polynucleotide
gttygggttttgggyggygagggygtagygagggttgtygttttttygggtagtttyggggggygyggygttgggtygygggttygggggttgtygtgttygatygtatgygtygatttgtygttgggygttygtttttttttgttggggttgggygyggtttyggagtttggyggyggtggtgagggygtayggttagttgtagyggygttgtgtttgtygtggatttaggatattttaggtttggtggyggggttaggtggyggyggttttttgygttygggygatggygatagygataggtttttaatttygtttygggttygggtyggtygggtttygygtygggttaygygygygtata

SEQ ID NO: 3833 - DNA, 242 bp, Artificial Sequence
  Description of Artificial Sequence: Synthetic polynucleotide
ggygttttttgagtttagagaagtgggttaagataagggaagaaaattttttatagaagaggagattttygtttttagtgttggggattttyggtattygygtttttgtgtttttggtggtttyggygttttttyggagygygyggtatgtttgtttttataygtttagtatttttgtttttagagtaaatttattttttagggtataygtagaggggtagttaggtatygtttttattttg

SEQ ID NO: 3834 - DNA, 285 bp, Artificial Sequence
  Description of Artificial Sequence: Synthetic polynucleotide
ayggtygttyggggtygtattttygttyggtggyggygttygaagaygttagtygygttaygtattgtttgygtttygygttttagtygtygygtattaaygtygtygttttygtygggagttaagttygtygggtyggttyggttttaggtgggtagttyggtttgtagttggttggaggtggyggtygttgtagttttggtagygggtatatttttaagtataygtatttaaygttttttttttgagttaygaggatggagtagttatttyggttygggattg

SEQ ID NO: 3835 - DNA, 222 bp, Artificial Sequence
  Description of Artificial Sequence: Synthetic polynucleotide
ggtattgattttttagttttttgtttgttttttygttttttttttttatttyggatatttttaggataattagggttgaagttttygggagaagtagtttygagttygtgggataagggggyggttyggtttygtttaggatttttttyggatttttttttyggttgtttyggttggttgtagggygygttatttygyggggaggyggyggtagyggtggyg

SEQ ID NO: 3836 - DNA, 201 bp, Artificial Sequence
  Description of Artificial Sequence: Synthetic polynucleotide
gyggyggyggyggyggyggygggggttggggygygggggtyggattatgagtygttgagtygggtaaattttaggttatygagttagyggattttyggagygtagttttgygtygyggagtaggttttaattaggyggygaggyggttataygtatygagttagygattttygggygaygygyggggttagggagygttac

SEQ ID NO: 3837 - DNA, 298 bp, Artificial Sequence
  Description of Artificial Sequence: Synthetic polynucleotide
gggattattttttayggtgttatygtatttatttygygtttttttttygttttttggagtttatygggattaggtggyggygggtgtttttttgggggtgygyggttatgtaattggtggatttttttaaatygttttggaggggggagygyggygttgggggygggagagygtttttggttgtgagttgtttttgtygtttygtttygygtttttttgtygtttygtttygggtttttygygttttttttttyggttyggtygagygygttgtttygaygtygttatttagagtygg

SEQ ID NO: 3838 - DNA, 272 bp, Artificial Sequence
  Description of Artificial Sequence: Synthetic polynucleotide
tgatagggatygggtttagatttgttaaatgttgyggaggtagaatttgatagtgygggagggtaggygtttgggaggtaggagttggtggagatgatagygtggaattygtgagttttaygtaaygtttttttgtygtttagggtgggtttttagaagtatagaaatggtygggttgygggatattatagygaggaattagyggagtataggggttttaggagygtygggatatgttaggtygggtagatagtttygggtyggagtgagtg

SEQ ID NO: 3839 - DNA, 201 bp, Artificial Sequence
  Description of Artificial Sequence: Synthetic polynucleotide
gagtatgagggagagtgttattttttagttgaaggttattgtgttttgtatttttggtttgggtaagtgaggagtttgttagtttttggtaggaagtgtaygtgatyggyggttggttaggggtatagagaygtattttatatagaaatttaggttggyggggtgggyggtyggggagttagttttgtagatgttattaag

SEQ ID NO: 3840 - DNA, 251 bp, Artificial Sequence
  Description of Artificial Sequence: Synthetic polynucleotide
gtaggttgaaggyggagttggagatattyggggagtaggttyggagygttttygaggtyggggtyggygagggagaggtagggagttygaggaagggaggyggggygggtagggatygagttaggagagagygggygggggttttgggagyggttttygagagtggggtttgtggggagtagggyggtttyggggatagaggaagtygyggtggaggtttagggtagaygygggyggaygygaggagygta

SEQ ID NO: 3841 - DNA, 249 bp, Artificial Sequence
  Description of Artificial Sequence: Synthetic polynucleotide
attygttttyggagtttygttyggyggtatttgttttggttaygygttttagtttygttaggtttttyggygggttygaattygtagtygggaaggtataygygagtaggagggygtattttatggttaggtgyggaygyggyggttgygggtggttagaygyggtaggyggagygtaygggyggygygtatttttttygyggtttyggagttyggygttttaggtgyggttttaggtgagagtygtyg

SEQ ID NO: 3842 - DNA, 249 bp, Artificial Sequence
  Description of Artificial Sequence: Synthetic polynucleotide
gttttyggtagaygtagggggaygttygggyggygyggggygygggtttyggagtggttgygggaaggaygygyggtattgtttgtgyggggattygggaygggtyggggtattataggygygggaatttaygtgtggattttgygttygygggygyggtgattttygyggggatttgttggtgtttygagatttattgagttgygggggttttggagatttttaggtttgaaaagttagttttagaga

SEQ ID NO: 3843 - DNA, 201 bp, Artificial Sequence
  Description of Artificial Sequence: Synthetic polynucleotide
ttgttygyggygtygggygygtyggtygtygggtggtggtggtggtyggyggygtggtggtggtggtggtggtagtgygggttygygtygttttgygyggyggtygyggygattayggyggatattayggyggyggyggggtttattttttygtygttgtygtttaaggaggygtyggtatyggtttyggtygtygyggtt

SEQ ID NO: 3844 - DNA, 201 bp, Artificial Sequence
  Description of Artificial Sequence: Synthetic polynucleotide
ayggtatttayggtyggggggttygggggattyggygggyggyggayggygtatattygygattyggttygggagtygttgttttttttagtttggttttygtttttaygatttaggggyggttgygygttgttttttggygtygtatygggtttaggygygyggyggggttggggygygyggggyggtygtttgggttat

SEQ ID NO: 3845 - DNA, 251 bp, Artificial Sequence
  Description of Artificial Sequence: Synthetic polynucleotide
yggygtygggtagygygtagagttagtygygtgtgtagggtygggtgtygttgygtgygggygyggggygygggttyggggygggtgtagggygygggatyggggtagygtaggagtaggtaggggttygyggttygygtgggttttaggygygggatggyggygtttagtagygygggttygygtagggygygtagygttgggggtaatagygtggggttyggtyggtagtggggygygggttgygyggt

SEQ ID NO: 3846 - DNA, 201 bp, Artificial Sequence
  Description of Artificial Sequence: Synthetic polynucleotide
tayggtggattttgtgggtygttgagttttttgattttyggtttgttttattttgttttgttagtgggttttgygttygygttaataattygaatgggtaygtttttgygttttagaaygttgttygtttttttatatttagattgaggtggaatttaygttatataaatygggtygtaaggtttagtttagyggggtttt

SEQ ID NO: 3847 - DNA, 201 bp, Artificial Sequence
  Description of Artificial Sequence: Synthetic polynucleotide
tggygyggggygtaggtgtaygtaggttggtygygggygygyggggttyggygggagtttyggggtggttttygygtggggtygggggygttygygygggyggggygaggtyggggagggtagttgttygtttttttyggtattgggagttttyggttggtattgygggaggagttttygggtgattygygggttttgaaa

SEQ ID NO: 3848 - DNA, 201 bp, Artificial Sequence
  Description of Artificial Sequence: Synthetic polynucleotide
tgaggaattggatattaggygttggtygttttttatttttagtygttgggtgtttagagtttatttttagygattagagtagaattgtagagaagaygttygygttygggtttygtttggggagttagggygygyggggagygttygggtygygyggttattgatygttggttgtaygggggygtygtgyggattyggttt

SEQ ID NO: 3849 - DNA, 337 bp, Artificial Sequence
  Description of Artificial Sequence: Synthetic polynucleotide
tttagggttttygggatyggtgttygttagtgggtataggaygtygggtgttygaagggttgtttggagatgtaattgattttggygggtattagaatgaygagtggtagtagtaggagyggggtgaygaataagattaygaaggatttgaatttggagatatagtttagygtygaggttatygygygggagggagattggygggygagaygagtgaggggtagttagaggygtygygggtttaagaaggggttatagttttyggggattggggagggggyggtgataatttygtttygtaygggggygttttttygyggttttggggyggggttat

SEQ ID NO: 3850 - DNA, 201 bp, Artificial Sequence
  Description of Artificial Sequence: Synthetic polynucleotide
ggttygtgtagagtygtttattttttttygtagygtygggttgttttaaattgtttttggattttatttgtgagtygygtggttgggttgggttgggttgygygggatttgttagyggttttygttattttgttygtaggygtttatyggttgttttttgggtygtygttggtygtygttataygtgggaygtygagggta

SEQ ID NO: 3851 - DNA, 201 bp, Artificial Sequence
  Description of Artificial Sequence: Synthetic polynucleotide
atatggygtatgatagggaattggtagggttatagtttyggattattyggggtagggtagggaaattayggtagattgygtagygtattttgttygggtgyggtgagggttgygtttygtttggttttygttataatttatagaaagttttygyggagtattggtgtttttgaatttattaggygatttygtygtaaagaa

SEQ ID NO: 3852 - DNA, 201 bp, Artificial Sequence
  Description of Artificial Sequence: Synthetic polynucleotide
tygattttgtttygggtaatygatgggaaatttttygagagygyggtttttttggggattyggygtttttgaygtttttaggygttttttygggtygttgyggttttttttygtygttygttagygtttaaggtygygttttttttattttygtttttttttttttttyggyggttttyggatttggatagagttgtagga

SEQ ID NO: 3853 - DNA, 1216 bp, Artificial Sequence
  Description of Artificial Sequence: Synthetic polynucleotide
taaggtggggatcgggacgcgatcggggatggggaagggggttgtaggaggtttcgtttgcgttgtcgtttttgttgggtatagcgttttttattattcgcggcgatttcggttttcgtaaggtggggcggcgagtaggagtcggggttaggttaggggttcgagttttcgttcgaggggcggggaaggcgggtgacgtgagtcgggtcgggcgggcggagttgggatcggtttcgggaggcgggggcgagcgcgcggagaggtagacgcgaggagggaggcggttgagtagcgcgggcggttttgcggcgggcgcggtgggcgcgggcggcggggtttcgggattttcgcgcgtttttttcgcgcggcgtcgtcgtcgcgcgtttttacgtttcgcgttttacggcgttttcgtttcgcgcgtttttcgtgttcgttttttgttagttttcgggtcgcggtcgtttgtagagcgagcgtttagacggagttttcgggtaatttgagtggcgtcgatcggcggcggagtttttggtagagtttttcgattcggtagcgcggaggggattcgcgttcgttcgcgtcgcgttattttaaattttaagtagcgtcgttttatcggcgcggagtttcggttggaggtaagagtcgcgcgtcgggagatacgtatcgtgagcggtagcgtcgtcggttttttttttcgtcgtttcggagggcgaagtcgcggttttttagttttttgttgcgtcgcgatagcgtcggaatacgtttcgtttcgttgtcgttttcgttgtgtcgtcggcggagggggtcgcgagtttcgcgtttcggtcggaggatgtgcgttttcgcgggtcgtttagtttgagttatgcgttttaacggcggcggcgcgtcggtcggtatggagtttcgcgcggtcgcgttttgattcgttgtgcgtttcgcggtcggcgggcggcgggaggcggcggatcgagagtcggagatcggcgtcgcgggacggaagcgagcgggcgcgggcgtcgcgtagatggtttgggcgagttaggtttgaggtttcgtttttcgaaacgtgattatgtggatttaatagtttttaggatttaggtgagcgattcggtcggcgtcgggtgcgtgtgggcgcgtgggtgttaggttgggcggaagcggcgtttttttttatgttgtaaattaagggattttttttcgtttt

SEQ ID NO: 3854 - DNA, 365 bp, Artificial Sequence
  Description of Artificial Sequence: Synthetic polynucleotide
ggcgttcgacgtttatttcgggtttggcgttttttttcggttattacgcggcgtcgtttttcgggattttttagttttcggagtttcgcgcgtttagagtcgttcggagcgcgggcggggttagtttgggtagtcgcgggtcgttgttgcgtcggaagttttcgtcgttagggagttttttgggcgttaggttttgggtttttgggcgaagtcgacgttagaatatgtttggtttcgtatttagtttatcgtatttttagcgcgcgtgggtggggggcgtcggttgaggtggggagggtatagtttagttttaggttatagtgtttcgggcggggtagcgcggtgcggggtgaacgttatcggtt

SEQ ID NO: 3855 - DNA, 201 bp, Artificial Sequence
  Description of Artificial Sequence: Synthetic polynucleotide
tggcgtgacggtttgtggggtttgcggggtgcgttgttttcggatttgcggggggaggcggttgagttggcggcgttcgcgggtttagtggtgagtgcggcgtttttacgtttagttcgacgttttcggagcggtcgtcgcgtaggggtgggcgcgggtttttaggagggagggcggttgtgaacgcgttttgtttttcgc

SEQ ID NO: 3856 - DNA, 201 bp, Artificial Sequence
  Description of Artificial Sequence: Synthetic polynucleotide
attacgtcgttcgtgtttattatttacggtacggaggacgaggtgatcgatttttcgtacgggttggcgttttacgagcgttgttttaaggcggtggagtcgttgtgggtggagggcgtcgggtataacgatatcgagttttatagttagtatttggagcgtttgcgtcgttttattttttaggagttgtttagttagcgc

SEQ ID NO: 3857 - DNA, 201 bp, Artificial Sequence
  Description of Artificial Sequence: Synthetic polynucleotide
gggcgcggcgggcgaggggttcgggttgagttgcgggtcggttcggatggcgggcggcgcgggttggtcgggcgttttcgcggttttgttgcgtttcgtgcgtcgtttgcgcgaggtgttcgaggtgtgcggtcgcgatttcgacggttttttgcgcgtggagcgcgtcgcggcgttcggattgcgtttcggttagggcga

SEQ ID NO: 3858 - DNA, 201 bp, Artificial Sequence
  Description of Artificial Sequence: Synthetic polynucleotide
ggcgtttttttttcgtttttggtttaggttcggttcgcgggtgtagttttttttagggttttttttttttttcgggtcgcgcgttcgtttcgtatcgcggcggtttttcggtagtgtttgtttttattggacgtatagtgatcgtgacgggtacggggcgcgagtttttattattataatgggtgtgtatggcgcggggcg

SEQ ID NO: 3859 - DNA, 201 bp, Artificial Sequence
  Description of Artificial Sequence: Synthetic polynucleotide
tttttttttaattgatttaattttttaattttagtttttcgtttttggtatcggtttttttttaagtttttagattttaattttggttttcgattcgtttcgttatagtttgggaagcgggagaagtagcgcgcgtttttttgcggatttttttttagggaagattgtggtgttagttgtttagggggattagggggttat

SEQ ID NO: 3860 - DNA, 201 bp, Artificial Sequence
  Description of Artificial Sequence: Synthetic polynucleotide
agtttaggggtagggggtttagggtagttagatttttttaggtttaggaagagtagtttttagcgttcggttgttaggtaattcggttttcggttttttacggcggttttttcggtgtgttttattaagagcgatagggttggtgattcgaggggcgcgtgcgcggtcgttagtttgggatttgtacggattttttttttt

SEQ ID NO: 3861 - DNA, 213 bp, Artificial Sequence
  Description of Artificial Sequence: Synthetic polynucleotide
gttttttgtttgaattaaagtggttaggtatttagtttgtaagatgaataaatgaaggaaagaaggaacgaatgaataagggtttattttgtagagcgttcgcgttttagcgcgtattaggtatattagtgttaaaggtgttgggggtcgggtttagcgttcggcgcggttggaatgggggcggcgaggagttttttttagttagtcgtaggg

SEQ ID NO: 3862 - DNA, 201 bp, Artificial Sequence
  Description of Artificial Sequence: Synthetic polynucleotide
gggaggcggtaggtagggggcgttgcggggcgaggtaagtgtagttcgtcgttgtttgtttgcgagtttggggttgcgcgtcgttttttatttagttgcgcgattcgagcgtcgcgtttatcgcgtttcgtgggttttcgcgtttcgaagggtcgggattcggtttgagttttttttggttttcggtgtaagtcgttgggt

SEQ ID NO: 3863 - DNA, 201 bp, Artificial Sequence
  Description of Artificial Sequence: Synthetic polynucleotide
cggggtattcggtcgtgtcgtcgtcgtcgttttagttgtcgtttttgttttcgttttcgcgatcgttgttagagcgtattattcgcgaggaggtggagggcgaaagtttggatttgtgtttgtagtagttttataaatagttaagtagttgggtttggttggtggtgggttcgcggtttttatcgcgtcggtttcggacgc

SEQ ID NO: 3864 - DNA, 201 bp, Artificial Sequence
  Description of Artificial Sequence: Synthetic polynucleotide
aaggggggtttggttcgttagcgtaggggattcgagttgggtaggatatgtgagatagttatagttttttagagattacgataagatttaattagtcgcgcgtggttttcggcgtcggagcgggttagtttagttcggtttagttcggtttcgcgtagagttttcgtcgttttcgcgtatagagtcgggtgttttttgcgg

SEQ ID NO: 3865 - DNA, 324 bp, Artificial Sequence
  Description of Artificial Sequence: Synthetic polynucleotide
ggtgggggtttgggagacggtcgaagggggttcgggtagaagtttcgcggtcgggtcggcggagggaagggggcggtcgcgttcgggattcggtttttttcggttttatttatttgtttcgaagagtggttttagttttgcgtttttttttgcgattttatatatagggatagttttaggtatagttttagtagtaggagtatggcggggcgagggcgcgggacgttcggggattcggcgggatacgttttgtagcgtttagggttttagttattgcgggacgttttcggggtcgtttatttcgcggttttagttcggatttcg

SEQ ID NO: 3866 - DNA, 201 bp, Artificial Sequence
  Description of Artificial Sequence: Synthetic polynucleotide
tcgcggtgttgtcgcgttaagcgaaggaggaggagggttcggcgattttggggacgaacgttttggacgtttcgttcgcgtttttttttcgcgttcgtcgcgcgtttgtttgttcggtttttttttcgtttttttttcggtcgttcgggttaaaatttaaggttaggtttttgagggttcgggttttttagtcgttttttt

SEQ ID NO: 3867 - DNA, 330 bp, Artificial Sequence
  Description of Artificial Sequence: Synthetic polynucleotide
ggattttggcgtttttttaggttgttgcgcgcgggttggggatcgtgtatcgttttgcgcgttagacgatgtattttttggaacggtagttgaggtaatgcggggtgtgaagtggcggcgggtagaggggttcgtaggggttgggattcgcgtgtttttttttgtttcggtgcggagtacgatgtgttcgggcgggggcgaggacgttcgggaggggttgggttgcgtacgttcgcggggtcgtcgtagatgggcggtttggaggcgttgtagtttttgggaaatgggagttttcgttttgttttttttgttgtttggttgggttgggtt

SEQ ID NO: 3868 - DNA, 293 bp, Artificial Sequence
  Description of Artificial Sequence: Synthetic polynucleotide
tttagtattttagtttttaagtttttttgagtcggggttgcgttttcgttgtttttttcggtcgtcgttttttggcgttagagggatttcgcggttcgtacgggtttgttttcggtttcgttcggagggtgtgcgggttttcgtttcgttggtttcgtttgtttattacggcgcgtttaaatttacgcggttcgcggttttttgcgtgttttgtcgatttcgggtcgtaggaggggttagtttcgtcggtttttacgcggggtttgcgtcggtagcgttacgggttggaacgc

SEQ ID NO: 3869 - DNA, 201 bp, Artificial Sequence
  Description of Artificial Sequence: Synthetic polynucleotide
cgttttcgtttcggtttttcgtcggtttggcgggcggcgacgtggggaggggtcgtttagaagtcggggtcgttcgggtcggggaattttttcgcgtcgacgtttattttttacgggtcgtattcgtcgaggggtcgaaaggggttttagtggaggacgcggtgggagttgggtttcgttttagttgtcgacgtcggcggt

SEQ ID NO: 3870 - DNA, 201 bp, Artificial Sequence
  Description of Artificial Sequence: Synthetic polynucleotide
tatttcgttaaagtcggataaagcgtggttagagtgcggtttagttttttagtttgcggttcggggaggagggtagcgcgggcgcgggttgggggtggcgcggggcggcgtttaggatttcggtgtaggcgagagtgcggcggatttgttttaagaggagagcgaggcggatttgttttaagaggagagcgtggggcgtcg

SEQ ID NO: 3871 - DNA, 226 bp, Artificial Sequence
  Description of Artificial Sequence: Synthetic polynucleotide
atggcgatgtttttatttttttcggtaggtttttttaattaaaaagttggaaacgggaattcgtaaataacgatttagggttttaaattatttgtaaagacgcgatggggaggggaatatttgcgcgttttaaaattttaatttcgaggtttttagtcgcgtttgattcgggagtcgggtgcgtttttagtgttcgcgtacgaattcggcgttttggtagtttcga

SEQ ID NO: 3872 - DNA, 363 bp, Artificial Sequence
  Description of Artificial Sequence: Synthetic polynucleotide
ttgtaagggattatagttataatttattaggtaattatatttatcgtattgtagaagttatgaatttggcgggcgtgggggggaaggggaagaagttcggcgagattagaggggaaattcgaaaaagtaagtttttgcggtagtagttaggaaatattcgttaggaattggttgcgattttaattttagcggttcgaagttttagtttttttatttttatcgcggtagagtcgttttcgtagatatttttcgaggagaatcgcggtttcgagggcgttaggtgagtcgcgtcgtttcgagttttcgggttacggtaggtcgatttaggcgttttcggttcgttcgtgttttcgcgttcgggtg

SEQ ID NO: 3873 - DNA, 201 bp, Artificial Sequence
  Description of Artificial Sequence: Synthetic polynucleotide
cggttcggtgggggtttcggcgagcgggagggcggttggggatttcggtcgcgtcgggcgcggggttcgggattcgggagatcgcgcggcgtcgaagttacgcgttagttttattgtttcgcgcgtttcgttttaggtttcgggtttttttttcgtatttcgtaaagtcgagattttttcgtagttttttatttcgagagg

SEQ ID NO: 3874 - DNA, 201 bp, Artificial Sequence
  Description of Artificial Sequence: Synthetic polynucleotide
tcgcgttttttcgttagtcgtcggttaggagtttttcggtttttgagtaggacgcgttaaagggagttgggaggtttagtagtttttagcgtcgttttttcgggtgacgtgacgttttttttggagcgcgggttcgttttcgttaagtttttatcgtaggtttttatagtcgagttacgggaagatgtaacgtcgggcgag

SEQ ID NO: 3875 - DNA, 267 bp, Artificial Sequence
  Description of Artificial Sequence: Synthetic polynucleotide
cgcggggtgggggcgcgggagtcgttttttgttcgtttcgcgcgtatgttttcgtcgtatttgtttcgtttagtgttttatatttcggggagtcgggtggcgttgggttcgtcgaggtcggggtttttttatgggagggaggtggttgcggcggaatttttagatgcgtttttttttgtattcgttttttgggaaggatttttttaaattttggttattttttgtttgttagtttgttttttggtagcgaagttttagtagtttatt

SEQ ID NO: 3876 - DNA, 707 bp, Artificial Sequence
  Description of Artificial Sequence: Synthetic polynucleotide
gcggtggcgtcggcggttgtagggggacgagttagcgtcgcggcgttgggagttagttgagttcggtcggcgagcggaggcggtagcgtaggtagagcggcggcggtagcgggagttcgagcgttgcgcgtttattatggtcgtttagggagagttcggttatttggcggcgtagtcggatttcggttttaatagcgagcgtagtatcgattttttagtgttcggtttcgaggacgatttggtcgtcggggcgattttgtatagttcggagtggagcgaggagcgttttcgcgtggataggaagaaatttgaggttatgttataaggtaggtatttttcgtgttttcggatttttcgattgagtttttaattttttttcggatatttttatcgcgcgtttcggcgttcgttattttagtttacggtcggtcggtttagttttaggttcgttttttcgcggagtcggaggatatttagggattggagatttcgcgggattttttatttttttacgttttttagatttttaggcgttgggggttttgtgcgaatttgattggttttagaaaagtcgaaggtcgagtttgtattggcgcgtttaagttgcgttttggattttggagatgttaattttagttcggatatttgggttgtgttattcggattattcgggtcgtatagagtatgcgtgattttttttatttttt

SEQ ID NO: 3877 - DNA, 201 bp, Artificial Sequence
  Description of Artificial Sequence: Synthetic polynucleotide
ggatttaggattttgtgttcgcgtttttggagtcgttggagttcggatttttgtaattgttggtattttgggggtttggtttagcgttttgttgtttattcgttttttttcgttgtttcggaattaaagttttcggtttttttcgttttcgcgcgtttatttatcgtcgtcggggagcggttcggttcgtatttagtatta

SEQ ID NO: 3878 - DNA, 201 bp, Artificial Sequence
  Description of Artificial Sequence: Synthetic polynucleotide
taggtttcgcgtttgattttttagtttgcgtagcgggtattcggtcgggaagaatttttttagtaggcggtttagtattacgtttacgcgttcgcgttcgcgttcgcgttcgtggtcgcgcgggttttagttttacgtagcgtttatagatcgtgagttcgtagggtagtgttatcggtttgtgtagtagtttcgggtagt

SEQ ID NO: 3879 - DNA, 201 bp, Artificial Sequence
  Description of Artificial Sequence: Synthetic polynucleotide
tattgggatttttatatacgagttggtatatattagttatatacggttaattttagagggttggttttttgttttgggacgtttttaggttttcgggtcgcggtgcggagaatttaggtgggtgttcggtaagttatttattaggggttgttttttcgcgattttcgttataagcgtagggattcgggggtcgcgttggtt

SEQ ID NO: 3880 - DNA, 201 bp, Artificial Sequence
  Description of Artificial Sequence: Synthetic polynucleotide
gaaaattgtaaaatttgggagttattttgttttatttttttgttgtttggggatatttttcgcgagtttgttcggtttcgaagaaggagtagaggggattcgtaatttagtttttagagtttcgttaggaaaggcgcgagagatttattggtttcggtaattttgtttcggcgttcggacggagttcgatgtttgcgtagt

SEQ ID NO: 3881 - DNA, 203 bp, Artificial Sequence
  Description of Artificial Sequence: Synthetic polynucleotide
agtttagagtgcgtcgagtatcgtttcggtaggtggaggggttgcgggaaataaaataatttgggtaggaatttgattggtagtaggtttatttttggttcgcggtagggaatttaatggagatgaagaatggtggggaagggggggcggtgtttttttgggagtttaacgtacgtttttttattttgttattttttggagat

SEQ ID NO: 3882 - DNA, 201 bp, Artificial Sequence
  Description of Artificial Sequence: Synthetic polynucleotide
cgcgcgttttttcgcgcgtttttcggattcgcgtttgtttattttttcggttttgttgcggtcgaggttttaagtcggttatttcgtgtttaggtaatcgcgggggcggcggcggcggcgtgaggagcgggcggttgttgtttcggggttttttggttcgagtttttagttttcgattttcggcgtttcggcgttcgatta

SEQ ID NO: 3883 - DNA, 201 bp, Artificial Sequence
  Description of Artificial Sequence: Synthetic polynucleotide
gggtttttagtttggtttttaggcgcggtggcggcggtgggatacgcgttaggcgtttagagaaggatatgggataatggtttagttcgaggacgttagacgtcgtcgttcgattcggggaaggaagtttttgtagtcggttcgggaattcgaggcggggagggaggttagttttggaggtgcgttgtcgttttaaaataa

SEQ ID NO: 3884 - DNA, 208 bp, Artificial Sequence
  Description of Artificial Sequence: Synthetic polynucleotide
gcgtcgcgtcgtcgttcggtttttcgaagtcgttttttgtcggcgcgtcggtcgtttgcgttacggcgggcgttatttatttcgggtagagttttttgttcgtgtagcgcgttttgggtttttagcgttgatttacgttcgtagtaggtgaggaaggcgtagtttggggaggaaagtaagcgttaagaagggttagtggggcgttttc

SEQ ID NO: 3885 - DNA, 201 bp, Artificial Sequence
  Description of Artificial Sequence: Synthetic polynucleotide
gtaggggggttttatttattaagttatgttttattagggcgttaggcgggcgaagtaaaggtagggatggcgggcggggcggcggcggaggtggaatgggcgttttttttttttatttggttttatttatttatttagattagaaaagcgagtcggtttggagggagttcgttcggggattcgagcgcgtatttattagtg

SEQ ID NO: 3886 - DNA, 201 bp, Artificial Sequence
  Description of Artificial Sequence: Synthetic polynucleotide
gcgtttcgtttttcgtttcggcggttttcgtagtttcgtcgtcgttcgcgttcgcgttttggagtcgcgttataaagggttcgcgcgtagtcgtcgtcgtcgtcgtcgtgcgaggagttaggatggttttggtttacgtcggttatttcgtgtttttagtgtttggttttgtgcgaaatagaggtatcgtttttttttttc

SEQ ID NO: 3887 - DNA, 595 bp, Artificial Sequence
  Description of Artificial Sequence: Synthetic polynucleotide
aggaggttaggaaagtttattatatgcgttggtttcggttgtcgtacggtatttttatggttatcgggatgatgagcgtatttattttgggttcgtggattgaggacgaggaggaagaggaggaggaagaagaagaagaggaagaggaggaggaggaggaggaggacgcgtttaggttgagatggttcgcgtggatattgttatttattttaagattgttgttttcgtcgtcgtcgtcgtcgtcgttgttgtcgtcgtcgtcgtcgttattatttgttatagttagtaacgggtagtcggcgtaggggttcgggggagtttttttcgtcgttagcgttattttaaatatttattaatagttatattgttgttattgttgtcgtcgtcgtcgtcgtcgtggagcgcgggaggggggcggggaggcgtttgggttcggggcgttgtgcgcgatttggcggggtgcgtcgagatatatatagcgagtcgtcgtcgttcgttcgggggggagggggatggagtgcgcgggtagtttttttttttcggttcgcgtttcgttcgtttcgggttgcgttggtttcgagcgtcgagagttagg

SEQ ID NO: 3888 - DNA, 201 bp, Artificial Sequence
  Description of Artificial Sequence: Synthetic polynucleotide
tatcgtcggcgtcgaggcggcgtttatgtttaatcgtcgtcgttatcgtcgtcgtttgtttttgcgttcgttttcgcgtttgttgttttttcgtcgtcgtcgtcgtcgtcgttattatagattcgtagatatatagttaagatttttgatttttaatattaatttttttttttggggaggggaggggacggagggaagggg

SEQ ID NO: 3889 - DNA, 269 bp, Artificial Sequence
  Description of Artificial Sequence: Synthetic polynucleotide
ggtgtgatgttttcggtggataatgtttttcgttttttgtttcggggtttagatagttggtgtttaagcgtttataatgtagagttttttgtatttttttcgggtcgttatttgtttatttgttttatttaggatatttttttaaataatttttaagtggaaaaattacggttttttaggagatttattcgggaacgaacgtgcgtggggtagtttaaatttttgagtttagatttcgtttttcgcggttagatggtgcggtcggtggg

SEQ ID NO: 3890 - DNA, 201 bp, Artificial Sequence
  Description of Artificial Sequence: Synthetic polynucleotide
ttagtttgttatcgtacggcggtcgggatcgtagtttttgggtgcgtagtgcgtttttcgttgcgtttttttagagcgcgggtttcgtgtttgtgttcggcgcgacgcgatttttttgttagtcgggtttcgcgtgtttttcgcgtttttcgtagttttcgcgtagttcgtagcgttttttagtttcgtttcgcggtcgcg

SEQ ID NO: 3891 - DNA, 267 bp, Artificial Sequence
  Description of Artificial Sequence: Synthetic polynucleotide
gtaggagtttcggcggtttgtaggggcggtggcgcggcgttgggcgcgcggtcgttagatggtagcgtagtttcggttcggttcgcgggaggcggttacgcgcgggggacgcggggcgcggcgcgttgagcgcgggtgtcgaggttggagggcgcggtcgggttttcgagtttttttttcgcggtatttttgtttttatttttaaatgttttgtaagttaggagttttcgtaggaatcgttgtatttttatttttttttaaatttta

SEQ ID NO: 3892 - DNA, 287 bp, Artificial Sequence
  Description of Artificial Sequence: Synthetic polynucleotide
ggcggtgtgtagagtggggtttgggttttttgtttttaagggtagttgggtgggtttcgtgtttttttcgagtggatttggtttcggttttaaatttagtcgagggtcggttcgtttttggggattcgcggatgtcgcgagggggcgtcgcgttattgaaggttgggacgggggcggtgcgcggggcggcgtcggagttcgggatgtcggttttagagacgtcgcgtttcgtttcgaggaggtcgtcggtcgggtaagcggagttcggagttcgcggagtttggatc

SEQ ID NO: 3893 - DNA, 201 bp, Artificial Sequence
  Description of Artificial Sequence: Synthetic polynucleotide
ggtttgtttcgagcgcggcgggggcgtcgggggcgtcggtttttattttgtagggtatcggcggcgggaggaggggtcggcgtttacgggttttcgttttcgcggcgtcgcggattaggagttggaattgttgcgggagtgtttgggagtcgtcgtgtttgttcggttgcgtaaggtggttttcgcgttggtgttaggtcg

SEQ ID NO: 3894 - DNA, 201 bp, Artificial Sequence
  Description of Artificial Sequence: Synthetic polynucleotide
gcgtttgttcgcgttttgtttaggtggtttcggcggtttcggcgattttttgcgagcgttgttgtttttgaaggcgttgtagggtttgcgcgtggagtggcgcgggcgggattcgcgcgggtcgggtcgggtatagcgtagcgcgggggttatcgtcgtcgacgggtcgtgcgcgttgcgcgagtttagcgtagattttcg

SEQ ID NO: 3895 - DNA, 286 bp, Artificial Sequence
  Description of Artificial Sequence: Synthetic polynucleotide
tttagggggcgttttcgagtcgcgtttcgcgttcgtttttaggagggttttcgcgagtcggttgtatatttcgaggcggtttcggttgtataatttggagcgagttgtttcgtttttttattttgggggcgaagaagggtcggggagtgggggaaagcgggaggcgtcgcggtttgggaggttttcgcgggttttagcgtcggtcgtattgcggtttttttcgcgcgtcgtcgtcgtcgtcggttttttttcgtttcgttttcgcggttttcggcgtttttcgcgc

SEQ ID NO: 3896 - DNA, 244 bp, Artificial Sequence
  Description of Artificial Sequence: Synthetic polynucleotide
tagtagattttggcgtggggtatttgagattttcgttattgaaaaggcgttatagaaatgtaaggaattatgattttaataaaattgttttatttaggagcgagtttttgcgttgtttttgtcgtcggagttcgggtttgttacggtaaagtttgtaattagagaaaaatattagttttgttgagggttagaatatattattggttaatgtgtgtggttttttttttaaataatgttaagtatt

SEQ ID NO: 3897 - DNA, 201 bp, Artificial Sequence
  Description of Artificial Sequence: Synthetic polynucleotide
gtgggtcggggatttcgttgttttgtttttttagcgggaaattgattgtttgagttttggaggataaatagagatattggggggttaacgggggcggtcgcgggcggggttttaggtttttatttatcgggttgttgagcgcgtacgtagttattcgagggaagattttcgtcgttcggggtttcggagaggggttagaat

SEQ ID NO: 3898 - DNA, 372 bp, Artificial Sequence
  Description of Artificial Sequence: Synthetic polynucleotide
gtggtattagcgaatgtggtggatttcggtaggtttggggtaggggaattttcggtaatattttttagtatcgaaggtaggatttttcggttattttcgtcggttggaatttttttaagtattgttttgagtttatttttaaatgaaagggggaaaaatttaaattagattagaatttgaaatagttgaaatagttatcgatttttagtttgtttttaagtttggtagagattgtgaaagttttaattttttcgcgatgttagttacggttcgcggcggttacggagttattttagtatttcgcgatggatagtgattttcggcgtggcgcgagttttttgcggtttttacgcgggtttgggcggcgggttt

SEQ ID NO: 3899 - DNA, 201 bp, Artificial Sequence
  Description of Artificial Sequence: Synthetic polynucleotide
agttagttttataatttgcgatcgatttttttttgtttagttcggttttagttttttttagttataagatggtaatagcgtcgatagtcgggtttcgcggcgttttgttttttttttgttttggtttggagttttttttgggtagttttgtatttatagcgttgcgttttttttagattgtgtagggagtacgggagggtt

SEQ ID NO: 3900 - DNA, 247 bp, Artificial Sequence
  Description of Artificial Sequence: Synthetic polynucleotide
gttttcggggggttttggcgttttagttgtggattttttaatattcgtaggttatagagttatagaggttggatttttagtagtagaggatatagaagaacgaagacgagacgtagagttttaattgtagttagagataaaggtttcgttatatttcggaagtcgttttgtttttttttgtttcgtgtttgattggacggtttttagtttagcgtttttgattggataatttttaaggttttgtttt

SEQ ID NO: 3901 - DNA, 201 bp, Artificial Sequence
  Description of Artificial Sequence: Synthetic polynucleotide
gatttggcgcggtttttgtttttcgttgtcgtcgaagttttaattttcgtttgtttgttttgtgttttttgtacgtagaagtttagtttgtgtggttttgcgatttgcgggtattgggagatttatagttaagacgttagggttttttggaagtttagaaatggtgagagtgtcggttcgatatttcgagagagggaacgg

SEQ ID NO: 3902 - DNA, 201 bp, Artificial Sequence
  Description of Artificial Sequence: Synthetic polynucleotide
ggcgttttagttgtggattttttaatgtttgtaggttagagggttatagaggttgggtttttaagagtaggggatataaagtagggaagacgagattaagcgttttagttgtagcgagagataaaggtttcgttaaatttcggaagtcgttttgttcgttttagttgcgtgtttgattggacggtttttagtttagggttt

SEQ ID NO: 3903 - DNA, 235 bp, Artificial Sequence
  Description of Artificial Sequence: Synthetic polynucleotide
tttggtcggattgcgcgtttagggtttttcgcgtttgttagttttcgttttgcgggtattttttttagtatcgggagcgcgcggttgttcgttttcgtcgcgatcgtggcgttagtttttcgttttttttgtttcgttttgagtatttgttttgcgtttttcgttgtaattttttatttttcgtttggattgcgggtttgggtgcggggtgttgtaggtttgtaggggacggggt

SEQ ID NO: 3904 - DNA, 201 bp, Artificial Sequence
  Description of Artificial Sequence: Synthetic polynucleotide
atttcgcgttttttagttcggagtttatttgtataattggattttttttttttgtttttttttttttttttgaaatttgtttgaaaatttaagtgaaaatcgcgacgatttgtatatttaaaagtaagtgttaagtaagtgttttgcggtggtttcggcgcgtttcggggtgagcgcgtaaagtcgggagcgaggtgtcgc

SEQ ID NO: 3905 - DNA, 201 bp, Artificial Sequence
  Description of Artificial Sequence: Synthetic polynucleotide
gggcgcggttttgggagcgggggaaggtgaggggaaatgggatatgatggtattaataatcgttattaaagacggtgggagtaataaaggaatgcgttttcgagacgtcgtttagtttcggggtgttttttggcgcggtcgcggtgtaggaacgcgagtttcgtcgtcgagtttttcgtcgtttgcgttcgttggcgcggc

SEQ ID NO: 3906 - DNA, 201 bp, Artificial Sequence
  Description of Artificial Sequence: Synthetic polynucleotide
gttcgggcgcgtcggttggggttttggcgttttcgtaggtttcgaggtcgatagtttcggcgagggcgggcgtttcgcgttttagtatcggttgtttgagcgtttttggagtagtaaattttagatttttttttttttttttttttttttttttttttttttttttatttttttttttttttagttttttttttttttttt

SEQ ID NO: 3907 - DNA, 201 bp, Artificial Sequence
  Description of Artificial Sequence: Synthetic polynucleotide
tttgttttaaaagtttatagtatgttttttttttttttagatcgggagatagtgattttatttatacggtaagattaaaagttttcgttcgtttagtttgcgggtttgggttgggtttagacgttttttaggatgtagatgcgtcgtcgttggttttttcggttataaagtcgtttttagcgttttttcgcgcgtaggagc

SEQ ID NO: 3908 - DNA, 201 bp, Artificial Sequence
  Description of Artificial Sequence: Synthetic polynucleotide
gggcgaagcgatttagcgcgaggattagtttttaattaattcgtttttagttttgggcgttttttttagtagttagatgggggttttagaggtcggtgcgcggttatatggtttcgggttaggtagggggtcgtggggacgtatttgcgttaggcgtatagtatttttgggcgcgggacgggcgaagcgtcgtgggtttta

SEQ ID NO: 3909 - DNA, 296 bp, Artificial Sequence
  Description of Artificial Sequence: Synthetic polynucleotide
tgtttttattttttatcggggttcggttggttagaggtaagtttcgagattttttattaattattattatcgttgcgagggtcggtgaggttgtagataacgtttgtaaggacgggagtcggggagggtgtagggcgagtttaaaggacgggtagagtaagtttcgggaagaggtaggggttttttttttcgggtcgtcgtttttcgtattttcggagttagtcgtagttacgtagcgtcgtttgtcgggtatattaaggatttggcgcgtacgtggcgtttatttttattttcgg

SEQ ID NO: 3910 - DNA, 201 bp, Artificial Sequence
  Description of Artificial Sequence: Synthetic polynucleotide
agtttacgggttagtttggcggggttcgacggcggcggcggtggcggtagcgttcgatttagcggtattagtttgggttacgattagcgttacggtagttcgcgtttcggtcgttcggattcgcgtttcggtttcgggtcgttttcggtgggtagcgttcgttttagcgtttttagtttcggttttcggggttcggtcggc

SEQ ID NO: 3911 - DNA, 201 bp, Artificial Sequence
  Description of Artificial Sequence: Synthetic polynucleotide
atttattggttgaaagtttcgtttattttagggtgattgagagcgttttttttttttgtgttgtttggaaacggattgttcgtttagtaatatttgattacgttttttattggttatcgttttcggaagttcgttttttcgttttcggaattttcgtaggcgttgggtttgtagatggcgtttaggtatatagtggcgagt

SEQ ID NO: 3912 - DNA, 266 bp, Artificial Sequence
  Description of Artificial Sequence: Synthetic polynucleotide
gaaagataaaagggaaagcgtttttacgaaattcgtttacggatacgatttcggggttatatttagttagacgaatgtttggtaaatgatagttattttacgttagatttttatagttttttatacgttatttttattgttttagggaattataagtataggtatcgtttcgttcggcgtttttttttaaagattggggtattaggatcgcgggtttttatttttatttagtataaagagttcggcgtttagagttagcggttttt

SEQ ID NO: 3913 - DNA, 201 bp, Artificial Sequence
  Description of Artificial Sequence: Synthetic polynucleotide
tcgtaggttatttgtgtgatttcggtgcgagtggaggttggtatcgtttagtgcgaggttgttatttcgtgtgtttgtttacgttttgtgtgattgggtgcgaggaagttaatggtatcgtggaatgtgaggttgtgagttgaggcgggagcgggcgattgttcgttgtattttgttgggtcgatattcgcggtttttttg

SEQ ID NO: 3914 - DNA, 228 bp, Artificial Sequence
  Description of Artificial Sequence: Synthetic polynucleotide
tagagtttaggatattttaggttttttttgattcgattggaatttattttttacgtttttttggttttaattaatcgttatttgtatgtataaatggaaacgatagggtagagggttagtagttattcgcgtttgggttcgtagtttcgggtacgttgtagtttcgtattcggttgtttacgttcgggattatttattgtgttttttcggaattgtttagcgtgtttt

SEQ ID NO: 3915 - DNA, 248 bp, Artificial Sequence
  Description of Artificial Sequence: Synthetic polynucleotide
agattttagatatttattttaaatttaggttttagcgttttgtaggggatttttattttggggcgtttatttttgattttttttttgggttttttcgttacggtcgagtttaagtggttgaagcgcggacgaggatgcgcggggtttcggtttttaattgtattataggtcgtatttacgaatttggttcggtatagttattatcgttcgggtttttaggttttagggttgtagaagtttagtttcgg

SEQ ID NO: 3916 - DNA, 387 bp, Artificial Sequence
  Description of Artificial Sequence: Synthetic polynucleotide
gaggcggttatcgtagcggtcgttaacgagtagttgtacggaggtgtagaagaaggaggttattgttatttttttgataagttgggggcgtgggaggtttcgggagttcgaagtcgtttcgagcgggggtgggcggtgagcggattttcgggtgttgattaggtgtttggtggtagagtagggaaggggggaacggacgtcgattttagggattttttattcgtttacgttttttggcgttggttatacgtcgtcgttttagtattaattggaggtttttagtggacgagtagtcgttcgagggtagtcgtttgagtcggtagatagcggttagttggggtagcggttcgaattgttttcgtaatacgttttttagtatttcggttt

SEQ ID NO: 3917 - DNA, 203 bp, Artificial Sequence
  Description of Artificial Sequence: Synthetic polynucleotide
cgttgtttttttgtgcgttatcgggggtttgttttgggtttgttcgatatcgtggttgttcgtttatttgagcgtaggtttttattttgtgttagggtcgcgcgtggttttcgtttgcggtttgttgggtttcggcgttataggtattgcggtttcggcgttcgtacgcgggggattgggcgggggttggagagtttaggtcg

SEQ ID NO: 3918 - DNA, 203 bp, Artificial Sequence
  Description of Artificial Sequence: Synthetic polynucleotide
gttgcgtttcgttgtttagttcgggcggtttatcgttttttttgtttgggtggacgtatttttgtttttcgtttttattggcggtagttttcgtggggcgcgcgtggggggcgttggggtttttagttttcgtttcgagttttttgtcgcggcgttgttagtttcgggggtttgggttttatttcgttttggttttgttcgta

SEQ ID NO: 3919 - DNA, 312 bp, Artificial Sequence
  Description of Artificial Sequence: Synthetic polynucleotide
gtcgggggggcgttcggggcggcggcggtggcggcgggcgggggtaggtcgggttgcgaatatatttcgaagttgtcgtcgtagtagagggttatgtcggcggtcgtgggcggttgcggcgcggtcgcggcgaggggcgagcggggttggtttcgtcgttcgggcgagagtatttttttgggggttaattttgcggtttcgtttttattcgcgttgggcgttcggtgtttcgggtcggggtcgggcgggtgttagcggagcgtttgttagtcggttttttataatcgagttcggcgcggttttttttgggtc

SEQ ID NO: 3920 - DNA, 407 bp, Artificial Sequence
  Description of Artificial Sequence: Synthetic polynucleotide
tttcgggaggtttaggggtacggcgaggggtcggggaaaggcgatcgtttattatagttcgcgcgtttagattgagggaggagtcgggttgtagaatcggcggcggatggagacgggagggaggttgcgaggtcgttcgaggagagattaaggttttagaaacggagaagcgggcgttttgcgggaggcggcggcgttgtcgttggtcgttaagggcgggaagtgttttgggatttttattaggggtcgcgagtttcgagcgttaaattttcgcggcgttcgtttagcgcgttgttgtggcgggcgcggagggcgcgcgtcggtagtgggggttgcggcggcggagggtacgggttttcgtttagcgtttttatttttttggtgtagttgtttttcgcgagtcgaga

SEQ ID NO: 3921 - DNA, 295 bp, Artificial Sequence
  Description of Artificial Sequence: Synthetic polynucleotide
gcgttcgtttcgcgcgtttttgtatttttcgcgtcgtttttcggggtttcgcggcgttcgtaggtcgcgtcgttttgtcgtttttttttcgtggtttttacggttcgttcgttttttagtagttttggggtgttcggggcggttttgtaagcgggagagagcggcgaggcggcggcgtcgagtgcggggggatgcggagtcgtgttcggttttgtcgtatttttcggtcgttcgttcgcgttcggtttcgttcggttttgttcgggttgtacgtatttttttcgcggtttagaat

SEQ ID NO: 3922 - DNA, 435 bp, Artificial Sequence
  Description of Artificial Sequence: Synthetic polynucleotide
tttggttcggtttggttagttttcgcggtttttgttcgggttgacgtttaggaatgtggtcgacgagaagttttaatagtacggcgtggttttttagtttcggtgagtattcgtcgtggggaagggttttggggatttattggaggtcgcggttcgtagtagttaggggtcgagttacggttacggacgttttggtgtttcggttcgtgtcgggtttttaggcggaggaggcgttcgttgggtttagattttcgattttagtttcggtttttcggcgtttgggttgcgcggagtttttgtttcgcgtttcggatttttacgcgtagtttttacgcgtttcgagttggagaagtcgttagttcgtttttttagggcgtgtcgttcgttttttgtttttttgtgcggggtatgtgaaatgtgtggggttagaattgt

SEQ ID NO: 3923 - DNA, 410 bp, Artificial Sequence
  Description of Artificial Sequence: Synthetic polynucleotide
tttttggagggaagttcgtcgggaagttgaagatagtggttatcgttttcggttattatttttcgggattcggattttaattttgcgttatatttttattcgtttttagtcgtgttttggttgcgtagttggaaaggttgagtagtttattgttgtttttttgttcggttttggatatatcgtttgaatttttgggcgtttttgttgttaagtgggggatagtattatttattggggaggaaaattttaggaatgtggattttggggttacgtaggggttgggaagtgaagggtagggaacgcgggcggcgttcggggtttgcgggtaggtaggcggtttggtcgcggaggttttttcgagttttgcgtttttttagagagggaggggtttatatcggttggtatagtta

SEQ ID NO: 3924 - DNA, 392 bp, Artificial Sequence
  Description of Artificial Sequence: Synthetic polynucleotide
ggagttcgttgggcgtgttcggttcggttcggtttcgtcgtacgttcgtttttttggtttggttgaggatttcggggtttggacgtgttaacgttattttcgcgcgtcgaagttgtgacggtttattaagtagagatttgcgaggtatatagagagggaatgaggcggaatcgttcgggggttcgttgatattgtagagtttttcgtagtatcgttgttttaaatttcgtttttttaggcgtgcgcgtatagcgagttagaggaggtttcgtttcgatttggggtttttcgcggtttttagttcgggggttcgggttttcgaagagatttttggtaatggtagaggttttaaagtttagatgttaagtttcgcgatggggcggatgttttta

SEQ ID NO: 3925 - DNA, 203 bp, Artificial Sequence
  Description of Artificial Sequence: Synthetic polynucleotide
agagaagacgttaggttgaggttttagcgattttaggtattagtttcgaaggagggcggggagatcgtaaaggggaagtgttcggagggttaacggttttcgcgtattttgcgtttttttgaagcgcgtcgttttttcgcgtcggggattgggatttgtttttggggaattcgtttagaagacggcggcggattggggtcggg

SEQ ID NO: 3926 - DNA, 398 bp, Artificial Sequence
  Description of Artificial Sequence: Synthetic polynucleotide
aaaattgcgggagtttatttattgcgtttaggtggttagtttttgagttttttttattcgtggttttttgtcggtatgtaggtatgtataagtatatcgtcgagtaggaggatttaacgaatttagtttgtggatatgttttaatttttattttcgttttttttaggtttgtttaggtgaggatgatgggagggaaaagcggtgtatagtcgtaatattggtattttgtaagagtcgtcggggtattgatatagagggatatcgtattggagatgcggtgtttacggagatttattgcgcgcggtgaaatattttaagtatcgcgcggaataattgggtttagtttttttatttcggattttttttaggattatacgttattttttattttcgaattt

SEQ ID NO: 3927 - DNA, 286 bp, Artificial Sequence
  Description of Artificial Sequence: Synthetic polynucleotide
tgtagagtttgaattttatcgtttagaaggaaaggtgagtgggggattcgggcgggaggtgaggtttgtcggtagcggtttttaggcgtgttgggtagtacggttagtagaggcggcgtttggttttggatgttgtagcggagacgttaaggagattgaatgtagggagcgaggcgtagcggtcgcggagggtggggtcgttcggaaatttaggcggcgttagttttgtagtatttgtaggtcgggggcgcgtatacgaggggtacgtgggtgtggaggaatcggc

SEQ ID NO: 3928 - DNA, 267 bp, Artificial Sequence
  Description of Artificial Sequence: Synthetic polynucleotide
ggttgttaaggaggcggggtggttagcgcggggggtggaggatgggggtaggacgcgggagggaagggtagggggtggggggcgaggtttcggggattagcgcgcgagagtgtttagttgggaaatgtagtttcgaattaatatcgtatgttttataattagtttacgagtcgatgtggggaaagttatttttagatggggaagagtagttcggatttttttaaggacgttttttagttagattagggaggggagaaggagatgggg

SEQ ID NO: 3929 - DNA, 260 bp, Artificial Sequence
  Description of Artificial Sequence: Synthetic polynucleotide
tagagtcgtttgtatttgttcgtattttttgggaggttgcgatgatcgtagttagggtggtcgagcgttcggtttattgtattcggcggttgttttgtagcgtttttggtatttagggaatggtttgtaaattttaatgtattatagattagtttttatcgtggagtaggaaaggcgtttattagttaggggtaatcggttttgtagatttgggcgggggcgtagggggaggggcggtggtgtaaatttatcgtgatttt

SEQ ID NO: 3930 - DNA, 239 bp, Artificial Sequence
  Description of Artificial Sequence: Synthetic polynucleotide
gaaggtaagttttaaatttttgtttggaagacgggttgtcgcggttgtattattagtaggaggaggaggagaagaaattatttcgcgatattttattttgcgggtgttttgtcgttgtcgtttttgttgtcgtcgattcgagttcgcgggttcgaatatcgtagcggtggggacggtgggttcggcgggcgtcgggaggaggatattagcggagttttgtattttcgtgtttcgtttat

SEQ ID NO: 3931 - DNA, 846 bp, Artificial Sequence
  Description of Artificial Sequence: Synthetic polynucleotide
gttggcgggttttggttttcgaggacgtagatatgtggtttgaattttcgtttttttagtcgttgtttttgtgtatttttttgggcgtttttagcgaatgcgagcggcgaggcgagggcgagcgcgtcgaggaagggcgggagaggcgcggagtttggtcgcgtcgcgttgcgtcgagcgtcgggtttttttcgcgagtttttcgggttcgcgcgcgcgttttttattgttttcgtttttcgcgcggcgcgtgttttttatttttcgtcgcgcgttttcgtattcgttcggttttacgcggcgcgcgtttgttttggcggtagcggcggcggcggcggcgcgttttttttcgaacgtcgtttttagggttgttggttgcgttttttattgtttcgcggttgttgttcggggtgggcggcgaggcgggggggaggtgtcggtttggtcgtcggggagggtttatcgttcgggcggatttttattgcgagagcgatgcgggtttaggcgcggcgcgcgggggttgtagggcgtttagtattgggggttgtcggcgcgcgggggtttttttttggtttttaggtattcgttgttgttgggcgtttttcgtattttcggttattatggatatttcgttttttcgtcgtttttttcgcgtatttcgggaggtcgtcggggcggtagtagcggcgcggtttcgcgggtgtttaggtgatcggttcggtagcggtagagtagtggtagtagtcgttattgtcgttgttattgcggtcgtcgtcgttggagagaggaggacgaggagggtaaggggtagaagtaggttttgttttgtttgttttagaggttatt

SEQ ID NO: 3932 - DNA, 526 bp, Artificial Sequence
  Description of Artificial Sequence: Synthetic polynucleotide
tgttgttttttttcggcgttttgtttttttataattggaagtcgcgaaggcggttattgcgttgagtcgttcgttttgttggttaagtttgggcgattcgcgcggaggagggtcgggttgattgtcgtcgttgagttgttttcggacgggagcgtttgtttacggtatttattttttttagcggtggaaatgtggagaagtaagtgggaggcggtgtcgggaattgattttttttaaaacggtcggcgtcgttgttttgaaatgggcggttaagtgtttgtgggattaagggcggttttagagatgttcggaaaatcgttgttacggttagagtgcggcgtagacgcggtagagttggaggtgttcgcggtgtaggttgttgtttacgtcgtttaggttaggtgttgagggtttagttcgcgtttcggtcgaattatttttagtttcgttgagttatttcgttcgttcggtttttatcgtatcggttagaggaaagttttcgcggtttttacgtttttttatagtt

SEQ ID NO: 3933 - DNA, 201 bp, Artificial Sequence
  Description of Artificial Sequence: Synthetic polynucleotide
gtttcgttcggggatttagggaggagggagagaggagggagggagtgggtagtttgggcgtacgttatcggttttcgtacgttcggtatttttcgtggcgcggcgagttaatgggatttgtatattcgaggtgtaatagtattattgtattaattattatttttattttacgtttagattgtttatttatttgcgggaaat

SEQ ID NO: 3934 - DNA, 523 bp, Artificial Sequence
  Description of Artificial Sequence: Synthetic polynucleotide
tgttttgtacgcgtgtgtacggttcgtacgaggcggtcgggttcgttagttttttgattatagcggtcgcgttagggttatcggggttcgcggttgtagtcgtagttgttgtagtcgttgcggttgtcgttatttggtaggaggtatagggtatgggtgagggaggttgcggtagcggttacgagttgttgaggaagttagattgtaggtatttggggggcgttaggtagtcgtagtcgtcggtttcggcgttcgttacgtcgtattcgtttgcggcgttttcggtttcgaagagttttttgtcgggttggaagtgcgcgggcggcggtcggaagggtttttttatgcggcggcggcgtcggtagttgtttttttcgaatatgttttcgtaggtcgggtttagcgtttagtagttgtttttgcgttcgtcgtcgttttcgcgcggtattttgatgaagtattcgttgaggttgaggttgtggcggatgttattttgttagttttttttatttttttcgtagaa

SEQ ID NO: 3935 - DNA, 276 bp, Artificial Sequence
  Description of Artificial Sequence: Synthetic polynucleotide
gttattttttttttttcgtgacgttacgggtcgtttcggggtgagcgtttgagtcgtttcgggttcgcgttagtgagcgcggttgttgtcggcgagttagcggcgtagcggcgggaattcgaggtcgagcgtcgcggcggtagcgttagaagcgtatttatcgggtacggcgaggcggtttacggtgcggtaggtatcgggaggcgagagtcggcgcggatagtaggcggcggttgtagttcgttggcggttgttgcgaggatgttgtttgggcgg

SEQ ID NO: 3936 - DNA, 357 bp, Artificial Sequence
  Description of Artificial Sequence: Synthetic polynucleotide
aggagggaggtagggtaggtttgagggtgaaagcggtaaggatttaggtttaagttggatttgtttatttttttttgtcgtagtttttttggtttttgtgcgttttggattttcgaagttagttttttgcgtagcggattagagaggtttattcgcggacgttaatttaatttttgggcggggttcgggggttgagtagaaggcgaggtttggggagtacggataattttgagggttgtttgtgtcggggtgggagcgtagtgggtgagtttcgagttttggtttagggacggttagagtagggcgttggcgcgtcgtggggataagtaggtgtttgtttttgtttgggggaaggat

SEQ ID NO: 3937 - DNA, 278 bp, Artificial Sequence
  Description of Artificial Sequence: Synthetic polynucleotide
tcgggcgttgggtagttttcgtcggtcgtcgtcggagtttttgtgtttacgtcgggggcgtcgttgtaggtttaggagaagattcgtgttttcgagtagtcgtttttaaaaattaaataaattaataagagaattaattaataggtagcgttgcgatcgttaggagcgcggagcgcgcgaggtttagcggttttttcgttaagtttttgttatcggcgcgcggtcgttcgcgttgcggtagcggcggcggcgcggttgattgcggcggtagcgcggta

SEQ ID NO: 3938 - DNA, 336 bp, Artificial Sequence
  Description of Artificial Sequence: Synthetic polynucleotide
gtttcgtatgtggggtataatgaaataagagtagtttcggttagaggtttagtaaagcggaaagacggtttcgttcgtatattttttcggaaaattgaagcgttttttttgatttttaaggttagaaagatttattatttttttcgagagggcgtagttatagatttattagagagggcgggtagggtgtcggaagttagagaacggcgtttcgcgtttttttatcgttttagggcgtagaggtgtttttagtgttcggagaggttggtagtgtcggtttcgagggaagcgtggagcggacggtcgataggggatttttgtttaaattttattatt

SEQ ID NO: 3939 - DNA, 311 bp, Artificial Sequence
  Description of Artificial Sequence: Synthetic polynucleotide
cgcgtgttttgttttcgtagtggtttcggcgtttaggacgtcgttggttcgcgttttttttcggaatgaaggtgtttcgtaggaaggcgttggtgttgtgcgcgggttatgtattgttgttggtgtttattatgtttaattttttggattataagtggtataaggagtcgttgtagtagtgtaatttcgatgggtcgttgggtgtcgtagcgggggtagtcggaggtagttgggggcgtttagggtcgttttcggtcgggtcgtttcgtgtttatgttcgtttggattttcgtattttttatcgttttttc

SEQ ID NO: 3940 - DNA, 201 bp, Artificial Sequence
  Description of Artificial Sequence: Synthetic polynucleotide
tataggtaatagagataaggttaggaggtaaagtatatttatgtgtaaatgagacgcgttagggaatttgtaattttttgtattttcgtttttgatgtttcgatttttataattatagaattttaggtagaggtcgtcgattttttcgttttcgttaagagggattcggagtatcgaagttttttagtcggtgtcggcgtt

SEQ ID NO: 3941 - DNA, 201 bp, Artificial Sequence
  Description of Artificial Sequence: Synthetic polynucleotide
aaacgtttttttagaaaataagttattaatcgtacgagagaaggagaggaaggtagtaatttaattttttgcggttcgcggttttgaagattaggaggttcgttttagtagggtgaggtttatagaatgtatcgcgtcggttgcggttttttaggggtcggttattcgagttttggaatttcgagaggcgcgaagtgggag

SEQ ID NO: 3942 - DNA, 481 bp, Artificial Sequence
  Description of Artificial Sequence: Synthetic polynucleotide
cgcgattgtatttggggtagtttcgtcgcgttttagtcgtttttcggtaggaagcgtaggtgtgtgagtcgattcggagcgagtcgcgttttcgggttagcgtgggtagggcgtcgtagtttgcgtagtttcgaggatttcgcgtcgttttttcgagttagggtttttaggagcgggtcgcgtaggagacgttagagggggttgttagcggttgttgggagaacgggttacggaaatagttttttttaaagtcggggttatcgtggggtgggcgagttcgtttttttaggtcgggggcgcggattagaggggacgtgtgtagacggtcgcggttagttttatttcgttcgggcggagacgtatagttggagttggagggtcgtcgttcgttgggtttttaggggtttgaacgtttaggggtcgcggcgagtttattcggagcgagttaggtgagtaggtcgttatggcgatgcggtttcgg

SEQ ID NO: 3943 - DNA, 280 bp, Artificial Sequence
  Description of Artificial Sequence: Synthetic polynucleotide
taggttttttggggttatttcgcgaggtagtcgagggcgtaattcgggcgtttggggtcggaggcggaattaggggtcggggttaggaggtaggtgtaggcggttgttaattcgtttaatttgttgcgcgggtggtcgtttagagtcgcgggtttgcggggcgtttttcgtcgtcgcgtcgtcgtttttttaggttcgggagggggcgtttagggtggagttttatttatgggttgaggttttgggcgcgcggagtcgtcgtcgttttttcggttggttt

SEQ ID NO: 3944 - DNA, 252 bp, Artificial Sequence
  Description of Artificial Sequence: Synthetic polynucleotide
cggagttttagttacgaattatttaatattcgtaggttatagagcgacggaggttgaggttgtgatcgaattatcgacgtttttttgaggggtgaaagtacggtcgtggagattttaatcgagtttacgttggcgtaaaaggtaaaagtcgcgttagatttcggatgtcgttttttttttttcggttgcgcgtttgattgggtagtttttaatttagcgttttgattggataagatattaagttttttacgt

SEQ ID NO: 3945 - DNA, 239 bp, Artificial Sequence
  Description of Artificial Sequence: Synthetic polynucleotide
ttatttgcgtgttgttttcgggtttcgtttcgtttcgtttcggagggatttttaggtcgggtttagatttaggagttatttggggatttcggggtggttgcgcgtcgagggggcgttagcggggacgtgagttggcgtcgagatagtttcggttttttagcgttagggttattgttaggagattttcggttagtatttacgtggggcgttttcgggagttcgaggggtttatcgtttgt

SEQ ID NO: 3946 - DNA, 405 bp, Artificial Sequence
  Description of Artificial Sequence: Synthetic polynucleotide
aagtttgcggagcgggtcgcgtttttggttcgttcgggttttaagtttcgcgtcgtcgttttggcggggacggtgtagtaggcggcgggatgcggcggggcggtagtttgagcgtttcggatggttcgcggcggggcggtttgtaagagcgacgcgcggttgttgttggggcgggacgcgttgcggtcggcgttcgttttgttggttttcgtcgtgttgttgggcgtcgcgttcggtttcggtttcggtttttggtttggttgtcgcgcgggtcgttagcgtacgcgatattaggtgggtcggtcgagtagatagcggcggggcggggagcgcggggcgcgtggtttttgggttttgcgggttcggagtttcggttttgcgattttttgagtttggttgggaatt

SEQ ID NO: 3947 - DNA, 237 bp, Artificial Sequence
  Description of Artificial Sequence: Synthetic polynucleotide
cgcgtacggtggtgtaggagtttcggtagtttagcgtgaggaagttcgagcgtttgttttgcgcgtcgtcgtcgtcgttattatcgtgcgttttcgggttcgagggtacggcggtcgtcgtttcgcgtagtagtagcgcgtcgttgttattttgcgagacgttgttttttaggtcgttttggtagttttcgtcgttgagagagttttgtttggtgattttgggcgatagtagtttga

SEQ ID NO: 3948 - DNA, 204 bp, Artificial Sequence
  Description of Artificial Sequence: Synthetic polynucleotide
cgatcggggcggtttcgtttagggttcggggtagcggcggcgtcggcggcgttcgagttttatcggaggagagacgcgcgagagaggagtttcgtcggtgcggcggcggtaatggagaggtaagaaggagttgttgtttttttggggcgagggcggggaagtgtgagagagatttgcgagaggttttagggttgttgttcggtt

SEQ ID NO: 3949 - DNA, 224 bp, Artificial Sequence
  Description of Artificial Sequence: Synthetic polynucleotide
aggattttttattggggttgagtttttttcgtttttaatagaatttttaaatataagtagtttttttttgtttttaggagtttacgaaacgttgttatatcgagcgaatgtaacgcgtatatacgtttatattcgaatagtataagtaagagatcggttgggtgtggaatagaggcgtatatcgcgtaacgtatttatagtatgtatacgcgcgtatttcgatt

SEQ ID NO: 3950 - DNA, 278 bp, Artificial Sequence
  Description of Artificial Sequence: Synthetic polynucleotide
gttttttattcggcgttttttaggatttttaaagacgttcgtttagatttataggtatttatttgagtttttttgtttttttataatttcgattttttttcgtttttttttttttttaaaaaaaaaatttaaataatttttaaataatatttaataggaaagaagaaggaaaaggagcgtataggaagggcggaggcggtattcgggggggattgtttttagaggaggtcgttgtgagtcggcgacgcgaggttgggggagtgggaggtaaattcgtt

SEQ ID NO: 3951 - DNA, 232 bp, Artificial Sequence
  Description of Artificial Sequence: Synthetic polynucleotide
ggtggggtaaaaagtaagacgaaatttatttagatagttttttcgatttttagaggatcgatatttttttcgagggttttaatagtggtcgtttagggttcgagggtaacggtcgaggcgttacgcggggtcgcggttcgttttggttacggaggatcggatttgttgcgtttttgtgagtttgttttatttttatttattcggtgtttttcggtacgtcgatttgtttttt

SEQ ID NO: 3952 - DNA, 331 bp, Artificial Sequence
  Description of Artificial Sequence: Synthetic polynucleotide
aacgcgtttcggattttatttttgtacgtgtagttgtttttggggatgagggttatttagtttttgtcgcgggtcggggcggcgaatttggtgttggggtcgtaggttaggcggtcgtgggtcgagttggttatgattattttttcgcgggcgttttgtttgggcgagtgtttttcgtagcgttcgtatttcgtttttttcgtgtgtagtttcgcgtcgtcgtcgttcgtcgtttcggtttcggggttcggcgcgggttcggcgtaggtgatgtttacgaaggcggtgtattatttttttttttcggttacggtaaagtttaggtagagta

SEQ ID NO: 3953 - DNA, 231 bp, Artificial Sequence
  Description of Artificial Sequence: Synthetic polynucleotide
gcggttatggtggtttcgggaacgggttcggggagggagggcgcgggaggacggcgagtcgggggtatcggaggggaaggcggcggcgtagatcgtggttcgttttcggggtagaggagggggtgttaggcgggattggggagaggggaaggggggtttagttttgatcgggatttatcgtttttttcgcggggcgcggggttaggcgcgtagatgcgtttagggcgtagt

SEQ ID NO: 3954 - DNA, 201 bp, Artificial Sequence
  Description of Artificial Sequence: Synthetic polynucleotide
ttcgtagtggttttttttgtagtttttttgggtttcgcggttagtagtgtagttcgtggagtcgcggttttgttcgttttttttgggtggttttagtgcgcgggttgatatttatttagtcggggaaggtgaggcgagtagaggttggtgcggaatttgtcgtttttagtagcgtcggcgggttaagtttagggtcgggta

SEQ ID NO: 3955 - DNA, 201 bp, Artificial Sequence
  Description of Artificial Sequence: Synthetic polynucleotide
agtttaggagttcggggcgttcgcggcgggtatgaggcggcgtcggcggttgtagtaagaggacggtatttttttcgagtattatcgttatttcgagttgcgcgaggcgttcgtgttcgtgtggttgtagtgtatcgttattagtaggatttatacggtggggcgtagtttcgagggtcgggagtttttggttatcgagtt

SEQ ID NO: 3956 - DNA, 219 bp, Artificial Sequence
  Description of Artificial Sequence: Synthetic polynucleotide
cggttggcggtgtttcggcgttttatcgggcgcggtttttttaggttcgggggttcggcgttcggcggtattttttcgtaatgggagtggtttaggtcggcggcgtcgttggtatattcggggttgtaggatagggttatgttgtagtcggggggcgatatttcggggtggtcgatgagttagttatggaagtaggggttttttttatggttgtagcgg

SEQ ID NO: 3957 - DNA, 284 bp, Artificial Sequence
  Description of Artificial Sequence: Synthetic polynucleotide
gcgggaggagggcggcggggcggttggcggcggcggggttcgggagcgtcgcggcgtaggattttttagagcgcgtcgggttgagcggcggcggcggcggcggcgggcgtaggggtagggtatgattgacgcgttttttgtttgcgtttatgtgagagaaagcggtcgagggagggagcgtgtcgagttcgggttgttttttttttttattttttttcggaagtcgtttttttggagtttttcgtttttttcgtttttttttcggcggttttatttttttcggt

SEQ ID NO: 3958 - DNA, 429 bp, Artificial Sequence
  Description of Artificial Sequence: Synthetic polynucleotide
ttttttttcgggtcgcgatattgattcgttaacgttaatgggggttcgcgattgttgcggggacgagggcgtagagtagttttcgttacgggtcggtttacgtaggggtcgagaaagtggcggagaggcggtggtcgaggtttaggggcgagcgcgggttgagttggtttttgttgcgtttacgagcgatatttattttttcgttgcggacgtttcgcgggcgttaggttgggggttttgcgatcgatttttttcgttttcgaggtatcgtcgggttcgtttggtaggtagcgcgtttcgcgagttggagggtcgagtttcgcggggtcgtggggcgtgtgggtgaaggcgatatttcggatgcgggacgtatgaatggtggtagagtaggggtcgggattcgtttatgggttgggagagagatgtttt

SEQ ID NO: 3959 - DNA, 283 bp, Artificial Sequence
  Description of Artificial Sequence: Synthetic polynucleotide
ttcgttattattgtttaatcgagaattagtaacgtttttcgtcggtttttattttacgtcggaatggatttttagaatttattgcggtcgtaagatagttcgtaagagttggttaaaatgtttttaggtgcgtgggggtttcggggttttagttggagttcgatattttgagattggcggttcgagggttgtagggtcgtttcgggcgtgcgtttatcggttttgtatttttgggtagtcgagtgtcgcggagaacgttttattttttttatcgcggtttttt

SEQ ID NO: 3960 - DNA, 241 bp, Artificial Sequence
  Description of Artificial Sequence: Synthetic polynucleotide
tcgtttatatcgttttttttttgtaggtgaggaatggggtttgtttcgtttggaatgtgtttttgtcgggttttgtttgatttttattttttagtcgggacgcgcgagttttttcgtttggttgagttaaaaagggatcgcgcgtatttcgtcgttttttattacgaagcgtagatataggaggttgtagggttagtgttgcggagaattttagacggttttatagtcgtcgttattcgcg

SEQ ID NO: 3961 - DNA, 244 bp, Artificial Sequence
  Description of Artificial Sequence: Synthetic polynucleotide
tcgtcgtttttatttcggggcgcgtaggtcgaggaggatttcgttgattacgaagagtttgaggatttttcgagtttgttagatattcgtagtatcgtttcggacgattttttttattttttcgaggacgaggaggagtacggcgtcgagagcgcggagagcgtttcggagggcgtttcggaaagcgtttcggagacggcgatttttttgcgcgtcgtttgcgttaataacgtggggttgttgc

SEQ ID NO: 3962 - DNA, 225 bp, Artificial Sequence
  Description of Artificial Sequence: Synthetic polynucleotide
ttagttcgggaagaggcgtgcgcggcgtcgttcggttttagggtaaggttttgattttgtttaattgtagtatttttcgtttttgttgtttgagcgcggtcgcgggataagggatgttggcgggcggtaggggcgagcgtcgcgggcgagaggcggttttcgacgcgagtgcgtagcgttcggttcggcggttttttcgagttcggcgagcgtagcgttttttgt

SEQ ID NO: 3963 - DNA, 249 bp, Artificial Sequence
  Description of Artificial Sequence: Synthetic polynucleotide
gagtttggggtcgtcgcggcgttcggcgtcgagcgttttcgagttgcgtttcgcgcgcggttcgcgttatttgtgtcgtcgtcgttttagtcgtcgagggcgaggtttttttcgcggcgcgcggtagttttagtttttatttaaatttcggcggtcggttcgggcgttcggttagtgagggagcgttcgtttcgtcgtcgaaatcggtttcgggtgcggagtatgtttagtgtcgtcgcgagagcggcg

SEQ ID NO: 3964 - DNA, 255 bp, Artificial Sequence
  Description of Artificial Sequence: Synthetic polynucleotide
gtatagtagatggtacgagtacgtgcggcgtttagtttaggttttcggaggtagttgagttggaaatttcgacggaaagtatttataagtttttattttgcgttggtttattcgcgtgtacgtttattttttacgcgcgtttttggtttagaagcgtatagatgtttattgtttagagtcggtatcgttggggagatcgagcgatttgcgcggcgtatagtgcggcgttggtagggttttgggttttcggtcggg

SEQ ID NO: 3965 - DNA, 243 bp, Artificial Sequence
  Description of Artificial Sequence: Synthetic polynucleotide
ttagtagcgtcgtcgttttttagcgtcgatgttttagtcggcggggcggttgaggggtgagggggaatttcgcgggcgggggcgagggagcgtgtgtgcgcgagcgtgtgcgcgcgcgaggggagcgcgtgcgcggtgaggacgcgcgtcggcggttggggcgggggcgggggtcggggcgtttttgtgggaagggaggggtgaaaggtcgttggttttcggtaatacggtttaggtaaacgt

SEQ ID NO: 3966 - DNA, 201 bp, Artificial Sequence
  Description of Artificial Sequence: Synthetic polynucleotide
tggagagaaatgagttggagagttatatcgagttaacgcgggatacggttttcggttcgggtcgggttaggggtgggaggcggttttttatcgtaggcggcgggatttttatgcgtcgagggatttaagtttttattttatttatacgtttattcggcgtcggggcgttgcggtttcgttttacgagtttagagtaggtcg

SEQ ID NO: 3967 - DNA, 208 bp, Artificial Sequence
  Description of Artificial Sequence: Synthetic polynucleotide
gtcggatatttttttttaggattattcgtattttatagtcgcgttaaaagcgttttatttttttgtttttcgtcgcgtaggttttttatcgacgttcgttcggaaggcgagagtttttacgtggttcggcgcggcgcggttttcggggatcgcgagtaataaaagttcggttcgtagtttttgtttttcgtttttttttttaattttt

SEQ ID NO: 3968 - DNA, 257 bp, Artificial Sequence
  Description of Artificial Sequence: Synthetic polynucleotide
tttagtttttcgtaagtatttttttcgtttttttattttttttagtttttagtcgtcgtcgttttcgtagtttcggtttcgcgttttttcgtagtttcggcgttcgtttattcgttaggtaggcggtggtgtcgatttatttgagtagttgtttcgcgtttagttcgtcgcgcgtagtggcgtgcgtcggttggatggtttggtttatgattatttcgtcgggcgtcggtcgttttatggttagggcgagagcgtta

SEQ ID NO: 3969 - DNA, 350 bp, Artificial Sequence
  Description of Artificial Sequence: Synthetic polynucleotide
gaacggtttagtttaggttttgcgttagagtatcgtattcgggggcggacggttttgtagttttttagttttttttcgtattaattagttgacgttcgggcgtattggtttttttcgttttcgttcgtacgaaagttttgttcgacgtttgtagttagtatcgttcgtattgtttagggagggtttgcgtcgagatttagtggtcgagtgagttatagagtcgttggttttggggacgttgttttttatcgttttttatcgttttttttttttttgtattttatttcggtatttcgtattttttttttcgttcggtttcgcgtattttgtttagattttataagtatttt

SEQ ID NO: 3970 - DNA, 216 bp, Artificial Sequence
  Description of Artificial Sequence: Synthetic polynucleotide
attaaattaggggttgggagtttttagattgaaatgcgttttttattattaagagggagtttacgcggtcgcggggggtcgaggtagttagtcggcgtcgcggttttggggagttcgtgtaggggtgtgttttggtgtgaaatttggtaggattttgtttgggtttgtatgtagggaggggttagagattttgaaatgtattagcgggtagggtgg

SEQ ID NO: 3971 - DNA, 269 bp, Artificial Sequence
  Description of Artificial Sequence: Synthetic polynucleotide
ggtattgttgttcgaacgaacgaacgaacgaacgaacgaagcggtttcgtttaggaaaaatatttttttgacgcgaagttacggttgaagtttcgggttacgtagaggggttagtaattttatgggtggtggggttttttatttttggacgtagcggggagtagcgggcggtttttttttttgtttattttttttgggggtgggggagttttgtgttattcgacgttgcgaggggttgttacgggttttttaggttgtgtttttcgcgg

SEQ ID NO: 3972 - DNA, 258 bp, Artificial Sequence
  Description of Artificial Sequence: Synthetic polynucleotide
agatcgggtttttgttcgttttttttttgcgtttcgggatgaggtagagattgaatagtcggcgagtaaattaacggtatttagaaagttatgtcggattcggcgtttagcgtttaagcgttaattcgttgaaagttttttagcgaaattttagggacgatttggatttcgttgagaggaattgtttttgagtgagatggttttagaggtttggaggagcggattggtaagtatcgggagggtagtgggagttttgtt

SEQ ID NO: 3973 - DNA, 224 bp, Artificial Sequence
  Description of Artificial Sequence: Synthetic polynucleotide
tgtgttttttttttttttttttttttttttttttttcgtcgtttttttttttttttttattttttttttttgttcgttttttttttttttttcgcggtcgcggttcggatagaggttatttagcgttttttcgtagtttttcggagagtatgtgattaggtcgttagtagcgtcgcgagtgttcggtaatggtagggatggtgttttaaatatttttggaagtt

SEQ ID NO: 3974 - DNA, 256 bp, Artificial Sequence
  Description of Artificial Sequence: Synthetic polynucleotide
cgttatttcgcgttagtgtttgagttgtaattgtaaattgcgcgttttggtacgagtagcggtgggggcgggtgggggaaggagcgagtgattttttaggcgtttttcgttatttgatattagttaggtagtttttagggttagagcgttagcgtcgaagttaggtttattcgggaagttatttcggtggtcgcggggtgtttatgttagtattagattttttttcggaaggaggagcggggcgggttatacggtt

SEQ ID NO: 3975 - DNA, 310 bp, Artificial Sequence
  Description of Artificial Sequence: Synthetic polynucleotide
gggaaggggcgttaatagggttattatttcggggtttcgttattttttagtcgttttttttttcggagattttgtttgttaagagttttgttttttgtttcgtttagggttggggttcggtgggaattttttcgtgttcgaagggacgatttcgttagagagtttttcgatttttgtatttatcgtttttggtaggacgtggagttgttcggaagttatttcgggttggtttttttattcgtgtgttacgatttttcggcgggtttttgtcgttcgagtgtttttatcgttagttttcggagcggcggag

SEQ ID NO: 3976 - DNA, 410 bp, Artificial Sequence
  Description of Artificial Sequence: Synthetic polynucleotide
aggataattgggacgggttggatttatatttgatattcgggaaatttttagagcgtgtggtgtttttgttagcggtagttattggtggagttgaggttatcgttattgtcgtcgttggcgttttgtttttggaattttttagtaagatggtatttattgtttgttttttttcgattagtatttttagtcgcgttttttttttttcgggatacgtattagttatatattgtggggagaagatgggttatgtaaatgtaagttaacgcgtttttttagttatttttgtataatgtaataggaatagcgattcgcgcgtacgaatcgggtagtgtgcgcgtgtgtgtgttcgcgtgtgtgagcgcgtgtgttagcgtgcgttttcgcgcgggcgtgcgtttgggtggattttt

SEQ ID NO: 3977 - DNA, 274 bp, Artificial Sequence
  Description of Artificial Sequence: Synthetic polynucleotide
ttggggttagttttttttttttatcgtcgtcgtttttttatttatttcgcgtttattttataattatttcgtttggttttttttcggttttatttttatgcgtttttattatttttttaaatattgtagtaagttgtagtaaggcgggtaaatatcgatagcgcgcgtgggggcgggcggcgggcgtcgcggggtttatttttttttcggttttttcgcgttttcgtcgtttttcgcgttggtttttatcgtatgagtagcgttttttcggttt

SEQ ID NO: 3978 - DNA, 201 bp, Artificial Sequence
  Description of Artificial Sequence: Synthetic polynucleotide
tttttggttggcgggcgtttcgtcggtcgtcggttttttttttgaaattcgtcggcgtatatgaggtcgttgttttcgtcgtaggcgttggcggttttttcgcggtgttcgtggtgatgttatgtttcgttattacgcgggaggagaggagggcggcgtcgtcgggttttgggtgaagagcggcgtagcggcggcggcggc

SEQ ID NO: 3979 - DNA, 265 bp, Artificial Sequence
  Description of Artificial Sequence: Synthetic polynucleotide
ttttcgtggtaggcggtagcgagttgggttcggggtcgggttgagttttgggatcgcgttgcgtagttttcgagtcgttcgttatttggttgcggtcgcgcggttatttgtttttcgttttcggggcgtcgtttagtttcgcgttaggcgttttttttagcgttcgtcgttttttttcggcgagattattcgggcgcgtttcgttcgtcggttttcgatgtaaatagttgggtttcgtaggcggttggtttcgcgtttttcggtt

SEQ ID NO: 3980 - DNA, 201 bp, Artificial Sequence
  Description of Artificial Sequence: Synthetic polynucleotide
attattattattttaagtgtttgttcgttggggattcgtcgtcgtcgtcgtcgtttggtttgttttgttttggggttttgcgcggtttttttttgtttttcgttttttcggaagaggcgttcgtttttaagtacgtggagcgcgtttcgttcgtagtcgtcgcgttgttaggagcgcgttatgcgtagttgttttttgcgt

SEQ ID NO: 3981 - DNA, 362 bp, Artificial Sequence
  Description of Artificial Sequence: Synthetic polynucleotide
tttggcggggagtttgggtagcgtcgattaaagttcggagcggtagtttcggggcgcgggacgcggggtatacgggtttagttgttcgacgggagttcgacgcgcgtttttcggcgggtcggcgggttcggaagtttcgttgttcgggtcgggtttttaagttcgtagtcgttttgattaaaataggtatcgcgacggcggcggtaggcggcggtagttagggttggggtcgtatcgcgtacgcgtatgcgttcgtcgtttcgcgtttttcggcgggcggagttcggcgtcgcggttaggattttttatttcgttttcgcgatttcgttgcgggtttgtatattcgaggattcggtttgaaa

SEQ ID NO: 3982 - DNA, 298 bp, Artificial Sequence
  Description of Artificial Sequence: Synthetic polynucleotide
gttttcgttttttatcgttttttttcgtttcgtagttttcgagtggcgttagtacgttcgtcgggtatgggttttaaatgtttattagcgggagtttaggcgtttttgttttggagcgcggtcgggagtaaaatcgtaggagtgggagggtagcgagttagttggatttcgagtcgcggagcgcgttggttttgtttcgtttgatgattttagagcgcgggtttaagcgtcgtttatgtagtatttttgagtttcggggaaggagagttaatgaaaaaatatttaatcgttttcgttg

SEQ ID NO: 3983 - DNA, 295 bp, Artificial Sequence
  Description of Artificial Sequence: Synthetic polynucleotide
gagcggcgcggagagcggtaggggcgaaatttcgcgggttagatgttcgagggcgcggcggcgttgttaggttgtcgttgttgtttttgcgggtttcgagcgcgttttcgtaggcggtattgttcgcggcgcggcgtgtgtatcgagcgagtgaaggtatgtgtggcgggcgcggttggagttgtcgtcgtcgtcgtcgtcgtgttagtaggttttaatgtttgttattttttaggacgttggtagtagtagtagttcggagttttcgagttttcggtaggtttgcgtgtttttt

SEQ ID NO: 3984 - DNA, 203 bp, Artificial Sequence
  Description of Artificial Sequence: Synthetic polynucleotide
cgaaggtatttgggatttttagacgtaggatgtttttgatcgttgagtaaatgataagggaggcgcggtcgcggtattcgtttatttagcgtaatcgtttcgcgcggggagatttcggttgggtttttaggttggatttcggtagtcgaacgttcgttattcggttaggaagttagggagcgagcgtttgcgcggtcgtattt

SEQ ID NO: 3985 - DNA, 215 bp, Artificial Sequence
  Description of Artificial Sequence: Synthetic polynucleotide
cgcggatcggtcggtttgggtttttgtagagtagattttgtttgcgttttttaggaggagtgggtggtaggattggggttttttataggttttggggcggcggcgagattggtacggttcggggtcgtaggcgcgtagttacgtttttggaagttcgtttcggttttcgtttttaattcgttttttcggggttttatggcgtgaggtttggggtt

SEQ ID NO: 3986 - DNA, 201 bp, Artificial Sequence
  Description of Artificial Sequence: Synthetic polynucleotide
ggaggttgtagtcgttcgagtcggttcgggtgggggcggggtgggggcggcgcggagggtacggagattacggcggcgttattcgggatatttagggtttcgaggttttgggcggtttttacgcgagatcgtaaattatgataataggtagttattcgaggttaaataaaaacggagtgggtttttcgcgcgtcgtcgttt

SEQ ID NO: 3987 - DNA, 340 bp, Artificial Sequence
  Description of Artificial Sequence: Synthetic polynucleotide
ggcggcgttgacggatgtcggtttttagggagttttaaggcggcgggtattagcgggttgattttgaagcgttgttcggagtcggagcgttattgtttggcgcggttgatggttgacgcgttgcgcggttgcgtgtttgttttttacggcgtggtggagcgcgacggcgaaagttatttgtagttgtaggatttgttcgatggtttcgacggattttgtgtgttcgattgtaaaatgggcgttaggtatgcgtgttttgttaggtcggttggggggattaagtaggggttcggggtcgggatagttgtttgagggggattcggggcgagtgttcgaaggg

SEQ ID NO: 3988 - DNA, 201 bp, Artificial Sequence
  Description of Artificial Sequence: Synthetic polynucleotide
agggtttagggcgtagggcgggtttcgtacgtagggcgggcgcgcgggtatttttgtggttaggcgatttcggttcgttttttcggagtttagggattttcgaggttggcgcgggttgttcgcgataaggtgttagtagtttcgggttcgcgaggagtagtttttattcgcggttttcgagtttagttttgttttttcgtt

SEQ ID NO: 3989 - DNA, 236 bp, Artificial Sequence
  Description of Artificial Sequence: Synthetic polynucleotide
tttgagtagtgtatttttttaaaggtaaagagagataagggaggaaatatagtatttaaggtgattagtcgattggatattgttgatggtatatttttttcgtttttaattaatcgtataaaattcgtaatatttcgcgttttcgcggggtttttcgcgtttttggttcggttttttcggtcgtttttagtaggcgtttcgtttttcgcgggaattttgggatttggtcgagcgtt

SEQ ID NO: 3990 - DNA, 251 bp, Artificial Sequence
  Description of Artificial Sequence: Synthetic polynucleotide
gttttttagtttttcgcgtatttttttgcgttcgggtttcgtcgtttcgtttagtgttggttacgggtcgtgttattagtttgtgcgttttcgttattcgcgggtcggggtatttggcgttttgtgtgggtggcgggagcggggacgtttcggtgttcggggatcgtagcgcgttggcgtttaattttgtcgtcgttcgttttggagtcgggaggttttagtcgtttaagtgtttcgggagatttaggtat

SEQ ID NO: 3991 - DNA, 201 bp, Artificial Sequence
  Description of Artificial Sequence: Synthetic polynucleotide
tttcgttttcgttttattttttattggcgtaggtttaggttatcgttgttaggatttttcgttgtcgtcgtttttcgttttttttatttagattttgagtcgtttattttagtcggtgtaggtcgcggggtcgtttttgatggtttgggtattttttattttcgtttcgtttacgattatcgcggttgtttgagttgttta

SEQ ID NO: 3992 - DNA, 206 bp, Artificial Sequence
  Description of Artificial Sequence: Synthetic polynucleotide
gttttcgagtgcgtagcgtgcgtttttagtttttgttgcgtttttaggtttggcgcgcgattcgagcgtagcgggtaaagttggaggaatttggcggcggcggagcgggcgtaggtttagttcgataaagttcgggggttcgggtcggggtcgttgtcgtagttcgtacgttgtttcgtgttttcgagaggttttttttttagcgt

SEQ ID NO: 3993 - DNA, 201 bp, Artificial Sequence
  Description of Artificial Sequence: Synthetic polynucleotide
ggtcgtcgtttatttcgcgtatttcgttttttggaaatttagtagtcggggggcgaatatcgcggcgtttttatgggaatttggtttcgggtttagagcgcgggtagttggtagagtttggggggcgcggcggcggtagtagtaggttggagggcgcgcggcgggggttaaggggatttggtcggcgttcggagtcggagt

SEQ ID NO: 3994 - DNA, 203 bp, Artificial Sequence
  Description of Artificial Sequence: Synthetic polynucleotide
gttgtaattttgggtttgggattgcggggacgggacgggtgggaagcggttaaaggcgtagcggtttttggttagagtcgtagaggtttgagacgtgggtcgcgtttcggtttaggagatttcgcggtcgcgttttaatttttagtttttcgattgcgattgcgattcgggaaaacgtttacgtttttggaaaggaagtttta

SEQ ID NO: 3995 - DNA, 216 bp, Artificial Sequence
  Description of Artificial Sequence: Synthetic polynucleotide
ttggggggttgggagaacgaaaatattagttgcgtttttaatatttaaggaaggaagtggtagcggggacggggagaggatgggaaggggatgttgattgcgagttggggcgggacgcggtgatgggaggggatcgggtcgggaatgcgggaggcgaggggagcgacgggatttgtcgtttcggcggtcgggtagttaatcgattcgtttttttta

SEQ ID NO: 3996 - DNA, 335 bp, Artificial Sequence
  Description of Artificial Sequence: Synthetic polynucleotide
agtgtcggagcgttcggtggtcgtcgcgtcgcgcgtttggagggatgttaacgtggagtcggcgtcgagttcgttcggcgtgcgtgcgtgtgtgggagcgcgcgagttttttgacgcggggattagttatgaatcgggggtgtgtgtttgtttttagagatttggtaaggtgcggagttttttagaagtgcggttaagcggtagcggagacggcgagttaggaattttttttcgcgtttttagttttttagcgtggcggcggaattttcggagaaagtttgtaaatttttagcgggcgcggcgaggacgtcgggttatttagggggcgggtgggc

SEQ ID NO: 3997 - DNA, 230 bp, Artificial Sequence
  Description of Artificial Sequence: Synthetic polynucleotide
gagagaaagtgagaagggagagaaaagcggcggttgagtaaagcgggagtcggcgcgggcggtggggtttgattcggacgtcgcgtattcggtttcgtttcgcgtttagcgtttcgtttattttttggtcgcgtttgttttcgcgtttttttgtttttttttatttattagtagttttgttgataagcgagaaaattgataagtgagaaaagtcgtttgttagcgttcgg

SEQ ID NO: 3998 - DNA, 224 bp, Artificial Sequence
  Description of Artificial Sequence: Synthetic polynucleotide
tagtatagggggtgagatggggtggtggttggtgaacgttggttattttattttatattattttattttgagagttgttataattatcggcgttatttttcgtgtattttgaggtttggttggcgagtcgttgttgggagttttttgtaaatattttttaaagtttgaaggcgggttttaaacgtaggcgtcggggattatgggagtttttaaatagttgcgtt

SEQ ID NO: 3999 - DNA, 211 bp, Artificial Sequence
  Description of Artificial Sequence: Synthetic polynucleotide
ggttaattttaggtatagtttattcgagttaggcgaggtttagaaaggtttgattcgtttggtagttttaacggatttgttttcgtagtcgttgattagtcgttgacgagcggatttttcggtcgttatggcgattgtgaaatgtagggtggagcgtatgcgttcgaagttattcgcgcgggtagtttttgcgtgtttttttgcgtgtttt

SEQ ID NO: 4000 - DNA, 205 bp, Artificial Sequence
  Description of Artificial Sequence: Synthetic polynucleotide
cgtgtaattcgattttttttgatttataagttttgagtgatagttttgatttggtttaatcgcgggagggaggggaaagagaaagaaagaaatttttagtcgtacgttttttttggtatttaatcgattttttggaaaaaggttttatttcggtttggtgtttcgtgttgggtggagaagtttttcgtttcgatttggtatcgtt

SEQ ID NO: 4001 - DNA, 398 bp, Artificial Sequence
  Description of Artificial Sequence: Synthetic polynucleotide
tttcgttcgtttcgcgtttcgcgtttcggcgtttcgtcgttcgtcgttcgttcgtttcggcgtcgtcgttcgcgtttcggcgtttcgggtcggcgaggggcgcgttcgcggtcgcggtcgttgtatggcgttgagatggcgggggcgtcgcgcggcggaggcggcggcggaggcggcgcgggcgagttcgggggcgtcgagcgggcggtcgggataagtcgtcggcgcgggtttcgggcgtgcgacgaggagttcgtttgtttagagttggaggcgttgtttcgcggttatacgttgcggttggagtaggcggttacgttgaaggcgttggtcgtttttagtttgttggcgggcgcgttggcgttggtcgagttgttgggcgcgtcggggttcgcgtt

SEQ ID NO: 4002 - DNA, 290 bp, Artificial Sequence
  Description of Artificial Sequence: Synthetic polynucleotide
atagcgggcgtttttagatattggggaaagtgttttacgatgtttcgagtttttttagtttcgttagcggggcgagcgtgagggtgtttcgatcgattagcggtttcgggtgtagggtggcgggttcggcggcgcgcgttttttttttttttttggcggttcgtacgtgtcgttcgcgtcgcgtttttacgggttacgcgcgggtttcgtagcgtcgcggtcgagtcgggttgttcggttcgcggatatagcgtcggtcgtcgtatttcgtgcggggtcgcggcgcgatg

SEQ ID NO: 4003 - DNA, 307 bp, Artificial Sequence
  Description of Artificial Sequence: Synthetic polynucleotide
cgtgaaattgtttaattaagtgcgtagttatagaggaagaggcggtttttttaatatggcggggtttttgttttttagttttcgggttttgattttagttcgcgtttttattgttttatttttttcgtttttggagtttttcggtgattttattatagtttttgttattttgtgatttgtaggtattgggagatttatagggaggacggcggaatatttggaggttgggaaatggtgagtgcgtggagtgggtgtttcgagaatggggaagaggttgtttgaattcggtcggaatcggttgcggtgg

SEQ ID NO: 4004 - DNA, 212 bp, Artificial Sequence
  Description of Artificial Sequence: Synthetic polynucleotide
agtgttgttaggcggaggttcgttagaaggtttcgtagttgttgaggcggggtgggattgcgttttaggggtcgcgttgaagttggcgtcgcgattattgcgtatcgatttcgtttattttttgttcgttttcgggagttttttttgttttaggacggttttttattttttaaattatgttcgttttttatttcggatttatagttattttt

SEQ ID NO: 4005 - DNA, 375 bp, Artificial Sequence
  Description of Artificial Sequence: Synthetic polynucleotide
tggtttttgagtagtatcgtttagtgtagttttcgttaggaaaagtagtagaatcgatagttttagggggcgagcggggtttatggtgtagggggtcgggcggttcgttgggtaaggcgttcgagaaagcgtttggcgggaggaggtgcgcggttttttgttttaggcggttcgggtgttcgttttatgcggggcgagcgttcggtcgattttcgtcggggcggagtttgaggggtggttgatttatgtacggggattgttatttcgtcgttttcgcgttgtaaattgtgtaagagggagaggaatttttcgttaagttgaaaagttgaatttgttttttaaatttttttttgtagtttagacggggacgttttg

SEQ ID NO: 4006 - DNA, 201 bp, Artificial Sequence
  Description of Artificial Sequence: Synthetic polynucleotide
ggggttgttcgtaatatgtagggaaatgagtatttcgttttgttttttatttttttttagtttttcgtggtgggtgtataggaaaaagaagggcgaaaagcgggggtaatagttagtcgtcgcgcgcgtttttagcgtcgtttttagtaatagcgttaggaggaaagtttgtcgggtttagttattgcgttttatgtcgtc

SEQ ID NO: 4007 - DNA, 356 bp, Artificial Sequence
  Description of Artificial Sequence: Synthetic polynucleotide
ttggagacgtcgggacggaggagttacgcggagagaaggcgagaagaaggcggacgggagcggaacgggttcgggagcgggtttgggagcgggttttcgtcgagaagtttcgcgggagacggcggtttttaaagttattttgggtcgcgggagcgcgggatcggggttgcgggcgtcgagagcgcgtcgtttgtcgttttcgtgcgtcgtcgtcgtttttgcgcgacgtttttcggttaggtttgggaaagcgttcgtttcgttttatatttttttaaagtttcgggcgtcgcgtttttttcgtcgtcgttatacgtgtttcggtcgttttttcgttttcgcgcgtcgtttcgttc

SEQ ID NO: 4008 - DNA, 265 bp, Artificial Sequence
  Description of Artificial Sequence: Synthetic polynucleotide
gtcggtttttttgtttgagtcggttgcgtttcgcgtttttcggggttcgtagtttgttagttcgggcggttcgtattcgttttgggaattcgttcgaggtcgcgaatcgttaggggttttcgcgttttttttttatttaggttttttgtttttttcgtcgcggtcgttcggtttttcgcggtagcgatagagttttatttgtagaggattttaaaatgagattaagcgaaagtggaattggtagattcgagtggtgtttggaaat

SEQ ID NO: 4009 - DNA, 697 bp, Artificial Sequence
  Description of Artificial Sequence: Synthetic polynucleotide
gattttagtcgtacgttgtgcgaggtttgtaatattcgttttagtcgttacgagatttatatcgtgtataagcggtattattgcgtttcgcgttacgattcgtcgtcgcgtcgatcggtcgcgttttcgggattttttgggtcggtcgcgttttcggttttttttttcgtcgcgtttgtgcgtacgcgtagacgtcgtaagttttacgagttgtacgcggtcggcgtttcgtttttttcgtcgttcggttacgttttcgcgttcgagtcgtcgcggttcggaagcggaagcggaagcggtttcggtttcgtttttgcgcgttcgttcggtttcgcggtcgacggttttatcgatttgagtaagaagtcgcggcgttcgtttttcggagtttcggtatcggcgttggtcgattattacgagtgtacggtttgtcgcgtgagtttttatagtttcgaggtttatttggcgtataagaagtattcgtgtttcgttgcgttatcgttcggcgcgttcggtttgttcgtcgtcgtttgtttttattgtttttcgaacggttcggtgcgcggggatttgttggagtattttcgtttggcgtacggtttgttgttcggcgcgtttttggtcggttcgggggtcgaggttcggacgtcggtcgatcgcggtttttcgttcgttttcgttttcgtcgttttttcgt

SEQ ID NO: 4010 - DNA, 226 bp, Artificial Sequence
  Description of Artificial Sequence: Synthetic polynucleotide
tgggaggagcgtagatatttttcggtgatagggagggttttttatttggttgttatttggaagtttatagtggtttcggcgggtaggcgggcgggtagagcgcgggttcgaacgtttttcgcgtttgcggcggcgtacgtgcggcggcggcggcggcgtcggcggcgcgggcgggatttattgggtggtcgcgcgcgttattcgcgcgttttttgcgcgtttttgt

SEQ ID NO: 4011 - DNA, 201 bp, Artificial Sequence
  Description of Artificial Sequence: Synthetic polynucleotide
ttttttttatttttttaatttttagtaggatacggaatttcggcgtttttcgaaagttataaaagaggggtacggaaattttaagttcgtcgtgttaattcggagaacgtaaattcgaggtagagcgtgcgtcgtgcggggatgtgggtgtcgaggatttcgaagcgttcggtttttttcgcgatttttattttttttaga

SEQ ID NO: 4012 - DNA, 201 bp, Artificial Sequence
  Description of Artificial Sequence: Synthetic polynucleotide
tatttcgttatttcggcggggtaagttcggattttattagggtaggttcgggaggttatttagggtagacgattcgaggtagagcgttttaaaattttgtcgtcgtacgtttagttagagcgtcgagcgcgtttgtttttttttcgttattttttagttttttattcgtcgattaaatttttgggggattatatttttaag

SEQ ID NO: 4013 - DNA, 215 bp, Artificial Sequence
  Description of Artificial Sequence: Synthetic polynucleotide
ttgttttttagttagaacgtgaatgtattgttgacgtatattgttttgggagaagattagcgtgatgtagtgtttttatgtattagcgtcgtttttttttcgtcgtttgtttcgcggggttaacgtcggcgttttttagcgtcgcgtcggtcggcgtcgcgtagtttcgcgttttcggtcgttcgtttttttttttttttttttttttttttttt

SEQ ID NO: 4014 - DNA, 252 bp, Artificial Sequence
  Description of Artificial Sequence: Synthetic polynucleotide
tgaacgtgtgcgtgtgcgcgcgtgtggttgttttttttagttttagtttcgaacgtaaatattttatcgaggtatagggaagtcgggagtagtcgaggaacgcggagggcgtcgaattagagtttgcggggtttgatagttttttttgcggcgtttaaggtgggcgtaatgtttaataaaaaggtcggaaaatggggatcgatttcgaatattttttttttttatttagtttcggagttcgagtagcggcgg

SEQ ID NO: 4015 - DNA, 203 bp, Artificial Sequence
  Description of Artificial Sequence: Synthetic polynucleotide
cgtttcggcggtcgcggagggagcgtaggcggcgtcgttgtaggggtcgggcgggttggcggcggcggcggcggcggttgtaggagcgcgggtaggttcgcgcgtcgttggtaggggtagtaaatggtagttttttttcgtagtatttattcgcggttgtatcgtatcggggtattgtgggaaatttcgtttattttttcgtt

SEQ ID NO: 4016 - DNA, 201 bp, Artificial Sequence
  Description of Artificial Sequence: Synthetic polynucleotide
cggcggtattcggcgtagaggttttagcgcggggagtcgggtttagtttcggtttgttagcgtcgcggttttagtttattcgaggtcggtttggggggttcgtagggcgcgcggagcgtcgagtgcgcgtcgggttgggtttcgtatttcggtgtaggagcgcgggcgcggcgcggcggagcgtttcgtatggagtcggtt

SEQ ID NO: 4017 - DNA, 201 bp, Artificial Sequence
  Description of Artificial Sequence: Synthetic polynucleotide
gttgaatatcgttcgggtttagtttttatttcgcggtttggtgaagttggttttcgtgtttgtttgggaagtttttgtttggggataatcgttaggttttcgagtcgttttttttttatttttcgttgcgtcggtaattttattttttcgtttttattaacggatcggtatttaaattaaagtttagttttttggggttta

SEQ ID NO: 4018 - DNA, 201 bp, Artificial Sequence
  Description of Artificial Sequence: Synthetic polynucleotide
tttcgtttttcggtagagtttttgttcgcgttaatttatttattaggttttgttcgcgttacgcgcgtttttggtaggtttggggcggggaaaggcgaagcgttgggtacgcgagggtttgtgtattttagtttttacgacgtttttggttttttttaggttcgtcgttgtcgtatttaatttttttttttcgggggttat

SEQ ID NO: 4019 - DNA, 213 bp, Artificial Sequence
  Description of Artificial Sequence: Synthetic polynucleotide
tagtttatttaatattatttatgtattttgtgtaaggaattgtgggatttcgttttacggtaaataatatggaaattttaaaaatagcgatttttttgtgcgtgtttatttacgcgtttcggggtgatttggcggggttgtcgtcgggtgatttatatttttgaatcgcgaagcgatagggaaagcgcgggcgagcgtaggagacgcggtcgg

SEQ ID NO: 4020 - DNA, 385 bp, Artificial Sequence
  Description of Artificial Sequence: Synthetic polynucleotide
ttattttttgtttgtttaagtcggttggttttcgtgattgattcggaataatagagtagatgtttgcgtgggaggtaagttttatttaatatttgttttgcggcgggaaggtttgggtgtttatagatagagttggagtttttcggtgggtggtatagataattagttggggttgttttatatgtaatttaattataggggaaataggtttaaatatcgggtgataagtagcgtaattgtttcgggtgattttgtaattttttttttattaattttttttataacgtatatgattgttataagggttaattaaaaagagcgtgagtggttttatgttatatgtagttggattagaaagtgttgagtatttgtttatgcgtgtaag

SEQ ID NO: 4021 - DNA, 278 bp, Artificial Sequence
  Description of Artificial Sequence: Synthetic polynucleotide
ggtattgcggtttagttttcgttcggggattcgcgggtcgattgtggttttttttggggaagtcggggcgcggggaggcgtttcgggtattttagtcgtacggggtacgttcgttttcggcggggtttttcgtttcgttgtgggagtggtagtgggtgtcggggtggagaaagtacgcgtggcgcggagttttggggacgcggcgttttattcgttttggggagtttcggattttttttagtttttaggttcgtatgtttttttttttttagtgtttt

SEQ ID NO: 4022 - DNA, 248 bp, Artificial Sequence
  Description of Artificial Sequence: Synthetic polynucleotide
acgcgagtcgttagcggtgggatttatcgacgatttttcggggcgataggagtagtttcgagagttagggcgagcgttcgttttaggtggtcggatcgttcgtcgcgttcgcgtcgcgttttttgtaggtaacgggagacgttttcgcgtagcgcgagcgttttagcgcggtcgttcgttttttttttcgagggataaattttttttaaattcgattcgagtttttggattaaattcgtttgcgtcga

SEQ ID NO: 4023 - DNA, 216 bp, Artificial Sequence
  Description of Artificial Sequence: Synthetic polynucleotide
tataatataagggagagaaagtaacgttttggttttagaaatttttatcgttaaggttagttttggttagacgtatagttaaagagtttttttagtttagcggatgaatcgttcgcgagtggtattttttaaaattttggttttattttttaagatgtttttttattgcgtaatttagaaagtattcggatcgtcgttatttattagcggcggcga

SEQ ID NO: 4024 - DNA, 201 bp, Artificial Sequence
  Description of Artificial Sequence: Synthetic polynucleotide
tgaggtgttttttttattaattttaggtatcggtttttggtggaattgtttttagattgtttgagtttttagggttaagttttttttttattttttagtacggagttttatttagaattgtatttcgaaagtttaaagtttatttatggtttttagagataggcgaaggcgaggttttttacgggacgttttggtaggtgt

SEQ ID NO: 4025 - DNA, 208 bp, Artificial Sequence
  Description of Artificial Sequence: Synthetic polynucleotide
cgagtagttagggttagcgagcgattttagtagtagggacgcggtcgtgcgagagttcgcggataggcgagggggattttaggggagtagttgttgtttacgggttacgggcgatgtacggagtggagaagtgaacgtggtttataggatttttgttcggaaggtggagagcgttataggggaattttttcgatttttgttcgtttcg

SEQ ID NO: 4026 - DNA, 201 bp, Artificial Sequence
  Description of Artificial Sequence: Synthetic polynucleotide
ttaggagttcggatttttgtttagttttttggcggagttaagttcgagcgtatagatttttcgagttttagcggttagggggtattgtgtgagcggttgacgttattttttcgttcggtcgaaattaggcggcgggattttatatagttgaggagagggagtcgaggtcgtgatttagggttggcgacgattaaattaagt

SEQ ID NO: 4027 - DNA, 364 bp, Artificial Sequence
  Description of Artificial Sequence: Synthetic polynucleotide
gtcgcgggtgaggtttgtggttaatttcgcgttgtcgaggttttattttttcgagtttagtttgattttaggtcgtttttaggtcggtgtttagttgaggcgggaacgttgtagtttggttgagcgtgatttttaggttttgtgaggaaaagtcgagcgcgttatatcgaggcgttagtcgtttattttattataaggtaaaagatttatgttgttttagttattttaaagttgggagatatattgtattttttattagatttcgaatgtttttagtgtttgtaattttttaagaagtttttagagtagatagtttttggatcgtgggtattttttttcggggacggggattttgttgatcgtt

SEQ ID NO: 4028 - DNA, 213 bp, Artificial Sequence
  Description of Artificial Sequence: Synthetic polynucleotide
gtttagtttttttttagtatgtaaagttttttgttttttttcggagttggcggaggcggtaattttttattttcgtcgtcgggggtcgggtagtagcgggcgcgcgggttagcgtttagtacggcgggtagcgtcgcgttgcgtatcgtcgtcgattatgagcgaggatagtcgcggagatagtcgcgtcgagagcgttaaggatttggagaa

SEQ ID NO: 4029 - DNA, 201 bp, Artificial Sequence
  Description of Artificial Sequence: Synthetic polynucleotide
ttttttcgttacggtaatttaattggaggtagaagtcggcggggcggtcgagcggggcggggcgggagcgcggtcgtcgcgagttacggtggggagcgggcgcgggggattttggcgggtttcgggtagcgcggttgtatttatttgtgttataattgcggcgacggggggttgaggaatcggtttttttaaaagtaaatc

SEQ ID NO: 4030 - DNA, 201 bp, Artificial Sequence
  Description of Artificial Sequence: Synthetic polynucleotide
ttttgggcggttgtagaggtcggtcgttcggtttggtttattttttttaggaaattttatattggagaggtaagggcgattttaaaatgtatcgttgagtcgttaagttgttatttttttttatttttttttgtttttttaaattgtatttaaaaaaaaaaaaaagttaattgtatagagtggttgggcgcgatgggtggg

SEQ ID NO: 4031 - DNA, 296 bp, Artificial Sequence
  Description of Artificial Sequence: Synthetic polynucleotide
ttcgggatcgcgtttcggtcgttcgagtttttcgcgttcgtcgttttttatttcggtcgggggtttatttgggagttcgttgttttcggttagtcgttcgcgtgtgtttagggttagtagtacgtataagtgttagcgtacggtcgtcgcgtttatgtttaatgcgggtttcgttgggcgtgcgggcgtgcggggcgcggggattcgatcgatcggtcgttttcgtaggcgttgttcgttgttcgtcgtttcgttatcgttcgggttttcgagtcgtttagttagttcggttgatg

SEQ ID NO: 4032 - DNA, 201 bp, Artificial Sequence
  Description of Artificial Sequence: Synthetic polynucleotide
ttttgtttggcggtttttgcgttcggggttgttgagttcggggttcgttttgaggtcgcggttgtggtttttggttttttcggttcgcgttattgtcgcgcggcgttcgttgtattttgttttttttgcggtttcgtatgtttttggtggaatttagttcggcggacgacgaggaggatgagatggaagtttgttggaaat

SEQ ID NO: 4033 - DNA, 297 bp, Artificial Sequence
  Description of Artificial Sequence: Synthetic polynucleotide
ggggagggaggcgcggcgcgggaggaggaggggcgtagtcgcggagttagtggtttcgtttggacgcgttgttttttagatattttcggagttttagtcgcgcggatcgcgcgttttcgtcgttttgtttttaaatttttgtcgtagtttttttttaagttagcgaatttattttttaaaattagaaattgaatttcggtacgggaaaggagttcgcggaggagtaaaattatagtagagtaagaagagttttagagagtagttttttcggagtattaatttcgtgtcgggagtgta

SEQ ID NO: 4034 - DNA, 268 bp, Artificial Sequence
  Description of Artificial Sequence: Synthetic polynucleotide
tcgcgttcgggaggggcggttgtcgttcgcggggcgttcgcggtgttcgggtttgggtagcgaggaggtgacgtcgttttcgcgggatgagttcgggaggcggaggggcggaggaggtgttggcggcggtattgagcggcggcggcgtagggcgcgcgggtttttcgcgtcgattttatcgatttaaggggcggcggcggtggcggcggttgagcgattttgggtcgggcgcgtgatgaggaggggtcggcgttagatttcgttgtac

SEQ ID NO: 4035 - DNA, 201 bp, Artificial Sequence
  Description of Artificial Sequence: Synthetic polynucleotide
ttgagtagtcgaagggataattagatagttatagatagatagacggttagttcgagtttcgggtaggagagaggttgcgaggagtagtttatgtttgtttcgtttagttttcgcgttttcgggttgtttttttaatttcgattcgcgtacgttgcgagttttcggcgttgtcgtttagtcggaggggtagtttcgtttttt

SEQ ID NO: 4036 - DNA, 201 bp, Artificial Sequence
  Description of Artificial Sequence: Synthetic polynucleotide
cgcgattagtattttttcgttacgaatttgagagataagaagcgaaaatagggtgtgtgggggatggagagagtttcggggaggtagttgcgttttcgtacgttttaatttaaagaagagagggaaggaggaagcgaatttattgtttagtacgagtcgcggagcggtttaatttagagcgggtagttgcggacgagttgg

SEQ ID NO: 4037 - DNA, 201 bp, Artificial Sequence
  Description of Artificial Sequence: Synthetic polynucleotide
ttttgtgcgagtaaagtcgggagagcgagttttaagtatttggtagcggtgtttttagtaggcgtcgaggaattcggttatttatttttggtgaattttgcgtttattgaggtattcgaggtacggatgtgttcgtttagtattcggagacgaaggagagagagcggggatatgcgttttagttttgttaggttttagggt

SEQ ID NO: 4038 - DNA, 201 bp, Artificial Sequence
  Description of Artificial Sequence: Synthetic polynucleotide
tttttttttttcgcgtatttcgtggttcgattcgagggcgtcgaatacggcggcgtttattagtaggtaggtgaaggtgtagacgatgagggatagagttcgtacgttttgtttttttatggtcgttagtaaggagtcggcgcggggggtatgtttcgtaggtttatagtcgcgcgcgttttattgtagcgttcggcggtc

SEQ ID NO: 4039 - DNA, 302 bp, Artificial Sequence
  Description of Artificial Sequence: Synthetic polynucleotide
cgtttattcgggcgcgcgggtgcgtagcggggttttcgtcgggcgtcggtcggtgcgcgaagtttgttcggtttaatttttaaggcgcgggagcggggcgcggttttaggacggtagggatcgcgatggagcggtttcgggggcggtcgggggacggcgcggtggcggtcggttagttcgttttttcgggggcggcgggcgcggcggcggcggcgggaggggtttcgcgggtttcgcggagtagcggggcggacgcgggcgtatgagtcgcgcgggggtcggggtttttcggcgttcgggcg

SEQ ID NO: 4040 - DNA, 201 bp, Artificial Sequence
  Description of Artificial Sequence: Synthetic polynucleotide
tcggtggtcgcgttcgtgaaatggggacgcgggttttgttttcggattttttttagttttcgatttttcgtatttgtttcgagatttaacgtgttcggttcgtagcgtgttgggtttgcggcgttagggtggttcgagtttcgagattatttgcgtttgcggatatagtcgcggggtttggtatgaagggttttagggagg

SEQ ID NO: 4041 - DNA, 220 bp, Artificial Sequence
  Description of Artificial Sequence: Synthetic polynucleotide
gcggggcgggcgattgtcgggtttcgggttagttttcgtttttcgtttcgttttcgatcgttcggttttttcgttcggcgttttttcgggttgcgtttcgcggtttttggcggcggcggcggcgggcgtagagcgcggtatgggcgttcgggtcgcggggtttggcggcggcgggcggacgggcgcgcggttgcgggcgtaggtgcggggcggcgggtcg

SEQ ID NO: 4042 - DNA, 347 bp, Artificial Sequence
  Description of Artificial Sequence: Synthetic polynucleotide
tatcgtttcgggtgcggcggttttaagcggagatttgagcgcggcgggtcgagttttttaatttgttggcgttgttttttttttttcggcggtgcgcgggcggcgttttaaaggggaggattttgcggcgcgggtaagaggcggcgggagcgcgcggttcgggagtgtggttgtagtgcgtcgggatattagggtttcgcgtttcgtatttaagaggttttcgcgttttaatttttcgcgttcgcgcgttcgcggatttaggtcgaggatcgaaaggggtcgttcgagttttcggggtcggcgtttagagagtttagtaaggtcggtcgttttgtcggtgtgtcgtc

SEQ ID NO: 4043 - DNA, 201 bp, Artificial Sequence
  Description of Artificial Sequence: Synthetic polynucleotide
tggtattaggtttttttatgggtatcggagtaggcggataggggtggggtttcgcgagcgatacggaagggttagtgtggcggagcggattttgtggaggcggggttattgtgtttttgagaagggttttcgggggtggagtttattaaggttgcgggggcgtggttacggagcggagttaataaaagcggggcgtgtacg

SEQ ID NO: 4044 - DNA, 201 bp, Artificial Sequence
  Description of Artificial Sequence: Synthetic polynucleotide
cgttttggtatcgggggcggcggcgtagaggtcgggaggaagaaattcgggttttggtttaggtcgggtttttatttttgcgattcgcgagaggtttaggcgggaaaggcggcgagtggcgttagcggtttcgaaagtaaatttggttcggtgttattgttcgagggtcgtcgggcgcgttttttaattttttcgagtttg

SEQ ID NO: 4045 - DNA, 225 bp, Artificial Sequence
  Description of Artificial Sequence: Synthetic polynucleotide
agtgcgtacgttgtaggaattacggttacgtttcgtcgtttaagggttataagcgtttttgtatgtggcgcgattgttagtgtaagaagtgtaatttgatcgtcgagaggtagcgcgtgatggtcgcgtaggtgggtgcgggcgtgcgggagttcgggtttagttttagtttttttttttttttttttttttagatggagtttcgttcggttgtttaggttgtag

SEQ ID NO: 4046 - DNA, 318 bp, Artificial Sequence
  Description of Artificial Sequence: Synthetic polynucleotide
gttgttaatttattcgggagttcggggtatgaacggttacggttttttttatttgtatatgggcggttcggtgtcgtagtcgttacgggcgtttttgtagcgtacgtttaagtgcgcgcgttgtcgtaattatggcgttttgttttggtttaagggttataagcgttattgtcgttttaaggattgtatttgcgagaagtgtatttttattatcgagcggtagcgggttatggttgcgtaggtggcgttgcgtcggtagtaggttaacgagagtttggagagttttattttcgattcgttgcgcgttttgttagggtt

SEQ ID NO: 4047 - DNA, 265 bp, Artificial Sequence
  Description of Artificial Sequence: Synthetic polynucleotide
aggaaggggagcgtagtttgtagattgaagttagtggcgttgcgttgaatgtaattgcgcgcgttcgtcgggtgagttagcgatttgagttaggcgggggcggttcgatttttttcgtttagtttgggttagaggaagtcgaaagcggttttagtaaggtgaggcgttcgaggttgtagaagatcgagtagaattttgtagagttcgggatgtgttgggttaggtcgttgaggatttgattggttttttttttttttttttttat

SEQ ID NO: 4048 - DNA, 259 bp, Artificial Sequence
  Description of Artificial Sequence: Synthetic polynucleotide
cggaggggaggtcgcggagggtcgggtggaggtttttatcgttagttttaaggtttgtagtatttttttttggtttttgtttttagggtcgatgtgttttcgagcgaagtcgtcgtgtttgggtagaaggcgttttaggaggcgcgaggttttagtcgcggcgttgttttcgtcgttattgttgttgtttcggtttcgcggcgtttagtacggtttcgattttttagttaggcggcggtcgttttcgatttcgcggttt

SEQ ID NO: 4049 - DNA, 201 bp, Artificial Sequence
  Description of Artificial Sequence: Synthetic polynucleotide
gacggggtatcggtattaattagcggttcgtttcggggttttcgcggttaaggcgagaacgtaggattaggagtattgttgtttattttttatcgtaattcgtatatttcgggattacgtaacggcggatggggcgttcgggagcggtttttgtaggggagagtaataggttttcgcgttttggaggtttggtttgcgttt

SEQ ID NO: 4050 - DNA, 323 bp, Artificial Sequence
  Description of Artificial Sequence: Synthetic polynucleotide
ttttcgcgattttatcggggaaatatcgcggatagtcgggttagtagcgttcggagtttattttaggtttttaaatttgtagtattttttagagcgcgcgcgttcggagcgggatttgtttgttttagtgtacgtcgcggagcgaattatcgggttggcgggggtggaggggtgtaggcgtgggggttgcgggtcgttcgggttttgggttttttttgtcgtcgtcgtcgtttttcgttttcggttaggagtcgcgcgtgacgcggttcgtcgtaggagtttcgaaggcgcggcgtcggcgagttttttttcggtaggcgcgt

SEQ ID NO: 4051 - DNA, 201 bp, Artificial Sequence
  Description of Artificial Sequence: Synthetic polynucleotide
agtcgttttcgtatttttcgttatagttttcgtagtaatcgttttagtagtcgtagttttagtagtcgttttatttcggtaagatgtaggaggcggcggtcgtggcggcggcggcggcggcggtcgcggtagtcgcggtgggtagcgtgggacgtttgttttagtttttattttacgggttgggttcggtcgtcgtcgttg

SEQ ID NO: 4052 - DNA, 355 bp, Artificial Sequence
  Description of Artificial Sequence: Synthetic polynucleotide
gcgaatataattgttttagttataggcgaggtttggttaaggtgtgggcgtatttggggtaggttttgagaggtttagcgttcggtggtgcggatagaggcggggtatcgcggcgttcgtcgtcgttttttcgtaggtgattatttttttgtaggtgttttcgggttttaggtggttgcgtgtttgcgttatggttgatattttgggcgagcggtatttggtgatttgtaagggcgcgacggtggaggtcgaggcggcgttgtagaataaggtggtggtattgtatttcgcggcggttcggtgcgcgtcgagtcgcgattttacgtcgttgttttgcgatttttatacggcgttg

SEQ ID NO: 4053 - DNA, 201 bp, Artificial Sequence
  Description of Artificial Sequence: Synthetic polynucleotide
ttcgcgcggagcgattgtgaggggttttgttggaatttggtagcgcggaggtttggagagaagttttatgttggtttttatttagtcggttcgtttttttcgagttttggaagttttatttagtcgtgtatttaatggttttataaagttgattataagttttagcgtatttttgaaggagttaaaagcgacgtaggtgta

SEQ ID NO: 4054 - DNA, 290 bp, Artificial Sequence
  Description of Artificial Sequence: Synthetic polynucleotide
gatattttgtggagtaggtggtttaggttgtcgggtttatcgtcgggcgttttgcgtagcgtttcgtcggatattaagtagggagtcgtcgtcggggtcgcgcgcgtcgtcgaaattttgttttcgtcgtcgtttatcgataggttgtggagaaggttatcgatcgatgttatcgagttatttttgaagcggttatatttggtgcgtggaagtatgttttttcgtgggttcgttgtattcgttcgggcgttgttggtgtcggtttcggcgcgggttgtcgcgtatagtag

SEQ ID NO: 4055 - DNA, 201 bp, Artificial Sequence
  Description of Artificial Sequence: Synthetic polynucleotide
tagagattgtagttttcgtcgggttggatgcgagttttttaggttagagtttagaagcgcgttgggatttgggtttggtttttgggtttgtgttttttttcgtttggttttaattgttcgtatttaagattataataaaaaggtttaggaagtaaattttttggacgcggaagggtcggttcgcgggttttcgtcgagtga

SEQ ID NO: 4056 - DNA, 201 bp, Artificial Sequence
  Description of Artificial Sequence: Synthetic polynucleotide
agaggtcggttcgtcgcgcgggagatattttttttaaagtggaagcgttgcgtgggtagtagcgcgggtcgggttttcggattttagtttttgttgttttcgagattttcgtttcgcgtcgtatttttcgagtttagcgttttcgggttgcgttgggcgtagtggttttcggttagggcgtagtcggtttgggcgttagag

SEQ ID NO: 4057 - DNA, 288 bp, Artificial Sequence
  Description of Artificial Sequence: Synthetic polynucleotide
cgatgtagtttagaattcgcgatttagttcggtttattatagtttttagtagcgatattcgtagttttcgattttttagatcgagtgagtttaattaagtcgttattcgcgtgttagtagttgggcgtttcgattttttagatcgcgtgagtttagtaaagcggttaggcgcgcgtttgtagttcggcgttagttcggatttcgggagtcgttttcgagttcgcgtggacggtagagggcggttgtagttcgggcgtaggcgtcgttggtttgcgggtttttttgggt

SEQ ID NO: 4058 - DNA, 212 bp, Artificial Sequence
  Description of Artificial Sequence: Synthetic polynucleotide
ttatttttcgttgcgggaaggggttgtttggttgtttttgggggtttttagagttattttggtttcgggggattggaggaggaggttatttattttgcgtcgtttttaattcgtgtattattatttattaaatagagatagattttgggttttttaaagacggatgattgggggtggtgattggtttatttttaaatatttattacgtaagg

SEQ ID NO: 4059 - DNA, 201 bp, Artificial Sequence
  Description of Artificial Sequence: Synthetic polynucleotide
agtagtagtaggagtagcgacgtttagattttcgggtgttgtcggggcggtcgcgttattcgtgcgtatagatttcgtagttaggtcgttcgggtcgtagcgggggcgtcgcgggcgcgggtcgggattgagttttcgtcgaggttattagtacgcgttcgcgtagtcgcggagtttttcgtattttcgtttttttgtttc

SEQ ID NO: 4060 - DNA, 246 bp, Artificial Sequence
  Description of Artificial Sequence: Synthetic polynucleotide
gcggggatattttcgggggtttcgggcgcggtttcggggaagaggcggaagttgaaattgcgcgacggggatatttgttgaaaggtcgtttagttcgaaacgagcgttagattttagtaataaaaggttaggcgaggttatatcgcgttggagatagagcggttgtttcggagcgtaggcggcggttcgggcgggaagaggcgttgggcggtcggattcgtagaggggcgtgcgcggagttgggcg

SEQ ID NO: 4061 - DNA, 201 bp, Artificial Sequence
  Description of Artificial Sequence: Synthetic polynucleotide
ggcgttgtatcgtttttgcggttttagaggttcgcgggtgtttgggcgcgggtggcgggcgggtcgggggtttgcgggcgtgtttgtgcgagagttgtttcgcgagcggcgtagagatattcgggcgagttgagagttttattttgttttatcggtggaatgggtatattcggaaggcgtagttgttttatttttgggagg

SEQ ID NO: 4062 - DNA, 201 bp, Artificial Sequence
  Description of Artificial Sequence: Synthetic polynucleotide
ggttgcgcgacgtttttcgtcgttgggggagattagtaaagttattcgtttttggatttcggggtttgggtttttagatttcgtttcgcggcgggagatgcgtttgagttttttatagacggagcgcgttttagtttgacgtagagggatgaatagataagcgtatcgggcgggaatttcgattgtttgtgtatttggggt

SEQ ID NO: 4063 - DNA, 358 bp, Artificial Sequence
  Description of Artificial Sequence: Synthetic polynucleotide
gatatttagcggttttagggtgaatttcgatcgtagtcgtcgtcgtttcgggtagagtttgcgtttttgttttgcgtttcgggcgttgaagtcgggcgggcgatgttcgcggcgtgaaagcgttcgcggcgggcgtcgatttttgttttagttttttgtttttttcgtttcgtttgtttcgtgtttttgtgattttggttttggcgtcgtcgtttaggcgtttcgtaatgtagttgtttttgcgtttcggcgggaggcgttttgtttcgcgagcgttcggggttcggagttcggtttgggggtttagtcgagttcgggcggggtcggggtcgcggtggcgatgtatcgggttcgttag

SEQ ID NO: 4064 - DNA, 201 bp, Artificial Sequence
  Description of Artificial Sequence: Synthetic polynucleotide
cggtcgggttttttggagagggagtgtaaggaggagtagtgttttttcgaggaggttcgggagatttttaaggacgcggagaggacggtgagtttagtttcggggcgtttcgcgtcgcggatattgtaggcggcggtgaattaggtcgcgtggggtcgtttgcgtttttttggttgcggttgtgggcggcgaatacgtagc

SEQ ID NO: 4065 - DNA, 201 bp, Artificial Sequence
  Description of Artificial Sequence: Synthetic polynucleotide
gttcgggacgcgagagggggcgcgacggcggttgcggtcggttcggcgtttatttggtcgtttttgcgagtagcgtttcgcgtttcgttcgcgcggagttcgtatttttcggtcgcgtcgtcgtcgtcggcgaggagtcgtattcgggcgtagcgtcgttcgttcgcgatgacggtcgttcgggtcggggacggggaggcg

SEQ ID NO: 4066 - DNA, 201 bp, Artificial Sequence
  Description of Artificial Sequence: Synthetic polynucleotide
agagagaattcgaggttgtttttgtcgttgaaatttgagcgggagagtatttcgaagtcgtttgcgtggagcgagtagttttcgcgttatgggttagaggcgttcgggagaatttgcgggttacggattatattcgtaggggtttggcggagtaaggtgtcgttcgtcgtttgcgggtaggagtcggttttgggtttcggt

SEQ ID NO: 4067 - DNA, 277 bp, Artificial Sequence
  Description of Artificial Sequence: Synthetic polynucleotide
tcgtagagatttagttttgtttgtcgattggtttttcgacgtcgtcgtcgtgtttgagtttcgttgtttgttcggataagtagaatttcggtaggcgtagcgggcgtcgaggtttgggttttagtcgtggcgttcgtttcggcgtagtggggagtcgcgggcgtcggagaagcggtcgcgttgtttcgggttattgtatcggttgaaaaaattaaaagtaaaattaatatttagaaacgaagtttgcgtgttttcgggggtttcgttttgttttttt

SEQ ID NO: 4068 - DNA, 201 bp, Artificial Sequence
  Description of Artificial Sequence: Synthetic polynucleotide
agttagtggaatcggagggggatttcggaggaatttgtttttgatgtttcggttttttggttttttattagaattcgtagaggattcgttttggagttttcgtgcgttttggtagaggtcggggacgttagagtgtacgtagttttttgcgcgtcgagtttaggtttcgggcgtagggaggatcgggttgagagtagggtg

SEQ ID NO: 4069 - DNA, 247 bp, Artificial Sequence
  Description of Artificial Sequence: Synthetic polynucleotide
gtaagggtcgggagtttggttttttatgaagttgttttaggtcgggattagttttagtttcgacggtcgttgcggtttcgtttcggtagtttcgtgagttcgcggaggagtttcgtattcgatcgtgtatagcgatcgagttggcgcggttcgtatgaagcgaagcgtcggttttagtagcgtagtttgagtaggggattcgcgtggtaattagggttgcgcgcgagttcggggcgattgtggcggt

SEQ ID NO: 4070 - DNA, 201 bp, Artificial Sequence
  Description of Artificial Sequence: Synthetic polynucleotide
ttttcgcgcgtagttcgcgtagcgtttagagtcggacggcgtttttcggtggcggcggaggagttcggagggacgtagtcgggtaaggtagggcgtagggcgggcggcgcgaggcgtagggcgcggcgggtagaggttatttggttattttttttggcgttcggggaaggtgcggcgatggtcggggcgcgcggggcggcg

SEQ ID NO: 4071 - DNA, 201 bp, Artificial Sequence
  Description of Artificial Sequence: Synthetic polynucleotide
cgttaggttcgttttcgttcggtcgttcgttcgttcggtgggtcgcggtggtcgcgggttgcgttgcgcgggtcgggtttggcgggtcgggggttgcgcgcgttcgcgagggcgttcgacgcgggttgaggggcgttggcgtgtgttcgtaggcggttttgcgcgggggacggcgcgtttttggatatcgtcggttttaag

SEQ ID NO: 4072 - DNA, 201 bp, Artificial Sequence
  Description of Artificial Sequence: Synthetic polynucleotide
ttttcgagtttcgcgattttttcgtttatcggggaaggagattttagcgtcgttgttttgttttttttgaacgttgtttttgttcgatttggagtcgtcgcgggagcgttttatgttgcggaaatattgtttttagcgttgtcggtcggcgtttttttttagttttttttttttggttcggcggttttggaattaaatttg

SEQ ID NO: 4073 - DNA, 356 bp, Artificial Sequence
  Description of Artificial Sequence: Synthetic polynucleotide
aatacggagtacgaatataagtaggtatcgtatatttgcgagttattcgggttttcgggggaaggtaaaaagttttaataagttttaagtaagattaggacgtttttatagttttgttttgatagttaaggaaaaaatttgttaaaaattagaggcgttgttgagtgttggcgtgggaatgttagtttagttagagttttgttttgggttatttaaataaaaatagatatgttggtggtaaatgttagttgaatacgtaggagagcggtgtttttcgggttcggagaagggtttgtagttgtatttttttttttttttttttttggtttttttagtttttttattattacgattag

SEQ ID NO: 4074 - DNA, 201 bp, Artificial Sequence
  Description of Artificial Sequence: Synthetic polynucleotide
ttaacgtttgtttttattttaagttttgttatagttgttatatttattattgttcgcgtttgtgtcgtcgcgaggattgggacgtttataaggcgcgttgcgtgtacggtcgcgtgggtagcgtgtgtcgttacgtattgtagttttgtcgcgatagcggttcggtgtatcgcgttttttcgcgtatcgcgcgtgtcggtt

SEQ ID NO: 4075 - DNA, 281 bp, Artificial Sequence
  Description of Artificial Sequence: Synthetic polynucleotide
agtttcgtgcgtcggtttttgtttcgttagtttcgttatggttttttatttattttcgcgggagcgtttttgtttttttattttgtattttttttagagtcgcgcgttagtttttcgtttcgtggaagcgtttttttttcgatttcggttgattttcgttcgtcgtttttttcgcgggtgcgcgttcggtttttttttcgttcggggcgggtttgcgtgggcggtgtttcgggtcggcgggcggagtttcggttttttagttttgcgtttcggtggagttc

SEQ ID NO: 4076 - DNA, 222 bp, Artificial Sequence
  Description of Artificial Sequence: Synthetic polynucleotide
gtttaggttatatattagattttattggggatgtgagaagggtgtagcgggcgtgaggtttcgttttcgtcgttttttgttcgtttttagattcgcggttcgtttggtcgttttatttggtcgatggcgttggtggtgagtataggaaggttattatagttttaatttttgaggtaatggttgaagttcggcggggcgaagtcgttgtacgaggggtcggta

SEQ ID NO: 4077 - DNA, 237 bp, Artificial Sequence
  Description of Artificial Sequence: Synthetic polynucleotide
cgggtttggattaggacggcgaggcgggtcggcgcgcgcgcgaggtggtttttatttatatttagcgcgagttgcggttgcgcggcgtttttttgcgttacgagttttcgcgcgtttacgagtagttttgcgagttcgtcgaggttaataggcgttttacgtttattattatttattttacggatcggcgtatcggtcgtttttttatgtgtatgattatggtcgttttcgagtcgc

SEQ ID NO: 4078 - DNA, 201 bp, Artificial Sequence
  Description of Artificial Sequence: Synthetic polynucleotide
tttggttttttaatttagtagtgtttttgaatgaacgtgtgatagtttaatgaagtagtcgagtattttgatttgaatgttggagtcggggtttatagggggttgtattagttagtataggttgggttatgttattgtgataaagagttttagattttaaatttcgtttttgtgggttagttgaggtttttgttttaggtt

SEQ ID NO: 4079 - DNA, 364 bp, Artificial Sequence
  Description of Artificial Sequence: Synthetic polynucleotide
gttttattagtttttcggtcgagcggaaggcgtcggcgtttagttgggttaagttgttgtagttgaggtcgaggaatacgagtttggtcgagtcgttgaacgtgtttttttttagcgagcgtagcgagttgtttttgaagtttaggtagattaggtcgtcgtagaagatgaagaagttttcggggattcgttggatgcggttgtcggttattagtagtttgcgtacgtttagggggaaagggtttggtacgttgggtagttcgcggtcgcggtagtttacggtgtgcgggtcggtgtaggcgtagttcgcggggtacgcgtgttcgggcgcgagtagtagtagaaggttgtagagttcgagcgt

SEQ ID NO: 4080 - DNA, 201 bp, Artificial Sequence
  Description of Artificial Sequence: Synthetic polynucleotide
gaaattaattcgttagaaaaattttttgggagaggcgggagcggtaggggtggtcgagtggtcgtcgttaaaacgcggttttattttggtagttgattttcgagatttggtagtaagacgtcgcgcgtatcgggcgggttgtattcgacgtttaagtttagttattaagtttaggagcggtttttttaaggcgtgtttcgg

SEQ ID NO: 4081 - DNA, 201 bp, Artificial Sequence
  Description of Artificial Sequence: Synthetic polynucleotide
gcgtttttttttggggtgggtagcgtaggtttggtttgcgggtggggggtggagagtgagaggtacgcggggtattagtttagtttttttttggggatttcgtattcgtagtttaaggaatcggtggagtacgaattttatttttgagttggcgtaagcgttttttttttatggagatttatttcggtttttttttgaggt

SEQ ID NO: 4082 - DNA, 201 bp, Artificial Sequence
  Description of Artificial Sequence: Synthetic polynucleotide
aggaatcggcgttgtcggtgtttgggggtcggggcgcgggcgaagtcgggtcgcggaggatataataggtagagtcgggggtgttcggtcgcgcgtttttcgcgtattatgtagttttttgttatttttttcgtttttaggttaaaattttgagtatgatggaagataataagtagttcgcgtttcgtatcgatggggcgg

SEQ ID NO: 4083 - DNA, 222 bp, Artificial Sequence
  Description of Artificial Sequence: Synthetic polynucleotide
tgcgcgcgtgcgtgtgtggcgtgtgtttgggtgttttatgattgtttttcgtgaggtcgtgtgtgagtttttgcgtgggtcgtgagtgcggtagggagcgcggtgttcgggggtcgtttgtcggtgtgtttgtgcgtgtttgtgcgttagtttttgtttttgcgagtgcgtatttttaggatcgagtttgtttatatgagtttgtgtttgtgtgtgtgcgtt

SEQ ID NO: 4084 - DNA, 201 bp, Artificial Sequence
  Description of Artificial Sequence: Synthetic polynucleotide
gataataagatttgttattgacgttatcgggttggtgatatttaggtatagtagttttagtaaacgaatatatttttatgagaattaagttttttgagagcggtaagttgttttgttttgtttatagttgataagaatacgtttgtacggttatttagtatttagtattgttatttaatcgttttattagtatgtatgaat

SEQ ID NO: 4085 - DNA, 265 bp, Artificial Sequence
  Description of Artificial Sequence: Synthetic polynucleotide
aggcgtatacgaggagttcggtttagtatttttaaattagatttcggaggcgtcgttagggagcggttatcgttgggcgtcgtcgagcgtgttcggggcgcggtcgtggcgggttttttggggcggtagttttaggcgcgggcgcgtagtagtttcgaaggcgtcgtttggtttagtcgttcggttttcgagcgtcgttgtaagtggggggcgtttcgcggcgtcgcgtatattttattggggggtcgtttcgtcggcgttcgtt

SEQ ID NO: 4086 - DNA, 242 bp, Artificial Sequence
  Description of Artificial Sequence: Synthetic polynucleotide
tcgggttgttttcgtcgtttatcggagagggtcgttcgggtgtttggttttgttcgaaagtttttgggtttttttttttttttgtaaaatttaaagtaatcgaataaaaagagtttaggtcgcgcgggcgggttgcgcgttcgcgttttgtagcgcgtcggcgggggttcggttcgcggggttattgtattgagtcgggtagtgtgtggtggtggtggtggtgtagcgtcgtcggcgggggc

SEQ ID NO: 4087 - DNA, 201 bp, Artificial Sequence
  Description of Artificial Sequence: Synthetic polynucleotide
ttttagggcgtagggttacgagttttcgtttttattttcggtttttggtattcggcgtcggtttcgtcgtttttttttatacgtatttttggtagggtttcgcggggcgttttaaagtttgggggtagtttttaggtgtttttgggaagggaaagaaaggttataaagtaaaagaaggagtaaagagaaggcgagggagga

SEQ ID NO: 4088 - DNA, 261 bp, Artificial Sequence
  Description of Artificial Sequence: Synthetic polynucleotide
tcgtttatcgatgagtcgtcgtcgttcgcgttcgggtgtaggtgcgtcgtcgtcgcgtgtaggtcgttcgcgtgtgtatgttcgtgtgcgtgttcgtgggcgtttagatgcggcggcggcgacggttttagttgcgtttcgtggttattttcgtgtagcgcgtggtgtaggttcggtttcgcgtcgttatcgttcgtcgttagtatttcggttaggtcgtcgtcgtcgtttttcgggtaggtcgtttgcgcgtatagttcg

SEQ ID NO: 4089 - DNA, 201 bp, Artificial Sequence
  Description of Artificial Sequence: Synthetic polynucleotide
cggtgttttgggtcgagtcgtttggagattttagattagtatgtgggtgggaaagggcgtttcgttttgggttttttcgtttttgcgcgtagagtagagacgcgtagattcgtttttatttcgtttggtttttttggagtagtttcggcggcggtagcgatgggttgggaggggtcggtacgttggtttgcgcgggttttt

SEQ ID NO: 4090 - DNA, 337 bp, Artificial Sequence
  Description of Artificial Sequence: Synthetic polynucleotide
gaattggataataatgtggcgtttgttattggttaggggaggtagacggcgttttgattggtcgggttcgcgttcggggagtttcgtattttgtagtgttcgaaagattcgaaattttaaaagttttattgcgtgtttttgggaggggagggggcgcgttaggaaaggagtggaaaaaagtgggcgaggaggagcgttgaaaattttttgataagtagttttcgtgcgttcgagagcgtgtgaattgtttttaattatcgtgttcggtgcgtttttttgcgtagatttgtgtaatttttcggtttttggggcgtcggttcggttgtatcgtttttat

SEQ ID NO: 4091 - DNA, 201 bp, Artificial Sequence
  Description of Artificial Sequence: Synthetic polynucleotide
tgaagttgttttttcgggataggaagggttaaatggttgcgcgttaattcggtttcgattggggtgttagggagtaagagtcgtttgtttcgggggatttcgtttggggggtttttaggggtcgttttggcgtttcggttataatttgggcggttttgtgcggcggttttcgtttgcgtttttgcgcgttatttaaaattt

SEQ ID NO: 4092 - DNA, 201 bp, Artificial Sequence
  Description of Artificial Sequence: Synthetic polynucleotide
tagtaggtagtgcgggtatagtgttgtagattattatttcgttaggttcgggtagcgtttattagacggataggcgttcgcggtcgtttttatttcggcgcgtttatttcgagttttttacgtcgcggcgggcgggcgtaatatatttttttatttttagtcgtcgaggattatatttttcgtttagttttttcgatttat

SEQ ID NO: 4093 - DNA, 201 bp, Artificial Sequence
  Description of Artificial Sequence: Synthetic polynucleotide
ttttgaatcgttatttgtttattattcgggcgttcgttatttattaggcgttgtattagaggcgttatacggcgggtatgttggcgttgttttgggcgttcgttttgggtttcgtgttgttgttttcgttttgggtatcgcggttcggcgtcgcgttatcgcgagtttattattcggcgttgttggtcgtcgcggcgttgt

SEQ ID NO: 4094 - DNA, 201 bp, Artificial Sequence
  Description of Artificial Sequence: Synthetic polynucleotide
gtttcgtgcgtttagttttgtcgggcgtcggcgacgcggcggtcgttgtcgttgtcgttatagtcgtgttcgtagtgttttaggcgtaattgggtattcgcgtcgcgggttagtattggtaatttagtcggggttcgagggaagcggagattttcggttttcgacgtttttgggtatcgtcgttttttttttttttagggt

SEQ ID NO: 4095 - DNA, 386 bp, Artificial Sequence
  Description of Artificial Sequence: Synthetic polynucleotide
tgtttgttgaaaaataatattgtgattatttttagcggcgaagggtgtgtttgggaacggtttggggaggggatagaagagagaggggtgggatggacggcggtagaagtgggaggtatacgaggagttattggaaacggcgtttttgtggaggagtcgggggggatggggagtagagggagggggttttgttgttttagcgtttcgaggtcgtggagcggtagtagttgtagtcggagtagtattagtaatagtaatagtgagcgggacggagttaggatcgttcggagcgtataggtttcgaggtagtataaggtttgttatttttttatttgttggtagttgtagaagaagatttgttttttaagtgaaacgtatatgttatt

SEQ ID NO: 4096 - DNA, 201 bp, Artificial Sequence
  Description of Artificial Sequence: Synthetic polynucleotide
aggttatataggggtcgggtgtaggttttacgcggaaaggcgcgtagtgttcggggtttatgtcggtttagggcgtataggttttcggggtttcggggttcgcgttgttcgcgtcgtttgtgagcgttcgttaagggggagggatttgggcgcgggggcgcggagttttcgggagcggcgcgcgtcgcggggggcgggggg

SEQ ID NO: 4097 - DNA, 201 bp, Artificial Sequence
  Description of Artificial Sequence: Synthetic polynucleotide
tgttagggcgtagggagggcggtattcggttttagttttcgtaatttcgcgcgtttttttcgtcgtgggatttgggttttcgcgtcgtttttttgagtttcgagcgcgcggcgggcgggagttaggttgggattggtggtgaggtagggagtgaggagcgagcggagtcgcgtgcgtcggcgcgtagtttcgggtcgtttt

SEQ ID NO: 4098 - DNA, 309 bp, Artificial Sequence
  Description of Artificial Sequence: Synthetic polynucleotide
tttgggtcgcggcggtttttatttcgttatcgtcgtcgtcgtcgtacggttgttcgtcgcgaataagtatcggtattattacgcgacgtagtaggtcgggcgcggcgtgtagttcggcggatgttgttaggttaggcgatttcgtcgtttttggagcgcgagcgcgttttagtttgtagcgatgattttggaattagattttgatttgcgtgggcgtgaggcgaagtaggttcgttagttgttcgcgttcgggcgtagataggtatcgttgttgtcggaagcgtcgttttaattttagcgtttgcgttt

SEQ ID NO: 4099 - DNA, 203 bp, Artificial Sequence
  Description of Artificial Sequence: Synthetic polynucleotide
tattttgttttcggtcggtgattcgttgtggtttttaggttaagtgtttttcgtgttcgggcggttgacgttgtttgaagtttacgcggcgtgtcggcgacgcggcgtcgtggtggttaaggttgggtatttttacgtcgtttggaagttttcggggttagattagtgcgacggcggttggttggttgacggtagtgtgcgtt

SEQ ID NO: 4100 - DNA, 388 bp, Artificial Sequence
  Description of Artificial Sequence: Synthetic polynucleotide
atcgggaagtagttcggtgttttaagttttttgagatttttcggatttgcgcgtcgttcgttcggtagggggttcggtaggcgcgggcggcgggtgggggcgggaggttttgttcgttcggtggttgtcgcggtttttttcgcgttgttttttacgtttggtttattatgtacgaggtaggtaatttgttttttttttcggggatttatttcggagataagaaggtagtttgttttttgtaatggtttttgttggagtgcggcggggtttaggcgcgagcgggggtacgggcggggagttggtagcgaaggatgcgttcggcgtttttcggcggtcgttcggagttcgaggtcggcgcgggaggagcgttgatttcgcgggtcgagtt

SEQ ID NO: 4101 - DNA, 241 bp, Artificial Sequence
  Description of Artificial Sequence: Synthetic polynucleotide
gagggcggcgcgtagcggcgtttcgcgaggtttttacgtcgggcgatatggggtgtttgttgtttttgttgttttgggcgtttttttaggtttggggaagcgttgaaggtgggtggaacgagggcgtttgagtgtattcgcgggagggcggagagagggagttgggtagggacggggagggtaacgtttgatggggattggtgagattcgggacgtattggcgcgatttaggtagaaaatt

SEQ ID NO: 4102 - DNA, 232 bp, Artificial Sequence
  Description of Artificial Sequence: Synthetic polynucleotide
gggttttttatttgtatttttttataaaattgtcgttcgtgtgtgtttttgcgtttggttttttgtatttttaaggggtttttgaagatagggtcgaatgcgcgcgggggttttaggtattttgcgttttacggcgggtttcgtagttcggttcgagtcggttttggaagtttcgttttggattagattggtatcgacgtcgtttttagtttgagcgttgagagggaaaacg

SEQ ID NO: 4103 - DNA, 214 bp, Artificial Sequence
  Description of Artificial Sequence: Synthetic polynucleotide
gaattttttttagtgtcgtaattaggaaagttttaaaaagtaaggattttagatagataagagatttatttttttttttagtataagaaatatttcgcgtcgcgttagtcgaacgttgttcgtataaggttattcgttttttttggtcgggacgtattcggtgttttttagttttttattagaattggtttagggggcgcggaaatagagaggt

SEQ ID NO: 4104 - DNA, 250 bp, Artificial Sequence
  Description of Artificial Sequence: Synthetic polynucleotide
agtagggattagttggtcgtcggtttttcgggtaagatggggaatcgggagatggaggagttgatttcgttggtgaatcgtttgtaggacgcgttttcggcgttgggatagagttgtttgttggagttgtcgtagatcgtcgtggtgggcggttagagcgtcggtaagagttcggtgttcgagaatttcgtgggtaggtaagcgcgtagggcgcggagtaaggatgcggtagtggggcgatttcgttgcg

SEQ ID NO: 4105 - DNA, 201 bp, Artificial Sequence
  Description of Artificial Sequence: Synthetic polynucleotide
ttaggattttgtagattcggtcgcggtcgggtcgagtgtttttcgtcggggttttacgtttacggtttacgtttgtaatattagggttgtacggcgggttcgtagttgggtttgcgtttgggattcggggttttttgcgtttttcgtgtcgtattttttgttttaattttaagcggacgggttttggggttttatcggtta

SEQ ID NO: 4106 - DNA, 467 bp, Artificial Sequence
  Description of Artificial Sequence: Synthetic polynucleotide
tcgtttttttttacgttttttttttcgttttttttcgcgtttagtttcgttttttttattttgtaaaataaagtcggggaaaatgtttgttcgtgtagttcggagcgcgtagttcgtttttgaataagaagtgagtataatggcgtgtttgtaaaaaaaagttttaagttcgttttttttaaaaaatattttgaatgttgtatgttttatgttttttagcgtttcgcgggagagattcggttatagagtaggaggtgagatttttttttcggtatttttatttttttggtcgtacgtttttttgttttagttttttttgggaggattgtaaatgtttttttttagtaagcggtcgttttttattttcgtttcgcgtttaaagtgttgggttataatttggatttggaggtaaatttttgttagattttttttacgtcgttttttttttttttttcgtcggtgttcgg

SEQ ID NO: 4107 - DNA, 201 bp, Artificial Sequence
  Description of Artificial Sequence: Synthetic polynucleotide
ttcgaggggtttatagtttggtattaatttgtaggtgttcgttgttgatttggtttttttttcgatttgcggacggttttttttagcgattttcgatatacgtttttttgttttcgtcggagggtcgggtttggggtcgtcggagtttgcgggaatttagcgtttattcgttgattttcgagtcgtttcgttagttgtgcg

SEQ ID NO: 4108 - DNA, 232 bp, Artificial Sequence
  Description of Artificial Sequence: Synthetic polynucleotide
ttggggtgtttttaggaagtgaaggaaaaggttttcgacgatattgttattggaaaagtgttggttacggttttcgttttattttttttatttacgggttcggagtttttaggagtagttagatcgattatcgtttttgtagttttatttgttttcggagagatatttataagttagtttacggagagtttggattcgttcgttttagtatttacgtttttttcgcgttcgg

SEQ ID NO: 4109 - DNA, 222 bp, Artificial Sequence
  Description of Artificial Sequence: Synthetic polynucleotide
ggttagggatagtaaaggagatacgggtgggtgagacgtcggattttacgagggtttgttgtttttttggcgcgggcgtggaggtattggttagagggtacgtttattagttcgagattttcgggatgaggttattttttgagtttatatttggatatttattttttcgaatgcggtgattttatttatattatagcggttattagcgggtttgagatcgtg

SEQ ID NO: 4110 - DNA, 239 bp, Artificial Sequence
  Description of Artificial Sequence: Synthetic polynucleotide
ggtttttaggcggagcgcgggcgcgaggtgcgggtttcggggcggagcgtacgttcgggaggcgggaagtgggtagtagcgttttcgtttggtttttgtgcgtttcgattcgacgttttttcgttcgattaggtgtttcgagagcgtatagttgggagggttttttcggtcgcggcgagatttacgtttgcggtgtgttagggcggcggcgacggtgacgggcgtggggcgcggcgttg

SEQ ID NO: 4111 - DNA, 209 bp, Artificial Sequence
  Description of Artificial Sequence: Synthetic polynucleotide
cgtttcgggggtttttgtattttagtcggggaatgttgttattttgaggggggttgtttggttgcggggcgtcggggttgggggtattgtttttttaggacgcggtttcgtagtgtagagcgtcgtcgtttgcgtggggggatttggtagttttaggggttgttttgagttttttggcgagtaggagtgagttgttgcggcgagtgagt

SEQ ID NO: 4112 - DNA, 380 bp, Artificial Sequence
  Description of Artificial Sequence: Synthetic polynucleotide
gaggtcgggtttcggcgattttcgagggaggttcgggaattattttcgatttaggcgttagattcggagtcgtacggggtttttagtttagtttcgcgagcggttgttgatcgtttttttcgcgttcgttagggtttttgtttcgcgttagttatcgcgcgttttttttttgtttatgtcgtagttttcgtggtttttgttttggattcgggatgttaggttgagatacgttttgtaaatttttggtagaaatgggcgtaagggggtggatttcgttttcgtttttcgggtttttttttttttttcgtttatatgtttttttattattttttttttttttttttattgtattttgatgaaatggttttgtttgtttaaat

SEQ ID NO: 4113 - DNA, 394 bp, Artificial Sequence
  Description of Artificial Sequence: Synthetic polynucleotide
cgggtcggtagggattaagagtttgaaagggaatttgttttttttttttcgtagttcggttattaaggtaagaaattgtaggtagagaagttttcgaattcgatttaggacgtcggcgtttgttaggattttttcgtttgtttttcgcgtttcgcgcgcgtttatgttattattacggggagggtgtatgcggtaggtgtttggtcgaggttttcgggagcgagtcgtttttacgtgttttagtttgtttttttttcgaagttagacgttggcgttgtagttttgttgtttgacgttgttgtagaagttcgcgtttattcgggttaggtttggggagggttttttggggcggtttttgagttttatttgttcgaagtttttatggggggaggtc

SEQ ID NO: 4114 - DNA, 201 bp, Artificial Sequence
  Description of Artificial Sequence: Synthetic polynucleotide
tttcgttcgggttttttaaatatgtcgtagcgtggttgtttattgttttttttgggtaagaggaggttttagatatttttacgggatttgaattttcgagcgttttgtacggagtagttatttcgttagtattttaaagtgaagttgtttataacggataagttcggagattttatgagaggtcggggtggagaagtcggg

SEQ ID NO: 4115 - DNA, 557 bp, Artificial Sequence
  Description of Artificial Sequence: Synthetic polynucleotide
gtcgttatcgtttagtttcgttgtttaggtgggaggggttatttgtcgcggggtttttaagttagtgtcgtttgttttcggtttttatttattgatagtacggcgttcgagtgattttgtttagtttcgttttgcgtttttgtaaattacgttgttgcgttaattataaatttggttaatatgtttttgtaattttattatttaaaaacgtttttaggtatttggtcgttgttagattaggttcgcgggttcggaggaggtttttttatttgttttcgttagtttcggggatcgtgcgcggttttcgtgtggttttcgtttacgaggtttttcgggtaggaatcgtcgcgcgatttttgtttagcggtcgcgttttggttacgggcgatttttgtcgggaattttgttttcggttaagttgcgttttcgtatttcggtggtttttattcgagttcgcgtttgttggttttttttttggtttttttgtttgatttcgattttgttttcgaattttatttttagatttttttcgttttggaacgtcgatttttttttcg

SEQ ID NO: 4116 - DNA, 212 bp, Artificial Sequence
  Description of Artificial Sequence: Synthetic polynucleotide
agttgggtttttttttattttaaaatttttatttttagtttttaaaagttattttagttcgttatattgaaattggtacggtttttaaagatttttttttcgtagttgtggcgtttttaagaaaatacgagtacggattaggttttggatgagtgttcggttatcgagaattagttattttttattttttaggattttttagttttttttag

SEQ ID NO: 4117 - DNA, 201 bp, Artificial Sequence
  Description of Artificial Sequence: Synthetic polynucleotide
tttttaatggtttagtcgatcgtgtgtataaatttgcgttttattcgtcggggatcgttgggagcggagataaatttaatttttagggtaattttggtttcgttcgttttattttattttgtgtttaaatagagttttttttgaagttgcgaatatttttaggttttttgggtagggttggaggggtcgaggagagttatt

SEQ ID NO: 4118 - DNA, 201 bp, Artificial Sequence
  Description of Artificial Sequence: Synthetic polynucleotide
ttttggataataatgcgcgttttcgtttttttagaaagttagggacgtttttagtcgtcgttagagttggttcggttttttagttttttttcgtggtattcgtaggcgagataaagttcgttttcggtgaggttgcgcgcgtttaaagcgtgcgggatgtttagtacggaggtttttaagcgggggatttttggttttttt

SEQ ID NO: 4119 - DNA, 294 bp, Artificial Sequence
  Description of Artificial Sequence: Synthetic polynucleotide
ggtagatgacgattcgtcgagttcgtcgtttgttttttcggaggcgttcggagttgttgcgggtttcggtcgtcgttgttattgttgttgtcgtcgtcgtcgtgcggggttatttgaaggttggggcgcggaagtttaatttcgtgttgattgggttttaagttttttgcgttttcgtttcgtttcgagtgttcgcgaatttttcggacgtttacgtagattatttagttatattataattttgtttgcggagagaggagaggagaaaaaggggtcgttttaaaaatttttaaa

SEQ ID NO: 4120 - DNA, 244 bp, Artificial Sequence
  Description of Artificial Sequence: Synthetic polynucleotide
tagttttgagtcggttgtcggttaggtgttgggtatattcgcgtcgtcgtcgtcgttcgtttttggtcgcgttagtcgtagggttttcggcgttcgggggcggtagtaggttggagcgtatcgtgcgcgttttgttttttcggcgttttcgtcgtttcggaggttcgggtttttcggttttcgtcggttttcgttttatggtcgcgtgtcgtcgcgttcggttttttcgtcgtttacgttcgtt

SEQ ID NO: 4121 - DNA, 303 bp, Artificial Sequence
  Description of Artificial Sequence: Synthetic polynucleotide
ggtttggggttatgggaataggattaaggttttttgagcgtcgggtttggtttttgtggtttcgtaaattttttagtttgtgtgttacggcgacgcgtagcggttgagtcggagtttacgcggcgcgcgtttttcgcgaggaatttttcggtttgtaggttgtttgttattttcgtttttcgacgcgtttttttttggttcgcgttttcggagttttttttttttttggcgaggatttttttcggcgttcgcggtttcgattttcgtcgcgttgcgttcgttttttcggtttcggttgtttcg

SEQ ID NO: 4122 - DNA, 286 bp, Artificial Sequence
  Description of Artificial Sequence: Synthetic polynucleotide
aatagattttcgagttgaaaaaataaaaataaattggggagttagagtttttgaaagtttcggtaggaaatttaatgggttttttgtttttttaaattttcgttttcgttttcgttgatattttgtaaagtcgcggcggtagcggcggggattacgttgcggtgtattatttttcgttattttttcgcgttgggttggggtcgagggggtttcgtagagtcggtaatcgaatcggttttggtttgttttttttattttttagttattattagaattagttttcgcg

SEQ ID NO: 4123 - DNA, 261 bp, Artificial Sequence
  Description of Artificial Sequence: Synthetic polynucleotide
tggttgtggaattagatttgttttgaatttagtggagcgtatcgttggggttcggaagttatcgttcgcgggtatcgggttggcgttgttcgagtggaatcgatagtttgcgagtttcggttgtaagtggtttttttttttcgcggttgttgtttagtgtcgggtgagggttgcgagtgtggtaagttgtaaagagagttttagaggttcgaagagcgttgcgtttttattcgcgttcgttttttttttttttcggttttt

SEQ ID NO: 4124 - DNA, 201 bp, Artificial Sequence
  Description of Artificial Sequence: Synthetic polynucleotide
gaacgcgtagagagttttttggagtgttttgattttgttttcgagagggtttttaattttcgtatttttttagtggttgttttggtaggtgcgcgttttgcggggagttgcgtttcgggggttatcgtcgagcgggagttgttttttggaattttgtttatcgcgaattgggtgtttattttttatttttgttttttagtg

SEQ ID NO: 4125 - DNA, 201 bp, Artificial Sequence
  Description of Artificial Sequence: Synthetic polynucleotide
tcgcgttttagtatcgagtgttttaagttttgcgcgtagcgtcgggtttggaaggcggcgaatggttgtttagtcgtcgtttttattagtgatattcggtcgttagttttcgtttaggatgtgtatatttgttggtagtattggttcgggtggtagttatcgggttatttattttataggtataatcgtatttaatttaat

SEQ ID NO: 4126 - DNA, 201 bp, Artificial Sequence
  Description of Artificial Sequence: Synthetic polynucleotide
gcgtttcgggaagtgtatggttttaaggtttaaggcgttaggatttaggtttttagagtttttaattagtgttattttttttcgtagcgcgggtgttagtcgcgagttcgtagtttttcgatattcgtttttttttggggttttcggggatttttttagaggttgtaaaggtgttagaagtttaaggtaggaggtagtttg

SEQ ID NO: 4127 - DNA, 201 bp, Artificial Sequence
  Description of Artificial Sequence: Synthetic polynucleotide
tcggcgtcgtcgttgtcgttcgggtttcgcgattcgggtcgggttgtgggcgcgcggtaggcgggttgcggcggcggcgggacggggcggtcgcgggttgcgtggggtttgtgcgcgcgtgtgcgcgggcgtcggttgtgcgcgtcgcgggcggatagggttcggtcggcggcggtaaagttgggattcgcgggtcgggcg

SEQ ID NO: 4128 - DNA, 201 bp, Artificial Sequence
  Description of Artificial Sequence: Synthetic polynucleotide
tgtttcggttgatttcgttttgtagttagtttgaggttaggcggtcgttttttgtaggttataaattttcggcgtaaaagtagggttttgaacgcgatatcgtattagagcgtttagttaagcgagttgtttttatttttattgtgtcgggcggcgtaaattgcgggcgtaggtagaggagtcgcggttttgcgtcgggcg

SEQ ID NO: 4129 - DNA, 201 bp, Artificial Sequence
  Description of Artificial Sequence: Synthetic polynucleotide
ttgcggaggggtcggtgggttagagttaggttaggtagttgttgagtttttttttttttttttggcgggagtgtgtgtgtaaggggttagggggcggagtcggagaaagggttgggggtgttcgtgtttagcgttttttcggacgcggttttataatttagttgcgagaatagatggacgtagcggcggtttatttcgggg

SEQ ID NO: 4130 - DNA, 201 bp, Artificial Sequence
  Description of Artificial Sequence: Synthetic polynucleotide
cgcggtttttcgtgggttggtcgggttaatgagcgcgcggttgtaggggcggcgggcggggagggggcgtcgagttttgcggatggaggcgcgggtagcgcggcgcgtttatttcgcgcgggcgttgttggcggggggcggcgtagttattggattcggatcggggtcgcgattcggggtggcgggtggcgtgggcggcgt

SEQ ID NO: 4131 - DNA, 201 bp, Artificial Sequence
  Description of Artificial Sequence: Synthetic polynucleotide
ttcgtcgatttttagaggtatcggttgcgttttttggtggtttggaacggcgcggagggtaagtttgttgtgatttgttacgatcgtatcgcgtagtagtcgtagcggcgcgagggggttcggttggggttggagtataagttcgaggtcgtcgtgttttcgtttagttgggtcggtcggttttcggtcgcggggtttcgc

SEQ ID NO: 4132 - DNA, 344 bp, Artificial Sequence
  Description of Artificial Sequence: Synthetic polynucleotide
gtcggttagagggtttacgtaagtttcgaaattcggggggacgttttttttatttttatttttgcgttcgttcggggttgggcgcgtcggggcgtacgtacgtcggtttgttggcgatttggcgtatttgttcgcgcgttttggttttagttgtcgtaggttttttttgtatttatttttagtttttaaagttagtgtagttagtatcgtttatttggagttttaatttttttttgcgattttcgtatatttattgtattttatttattattttcgggtcgcgtaggttcgggtttgcgaagatacgcggtttattttcggttatttcgtttatttggttaaag

SEQ ID NO: 4133 - DNA, 201 bp, Artificial Sequence
  Description of Artificial Sequence: Synthetic polynucleotide
attttttttcgcggcgttttttcgcgtagtttttagattgtttagtcggtgttcgcgggcgttcgttttttgcgagttttaggttcgcgcgagttgtttgcgggaggggtcggggatacggatagacgttgttttattagggattcggaggatttggtgggtaagagtatgatttagcgattttcgtttcgggtaagcgtt

SEQ ID NO: 4134 - DNA, 218 bp, Artificial Sequence
  Description of Artificial Sequence: Synthetic polynucleotide
attatttttttttttgtttaaaggattttttttttttttttgattttacgaatttatttttttaataggtttttaaagtatgggcggatgtgttttttttcgtttatcgttaggagtcgagtttcggtaggtgagcggtgtaaaatacgtatttagttgtttttagtttttttcgttttcgttgagttggttgtttttatttcgtattacggtattcg

SEQ ID NO: 4135 - DNA, 234 bp, Artificial Sequence
  Description of Artificial Sequence: Synthetic polynucleotide
gcgcgtttcgtgcgttttcgtttttcgcgcgttttcggtttattttcgtttttggagagttgtcgtttgcgttcgggcgcgcggttggttgttttttcggcggcggcggcggcggttttattagcggagttttcgtttatgattggtttcgttcgggaagttggagacgggcgatgaataattgatgtgtgcggtgcggtagtcggacggcggcggcggtggcgggtagtagcg

SEQ ID NO: 4136 - DNA, 201 bp, Artificial Sequence
  Description of Artificial Sequence: Synthetic polynucleotide
cgggggtattcgggtaggggtgttagatatagtattgtatttggtaatttttcggggcgtttagtgtggtttttttattcgggagtttggaagggtttttcgtagttcgtaggagacgtagcgtttttcgtttagggggagtaggaggatagttggtcgttttcgggagttttaggcgcgaagcggttttttttcgtttta

SEQ ID NO: 4137 - DNA, 201 bp, Artificial Sequence
  Description of Artificial Sequence: Synthetic polynucleotide
agttatagtagtcgtatttttcgtagcgcgtcggcgtttagtgtagcgtttttagtagtagcgttagcgcggtcgttcgtacgttttttttcgtcgtcgtcgttcgtatggttgcgttttttttaggtgcgcgtcgcgtagtttttcgacgttcggtgttcggcggtttaggtgtttcggcgtgcgttttcggttttgatt

SEQ ID NO: 4138 - DNA, 235 bp, Artificial Sequence
  Description of Artificial Sequence: Synthetic polynucleotide
tttcgcggtttgggggacgggagaatggggggtttacggtcgttttgggtttttatcgcgtatcgcgttcgtagcggagtttcggagttatggttttgagcgagttggcgttggttcgttggttgtaggagagtcgtcgttcgcggaagtttattttgtttatcgtgtttttggcgttgttgttggataatatgttgtttattgtcgtgggtacgtgcggatagggtatttttgt

SEQ ID NO: 4139 - DNA, 201 bp, Artificial Sequence
  Description of Artificial Sequence: Synthetic polynucleotide
attcgtttattttttatttttggtttatttatcgttatcgatatttgggttatcgtttttaaggtacgtgttacgtcgcggaattgtagcgcgtcgttttcgtcgtattttttattgttttcggtttgtttcgggtgggcgtttggtaaggtttgggcggaggttttttcggttcgcgggttagcgcgttttgttgggaaa

SEQ ID NO: 4140 - DNA, 241 bp, Artificial Sequence
  Description of Artificial Sequence: Synthetic polynucleotide
gttaataacgggcgggtttttatagttcgaagttaaagcgttaaaattcgagggaaggcgaggagggggcggtggcggaggcggttgcggggtcggggttcggttgagttttcgtttgtttaattttatttgttattgtacgcgtttaatcgtcgtatatttttcgtatttaatttggatgatattttgattttattattagtattcggcgtcggattgacgtagtttcgagtcggggatt

SEQ ID NO: 4141 - DNA, 201 bp, Artificial Sequence
  Description of Artificial Sequence: Synthetic polynucleotide
ggggtatttgtatcggggttgggcgggcgtatttagagttaggcgggtaggaatttttgcgtagttattcggtgtttgtatgtttttggcgcggaagggacgttttattagtttcggcgttttttttttttagatttttttttcgtttttttttattgtttgtttgttgtattattttttatttagattatttagatcgtt

SEQ ID NO: 4142 - DNA, 201 bp, Artificial Sequence
  Description of Artificial Sequence: Synthetic polynucleotide
ggtcggcgcgcgtgggtttcggcgaggcggcgttgtaggagttttgcgggtagttggagcgttatttgggcgcggcggtttacggttgtggcggcgttatcgtgcgcgacgtttttttcgcggttaagggtcgcgcggtcgattgcgagagttcgcgcgagtttcgggagcgggttttgcgcgtttgatgggtcgaggcgg

SEQ ID NO: 4143 - DNA, 217 bp, Artificial Sequence
  Description of Artificial Sequence: Synthetic polynucleotide
tcggcggcgagcgttgtattattttacgcgggcgtcgagtcggggtcgggcgtcgcgatcggagggattttttgtttcggcgagttagtttcggagttttcgcgtagcgttcgcgtcgtcgttgagtttttttagttttttatttttaaaaaagttttttttcgtgtgtgtgcgtgcgtgcgcgcgcgcgcgtcgttttggtataagttagttttga

SEQ ID NO: 4144 - DNA, 201 bp, Artificial Sequence
  Description of Artificial Sequence: Synthetic polynucleotide
tagggtttcgatttttcgtggggtacgcgcgatttcggcgtagatgttagttcgttgtttttcgggttgagggagcgaggattttagacgattttagggtcgttgtttaggtttagtttcgcgttttttatttcgttatttcgttttgcggttttagtttggagatttacggattttattgcgattttttgcgtagtgtag

SEQ ID NO: 4145 - DNA, 201 bp, Artificial Sequence
  Description of Artificial Sequence: Synthetic polynucleotide
taaatgggttaaataggttcgtaaggttttcgcgggttttttggttcggaagttgagtcgcgggtgtttggtttgaagtttcgcgttttatagtggttcgcgggtttcggcggtttttgttttacgttttttaaggtattaggtaggtggttttagggtttttgtttacgatattttttgggtggggtaggattatttttt

SEQ ID NO: 4146 - DNA, 201 bp, Artificial Sequence
  Description of Artificial Sequence: Synthetic polynucleotide
tgtagttcgttcggcggcgttttcgggcgagggtttggtgttggggagcgagcgcggagcgaggtgtttttttaaatacgttttgtagtgtgacggcggtcgttcggttggaagagttatttttattttgcggtaggagttcgttcgtcgttatcgttcgtttcggtttttatggttacgcgtttgttttcggtttcgggt

SEQ ID NO: 4147 - DNA, 317 bp, Artificial Sequence
  Description of Artificial Sequence: Synthetic polynucleotide
cgcgttttgttattaggcgttgtagttgttggtcgagttttgtgttcgtggggttttggagtacgatagttgttaggattttatttattatttgcgggatcgtgttagatttcggtttcgcgatttaggtgagtgtcgttatcgtcgtttggagggatttaagggttttgggttgggatttggggtcgtatcggggtttgaggtagaatagcgacgcggattgggagagggcggggggcggttatcgagttaggagagtgattaagaattagcgtattgtggtttgatgttgtaattaggcggggattcgggcggtg

SEQ ID NO: 4148 - DNA, 221 bp, Artificial Sequence
  Description of Artificial Sequence: Synthetic polynucleotide
tttgtattgtggagtacgttatgattgtttacggtggtcgtaggtgtagacgttagtcggaatcggaatcggaatcggagtacgggttgtcgttttcgatcgaatcgcgggcggcgcggacggcgtcgcgcgagggataaggtgcgcgaggcgtacgtatttttatttttattgtcgggagttgatttgtttttttcgcgtggttattcgtcgttgtaaat

SEQ ID NO: 4149 - DNA, 201 bp, Artificial Sequence
  Description of Artificial Sequence: Synthetic polynucleotide
tcgagagttttgcggcgttcgtttttttgttggcggacgtgttttttgagtcgttttcgcgtaggtaagaggttgtcgtttttagcgagggagagagtagcggcgattttatttagttatcggacgtcgtttcgtagtgttttgcgggtgcgaattttaattcgatatattaggtgttttgaggggatggtggtcgtttat

SEQ ID NO: 4150 - DNA, 201 bp, Artificial Sequence
  Description of Artificial Sequence: Synthetic polynucleotide
gtaggggagagcgagtatgtttttgtttcgggcgtcgtgcggtcgtagtagtagcgcggttttttttagtgcgagtcgtgtttggaatgtttcgggtaagcgaagggttagtaagcgaggcgaaacggatattataaagtagagagtggtgtgagttttttcgttttttgaaaagatggtaagttttcgtttcgggaaggt

SEQ ID NO: 4151 - DNA, 201 bp, Artificial Sequence
  Description of Artificial Sequence: Synthetic polynucleotide
gagttttacgtcgtcgtcgtcgcgttagcggtggggggcgggttgggggcggggcggtcggggttgttttttcgggcgtatatgcgagcgtagtattcggcgttgtcgagttatttttttcgtcgttcgttagtaagtttggcggttttaagttaggcgcgttttaggatttaggtttatttgtttttatttagtttcggt

SEQ ID NO: 4152 - DNA, 201 bp, Artificial Sequence
  Description of Artificial Sequence: Synthetic polynucleotide
gggtatagttacggtaatttttagtttgttaatgttaaggcgggcgcgtaaggtcgtttaaatttagatttttttttttatttattttaaaaaataataacgtgttagttattttcgtagatatcgtcggttggtgtttgtttaggagacgttagggttagagcgttatttttagtatcgaaatggtagagagaaagcgta

SEQ ID NO: 4153 - DNA, 230 bp, Artificial Sequence
  Description of Artificial Sequence: Synthetic polynucleotide
tcggtgttttttttcggtcgttttatttagtaatttttcgtgttttgtttttcgattggaaatgttttacggaagcgttttggatagggttttcgttaggcgataagagttcggtgttgagatgtgttacgtttttatttttttattaattatggatggaaataaataaggaagagttaattttgttgagtttttttttcggtaacgagaggcgttttgtagtcgggagg

SEQ ID NO: 4154 - DNA, 201 bp, Artificial Sequence
  Description of Artificial Sequence: Synthetic polynucleotide
gttttttcgagttggtcgtttttgtagatttttacgtttagttgttatagcgtcgtttcgattttttcgttaagtatattttgtattgtaaggttaagtacggtcgtcggtttgggatttagtgttatcgggaggaaaagagagagatttggggttggggtatggatgatggggggaagggcggtcgtttttgttattgtt

SEQ ID NO: 4155 - DNA, 201 bp, Artificial Sequence
  Description of Artificial Sequence: Synthetic polynucleotide
tcgtagacgtcggaggcgttatggtcgttaagttcggcgagttgatgggtatttgttttagttattaggcggtgatgtcgtatttcgtgtgtttggtcgacgagttttcgtagttcgtgcggttcgttaagttgtttaagggtcggggtcggttgcggcggtcgcgttagtttcgttttaagacgtagtcggtgattttcg

SEQ ID NO: 4156 - DNA, 201 bp, Artificial Sequence
  Description of Artificial Sequence: Synthetic polynucleotide
gtagttttaggaagtcgtagtcgtcgtcgtcgtttaggtagagtagtagcgcgcgcgtggcgttggtgcgtaggttgaagttgagttcgtcgttgttcgtcgcgttcgtttagcgcgcgtagcgagtttattgttcggggtcgtcgtcgaattttaggtcgttcgcgcgcgtcgttagcgttagtagtagtagtaatagta

SEQ ID NO: 4157 - DNA, 201 bp, Artificial Sequence
  Description of Artificial Sequence: Synthetic polynucleotide
aagtttttattttttggattcgggtttggcgttttcgttttcggcgcgtttttattcggcggacgcggtcgcgtataaggtttagtacggttcgcgttttcgtagttcggtcgcggttgaatatttttagcgcgaagcgggtgggcgttagtagtttcggggacggcggtttttaggtttgaaagttggcggttcggggtt

SEQ ID NO: 4158 - DNA, 201 bp, Artificial Sequence
  Description of Artificial Sequence: Synthetic polynucleotide
ggttttttagtttgggttaggtcggggcgcgtgtttcgggttttttgtggttgtatcgcgcgttttgtgtttacgggcgaaggcgttggaattcggcgttcggagttcgagtttttgaaggcgggaggcggcgttcgattttaggggttgcgttgggttgtcggagttaagagtgtttgcgtttttagtttcgcgttagaa

SEQ ID NO: 4159 - DNA, 201 bp, Artificial Sequence
  Description of Artificial Sequence: Synthetic polynucleotide
ttagagtgtgattgagcgggttggttcggcggtcgttgtttttcgttttcgttttttcgcgtttggtcgcgttatttattgtcgcgggtgttcgcgtgcgcgtcgtcgatgcggtcgtcggggagcgtttggaggtggaagtcgatgtttacgttgtagtagagtcgtcgtagtcgtttgatgtttagtaggtagtcgtcg

SEQ ID NO: 4160 - DNA, 201 bp, Artificial Sequence
  Description of Artificial Sequence: Synthetic polynucleotide
tatttagaaaatggaaagttgagtggtcgatgaatcggaattgggagtagttttttatgaattagagaaaatgtaagttaaaaggagatattattttttacgtattagattggtaaatattaggaaatattaagttttgttgaggaggaggggtttagggagtttttatattatgtgggtgggattgtaatttggtataat

SEQ ID NO: 4161 - DNA, 201 bp, Artificial Sequence
  Description of Artificial Sequence: Synthetic polynucleotide
ttttcgggacggacgttttaggcgcggcgtcgagtggaggcgagggggttgcggagggggaaggggttacgcgggttacggggtttaatttttgatttttcgcgacgttaagaatgtaggagggtagagttgagggagattttaggtggaatttttaggtggggaaggttgagttgtcggggttgcgggtatcgggaaggt

SEQ ID NO: 4162 - DNA, 201 bp, Artificial Sequence
  Description of Artificial Sequence: Synthetic polynucleotide
tcgtcgtcgtttgttcgggacggtttcgtgaagaaggacggaggtagattgcgtgttcgtagcgggatttttttggtttttgggatcgtcgtggttttcgcggggtttgttacgttttttttcgcgtttttagtgttcgtattttttagttcggtcgtcggcgtagttattttatttttcgtcggttcggtattttcgggg

SEQ ID NO: 4163 - DNA, 268 bp, Artificial Sequence
  Description of Artificial Sequence: Synthetic polynucleotide
gcggttagatttcggttttgtaagttggcggtcgcggcggtttgcgacgtttttcgtcggggggtagttttgtcgtgggtcggggtcgcgattgtcggggcgttaggggcggttagcggtcgtttggttggcgtgtcggcggcgttcggggagggcgggtcggggggcgcggcgtttatgaggtcgttgtagcgtttgatttgtttttgtaggtatttgcggtggtttatttttcgtttcgatttgttcggtttgtttagcgttagtt

SEQ ID NO: 4164 - DNA, 614 bp, Artificial Sequence
  Description of Artificial Sequence: Synthetic polynucleotide
agagttattttgttcgttgttttggattttgaaatttgggagatttatattaaaggagggaatcggtttttttattttttaagcgcgtcgtgttttttatcgtttttttttttggttcgattggttttggttttttttacgtttttagtttttaaattggcgttcgttttatggttcgtgtaggacgttaaaagtacggtaaattttagggcgatttttagtagacgttttcgacgtatgatgtcgagtcgttatcggttttcgtcgttttttgtcgcgttcggggttcggtttgcggtcgtcgttgcgttttgaagcgtatcgcgtcgtcggggtttcgttatttcgtcgttcgtttttcgggtcgggtttttttcgttttttttaggcgttgtttttattttaggcggtttttgttagttgtaatatagagataaattttcgaggcggggagatttttagggtatcgggatgttgaagtttcgcggtttttatttttaagtttaattcgtgcgtcgtttgcgcgtggcgtagttaatttgggtaagggaagatcgtttggtttatagttggttggaaagtttaggttttcggcggtagtagtttcggtcgat

SEQ ID NO: 4165 - DNA, 201 bp, Artificial Sequence
  Description of Artificial Sequence: Synthetic polynucleotide
gggtattagtttcgagtttaggttttattttcgggcggttcgggacgaattttttttataggttagtgtgtgtgtagggtaagtgtagggggttgaggggcgttggcggggaggtagtagaggtggtttggattattttggcgcggcgcgcggtgagcgcgaggatttcgttagtgggagtcgttgagttaaagtgtattt

SEQ ID NO: 4166 - DNA, 201 bp, Artificial Sequence
  Description of Artificial Sequence: Synthetic polynucleotide
ttcgcggcgacggtgacgcgttttggttttgataagtttggttttttttattttatcgggtggcgtcgttgttgattttacgtttagtcgtttttattttcgtttgaaattttttcgatagggtttcgtttcgggggtttagtttttagcgcgtatatattcgcgtggtgtcggtttagttttttgtaaaggaagtagggt

SEQ ID NO: 4167 - DNA, 201 bp, Artificial Sequence
  Description of Artificial Sequence: Synthetic polynucleotide
ttgtagttagtcggcggtttaggtaagagataaggtgtgagtaaaggtttttgatggtcgggtggtttgacggttaggtgcgagtggggaggatagtttacgcggtttgagtagttatttttggttatagttttagttttcgtttttgttttcggtttttgttttggtttgtttgcgcgttatttcgttatttcgtagtgt

SEQ ID NO: 4168 - DNA, 201 bp, Artificial Sequence
  Description of Artificial Sequence: Synthetic polynucleotide
cgttcggtcgtcgtttttagttaattcgggttttttttacggcgattaattagtgcgaagttggttgggcgggaagtcgcgagaggtttttattgcggcgcgggtggcggttaggagttgttaggatagtttttcggtgttttagtttaacggtttcgtttatttatcgttaagagaaatttcgttttgcggtcggttttt

SEQ ID NO: 4169 - DNA, 201 bp, Artificial Sequence
  Description of Artificial Sequence: Synthetic polynucleotide
cgggtattgcgaattgtcgggcgatgttgtcgttgtcgtcgtgatacggagagtaatagttttttagtaatattttttttcgatataggtatatatttttcgataggtacgtatatttattttatagtgttcggttcggttgcggtgagtgaggggtcgggaagaggcgtatcgtttagcgagcgtcgcgcgtcggggttt

SEQ ID NO: 4170 - DNA, 261 bp, Artificial Sequence
  Description of Artificial Sequence: Synthetic polynucleotide
ggatcggcggtgatatcggagttcgtcgtgcgttttcggtcgttttcggtgggtgtcggtttttgtatttgatgcgttcgggatgttttttttattttggcgcgttcgtcgttagttcgtatagcgtttcgtatattttcgtacgcgtttgaaatgcgtacggtttcgtcggttcgcggaattattcggacgtacggagcgtttcgtatcgattcgttcgtcgttttttcgagacgttcgtatcgtgtttgggtcgggcgc

SEQ ID NO: 4171 - DNA, 201 bp, Artificial Sequence
  Description of Artificial Sequence: Synthetic polynucleotide
cggttagggtaatagttagggtaaagggagagagaagtcgtttcggggcgagaaggagaaaagttagagggttgaataggtgacgttgagtttgttggagcgtgtgtgttttattacgtaagggcgcggagttcggtcgttttatttttcgttatttgcgcgttcgggggtacgttttttgcgatagtttggaatttagat

SEQ ID NO: 4172 - DNA, 201 bp, Artificial Sequence
  Description of Artificial Sequence: Synthetic polynucleotide
gggtatcggtgtcgacgtcgcgagggtagcgttcgcggcgggaatattaatgtattttaaagggtacggtcgtcgtcgtagtaggtaattagttggatcgcggcggagcgcgcggaggtggttgttggttgtaaggattgcgtttagttttcgtttcgtttttcgaggttttcgcgtgggtcggcgggtagtgcgtgggtt

SEQ ID NO: 4173 - DNA, 201 bp, Artificial Sequence
  Description of Artificial Sequence: Synthetic polynucleotide
ttttttgtttcggtttcgtgttttcgttggggattgtttgcggtgagtttgtcgtacgtacgttagggtcgaggtagtgatgcggggtagcgtgggaggacgggttgcggagttcgcgttattttgtttgtggggagcgttgtgtttgtttttttgttagcgcgtttagttgtttcggtcgtcgttacgcgggattgtttg

SEQ ID NO: 4174 - DNA, 201 bp, Artificial Sequence
  Description of Artificial Sequence: Synthetic polynucleotide
ggaaaatagggtattcggagtgtaggagattttttagggtcgttttttttttcgggggtgttttgaggaatcgcggcggggattcgtcgttggtagtttgcgggttttggtgttagcgcgtatgggcgggttgtgcggacgtggttggttttttaaaggttttagatttcgttcgggtcgtttagttttttaaagttgtgt

SEQ ID NO: 4175 - DNA, 219 bp, Artificial Sequence
  Description of Artificial Sequence: Synthetic polynucleotide
tttcgggttaggaagttgttaggtaggggagggttagcgttagttgtggacgtttcgggatagttttttattttagtttttgtttttgttttcggcgcggcgtaaacgtaaaagttttcgtggtcgtagttttagtttcggtggtcgttcgattttcgtcgggatttcggttgtatttattggagaagcggcggtttcgattttcgaggaggcggcggc

SEQ ID NO: 4176 - DNA, 268 bp, Artificial Sequence
  Description of Artificial Sequence: Synthetic polynucleotide
tttattattgtttttttttttcgttttttatttttttgtagcgttaagtcggttttttaatttggtttgttgaacgtaaatcgttgagagtttgttgtatcgttttttggggtttttggttgtcgagtttcgttaaggtaaagacgttagtaagcgaggaagcgtagcggaagaaaaataagcgggcgcgcgaggggagttttaggagggttgtcgagtggttggtaggcggttttcgtttttttcgggtggtttcgtcggcggttga

SEQ ID NO: 4177 - DNA, 201 bp, Artificial Sequence
  Description of Artificial Sequence: Synthetic polynucleotide
tttttcggttttaggattggggagtgtgtcgcggggtcgagggtggggaatagttagagggagacgcgaattaggtcgttggcggagggtttagggggagcgtagaggcgacggtttttatgtcggcggttaatatgatggagaatcggtcgttgttcgttttgtaggtgttcgagtcgtagggtgcgttcgagggtagtt

SEQ ID NO: 4178 - DNA, 517 bp, Artificial Sequence
  Description of Artificial Sequence: Synthetic polynucleotide
tagagcgcgggttttcgggttttatttcgggaaaagtttgggtttgttttgcgttgttgcgtgttgcgtttttgggatttgttgattgttttagagggaacgtttcgcggtagtgttagttttttggggattaggaagggcgatttttgtttgggagttagtgtttgggtcgtcgggttcgggtaagcgttgggggtttggttcgagaagatgcggataggtggtttagggcgtcgcggattttcgttttttgcgggtatcgggagtttagggtcgaggcgcgtcgtttcgaggggtttttttttttaataatgcgttcggaatggagttcgcgttttgatagcgcgggttagttcgaaatcgtttagaattcgtttcgatgagtgggtgagtcgttttgggagtttgtcgcgtttcggtagcggagggtttgagtggaaaaatttttattggatgtattttttaatggttggtttgtttcggttttcgttcgagtttttttcggtagtaggcgttg

SEQ ID NO: 4179 - DNA, 226 bp, Artificial Sequence
  Description of Artificial Sequence: Synthetic polynucleotide
cgcgtttttttagtcgcggttttttttttcgtcgtttttttttgtttttttagtttttttttttacgtgtggatgacgttaaaatttcgcgaaaaagtcgcgtggtggtttttcgagcggaggcgcgatttcgtcgtttagcggttttttttcgggggcgtttggagggggagaagggcggaggcggtcggtttttttttttttcgggaggtaggatttttcgacg

SEQ ID NO: 4180 - DNA, 201 bp, Artificial Sequence
  Description of Artificial Sequence: Synthetic polynucleotide
ttttcgggaggcgagtcgcgggttgttgggcgcggaggttggagtcgcgagaggttcggttgttgaagcggttattgttttttagagttaggtttcgcgtcgcgcgttttcgtcgtcgtcggtattgtgtatttatttatttttcggagattggggtaggggaaaaaagttttgaggcgtttttatttttgttttcggggt

SEQ ID NO: 4181 - DNA, 212 bp, Artificial Sequence
  Description of Artificial Sequence: Synthetic polynucleotide
tttcgggcgtttggtatttttttttatcggggtttcggcggcgcgcggcgtttgttcggaggggggttcgggtatggtgttgcggtagttggattcgtcgcgagtttttcgcgtttcgtcgtcgtttgcgtcgcggagttggtttagttgtaaataaatagtagttttttcgtttttttcggttatcgttatttttttcgttttattgcgta

SEQ ID NO: 4182 - DNA, 388 bp, Artificial Sequence
  Description of Artificial Sequence: Synthetic polynucleotide
ttttttcggttatttgtgttgttttcgttttggttgtttttgtttcgagggaagatgttcgagtattttttttattttatttggtcggcgaagtatagttcggtgacgatgtgtagagttttttggtatagattgtttatttcgttttttttgtggaaatttatcgtttggtttttttttcgtttttttttttttttttagttagtcgttttttttttttttcgtatttttaatttttttggcgttttaagttatagttcgttcgcggtgattttggttggagattgcgtcgttgagagtcggtaatttttaggagttttacgttggttttatggcgggagcggagggcgtaggggaaggagaggcgcgcgaggaggttgcggttgtc

SEQ ID NO: 4183 - DNA, 201 bp, Artificial Sequence
  Description of Artificial Sequence: Synthetic polynucleotide
tttttggatgttaaattcggtttagggagtttaggagtcgttgtagttttagtttttttttttttttttttcgatgattcgggtaatgttaattttttttcgggattgaaagttttaaatttaaggtgttaagttgatgggcggtttttgtttttatttttcgatttcgggcgcgtgttttgaaagataggagagaaaaaa

SEQ ID NO: 4184 - DNA, 201 bp, Artificial Sequence
  Description of Artificial Sequence: Synthetic polynucleotide
tcgtggtattttcgttagagtttaagtagttttttaggcgtggggtttggtggacgttggtttggagcgttcggagggcggggtgggggtgggggggacgcgttgtcgtttggggtgttttcgcgtatttttgttgggcgaattttggtttttcggtgttggttgttatttgagtaattgatgggtttttaggggaagtaa

SEQ ID NO: 4185 - DNA, 212 bp, Artificial Sequence
  Description of Artificial Sequence: Synthetic polynucleotide
ttcgtcgttttttttttatttcgttttttatcgtcgtttttagttttttttcgggatgagagagagtcgcgttgcggagtaattttagtggatgggttcgcgggggttgagcgggcggaggacgcgggaatttcgtgatatcgattagttgacgttgttcgcgtgaaattagagtcgggtattagggttttatttttattgtttttgtattt

SEQ ID NO: 4186 - DNA, 250 bp, Artificial Sequence
  Description of Artificial Sequence: Synthetic polynucleotide
taggagggtgggtgttagtttttttttttatttttcgagtttttttttcggcgtttacgtgggcggagtagcgcgagggtgtgcgtggtaggggtcgcggcggcgtgtgtcgtgcgtggggtggggtgcgggttgggcggtttcgttttcgggtttcgcgtcgtcggggcgcggtttttagttttattttttttgttatttgggcggagatttgggggattgtgatttattttgcggaagatacggaggg

SEQ ID NO: 4187 - DNA, 488 bp, Artificial Sequence
  Description of Artificial Sequence: Synthetic polynucleotide
atacgtttttcgttagtttgggcgtcgggtttcgaattttcggtttgtaaatttgcgtattttttttcgtcgcgttcgttagataatttggcgaatagttcgttcgttcgtatttcgtttttttcggttttttttttaaattttaaacgtatcgtcgtgttttaaagaaggtgtttacgtcgtttttagatttcggagcgttttttttttattttcgggattttttaggtcgtttatttttttcgtttttcgtttagatttgagagggatcgaaaatatattttcgattcgggtagttagggtcgaaattgttaagaggagaaaaggtaaagcggaaggagggtggttataaatagatttttttgtttttttttaaaaggatattgtcgttttaaaagtttttttttcgggtttttatttttcgtattttcgtattttgggggagcgtatttaattgaggtaacgtagtttttttttagtgtttgtag

SEQ ID NO: 4188 - DNA, 201 bp, Artificial Sequence
  Description of Artificial Sequence: Synthetic polynucleotide
ggttgaggagaagggagggagagtagagggaggggggaattcggtcgggggaggaggagagaggcgaggaggcggttttggtagcgcgcggcggcggcggcggtagcggtagtagtagcggcggtgcggagagtttggattgggagtttaaagttcggttgggtagcgggagaggaggagtcgtaggagttgtagttttgt

SEQ ID NO: 4189 - DNA, 364 bp, Artificial Sequence
  Description of Artificial Sequence: Synthetic polynucleotide
ttttataattaaggagtatggtggagttgggttaattttaggtatagtttagtcgagttaggcgaggtttagagagatttgattcgtttggtagttttaacggatttgttttcgtagtcgttgcggatttttcggtcgttatggcgattgtgaaatgtggggtggggcgtatgcgttggaagttattcgcgcgggtagtttttgagtgtttttttacgtgttttttagcgcgagtagtattttcgtttttgcgttttttagagcgtgtagttttcggtgagggtagttttacgtatagttttttatattttttttagcgtttgtagttttcggtgcgcgtaggttttaagtttatatgcgtagt

SEQ ID NO: 4190 - DNA, 220 bp, Artificial Sequence
  Description of Artificial Sequence: Synthetic polynucleotide
gtttttatttcgagcgcgtagttttacgtagtttttttatattttttttagcgtttgtagtatttttagtgcgtatagttttgttagtcgttttttcgggcgtcgtttttgtattatttcggtttataattttgcggcgattgtttgaagaatttttcgtggttttattttttttttcgggtttagttttagttgtgatattttaattaaaagattatac

SEQ ID NO: 4191 - DNA, 201 bp, Artificial Sequence
  Description of Artificial Sequence: Synthetic polynucleotide
tcgtttttttcgtttcgagcgattttttgttttagttttgtaggtttcgtattgtagatgtttgttggtttttttgcgttcggcggttttcgcggtgtttcgtaagttttcgtgattttttagtattagtcggttgtgcgttttttgtttttacgggtcggttagtcgtagatatttatttagtttcgcgagtttagtcgt

SEQ ID NO: 4192 - DNA, 201 bp, Artificial Sequence
  Description of Artificial Sequence: Synthetic polynucleotide
ggggtatcgcgttggtatttgtagggagcgattggtttggaagggtagagggtagacgggggtttgggtggggtagcggttattttaggcgcggagaattcgttgtttttatttttttttcgcggatttttattttgcggtttgtgtgttcggtttttttcgcgtggcggggaagtgcgggtggttgttcgggtttttaga

SEQ ID NO: 4193 - DNA, 201 bp, Artificial Sequence
  Description of Artificial Sequence: Synthetic polynucleotide
gtgtcggttttcgaacgtatttcgaggcggggtgagggttggtagtcgtttttgtattcgtcgttgcgagtcgcgttttttaaatttaggtatgggatttcggaaaatcgattcgttgttttgagtgtttattacgtgaggaattggagtggtcgagttcgttaaggcgtcggggatatttgagtagatgagaattggagt

SEQ ID NO: 4194 - DNA, 358 bp, Artificial Sequence
  Description of Artificial Sequence: Synthetic polynucleotide
gcgtagcgtttgagtttgcgtttcgttaagtgtattaagtacgagatttagagcgttatggagatcgtgttgttttggggtttggtcgcgtattgtacggcggttgcgttggtcgtattgtttttttataatatgagtagcgtcggcggcgatcgtttgggtcgcggtaagtcggttcgttgcggttttatttttttcgtgggtcgcgtgtatcgttggatggtggatagtcgcgtggcgttgcgtatttacgagtacgtcgttatttatttgatagtttgtatggagagtttttttcgggatatttattcgcgggtcgtggttttcggggtgtttcggagttgtagtggttttgggt

SEQ ID NO: 4195 - DNA, 201 bp, Artificial Sequence
  Description of Artificial Sequence: Synthetic polynucleotide
ggagttttcgggcgcgttttgggcgtattggggaggttttcgggcgggtaggcggacgttttggggcggcgggcggcggttgtcggggttcgtcggggttcggtcgttcgttgtttatcgataggtattaggaattgatttcgtcgttgttttttgttcggtttagttatcgattagttgtcgcgattatggagaagcgtt

SEQ ID NO: 4196 - DNA, 328 bp, Artificial Sequence
  Description of Artificial Sequence: Synthetic polynucleotide
cgtagggagggagggggtatcgtttgtttttttgttcgaaaggtggaggtaaagagggatttcggattttagagaggtttataattttttataagtaaggcggggggcggaatttagagaggtaaagtgattcgtttttaaatcgtaatattaggaggatagtagggttagatggaatttttcggtttatagttttcgatttcgggtaagtgttttattcgggcgtacggtttgtttttagattagaattaggcgcgttcgtagttaaggaagtttggcgggagattttttcgaggttttcggtttttaggttagcggggttaaggag

SEQ ID NO: 4197 - DNA, 201 bp, Artificial Sequence
  Description of Artificial Sequence: Synthetic polynucleotide
cgttcggtgaagtcggtgtatttattatattttttgttgtttttagtagggaagtcggcggtgaggcgggggagtaggtatggtggtttcggggtttatgcggggtttattgtttatttagaatagcggttattgttgtttattagggcgtatttatcgttggagttttcgcggcgattgtttatttttaatatatatttt

SEQ ID NO: 4198 - DNA, 319 bp, Artificial Sequence
  Description of Artificial Sequence: Synthetic polynucleotide
tggagtcggcggtcgcgttcgcgtcgttgttgtttggttcgttggcggcggggtcgggggttgtcggagttgattttatgtttttttttaatgtagagatcgttggagatggcgagtttcgagattttttttattttttgtttttagagtaattttatggtattaaaaaaaaaaaaaaaaaaaaaaaaaaaaaaaaaaaaaaaaaaagaaggagaaggcgatcggcgaaagtaggagggaaaaagtaggcggcggcgggcgggtaagtaaaagcgcgagggagcgcgcggagtgtttgggtggacgtgtgtgtgcgttc

SEQ ID NO: 4199 - DNA, 201 bp, Artificial Sequence
  Description of Artificial Sequence: Synthetic polynucleotide
atcgcgggaggagagcgtaaggaggtttttcgtaaagttggaggttaggtcggagcgatgtttcgggagcggagtttttttagtttcgggtttttagtcgcggatagttggtagtgttaaagatttcgttattatttgcggttcgtagttgcgattcggtcgtagagtcgggtatcgaggaaggcgtaaagttgagtttgg

SEQ ID NO: 4200 - DNA, 370 bp, Artificial Sequence
  Description of Artificial Sequence: Synthetic polynucleotide
agggcggttcggggtgggggcgttttatttttgttttttatggcgtgtacgaagtttttttggtatagttggttgcgaagttttttttttaggttgaagtcgcggacgttgacgattttttttacgttcgataagttttcgttttcgtcgtatcgttggcggttaatcgggcgttgcgaggatttaaattagagagttcgggatattattgtgggggttggaggtcgttttttaatttgggtttagtattaataggtgtagtagtcgagcgttttttgtattttattattgtaatttaagtaattttgcgtaattgttaaagatgttgaaaagtaggataaggagaggggttcgtatttcgagggtttag

SEQ ID NO: 4201 - DNA, 201 bp, Artificial Sequence
  Description of Artificial Sequence: Synthetic polynucleotide
gttatgttggaatttggaggggaggggggatgttggagaggtatacggtgatggatatggaaggattcgggaggtgtggagtggtgggttcggttcgtcgcgggaaggatatagagggatataggttgttttggagaggcgttttcggatatttggaggggcgtatagtgttgggatttggcggcgtttggggcggagggg

SEQ ID NO: 4202 - DNA, 201 bp, Artificial Sequence
  Description of Artificial Sequence: Synthetic polynucleotide
gtttttcgtttttacgtcgtagttcgggttagcggggttcgtcgcggtggcgttcgcggatgttgtcgtattggtcgttgcggtacggacggcgtagtttcgggcgcggttcggtataggcgtcggcggttttcgttagttagtagttcggcgaggcgttggtttatttatggttttcgggcggcggtttttgcgtttagt

SEQ ID NO: 4203 - DNA, 201 bp, Artificial Sequence
  Description of Artificial Sequence: Synthetic polynucleotide
attcgttcgttcgtgggtgagttgggaggggcgcggcgagggagggtgggttcggggcgggggcggcgcggggcgcgtttgcggttatgcgatattgtttcgttcgcgtttcgtttttttttttgggttttttgggttttttgggttgtaggattcgtcgacgcggcgcgttggtcgtacgggggttgggcgtcgttgtat

SEQ ID NO: 4204 - DNA, 263 bp, Artificial Sequence
  Description of Artificial Sequence: Synthetic polynucleotide
tgggttattcgtgtcgtatgtcggcgtagttgttcgttgtggtaaggggggggcggtcgggtttcggagcgggtcgggagggcgcggggcgcgtatttcgcggtaggtgagcggcgcggttgtaggtgagtagtagtttcggttcgcgcgtttagtttttttcgtcgcgttcgttcggtttatacgtttttcgcgcgcgcgtcgttttcgtttcgcgcgcgttcggtcgttcgttcgttcgtgggattttcgcgaggtcgcgc

SEQ ID NO: 4205 - DNA, 201 bp, Artificial Sequence
  Description of Artificial Sequence: Synthetic polynucleotide
gttttgttttttttgtttttaacgaattggtaagtaaaatattagttgtttattttgaaatttgttttaattattttcgtattttttgaagttcgttgggcgcgttttgggttgtttttttttgagtagtcgggtttagagttaaggcgcgatgattgtcgcgtaagttagggtttacgcggtcggggtttttttttcgtt

SEQ ID NO: 4206 - DNA, 201 bp, Artificial Sequence
  Description of Artificial Sequence: Synthetic polynucleotide
ttttttatttcggtatttttttttggtgacgttaaggggttttttattttttattcgtttttttatttattttttttttttttttaggttcgtttttttgcggttacggagaggggcgggggtcgacgagggcgggtggttcggggtcgagcgcgcgtggggaggtgttggcgacgcgggttcgggagcgcggtttcggta

SEQ ID NO: 4207 - DNA, 201 bp, Artificial Sequence
  Description of Artificial Sequence: Synthetic polynucleotide
ttatttagttttgggggtcgttcgaaattggggaagggataaggttgaagtttcgtcgtttggttttaggggcggaaagttcgatttaagggaagttggtcgcgttttcgcgacggtgtttttggtacggaggattgaggcgtagttcggttgtttttttttgtttgtttttttcgcgttgtttcgtcgtttttgattttt

SEQ ID NO: 4208 - DNA, 201 bp, Artificial Sequence
  Description of Artificial Sequence: Synthetic polynucleotide
cgcggggtcgggcggggatcggtcgggggcgtcgcgcgttcggtcgggttgattgtcgggggcgattttcgcggggtaaggcgggggcgcgggagtagcgcgtagttgcggggttattttatttgagcgttttgaggttagggtcggggtttgaggatacggcgttgggtttcgggggacgcgggtttacgtcggcgttcg

SEQ ID NO: 4209 - DNA, 215 bp, Artificial Sequence
  Description of Artificial Sequence: Synthetic polynucleotide
ttatatttatcgtttcgggcgcgtcgttcgcgcgcggtttcgtttcgggtcggtatttttcggttcggttgttttcggttttcgtttcggtttcggttttcgtttcgtagggttcggtttcgcgatggtggtcgcggcggcgagcgcggtagggagggcgtgtgtatgcgcgtgagagcgcgtagcgtgtgtatgtgcgtgtgcgcgggagggtt

SEQ ID NO: 4210 - DNA, 201 bp, Artificial Sequence
  Description of Artificial Sequence: Synthetic polynucleotide
cgcgagtgttttttaatggtagcgcgggcgtttttaatcgcgaggggttgcgttattatcggcgtttgttggagcggttgcgggagttgggcgtgtagttcgtggttattttgtattattgggatttgttttagcgtttgtaggacgtttacggcggttgggttaatcgcgttttggtcgattattttagggattacgcgg

SEQ ID NO: 4211 - DNA, 201 bp, Artificial Sequence
  Description of Artificial Sequence: Synthetic polynucleotide
gtgttagtagtttcggggtcgttcgtacgtaacgttttcgggtcgggttaggttggttagggtagggcggtcgtttttcgaggaattgcgggcggggcggcggggttaagttgagcgttcgttttgttttcggcgtttcgcggttgcgggcggagcgggttttgcggagtttttcggtcgtttttttcgtagttttcgttt

SEQ ID NO: 4212 - DNA, 201 bp, Artificial Sequence
  Description of Artificial Sequence: Synthetic polynucleotide
ttaggttgtttgtagcgtcgttttgtttttttattttagagcgtaggtgagtggttatttttttaggggatcgcggttgagagcgtttatttttttttttcgtatttggaaattgagtttggcggtagggttgggttatttagagtttgtatatttcggaagggaaagtgattttagaagggagagaggaagtgttgagtt

SEQ ID NO: 4213 - DNA, 217 bp, Artificial Sequence
  Description of Artificial Sequence: Synthetic polynucleotide
tgtagttggtgttgtttttgggacgatgtagacgttttatatttaggcgcgggtgttaggtcgtcgggtattagtttatttttagggtttgtgagttgcgcgtattttttcggtcgcgtattttttgggaggttgtagttagagcgtttttgaagggagggcggtagaagatattttttttcggtttatgtaaatcgttgggggaattttagttaat

SEQ ID NO: 4214 - DNA, 317 bp, Artificial Sequence
  Description of Artificial Sequence: Synthetic polynucleotide
aagcgagcgattttttgagttcgggtggttcggcgggtaagggcggcgcgggagattcgtagggcgcgggcgcggattcggggaattagggttatcgttgcgggcggatgggggttatcgaggcggttcgtttttaggcgtatatttcgtatatttttttgttaagtgaaggggttaaaatgtatagatgggggagtttatttaggaatagaggcgcgagacgtatagttatttttgggttgggagtacgagttagtagattttcggagcgcgttaaacggataatatgttcggtgttgtaaatagaggtttttgtt

SEQ ID NO: 4215 - DNA, 201 bp, Artificial Sequence
  Description of Artificial Sequence: Synthetic polynucleotide
tatttttgtgggggggagggtgtagcgaaggttgttagggatttcgcgatcgcgttttaatacgtattggagcgagtgtgcgagtgattatgagtgtgagcgggtgcgagcgttcggcggggttgatcgttacgttggcggggtcggcggggttaggtagtttttttcgcgttttttttttttcgtttcgtgttttttttt

SEQ ID NO: 4216 - DNA, 201 bp, Artificial Sequence
  Description of Artificial Sequence: Synthetic polynucleotide
acggtgttaagggatttagtttggcggatattttttattaggagatcgtaggtaagcgcgggcgcgttgtaggggtaggttgtagttttcggttgtcgtacgttttattggtcgttcggcgtttttttttttttttttgttgttgagttggtgtttattttttgttatcgttatgggatttcgcgttttcgtgttgggcgg

SEQ ID NO: 4217 - DNA, 201 bp, Artificial Sequence
  Description of Artificial Sequence: Synthetic polynucleotide
gcgtcgtagtttttcgggtatcggcggcggtgattaatttgtaattttagcgtttagagttgttatggtgttcgcgggcggcggcggcggcgatagtgggcgatcggtaggattagtgttaggcgcggcgtttagggcgggcggggacgcgggttttttatttacggcggtttagtttaggtagcgcgttcggttcggttg

SEQ ID NO: 4218 - DNA, 201 bp, Artificial Sequence
  Description of Artificial Sequence: Synthetic polynucleotide
gcggtgtgtacgggagttcgtcgggtatacgcggggtatatttaagtgtattgttaggaggtcgggagtttagcgtgcgagcgtgaggttagattgtgtacggtatcgaggattagttttatttttgagtatgaaagggtgaaatcgtttattttaagttttatttcggagttattaaataatgaatgtattagttatatt

SEQ ID NO: 4219 - DNA, 201 bp, Artificial Sequence
  Description of Artificial Sequence: Synthetic polynucleotide
gggttggtcgcggattcggacggtcgggagcgggcgcggcggtcgtagagacggttttttttcgcgcggttttagcgtagattttagatttggagtcgtgcgggcggagacgcgcggggttttttttcgtttcgtcgtcgttgggtttttagcgttttcggattcgcgggaggataggaattattcggagtgaagttgcgt

SEQ ID NO: 4220 - DNA, 221 bp, Artificial Sequence
  Description of Artificial Sequence: Synthetic polynucleotide
tcgagatataaagatcgaggttgagatcgttaggggttgagggtgaggtcgcgtttcggggtcgttggagcgcgggcgttatgcgagattgtttcggttgcgcgtcgttttagaggagttcgagcgttttttttagtcgcggcgcgttggttttggtcgggattgtagttaggtgggcgtcgcgcgtgtgagcgtcgcgcgtgtgagcgtagatttggatt

SEQ ID NO: 4221 - DNA, 311 bp, Artificial Sequence
  Description of Artificial Sequence: Synthetic polynucleotide
gattattgtcgaatagtcgttggagattcgtagagaagggcgggttttgcgttcggggcgtttcggaggtaagttcggagagttcgggtcgggcggagggcgggagcgtacgagtgtgtgtgtgtgtgtgtgtgttcgcggtgtgttcgcggttcggtgtatacgcgcgcgggttgtaaagttaggagttgcgggagcgtttttttgtttcggtttggtttcggagtattgcgggtcgcggaggtgtgggggtttttgtcgttgcgtttagggtagcggcggaaaaggtgtgtgcggatgcggggcggggt

SEQ ID NO: 4222 - DNA, 308 bp, Artificial Sequence
  Description of Artificial Sequence: Synthetic polynucleotide
ttgagtcgtagaaggtttttttcgcgtttttttttagtagggatttttggacggggagatcgacgggtttgtgggcgttttttcgggatatatttcggttcgttttgtttgggttgggtttatttacgttttgggtggggtttaggaattgcgtgcgggcgtagcgggtgagtatgttgatgatgattatttggttttatttttttacgtcgattagtaggttatagagttttcggtagtttttgtgaattaggtcgatgcgtttcgggtagatttttttaaaggttattattatattgttcgttatt

SEQ ID NO: 4223 - DNA, 201 bp, Artificial Sequence
  Description of Artificial Sequence: Synthetic polynucleotide
aatgtgatatagatattagtttttcgtgtttttggtttttagggttttttttatcgcgttttagtatttgtagtttttttatttttatagcgttcgtcgtcgttaaggtaatagagggatgttcggtgatagattcggcgtcggttttcggcgtcgtaagagaagcgttcgcgcgggcgttttggattcgtagagttttcg

SEQ ID NO: 4224 - DNA, 201 bp, Artificial Sequence
  Description of Artificial Sequence: Synthetic polynucleotide
ttattttatttgagcgtggttaaattgttgttatttagtggggagtaaaaaaaaataatttgtattatcgaaacgagttagtaattggttgggaggcgggcggtagttgggtttcgcgtgttttcggcggtcggggtttttttcggggagaggtatatatacgtatagtcggatcgcgtttcgttagggtcggagttattt

SEQ ID NO: 4225 - DNA, 201 bp, Artificial Sequence
  Description of Artificial Sequence: Synthetic polynucleotide
ggtgggagtcgcgaggagcgtttagtggcgcggtttgtcgggtatggtggtcggttcggcgatcgttgattcgtcgggttcgggggttttggaagcgaggcgcgtttttcgatttcgagattttgtagggttgtaatagacggtggggaggtaaaaaaaaaaaaggaaaaggaaaaaatggtgttaaagttattaagtttt

SEQ ID NO: 4226 - DNA, 630 bp, Artificial Sequence
  Description of Artificial Sequence: Synthetic polynucleotide
tcggttagtttattttcgcgtttcgtaaatttttttaatcgggtaataaagtgagtagcggtggtcgtcgcgatttttttaatttcgtatttcggaggttcgagggggttttgggatcgagcggtttcgtagcggcgatagaaatatatattttacgaaaaagaaaaaaaaaaaaacgagtcgcgcgaattcgttaagttagatgtgcgcggtttgaagcggaggaggttttgacgttagttttatttcgcgtagttcggtttggtcgtagattcgtcggttattcgtcggcggtttaggtcgggaggggttaggatagtttcggtcgcgcggtggacggaggggttattttttcgggcgttagtaaataaattttattcgagttaatatcgtttagcgaacggtgtttttttttagttattcgagaacgagaggtatttttaattagaaattaattaatgagtagttgttttttttcgttttattgtaattattcgttttaattataaatgagatttatgaaaggatacgttgaagatgtaattaatagttaaaattagttcggcgttgcgtaggcggtcggttcggtttcgcgttggcgcgttttgtttcgagtggtaggaaggggtt

SEQ ID NO: 4227 - DNA, 201 bp, Artificial Sequence
  Description of Artificial Sequence: Synthetic polynucleotide
aaatgggattagagcgcggagggagtttggttaggaggttttttaggatttagtcgcgacgttgaaaagtatgaagggtcggaattaggtatttatttagcgagcgttattaattcgaagttatagcgttaattttttgattcggtcgtttttatacgtagcgtcgggattagaggcgcggtcgtcgttcgtttcgttttt

SEQ ID NO: 4228 - DNA, 239 bp, Artificial Sequence
  Description of Artificial Sequence: Synthetic polynucleotide
gaagaaatcgggtaaatagttgtttttaggttcgtgttacgagttttggcgggatttttttttttttttgtattttttatttttcgattttttttgtgtgcgtcgcgtttcgttgtagtttcgttggagagatggggacggtttggtagaaggtggcggcgataggggttcgggacggtttggggagaggagggtgggggcgcggttgttgtggggtgttttcgggcggggtttacggg

SEQ ID NO: 4229 - DNA, 201 bp, Artificial Sequence
  Description of Artificial Sequence: Synthetic polynucleotide
tgtttagtttttcggaggagtattatgttttgatattttcgttttatcgttttaaagttggtttggggtttcgtagggagtggtttgtatggggagggttcgcgtgttgtgtttttgggaggggtaagagagtgggggcgtagggggcgggttaggtttttgggcgcggcgcgggttcgggggattcgcgcggttgacgtt

SEQ ID NO: 4230 - DNA, 221 bp, Artificial Sequence
  Description of Artificial Sequence: Synthetic polynucleotide
ggtagttggcgcgttcgttttggtcgtagttcggtttggggattcgttgcgtgttttggtattagtgcgtggtgaggaaagcggtggtggcgaatagtagcgttagtaggtttagggttacggttaggagcgttcggtcgcggcggttagtttttatgtcgttcgcgtcgtcgggacgggattgtatcgtcggggagtttcgcgcgcgaagttggtagttg

SEQ ID NO: 4231 - DNA, 201 bp, Artificial Sequence
  Description of Artificial Sequence: Synthetic polynucleotide
tagttttacgtcggttcgtttttcgtttacggttcggtttttttttcgtttggttcggcgttttttcgtttcgagttttttattttttggatttcgggttcgcgggggcgcggagaagaggatttaggaaaggtttgggaatttgatgggtttgtggttggggggaggggtagttttttcgttattttatttttttttcgt

SEQ ID NO: 4232 - DNA, 246 bp, Artificial Sequence
  Description of Artificial Sequence: Synthetic polynucleotide
tgggtttttttaggatttattttatgtagtttttatatggtttttagagttttgatttcgtggttggagtgtttgtttttttttaagtattggtagtatacgggtattttgtattgtacgtagtatatgttgtggttttttagttcgtggtttgtgtaggtggagattttgcgtgggtttagttttcggtttatacgattttgggtcgggggtattaggcggtgtttggttaggggttttcggggc

SEQ ID NO: 4233 - DNA, 223 bp, Artificial Sequence
  Description of Artificial Sequence: Synthetic polynucleotide
tgatattgggggtaggtgatataggagttgcggggtatcggggttagggtcggtgataagtgggtggtcggtggcggtatagtcgggggaaatacgcggacgtcgttgggggatttttggtacggggtagtgggggcgttggcgaatttttcgtaggagttatagtcgttgttcgtttcgttgtataggtttattttgtttaggtttagatagttatagtcgg

SEQ ID NO: 4234 - DNA, 201 bp, Artificial Sequence
  Description of Artificial Sequence: Synthetic polynucleotide
gggtttttcgttagcgtttgcgtttggtttttagttttgagtttcgcgtttatttatcgcgggcgagtgttgcgtagtacggaggacgttttttttttttcgttgttggtagttttcgtaggcgttttattcgggtttaggtttttgtacggtagtggggttttttttttttttcgtgaattcgttgacgtcgtgttttgg

SEQ ID NO: 4235 - DNA, 244 bp, Artificial Sequence
  Description of Artificial Sequence: Synthetic polynucleotide
tgcgtttattcgttgtataacgcgtttcgtttcggtttttagtttatttttcgcgtcgcgttagtttcgaatttggattttcgcgggcgtttgggcggggcgggattttaggtttatttagtaagttaattggttgaggttttcggttggggattaattatcggttttgagaaagttcggtagtggttattatatttggttttcgttaatttttttaaggtagcggtcgttggagtagcggggt

SEQ ID NO: 4236 - DNA, 201 bp, Artificial Sequence
  Description of Artificial Sequence: Synthetic polynucleotide
tttttatttttggttgtttggcggggtttgaaagggtaggtggttttggcggcgcgtttcgcgagggatgtggtagaagggcgtgcgtttggcgtcgaggcggagggattttcgatgtcgtgtggtagcggggtttgttatcgtagtttttcgcgggtattgtttttaggtttagagttagtttttagcgagtcgggtaaa

SEQ ID NO: 4237 - DNA, 457 bp, Artificial Sequence
  Description of Artificial Sequence: Synthetic polynucleotide
tttttttaaatatacgtttttttgttcgcggttcgttattttcgttcgggtttcgggttgtgtagtttttttttaggtttgttcgggtttatgtttttttcgaagcggcgggagtcggtgtagttttaatttttattgcgtgttttaggtcgttaattagttttgttcgcgtgtcgttggttcggaggttgtcgcgttagtttttgcgtgcgtttgagcgcgttggagtatttgcgaggttagggttgtcgacggcgagaggatattttgaggaatacggtgttttagtttcgttttcgtttttcgttcgagttggaggttggggcgcgttgagtcgtagcgtttggataagtgcgcgggtcggagtcgtttaggtttgtattcgggggttcgcggtcgacgtatgcgtacgcgcggtggcgggtttgtaggttcgaaggttcggttttttttttaa

SEQ ID NO: 4238 - DNA, 244 bp, Artificial Sequence
  Description of Artificial Sequence: Synthetic polynucleotide
gagcggtgattggaatttacgttcgggagaggttcggagtttcggtcgcgggcggcgggggatttttgtaggaaggggtaggaaggtaagtagttcggcgcgttttggcggtttcgagggatttgggttcgggtttgcggtcgcgtcgtttgggttttttttgggttgggagcgcgtcgggttttcgttttgtacgttgttatcgcgggagacgtttcggtttcgtcgcgcgtagaggggacgc

SEQ ID NO: 4239 - DNA, 206 bp, Artificial Sequence
  Description of Artificial Sequence: Synthetic polynucleotide
gtttcgacgttgcgggcgatagggtttggttttagtagtcgtcgtcgtcgtcgtcgtcgttattcggaggatttagtaaaagtttggatttgggggagggcgcggcgttgagcgggattattattagggttggaaggagatttcgagaatttttgtaggtaacgcgcgtttttaattttttttttttatgtttcgtcgttgcgttt

SEQ ID NO: 4240 - DNA, 203 bp, Artificial Sequence
  Description of Artificial Sequence: Synthetic polynucleotide
ggaagtagtggggggcgttcgaagagtagggtagttacggttatcgtggtcgtcggatcggttatgtgttaaagtttttggggttcggcgtttcgttgggcgcgtagcgcggggagtagacgcgtcgtgggtggggtagcgcggtgttgttggcgttcggttttcgcggggtgtagttttgcgcgtttttatgttgttttttt

SEQ ID NO: 4241 - DNA, 266 bp, Artificial Sequence
  Description of Artificial Sequence: Synthetic polynucleotide
ttaggttatttcgattttggtttttaggttcgggataacgtgttagttttaagagagcgttgtttatagtttcgggtgggttgggtttaattgtacggggcggggcgttaatagtttaggatttgggttgtaggttggtttttgtattaattagcggggcggtttcgggttttagtttttttatttcgtttacgaagggaggcgattgcgagcgtttggggtttttgacggatttcgtttcgggggtggggcggggagtggttacg

SEQ ID NO: 4242 - DNA, 242 bp, Artificial Sequence
  Description of Artificial Sequence: Synthetic polynucleotide
gtttagtagagatttggagttagaagtttagagatagtcgagtgcgtcgtgcggttttcggacgttcgttgtttagttcgattttcgttaattgtgtaggcggttgattcgtagcggtagcggtagtagcgaggattcgagcgttggttgtagcgatattatggattttttttttatggtcgcgtaggtaacggggcgttttttttacgcgtttcgggtcgttaagtttggggaggttcggg

SEQ ID NO: 4243 - DNA, 201 bp, Artificial Sequence
  Description of Artificial Sequence: Synthetic polynucleotide
agtttagattcgcgcgaacgtggatgggtatatagtttcgtttttttttattttgttttttcgaggcgttagtaatttgttttttgtcggtgatttcgggcgttttttttgtcgtcgtttgaggaaggttttgagattcgttttgtgatcgtgattcgttaagcgtcgacgcgtcgcggtcgtttgttttgttttgttttg

SEQ ID NO: 4244 - DNA, 201 bp, Artificial Sequence
  Description of Artificial Sequence: Synthetic polynucleotide
ttttgtttcggtttttgcggggatggatgttttacgtagtaagcgagtaagcgagttttggagatcggggttttgggtgtgcggtcggtttagtgttacgcggtgagataggtatggttattaatttacgttaaggcggttgtgtatttggtatagaaaatattgttgttgaatgttgtttttatagttattcgttagcgt

SEQ ID NO: 4245 - DNA, 312 bp, Artificial Sequence
  Description of Artificial Sequence: Synthetic polynucleotide
ttttttaatattcggtttgtacgtttggcgggggcgtaatagtgttttacggttcgggagttcgtttttggtttttgagtaaggtattttttttatttgtcgtgtgtttagttgaatttagtatatttttttcgtatttttcgtttttttttttttttttttgaatttgtttttttgttttgcgggtttttaatttttttcgaatttcgggcgttcggttcggtttaggcgagcgttcgcggttggggacgcgggtggggacgcggcggtttgggcgttgtaggatgcgtttggtcgcggaggagacgatta

SEQ ID NO: 4246 - DNA, 203 bp, Artificial Sequence
  Description of Artificial Sequence: Synthetic polynucleotide
cgttggttttggttgtttgtggggtttttttaggtttcggggggtttgcggcggtttgggaggtagattttcgcgggtaggtgtggtcgtgtttcgatcgcgcgaggatcgaagttggcggaagtttttgtgcggtgttttttagttcggaggaggttggtttgaagtttttaggcgttgtcgaagtttttttttgttagcgt

SEQ ID NO: 4247 - DNA, 201 bp, Artificial Sequence
  Description of Artificial Sequence: Synthetic polynucleotide
cgtatgcgcgcgcgtaattagattttcgtcgtcgtttttagcgttttttttcggggtagggatttatttaataggttggggtttttggagtgcgcggggtcgcgtggggaagcggggattttattttttttacgcgtcgtttagtattgggtaagggcggggtattttttgggttttcgtttttcgtcgttcgtttcggga

SEQ ID NO: 4248 - DNA, 283 bp, Artificial Sequence
  Description of Artificial Sequence: Synthetic polynucleotide
agcggcggcggcgggttttaggagtcgtagattttggttagtggtattgcgggttattttgagttttcgaggttttagggggatagcgttcgggcgttttcgttgcgcgtcgttttcgcggagtcgagcggcggtggttgcggaagcgattggggttgcgcggatattagcgttttagagttcgcgaggagtttggggttttcgggttggagtaagagtcgagtatcggcgtagtttgcgggattggtatttatcgggttttttaatttttagattttgttat

SEQ ID NO: 4249 - DNA, 201 bp, Artificial Sequence
  Description of Artificial Sequence: Synthetic polynucleotide
gttttcggggcgttttgttttgcgttatcgcgcgttcgttcgttcgttcgtttaatttatttgttgaagattaggtagtttaggtggttgattttgtggtcggagcggtggcggttgtagtttttttataggtttttgaaggtcgtgatggttaggatgaagagtatcggcgttagtgttaggtcgggttggaaggcgttt

SEQ ID NO: 4250 - DNA, 247 bp, Artificial Sequence
  Description of Artificial Sequence: Synthetic polynucleotide
ttgagcgcgtgatatggtttgtcgtttttgattaagacgggtacggttattcggcgcggcgagggtaggggcgttatttttatatttttttcggttcgggcgcgttttattttgtagcggtggttttggaattagattttgatttgcgtgggcgtgaggcggatgaggttggttaggtgttcgcgttcgggcgtcgataggtatcgttgttgtcgaaagcgtcgttttagttcgtaggtttgcgttt

SEQ ID NO: 4251 - DNA, 427 bp, Artificial Sequence
  Description of Artificial Sequence: Synthetic polynucleotide
ggggcgtttttttaggggattgggggtggggaggagggcgtacgggtcggggagggggttatcggatttggatttcgggatatttcgggggtttggggggcgggtcgcgcgtttatttgcgttttcgtcgtcgaaggagtttatgtacgggaagtagatggcgagcgtttcgaaggaggcggatagattgaggcggttttgcgagcgttttatgttcgcgtcggcgtcgggcgtttcggtcgcggcggcggcggcggcggcgggcggtttgggtagtttggtcgttttatttttgacgcggagtacggcgcgcggcgtggtggcggcggttcggggtcgggtcgaggtttcgttgcggggttggcgggcgcggcggggtcggcgggcgggttaggagttggcggcgcgcggagttcgaggcgcgttg

SEQ ID NO: 4252 - DNA, 246 bp, Artificial Sequence
  Description of Artificial Sequence: Synthetic polynucleotide
cggtttatagtcgggatgcgttttcgtcggggttatcgcggcggcgaacgtttcggatttcgtatttcggtgattttttgggatgaatcgaagtcggattcgtattttggtcgtaataagcgcgttttacgtcgttacgtattagcggtgattttcgagttttttgtcgttttggttttttcgtaggcgggtttcgaggttttcgtagggagtttagggttacggttacgtgtagtcgttttcgag

SEQ ID NO: 4253 - DNA, 384 bp, Artificial Sequence
  Description of Artificial Sequence: Synthetic polynucleotide
tgcgcgtcggtttggtttgtttgcgggttttagagtttcggcgttcgttgtttttttcgtttttttttttttttttatttttttttttttttagtcgcgacgcgtagggggcgggttttatttttttttcgttttcgtttcggttttaagtcgcggaggcgttcggtgggatttcgttgttgtttaattaggggggatcgggtgagtttttttttttggagtcgggttttattagcgtcgtaggtttataggtcgggggtgggggttttggatcgaggggcggcgcggggcggcgcggggcggcgcgcgcggttttggagcgttagtatttgtttttcgatttttcggtcgtcgttttcggtcgtttcggggatttcgttatta

SEQ ID NO: 4254 - DNA, 415 bp, Artificial Sequence
  Description of Artificial Sequence: Synthetic polynucleotide
tgggtagttttaggtcgtcgaattcggcgtttagcgggggtagttcgcggaaggcgcgagtcgagttagacgtcgcggggaaaggttcgggcggtggttgcgggggcgttaatttcgggagtaggaggtcgggttttagtcgtcgggttttgcgcgtttgttttttgcggcgcggtcggtatttgtagttggggtggtcgcgtaagtgttgtacgcgtagtcgttcggttttttttacgaagggtcgttttttcgtcgcgtttagttttttttacgttttgtttgcgggtcgtgggcgttagtgagtggaacgtcgtcgggcgggtgggcgtcgagtttttcgtgcgttcgggacgtttcgcgagggtttggcgtagttttcgtatttcgcggttcgggatttttgtttttttcg

SEQ ID NO: 4255 - DNA, 543 bp, Artificial Sequence
  Description of Artificial Sequence: Synthetic polynucleotide
tgcgttttacgttttggagcgtgaagtcgggcgttaaaaagttgttgtcgggtcgtagttttagatttagttgttggttaaaggcgtgtaggcggaggcgcgtggtttcgtgtttcggggcgcgttttagtttcggtattattagtttttcgtttttttcggaggggcgttcgagtgcgttcgatacggttagtagcgtcgcggcgagtagtagtagcgtgggtattggtttaaagtttcgagatttcggagttcgtttcgcgttttttatgtcgttgtttagtttgcgtttttcgaatttttcgggtatagttcgttgtattggagttttaggagatatcgttcgtagtagcgtacggagcgagggatttttagttcgggtcgggagagtaaagtttcgttggtttgttttggattgttaaaattaataatttttattattcgttggaagggcgcgtagagtcggttatagtcgaagttttcggagttattaaaaggaggcgttgtagttttgtcggcgcgcgggaagttttttttttagcg

SEQ ID NO: 4256 - DNA, 227 bp, Artificial Sequence
  Description of Artificial Sequence: Synthetic polynucleotide
ttaggagcgatggttgtaatgtttttttttttgttttgtttttcggtgtcgggagttttgtttttcgtcgttatttttggttagttttgcgtaagaacgtcgttttgtttggtagttaggtcgagacgtagtttgaatgtgagtaggaattcggagaagggaagggagagaattagaaagaaggttcgggagggattcgggaagtagtgggaggtttgcgttttgga

SEQ ID NO: 4257 - DNA, 323 bp, Artificial Sequence
  Description of Artificial Sequence: Synthetic polynucleotide
tcgtcggaagagttttgtagagtgagtttttagggttatttcgttgttttttttttcgttttcgtagtcgttgtagttagcgtgggagtcgggtaggtcgcgtggggcgttggatttatcgagaggttagcgtcgtcgtcgggggagggcgtgtttcgtacgtgtgtgttcgcgcgtgttcgcgttcgcgtgtgttagcgcgcgtgttttggtcgtgcgcgtcgagtcgggtcgtattaattttttcggcgtcgacgggtttagtttatggtgtgggcgtcgggtttagggaggtttcggttttcgttaatcgcggagtaggg

SEQ ID NO: 4258 - DNA, 279 bp, Artificial Sequence
  Description of Artificial Sequence: Synthetic polynucleotide
ggtacgagcgttagtagttcgtaaaataggtagagtacgtttttcgtgagggttatacgcgttttggtcgggttcggggttacgtaggtggtgtattgcgcgttcgttagggttacgaagagcgtaacgaacgttagtagtacggcgtttacggtgagcgttcgcgtcgtttgtatttcggtgtttagagttagtatcgagtcgtatattttgtattgtatgtgttcggtgttttgtattacgtacgatatttatagttttttttaggtggtttgcgtc

SEQ ID NO: 4259 - DNA, 261 bp, Artificial Sequence
  Description of Artificial Sequence: Synthetic polynucleotide
ttcggcgcgcgtttttcggcgtatacgttttttattttcgcgtcgcgcgggtcgcggatttgtaggttgcgcgttttttgcggagtttgtttcggttttacggataggtttcgtagtgagtaggtaagggtcgtttcgtcgcggttgtttttttacgtttcggtcgttttttttttttttagaattttcgtttagtcgggatttcggatttttttttttggtttggcggttttcgttagtcgcgatttttatcgacggaga

SEQ ID NO: 4260 - DNA, 364 bp, Artificial Sequence
  Description of Artificial Sequence: Synthetic polynucleotide
gttcgggttttgggcggcgagggcgtagcgagggttgtcgttttttcgggtagtttcggggggcgcggcgttgggtcgcgggttcgggggttgtcgtgttcgatcgtatgcgtcgatttgtcgttgggcgttcgtttttttttgttggggttgggcgcggtttcggagtttggcggcggtggtgagggcgtacggttagttgtagcggcgttgtgtttgtcgtggatttaggatattttaggtttggtggcggggttaggtggcggcggttttttgcgttcgggcgatggcgatagcgataggtttttaatttcgtttcgggttcgggtcggtcgggtttcgcgtcgggttacgcgcgcgtata

SEQ ID NO: 4261 - DNA, 242 bp, Artificial Sequence
  Description of Artificial Sequence: Synthetic polynucleotide
ggcgttttttgagtttagagaagtgggttaagataagggaagaaaattttttatagaagaggagattttcgtttttagtgttggggattttcggtattcgcgtttttgtgtttttggtggtttcggcgttttttcggagcgcgcggtatgtttgtttttatacgtttagtatttttgtttttagagtaaatttattttttagggtatacgtagaggggtagttaggtatcgtttttattttg

SEQ ID NO: 4262 - DNA, 285 bp, Artificial Sequence
  Description of Artificial Sequence: Synthetic polynucleotide
acggtcgttcggggtcgtattttcgttcggtggcggcgttcgaagacgttagtcgcgttacgtattgtttgcgtttcgcgttttagtcgtcgcgtattaacgtcgtcgttttcgtcgggagttaagttcgtcgggtcggttcggttttaggtgggtagttcggtttgtagttggttggaggtggcggtcgttgtagttttggtagcgggtatatttttaagtatacgtatttaacgttttttttttgagttacgaggatggagtagttatttcggttcgggattg

SEQ ID NO: 4263 - DNA, 222 bp, Artificial Sequence
  Description of Artificial Sequence: Synthetic polynucleotide
ggtattgattttttagttttttgtttgttttttcgttttttttttttatttcggatatttttaggataattagggttgaagttttcgggagaagtagtttcgagttcgtgggataagggggcggttcggtttcgtttaggatttttttcggatttttttttcggttgtttcggttggttgtagggcgcgttatttcgcggggaggcggcggtagcggtggcg

SEQ ID NO: 4264 - DNA, 201 bp, Artificial Sequence
  Description of Artificial Sequence: Synthetic polynucleotide
gcggcggcggcggcggcggcgggggttggggcgcgggggtcggattatgagtcgttgagtcgggtaaattttaggttatcgagttagcggattttcggagcgtagttttgcgtcgcggagtaggttttaattaggcggcgaggcggttatacgtatcgagttagcgattttcgggcgacgcgcggggttagggagcgttac

SEQ ID NO: 4265 - DNA, 298 bp, Artificial Sequence
  Description of Artificial Sequence: Synthetic polynucleotide
gggattattttttacggtgttatcgtatttatttcgcgtttttttttcgttttttggagtttatcgggattaggtggcggcgggtgtttttttgggggtgcgcggttatgtaattggtggatttttttaaatcgttttggaggggggagcgcggcgttgggggcgggagagcgtttttggttgtgagttgtttttgtcgtttcgtttcgcgtttttttgtcgtttcgtttcgggtttttcgcgttttttttttcggttcggtcgagcgcgttgtttcgacgtcgttatttagagtcgg

SEQ ID NO: 4266 - DNA, 272 bp, Artificial Sequence
  Description of Artificial Sequence: Synthetic polynucleotide
tgatagggatcgggtttagatttgttaaatgttgcggaggtagaatttgatagtgcgggagggtaggcgtttgggaggtaggagttggtggagatgatagcgtggaattcgtgagttttacgtaacgtttttttgtcgtttagggtgggtttttagaagtatagaaatggtcgggttgcgggatattatagcgaggaattagcggagtataggggttttaggagcgtcgggatatgttaggtcgggtagatagtttcgggtcggagtgagtg

SEQ ID NO: 4267 - DNA, 201 bp, Artificial Sequence
  Description of Artificial Sequence: Synthetic polynucleotide
gagtatgagggagagtgttattttttagttgaaggttattgtgttttgtatttttggtttgggtaagtgaggagtttgttagtttttggtaggaagtgtacgtgatcggcggttggttaggggtatagagacgtattttatatagaaatttaggttggcggggtgggcggtcggggagttagttttgtagatgttattaag

SEQ ID NO: 4268 - DNA, 251 bp, Artificial Sequence
  Description of Artificial Sequence: Synthetic polynucleotide
gtaggttgaaggcggagttggagatattcggggagtaggttcggagcgttttcgaggtcggggtcggcgagggagaggtagggagttcgaggaagggaggcggggcgggtagggatcgagttaggagagagcgggcgggggttttgggagcggttttcgagagtggggtttgtggggagtagggcggtttcggggatagaggaagtcgcggtggaggtttagggtagacgcgggcggacgcgaggagcgta

SEQ ID NO: 4269 - DNA, 249 bp, Artificial Sequence
  Description of Artificial Sequence: Synthetic polynucleotide
attcgttttcggagtttcgttcggcggtatttgttttggttacgcgttttagtttcgttaggtttttcggcgggttcgaattcgtagtcgggaaggtatacgcgagtaggagggcgtattttatggttaggtgcggacgcggcggttgcgggtggttagacgcggtaggcggagcgtacgggcggcgcgtatttttttcgcggtttcggagttcggcgttttaggtgcggttttaggtgagagtcgtcg

SEQ ID NO: 4270 - DNA, 249 bp, Artificial Sequence
  Description of Artificial Sequence: Synthetic polynucleotide
gttttcggtagacgtagggggacgttcgggcggcgcggggcgcgggtttcggagtggttgcgggaaggacgcgcggtattgtttgtgcggggattcgggacgggtcggggtattataggcgcgggaatttacgtgtggattttgcgttcgcgggcgcggtgattttcgcggggatttgttggtgtttcgagatttattgagttgcgggggttttggagatttttaggtttgaaaagttagttttagaga

SEQ ID NO: 4271 - DNA, 201 bp, Artificial Sequence
  Description of Artificial Sequence: Synthetic polynucleotide
ttgttcgcggcgtcgggcgcgtcggtcgtcgggtggtggtggtggtcggcggcgtggtggtggtggtggtggtagtgcgggttcgcgtcgttttgcgcggcggtcgcggcgattacggcggatattacggcggcggcggggtttattttttcgtcgttgtcgtttaaggaggcgtcggtatcggtttcggtcgtcgcggtt

SEQ ID NO: 4272 - DNA, 201 bp, Artificial Sequence
  Description of Artificial Sequence: Synthetic polynucleotide
acggtatttacggtcggggggttcgggggattcggcgggcggcggacggcgtatattcgcgattcggttcgggagtcgttgttttttttagtttggttttcgtttttacgatttaggggcggttgcgcgttgttttttggcgtcgtatcgggtttaggcgcgcggcggggttggggcgcgcggggcggtcgtttgggttat

SEQ ID NO: 4273 - DNA, 251 bp, Artificial Sequence
  Description of Artificial Sequence: Synthetic polynucleotide
cggcgtcgggtagcgcgtagagttagtcgcgtgtgtagggtcgggtgtcgttgcgtgcgggcgcggggcgcgggttcggggcgggtgtagggcgcgggatcggggtagcgtaggagtaggtaggggttcgcggttcgcgtgggttttaggcgcgggatggcggcgtttagtagcgcgggttcgcgtagggcgcgtagcgttgggggtaatagcgtggggttcggtcggtagtggggcgcgggttgcgcggt

SEQ ID NO: 4274 - DNA, 201 bp, Artificial Sequence
  Description of Artificial Sequence: Synthetic polynucleotide
tacggtggattttgtgggtcgttgagttttttgattttcggtttgttttattttgttttgttagtgggttttgcgttcgcgttaataattcgaatgggtacgtttttgcgttttagaacgttgttcgtttttttatatttagattgaggtggaatttacgttatataaatcgggtcgtaaggtttagtttagcggggtttt

SEQ ID NO: 4275 - DNA, 201 bp, Artificial Sequence
  Description of Artificial Sequence: Synthetic polynucleotide
tggcgcggggcgtaggtgtacgtaggttggtcgcgggcgcgcggggttcggcgggagtttcggggtggttttcgcgtggggtcgggggcgttcgcgcgggcggggcgaggtcggggagggtagttgttcgtttttttcggtattgggagttttcggttggtattgcgggaggagttttcgggtgattcgcgggttttgaaa

SEQ ID NO: 4276 - DNA, 201 bp, Artificial Sequence
  Description of Artificial Sequence: Synthetic polynucleotide
tgaggaattggatattaggcgttggtcgttttttatttttagtcgttgggtgtttagagtttatttttagcgattagagtagaattgtagagaagacgttcgcgttcgggtttcgtttggggagttagggcgcgcggggagcgttcgggtcgcgcggttattgatcgttggttgtacgggggcgtcgtgcggattcggttt

SEQ ID NO: 4277 - DNA, 337 bp, Artificial Sequence
  Description of Artificial Sequence: Synthetic polynucleotide
tttagggttttcgggatcggtgttcgttagtgggtataggacgtcgggtgttcgaagggttgtttggagatgtaattgattttggcgggtattagaatgacgagtggtagtagtaggagcggggtgacgaataagattacgaaggatttgaatttggagatatagtttagcgtcgaggttatcgcgcgggagggagattggcgggcgagacgagtgaggggtagttagaggcgtcgcgggtttaagaaggggttatagttttcggggattggggagggggcggtgataatttcgtttcgtacgggggcgttttttcgcggttttggggcggggttat

SEQ ID NO: 4278 - DNA, 201 bp, Artificial Sequence
  Description of Artificial Sequence: Synthetic polynucleotide
ggttcgtgtagagtcgtttattttttttcgtagcgtcgggttgttttaaattgtttttggattttatttgtgagtcgcgtggttgggttgggttgggttgcgcgggatttgttagcggttttcgttattttgttcgtaggcgtttatcggttgttttttgggtcgtcgttggtcgtcgttatacgtgggacgtcgagggta

SEQ ID NO: 4279 - DNA, 201 bp, Artificial Sequence
  Description of Artificial Sequence: Synthetic polynucleotide
atatggcgtatgatagggaattggtagggttatagtttcggattattcggggtagggtagggaaattacggtagattgcgtagcgtattttgttcgggtgcggtgagggttgcgtttcgtttggttttcgttataatttatagaaagttttcgcggagtattggtgtttttgaatttattaggcgatttcgtcgtaaagaa

SEQ ID NO: 4280 - DNA, 201 bp, Artificial Sequence
  Description of Artificial Sequence: Synthetic polynucleotide
tcgattttgtttcgggtaatcgatgggaaatttttcgagagcgcggtttttttggggattcggcgtttttgacgtttttaggcgttttttcgggtcgttgcggttttttttcgtcgttcgttagcgtttaaggtcgcgttttttttattttcgtttttttttttttttcggcggttttcggatttggatagagttgtagga

SEQ ID NO: 4281 - DNA, 1216 bp, Artificial Sequence
  Description of Artificial Sequence: Synthetic polynucleotide
gaagygaagaggggttttttgatttgtaatatagaggaaagygtygttttygtttagtttggtatttaygygtttataygtattyggygtyggtygggtygtttatttgagttttaaaagttgttgaatttatatggttaygtttyggggagyggggttttagatttggttygtttaggttatttgygyggygttygygttygttygttttygtttygyggygtyggttttyggttttyggttygtygtttttygtygttygtyggtygyggggygtatagygagttagagygyggtygygyggggttttatgtyggtyggygygtygtygtygttggggygtatggtttaggttgggyggttygygggggygtatatttttyggtyggggygyggggttygyggtttttttygtyggyggtatagygaaggyggtagygaggyggggygtgtttyggygttgtygyggygtagtaaagggttggggagtygyggtttygtttttyggggyggygaggagggaggtyggyggygttgtygtttayggtgygtgtttttyggygygyggtttttgtttttagtyggagtttygygtygatggggyggygttgtttagggtttggggtgaygygaygyggayggaygygagtttttttygygttgtygggtyggggggttttgttagaggtttygtygtygatyggygttatttaagttgttygggggtttygtttgagygttygttttgtagayggtygyggttyggagattggtaggaggygggtaygagaggygygyggggygagggygtygtggagygyggggygtggggaygygyggyggyggygtygygyggaggaggygygyggggatttyggggtttygtygttygygtttatygygttygtygtagagtygttygygttgtttagtygttttttttttygygtttgttttttygygygttygttttygtttttyggagtyggttttaatttygttygttyggttyggtttaygttattygtttttttygtttttygaaygggagttygagtttttggtttggtttyggtttttgttygtygttttattttgygggggtyggggtygtygygggtggtggggggygttgtgtttagtaggggygatagygtaggyggggttttttgtagtttttttttttattttyggtygygtttyggtttttattttg

SEQ ID NO: 4282 - DNA, 365 bp, Artificial Sequence
  Description of Artificial Sequence: Synthetic polynucleotide
ggtyggtggygtttatttygtatygygttgtttygttyggggtattatggtttggggttggattatgttttttttattttagtyggygttttttatttaygygygttgagggtgyggtgagttgagtgyggggttaagtatgttttggygtygatttygtttaggggtttaggatttggygtttaaggggttttttggygayggagattttygaygtagtagygattygyggttgtttaagttgatttygttygygtttygagyggttttgggygygyggggtttyggggattggaggatttyggggggyggygtygygtggtggtyggaaggggaygttaagttyggggtgggygtyggaygtt

SEQ ID NO: 4283 - DNA, 201 bp, Artificial Sequence
  Description of Artificial Sequence: Synthetic polynucleotide
gyggaaagtaaggygygtttatagtygtttttttttttggaagttygygtttatttttgygyggyggtygtttyggaggygtygggttgggygtgaggaygtygtatttattattgggttygygagygtygttagtttagtygttttttttygtaggttygggggtagygtatttygtaggttttataagtygttaygtta

SEQ ID NO: 4284 - DNA, 201 bp, Artificial Sequence
  Description of Artificial Sequence: Synthetic polynucleotide
gygttggttgggtagtttttgggagatgaagygaygtaggygttttaggtattggttgtagagttygatgtygttgtgttyggygttttttatttatagyggttttatygttttggggtagygttygtagagygttagttygtgygagaagtygattatttygtttttygtgtygtggatgatgagtaygggygaygtgat

SEQ ID NO: 4285 - DNA, 201 bp, Artificial Sequence
  Description of Artificial Sequence: Synthetic polynucleotide
tygttttggtygaagygtagttygagygtygygaygygttttaygygtaggaagtygtyggggtygyggtygtatatttygaatatttygygtaggyggygtayggagygtagtagagtygygggggygttygattagttygygtygttygttattygggtyggttygtagtttagttyggatttttygttygtygygttc

SEQ ID NO: 4286 - DNA, 201 bp, Artificial Sequence
  Description of Artificial Sequence: Synthetic polynucleotide
ygtttygygttatgtatatttattgtggtgatgagagttygygtttygtgttygttayggttattgtgygtttaataaaaataaatattgtygaggagtygtygygatgyggggyggaygygyggttyggaaaggggagggggttttaggaagagttatattygygagtygggtttgggttaggggygaggggagagygtt

SEQ ID NO: 4287 - DNA, 201 bp, Artificial Sequence
  Description of Artificial Sequence: Synthetic polynucleotide
gtggttttttggtttttttaggtagttaatattataattttttttgggagggggttygtagaagggygygygttgtttttttygttttttaagttgtagyggggygggtygggagttagggttagggtttggagatttgggaggggatyggtgttagaagygaagagttagggttagaaagttaggttaattaaggggggg

SEQ ID NO: 4288 - DNA, 201 bp, Artificial Sequence
  Description of Artificial Sequence: Synthetic polynucleotide
ggagaagggggttygtgtaaattttaggttgaygatygygtaygygtttttygggttattagttttgtygtttttggtggggtatatygaggagatygtygtggggaatyggggatyggattgtttgatagtygagygttgaagattattttttttgagtttagggaggtttggttgttttgagttttttatttttgggtt

SEQ ID NO: 4289 - DNA, 213 bp, Artificial Sequence
  Description of Artificial Sequence: Synthetic polynucleotide
ttttgyggttggttaggaggagtttttygtygtttttattttagtygygtygggygttgggttygatttttagtatttttggtattgatgtgtttggtgygygttgagaygygaaygttttgtaagatgagtttttatttattygtttttttttttttttatttgtttattttataaattgagtgtttggttattttggtttaggtaagaggt

SEQ ID NO: 4290 - DNA, 201 bp, Artificial Sequence
  Description of Artificial Sequence: Synthetic polynucleotide
gtttagyggtttgtatygagagttaggagaggtttagatyggatttygatttttygaggygygggagtttayggagygyggtgggygyggygttygggtygygtagttaggtggggagyggygygtagttttagattygtaggtaggtagyggyggattgtatttgtttygtttygtagygttttttgtttgtygtttttc

SEQ ID NO: 4291 - DNA, 201 bp, Artificial Sequence
  Description of Artificial Sequence: Synthetic polynucleotide
gygttygaggtyggygyggtggggatygygggtttattattagttaagtttagttatttaattatttgtagagttgttgtaggtataggtttaggttttygttttttattttttygygggtgatgygttttgatagyggtygygggagygggggtaaaggyggtagttggggyggyggyggyggtayggtygagtgtttyg

SEQ ID NO: 4292 - DNA, 201 bp, Artificial Sequence
  Description of Artificial Sequence: Synthetic polynucleotide
tygtaaggggtattyggttttgtgygygggggyggygggggttttgygyggggtygggttgggtygggttgagttggttygtttyggygtyggggattaygygygattggttagattttgtygtgatttttggaaaattgtgattattttatatgttttgtttagttyggattttttgygttaaygagttaggtttttttt

SEQ ID NO: 4293 - DNA, 324 bp, Artificial Sequence
  Description of Artificial Sequence: Synthetic polynucleotide
yggggttygggttgggatygyggggtgggyggtttygagagygtttygtagtggttggagttttgggygttgtaaagygtgtttygtygggttttygagygtttygygttttygtttygttatgtttttgttgttggggttgtgtttggggttgtttttgtgtgtggggtygtaggaagaggygtagagttggggttatttttyggagtaggtaagtggagtygaggggagtygggtttygggygyggtygttttttttttttygtyggttyggtygyggagtttttgttygggtttttttygatygttttttaggtttttatt

SEQ ID NO: 4294 - DNA, 201 bp, Artificial Sequence
  Description of Artificial Sequence: Synthetic polynucleotide
gagggggyggttggaggattyggatttttaagaatttggttttgggttttgattygggyggtyggagagaaggygaagaagaggtygagtagataggygygyggyggaygygagagaaggaygygggygaagygtttaagaygttygtttttagggtygtygagttttttttttttttygtttggygyggtagtatygygg

SEQ ID NO: 4295 - DNA, 330 bp, Artificial Sequence
  Description of Artificial Sequence: Synthetic polynucleotide
agtttagtttagttaagtagtagagagaataggayggaggtttttattttttagggattgtagygtttttaaatygtttatttgygayggtttygygagygtgygtagtttagtttttttyggaygttttygttttygttygggtatatygtgtttygtatygaggtagagaggggtaygyggattttagtttttgygagtttttttgttygtygttattttatatttygtattgttttagttgtygttttagaagatgtatygtttggygygtaaagyggtgtayggtttttagttygygygtagtagtttggaggggygttagagttt

SEQ ID NO: 4296 - DNA, 293 bp, Artificial Sequence
  Description of Artificial Sequence: Synthetic polynucleotide
gygttttagttygtggygttgtyggygtagatttygygtggggatyggygaggttaattttttttgyggttyggggtyggtagagtaygtaaggggtygygggtygygtgggtttgggygygtygtggtgggtaagyggggttagyggagygggaattygtatatttttygagyggagtygaggataggttygtgygggtygyggggtttttttggygttaggaagyggyggtygaaggagataaygagaaygtagtttyggtttagggaggtttaaaagttgagatgttgaa

SEQ ID NO: 4297 - DNA, 201 bp, Artificial Sequence
  Description of Artificial Sequence: Synthetic polynucleotide
atygtyggygtyggtagttagagygggatttagtttttatygygttttttattggagtttttttyggtttttyggygagtgyggttygtggggagtgggygtyggygygaggaagtttttyggttygggygatttyggtttttgagyggtttttttttaygtygtygttygttaggtygayggaggatyggggyggggayg

SEQ ID NO: 4298 - DNA, 201 bp, Artificial Sequence
  Description of Artificial Sequence: Synthetic polynucleotide
yggygttttaygttttttttttggagtaaattygtttygttttttttttggagtaaattygtygtattttygtttgtatygaaattttgagygtygtttygygttatttttagttygygttygygttgttttttttttygggtygtaggttgagaggttgggtygtattttggttaygttttgttyggttttagygggata

SEQ ID NO: 4299 - DNA, 226 bp, Artificial Sequence
  Description of Artificial Sequence: Synthetic polynucleotide
tyggggttgttagggygtygggttygtgygyggatattgggggygtattyggttttygggttaggygyggttggagatttygaggttggggttttgaagygygtaagtatttttttttttatygygtttttgtaagtagtttgaagttttaagtygttgtttayggattttygtttttaattttttaattgaaaaaatttgtygaggagagtggaggtatygttat

SEQ ID NO: 4300 - DNA, 363 bp, Artificial Sequence
  Description of Artificial Sequence: Synthetic polynucleotide
tattygggygygggagtaygggygggtygggggygtttgggtyggtttgtygtggttygggggttyggggyggygygatttatttggygttttyggggtygygatttttttygggaggtgtttgygaaggyggttttgtygyggtgggggtggggaggttagggtttyggatygttggagttggggtygtagttagtttttggygagtgttttttggttgttgtygtaggggtttgttttttyggattttttttttaatttygtyggatttttttttttttttttttaygttygttaagtttatggtttttgtaatgyggtgggtgtggttatttagtaaattgtaattgtggttttttgtaa

SEQ ID NO: 4301 - DNA, 201 bp, Artificial Sequence
  Description of Artificial Sequence: Synthetic polynucleotide
tttttyggagtgggggattgygagggggtttyggttttaygaggtgyggaggaagagttygaggtttggggygaggygygygggatagtggggttgaygygtggtttyggygtygygyggtttttygaatttygagtttygygttyggygyggtyggggtttttaatygttttttygttygtygggatttttatygggtyg

SEQ ID NO: 4302 - DNA, 201 bp, Artificial Sequence
  Description of Artificial Sequence: Synthetic polynucleotide
ttygttyggygttgtattttttygtggttyggttgtaaggatttgyggtggaggtttggyggaggygggttygygttttagagagagygttaygttattygagaaggygaygttgggggttgttgagttttttaattttttttggygygttttgtttagaagtyggggagtttttggtyggyggttggyggggaagygygg

SEQ ID NO: 4303 - DNA, 267 bp, Artificial Sequence
  Description of Artificial Sequence: Synthetic polynucleotide
ggtgagttattgggatttygttgttagggagtaagttggtaggtaggaagtagttaagatttgggggaattttttttagggaaygaatatagagaaggaygtatttgaaaatttygtygtagttattttttttttatgggaaagtttygatttyggygggtttagygttattyggtttttyggggtgtggaatattgagygaggtaggtgyggygggagtatgygygyggggygggtagggggyggttttygygtttttatttygyg

SEQ ID NO: 4304 - DNA, 707 bp, Artificial Sequence
  Description of Artificial Sequence: Synthetic polynucleotide
agggaatggggagggttaygtatattttgtgyggttygagtggttyggatggtatagtttaggtgttygggttaaagttggtatttttaaagtttagaaygtaatttgggygygttagtataaattyggttttyggtttttttgaagttagttaagttygtatagggtttttagygtttggaaatttgagaggygtggaagggtggggagtttygygaagtttttagtttttgggtgtttttyggtttygygggggagygggtttggagttaaatyggtyggtygtaggttggagtagygggygtyggagygygyggtggggatgttygaaaaggagttagaggtttagtyggagagttygagaataygagggatgtttattttgtaatatggttttaagtttttttttgtttaygyggaagygtttttygttttatttygggttgtgtagggtygtttyggygattaagtygttttyggagtygggtattggggagtyggtgttgygttygttgttggagtyggggttygattgygtygttaggtagtygggttttttttgggyggttatggtgggygygtagygttygggttttygttgtygtygtygttttgtttgygttgtygttttygttygtyggtygggtttaattggtttttagygtygyggygttagttygtttttttgtagtygtygaygttatygt

SEQ ID NO: 4305 - DNA, 201 bp, Artificial Sequence
  Description of Artificial Sequence: Synthetic polynucleotide
tggtgttgagtgygggtygggtygtttttyggyggyggtgggtgggygygygagggyggagggggtygggagttttggtttygaggtagygaggagagaygggtaaatagtagagygttaagttaagtttttaaagtgttaatagttgtagaagttygaattttagyggttttaggggygygggtatagggttttgggttt

SEQ ID NO: 4306 - DNA, 201 bp, Artificial Sequence
  Description of Artificial Sequence: Synthetic polynucleotide
gttgttyggggttgttgtataagtyggtgatattgttttgygggtttayggtttgtgagygttgygtggagttggggttygygyggttaygggygygggygygggygygggygygtgaaygtagtgttgagtygtttgttggagaggtttttttyggtygagtgttygttgygtaggttggagggttaggygyggagtttg

SEQ ID NO: 4307 - DNA, 201 bp, Artificial Sequence
  Description of Artificial Sequence: Synthetic polynucleotide
agttagygyggttttygggtttttgygtttatggygagggtygygggggaatagtttttggtaggtaatttgtygggtatttatttgagtttttygtatygyggttygaaaatttgggagygttttaggataaagggttagttttttggaattagtygtgtgtgattagtgtgtgttagttygtatgtgggggttttagtg

SEQ ID NO: 4308 - DNA, 201 bp, Artificial Sequence
  Description of Artificial Sequence: Synthetic polynucleotide
gttgygtaggtatygggtttygttygggygtyggggtagggttgtyggggttagtaggtttttygygttttttttggyggggttttaggggttggattgygggttttttttgtttttttttyggggtygagtaagttygyggggggtgtttttaggtagtaggagggtgaggtaggataatttttaggttttgtagttttt

SEQ ID NO: 4309 - DNA, 203 bp, Artificial Sequence
  Description of Artificial Sequence: Synthetic polynucleotide
atttttaaagaatgataaaataaagaagygtaygttaggtttttaaggagatatygtttttttttttttattattttttatttttattagattttttatygyggattaaagatgaatttgttattaattaagtttttgtttaagttattttatttttygtagtttttttatttgtyggggyggtgttyggygtattttaggtt

SEQ ID NO: 4310 - DNA, 201 bp, Artificial Sequence
  Description of Artificial Sequence: Synthetic polynucleotide
tgatygggygtygaaaygtygggagtygggggttaagggttygagttaggaggtttyggagtagtagtygttygttttttaygtygtygtygtygttttygyggttgtttggataygggataatygatttggggtttygatygtagtagagtyggaggggtgggtaggygygggttygggagaygygyggggaaaygygyg

SEQ ID NO: 4311 - DNA, 201 bp, Artificial Sequence
  Description of Artificial Sequence: Synthetic polynucleotide
ttattttaaagyggtagygtatttttagagttggttttttttttygtttygggttttyggatyggttgtaggagttttttttttygggtygggyggyggygtttggygttttygggttgggttattgttttatgtttttttttgggygtttggygygtgttttatygtygttatygygtttaaaggttaggttggaagttc

SEQ ID NO: 4312 - DNA, 208 bp, Artificial Sequence
  Description of Artificial Sequence: Synthetic polynucleotide
gggggygttttattgattttttttggygtttgtttttttttttaggttgygttttttttatttattgygagygtgagttagygttgaaggtttagagygygttgtaygagtagaagattttgttyggggtaagtggygttygtygtggygtaagyggtygaygygtygatagggggygatttygggaggtygggyggyggygyggygc

SEQ ID NO: 4313 - DNA, 201 bp, Artificial Sequence
  Description of Artificial Sequence: Synthetic polynucleotide
tattgatgaatgygygttyggattttygggyggattttttttaagtyggttygtttttttagtttaaataaataaataaagttagatggaagaaaaaagygtttattttattttygtygtygtttygttygttatttttgtttttgtttygttygtttggygttttaatagagtatagtttggtggataaagtttttttat

SEQ ID NO: 4314 - DNA, 201 bp, Artificial Sequence
  Description of Artificial Sequence: Synthetic polynucleotide
gaaaggaaaaagygatatttttgtttygtatagagttaaatattggaagtaygagatagtygaygtggattaggattattttggtttttygtgyggyggyggyggyggyggttgygygygggttttttgtggygyggttttggggygygggygygggyggyggyggggttgygggagtygtyggggygggaggyggagygc

SEQ ID NO: 4315 - DNA, 595 bp, Artificial Sequence
  Description of Artificial Sequence: Synthetic polynucleotide
tttggttttyggygttyggggttagygtagttyggggygagyggggygygggtyggggagggggagttgttygygtattttatttttttttttttygggygggyggyggyggttygttgtatatatttyggygtatttygttaggtygygtatagygtttygagtttaggygttttttygtttttttttygygttttgyggyggyggyggyggyggtagtagtagtagtaatatggttgttgatgggtgtttggggtggygttggyggygggaggagttttttygagtttttgygtyggttgttygttgttagttatggtaaatggtggyggyggyggyggyggtagtagyggyggyggyggyggyggyggaggtagtagttttagaatgagtagtaatatttaygygaattattttagtttagaygygttttttttttttttttttttttttttttttttttttttttttttttttttttttttttygtttttggtttaygagtttaagatggatgygtttattatttyggtgattatggaggtgtygtgygatagtyggggttaaygtatgtggtgggtttttttggtttttt

SEQ ID NO: 4316 - DNA, 201 bp, Artificial Sequence
  Description of Artificial Sequence: Synthetic polynucleotide
tttttttttttygtttttttttttttttggagaagagagttggtgttaagagttagggattttggttgtgtgtttgyggatttgtagtggyggyggyggyggyggyggyggggaggtagtaggygygggagygggygtaggagtaggyggyggyggtggyggyggyggttagatatgaaygtygtttyggygtyggyggtg

SEQ ID NO: 4317 - DNA, 269 bp, Artificial Sequence
  Description of Artificial Sequence: Synthetic polynucleotide
tttatygatygtattatttgatygygggaaaygaaatttgagtttaggaatttgaattgttttaygtaygttygttttyggataaattttttagaggatygtgatttttttatttagagattatttagggagatgttttggatgggataagtagataaatggyggttygaggaaaatgtaggaaattttatattgtagaygtttaagtattaattgtttgggtttyggggtagggaaygggagatattatttatyggaaatattatatt

SEQ ID NO: 4318 - DNA, 201 bp, Artificial Sequence
  Description of Artificial Sequence: Synthetic polynucleotide
ygyggtygygaggyggggttggagggygttgygggttgygyggaggttgygggaagygyggggagtaygyggagttygattagtagggagatygygtygygtygggtataggtaygggattygygttttaggagggygtagygagaggygtattgygtatttaggggttgyggtttyggtygtygtgyggtgataagttga

SEQ ID NO: 4319 - DNA, 267 bp, Artificial Sequence
  Description of Artificial Sequence: Synthetic polynucleotide
tgaaatttagaggaaaataaaaatgtagyggtttttayggaggtttttggtttgtaggatatttgagggtggagataaggatgtygyggagggaggattygggagttyggtygygttttttagtttyggtattygygtttagygygtygygtttygygtttttygygygtggtygtttttygygggtygggtyggggttgygttgttatttagyggtygygygtttagygtygygttatygtttttgtaggtygtyggggtttttgt

SEQ ID NO: 4320 - DNA, 287 bp, Artificial Sequence
  Description of Artificial Sequence: Synthetic polynucleotide
ggtttagatttygygagtttygggtttygtttattyggtyggyggttttttyggggyggagygyggygtttttggagtyggtatttyggatttyggygtygtttygygtatygttttygttttagtttttagtggygyggygttttttygygatattygygggtttttaggagygagtygattttyggttgggtttggagtyggggttaagtttattyggagggagtayggagtttatttagttgtttttgggggtaggaggtttaggttttattttgtatatygtt

SEQ ID NO: 4321 - DNA, 201 bp, Artificial Sequence
  Description of Artificial Sequence: Synthetic polynucleotide
ygatttggtattagygyggaggttattttgygtagtygggtaggtayggyggtttttaggtattttygtagtagttttagtttttggttygyggygtygygagggygagaattygtgggygtyggttttttttttygtygtyggtgttttgtaaagtggaggtyggygttttyggygttttygtygygttyggggtaggtc

SEQ ID NO: 4322 - DNA, 201 bp, Artificial Sequence
  Description of Artificial Sequence: Synthetic polynucleotide
yggaggtttaygttgagttygygtagygygtayggttygtyggyggyggtggttttygygttgygttgtgttygattyggttygygyggatttygttygygttattttaygygtaggttttgtagygtttttaggagtagtagygttygtaggggatygtygaggtygtyggggttatttgggtagagygygagtaggygc

SEQ ID NO: 4323 - DNA, 286 bp, Artificial Sequence
  Description of Artificial Sequence: Synthetic polynucleotide
gygygggaggygtygggggtygyggaggyggggyggggaggggtyggyggyggyggyggygygyggaggagatygtagtgyggtyggygttaggattygygggggttttttaggtygyggygtttttygtttttttttatttttygattttttttygtttttaaaatgaggaaayggagtaattygttttaagttgtgtagtygggatygtttyggggtgtgtagtyggttygyggaggtttttttgggggygggygyggggygyggttygggggygttttttgag

SEQ ID NO: 4324 - DNA, 244 bp, Artificial Sequence
  Description of Artificial Sequence: Synthetic polynucleotide
aatgtttagtattatttaaaaagaaaattatatatattagttaatgatatattttaatttttaataaagttggtatttttttttgattatagattttgtygtggtaaattygggtttygaygatagaggtagygtagaagttygtttttaaatgagataattttattaaaattataattttttgtatttttatagygtttttttagtggyggagattttaggtgttttaygttagggtttatta

SEQ ID NO: 4325 - DNA, 201 bp, Artificial Sequence
  Description of Artificial Sequence: Synthetic polynucleotide
gttttaattttttttygagatttygggyggyggggattttttttygggtggttgygtgygygtttagtaattyggtgggtggaggtttggagtttygttygyggtygttttygttgattttttagtgtttttgtttgttttttagagtttaggtagttagtttttygttaggaaggtagagtagygagattttyggtttac

SEQ ID NO: 4326 - DNA, 372 bp, Artificial Sequence
  Description of Artificial Sequence: Synthetic polynucleotide
ggattygtygtttaggttygygtggggatygtagggaattygygttaygtygggggttattgtttatygygaggtgttgaagtggtttygtgatygtygygggtygtggttgatatygyggagaagttaggatttttatagtttttgttagatttgaaagtaagttggaaatygatagttgttttagttgttttagattttaatttggtttgggttttttttttttttatttgaaaatagatttagggtaatgtttaagagaattttaatygayggaagtggtygggaaattttgttttyggtattgagggatgttatyggagatttttttgttttaggtttgtyggagtttattatattygttaatgttat

SEQ ID NO: 4327 - DNA, 201 bp, Artificial Sequence
  Description of Artificial Sequence: Synthetic polynucleotide
aattttttygtgttttttgtataatttgggagagaygtagygttgtgggtgtagagttgtttagagagggttttaggttagggtagggaagagataggaygtygyggggttyggttgtyggygttgttgttattttatggttgaaggggattgaggtygaattgggtaaggagaagtyggtygtagattgtggagttgatt

SEQ ID NO: 4328 - DNA, 247 bp, Artificial Sequence
  Description of Artificial Sequence: Synthetic polynucleotide
ggggtaggattttagaagttatttaattagggaygttgggttggaaatygtttaattaggtayggggtaggagaggatagggyggttttygggatgtggyggggtttttgtttttggttgtagttggagttttgygtttygttttygtttttttgtgttttttgttgttagaggtttagtttttgtggttttgtgatttgygggtattgggggatttatagttaagaygttaggatttttyggaagt

SEQ ID NO: 4329 - DNA, 201 bp, Artificial Sequence
  Description of Artificial Sequence: Synthetic polynucleotide
tygttttttttttygggatgtyggatyggtatttttattatttttaggtttttagggggttttggygttttagttgtggattttttaatattygtaggtygtagggttatataggttgggtttttaygtgtagaggatataaagtagatagaygaaaattggagtttyggyggtagygagaaataaaggtygygttaaatt

SEQ ID NO: 4330 - DNA, 201 bp, Artificial Sequence
  Description of Artificial Sequence: Synthetic polynucleotide
ggattttgagttggggatygtttaattaggtaygtaattggagyggatagggyggttttygggatttggyggggtttttgtttttygttgtagttggagygtttggtttygttttttttgttttgtgttttttgtttttagaggtttagtttttgtggttttttgatttgtaagtattgggagatttatagttaagaygtt

SEQ ID NO: 4331 - DNA, 235 bp, Artificial Sequence
  Description of Artificial Sequence: Synthetic polynucleotide
atttygttttttgtaagtttgtaatatttygtatttagattygtaatttaggyggaggataaagggttgtagyggagggygtagagtagatgtttagggyggggtagagggggygggaagttggygttayggtygyggygagggygagtagtygygygttttyggtgttaggaggaatgttygtagagyggaggttggtaggygygagaggttttaagygygtagttygattaag

SEQ ID NO: 4332 - DNA, 201 bp, Artificial Sequence
  Description of Artificial Sequence: Synthetic polynucleotide
gyggtatttygttttyggttttgygygtttatttyggggygygtygaggttatygtagggtatttatttggtatttgtttttgagtgtgtagatygtygyggtttttatttgggtttttaaataagttttagggagaaagaaggaggtaaaaaaaaaaaatttaattatgtaaatggatttyggattgggaggygygggat

SEQ ID NO: 4333 - DNA, 201 bp, Artificial Sequence
  Description of Artificial Sequence: Synthetic polynucleotide
gtygygttaaygaaygtaggyggygggaggttyggyggyggggttygygtttttgtatygygatygygttagaaaatatttyggggttgggyggygtttyggagaygtatttttttgttatttttatygtttttggtaaygattattaatgttattatgttttatttttttttattttttttygtttttagagtygygttc

SEQ ID NO: 4334 - DNA, 201 bp, Artificial Sequence
  Description of Artificial Sequence: Synthetic polynucleotide
aaagagggagaaagagattaaaaaaagaaaaagataaggggagggggaaggaaggaaggagagaaggaggaagaagtttggggtttgttgttttaggagygtttaggtagtyggtgttggagygyggggygttygttttygtygggattgtyggtttyggggtttgygagagygttagagttttagtyggygygttygggc

SEQ ID NO: 4335 - DNA, 201 bp, Artificial Sequence
  Description of Artificial Sequence: Synthetic polynucleotide
gtttttgygygyggaaaggygttggaggyggttttatagtyggggaggttagyggyggygtatttgtattttgggagaygtttggatttagtttaagttygtaggttgggygagyggagatttttgattttatygtgtgggtgagattattgtttttyggtttaaaagaaaagaaagtatgttgtgaatttttgaaataaa

SEQ ID NO: 4336 - DNA, 201 bp, Artificial Sequence
  Description of Artificial Sequence: Synthetic polynucleotide
tggaatttayggygtttygttygtttygygtttaggaatattgtgygtttagygtagatgygtttttaygattttttgtttggttyggggttatgtggtygygtatyggtttttgaagtttttatttgattgttggggaaggygtttagaattaggagygggttggttggggattggttttygygttgggtygtttygttt

SEQ ID NO: 4337 - DNA, 296 bp, Artificial Sequence
  Description of Artificial Sequence: Synthetic polynucleotide
tygggggtgggggtaagygttaygtgygygttaggtttttggtgtgttyggtaggyggygttgygtggttgyggttggtttygagggtgyggggggyggygattygggagggaaaatttttgttttttttyggggtttgttttgttygttttttaaattygttttatatttttttygattttygtttttgtaagygttatttgtagttttatyggttttygtaayggtggtggtggttggtggggggtttygaagtttgtttttggttagtyggatttyggtgggagatggaggta

SEQ ID NO: 4338 - DNA, 201 bp, Artificial Sequence
  Description of Artificial Sequence: Synthetic polynucleotide
gtyggtygagtttygggagtygaggttggaaaygttggagygggygttgtttatygaaggyggttygggatygggaygygggttygagygatyggagygygggttgtygtggygttggtygtagtttaggttgatgtygttggatygggygttgtygttatygtygtygtygtyggatttygttaggttggttygtgggtt

SEQ ID NO: 4339 - DNA, 201 bp, Artificial Sequence
  Description of Artificial Sequence: Synthetic polynucleotide
attygttattgtgtatttggaygttatttgtagatttagygtttgyggggatttyggaaaygggagagygggttttyggaaayggtgattaatgggaaaygtgattagatgttattaggygaatagttygtttttaggtaatatagaaggaagagaygtttttagttattttaaaatagayggagtttttagttaatggat

SEQ ID NO: 4340 - DNA, 266 bp, Artificial Sequence
  Description of Artificial Sequence: Synthetic polynucleotide
ggaaatygttagttttgagygtyggattttttgtgttgggtgggagtgggggttygyggttttggtgttttaatttttggaggaggaygtygggyggggygatgtttgtgtttgtggttttttgaggtagtgggagtggygtgtgaaggattgtgagagtttggygtgaagtgattgttatttgttagatattygtttggttgagtgtggtttygggatygtgttygtaagyggatttygtggaggygtttttttttttatttttt

SEQ ID NO: 4341 - DNA, 201 bp, Artificial Sequence
  Description of Artificial Sequence: Synthetic polynucleotide
taaagaagtygygggtatyggtttaataaggtgtagygaatagtygttygttttygttttaatttatagttttatattttayggtgttattgattttttygtatttagttatataggaygtggataggtatayggggtgatagtttygtattgaayggtattaatttttattygtatyggagttatatagatggtttgyga

SEQ ID NO: 4342 - DNA, 228 bp, Artificial Sequence
  Description of Artificial Sequence: Synthetic polynucleotide
aggataygttggatagtttygaaaagatatagtgggtggtttygggygtgggtaatygggtgyggaattatagygtattyggagttgygaatttagaygygggtgattgttgattttttgttttgtygtttttatttgtgtatgtaggtggyggttagttggggttagggaagygtggagggtgggttttaatygagttaagaaaagtttggggtgttttgaattttg

SEQ ID NO: 4343 - DNA, 248 bp, Artificial Sequence
  Description of Artificial Sequence: Synthetic polynucleotide
tygggattgagtttttgtagttttgaggtttggaggttygggyggtagtaattgtgtyggattaggttygtgggtgyggtttgtggtgtagttggagatygaggtttygygtattttygttygygttttagttatttaggttyggtygtagygaaaaggtttaagagggaagttagaggtgaaygttttaggatgaaggttttttgtaaaaygttgggatttagatttggggtgggtgtttggggttt

SEQ ID NO: 4344 - DNA, 387 bp, Artificial Sequence
  Description of Artificial Sequence: Synthetic polynucleotide
aagtygaggtgttggaggaygtgttgygggagtagttygggtygttgttttagttggtygttgtttgtyggtttaagyggttgttttygggyggttattygtttattgaaaatttttagttggtgttggagyggyggygtgtggttaaygttaaggagygtgagygggtgagggatttttagggtygaygttygttttttttttttttgttttattattaaatatttggttaatattygggggttygtttatygtttattttygttygaggygatttygagttttygaggttttttaygtttttagtttgttaggagaatggtagtggttttttttttttgtattttygtgtagttgttygttggyggtygttgyggtggtygtttc

SEQ ID NO: 4345 - DNA, 203 bp, Artificial Sequence
  Description of Artificial Sequence: Synthetic polynucleotide
ygatttaggttttttagttttygtttagtttttygygtgygggygtygggatygtagtatttgtgaygtygaagtttagtaggtygtagaygggagttaygygyggttttggtatagggtaaaaatttaygtttaggtaggygggtagttaygatgtygggtaagtttagggtagattttyggtggygtatagggaagtagyg

SEQ ID NO: 4346 - DNA, 203 bp, Artificial Sequence
  Description of Artificial Sequence: Synthetic polynucleotide
tgygaataagattaaggygaggtgaggtttaggttttygggattgatagygtygyggtagggggttygaggygggagttggggattttagygttttttaygygygttttaygggggttgtygttaataaaggyggagggtaagggtgygtttatttaagtaagggggayggtgggtygttygggttgagtagyggagygtagc

SEQ ID NO: 4347 - DNA, 312 bp, Artificial Sequence
  Description of Artificial Sequence: Synthetic polynucleotide
ggtttaggaggagtygygtygggttyggttataagaggtyggttagtaggygtttygttagtattygttygatttyggttyggagtatygggygtttagygygggtgaaggyggagtygtagggttggtttttaaagggatgttttygttygagyggygagattagtttygttygtttttygtygyggtygygtygtagtygtttayggtygtygatatggttttttattgyggygataatttyggagtgtattygtagttyggtttgttttygttygtygttatygtygtygtttygggygttttttyggt

SEQ ID NO: 4348 - DNA, 407 bp, Artificial Sequence
  Description of Artificial Sequence: Synthetic polynucleotide
tttyggttygygggaggtagttgtattaagaaggtgaggaygttgagygggggttygtgtttttygtygtygtagtttttattgtyggygygygtttttygygttygttatagtagygygttaggyggaygtygygggaatttgaygttygaggttygyggtttttaatgagagttttagaatatttttygtttttgayggttagyggtagygtygtygtttttygtagagygttygttttttygtttttagagttttagttttttttygagygatttygtagtttttttttygtttttattygtygtyggttttgtagttyggttttttttttagtttaggygygygggttgtagtgggygatygttttttttygatttttygtygtgtttttgggtttttygaag

SEQ ID NO: 4349 - DNA, 295 bp, Artificial Sequence
  Description of Artificial Sequence: Synthetic polynucleotide
attttgggtygygggagaagtgygtgtagttygggtaaggtygggyggggtygggygygggygggyggtygagggatgygatagggtygggtayggtttygtattttttygtattyggygtygtygtttygtygttttttttygtttgtagggtygtttygggtattttagggttgttgaggggygggygggtygtaaaagttaygagagaggggyggtagggyggygyggtttgygagygtygygggatttygaggagyggygyggggagtataggggygygyggggygggygc

SEQ ID NO: 4350 - DNA, 435 bp, Artificial Sequence
  Description of Artificial Sequence: Synthetic polynucleotide
ataattttggttttatatattttatatgtttygtataaagaaatagaaagygggygataygttttgggagggygggttggyggtttttttagttyggagygygtggaggttgygygtaggggttygggaygygggatagggatttygygtagtttaggygtyggggaatyggggttggagtyggggatttgagtttagyggaygtttttttygtttggaggttyggtayggatygggatattagggygttygtggtygtggttyggtttttggttgttgygggtygyggtttttagtgggtttttaggatttttttttayggygggtatttatygaggttgagaggttaygtygtgttgttggggtttttygtygattatatttttgggygttagttygggtagagatygyggggattggttaggtygggttagg

SEQ ID NO: 4351 - DNA, 410 bp, Artificial Sequence
  Description of Artificial Sequence: Synthetic polynucleotide
tggttgtgttagtygatatgagtttttttttttttaggaaggygtaggattyggggaagttttygyggttaggtygtttgtttattygtagatttygggygtygttygygttttttgttttttattttttaatttttgygtggttttagggtttatatttttggagtttttttttttagtaaatagtgttgttttttatttaatagtagaggygtttaggagtttaggygatgtgtttaaggtygaatagagggatagtagtgagttgtttaatttttttagttgygtagttaggatayggttgggggygggtggagatgtggygtagggttagggttygggtttygggaagtaatgatygagggyggtgattattgtttttagtttttyggygggtttttttttaaggg

SEQ ID NO: 4352 - DNA, 392 bp, Artificial Sequence
  Description of Artificial Sequence: Synthetic polynucleotide
tggaagtattygttttatygyggggtttggtatttaggttttgggatttttgttattgttaaggattttttyggggattygagttttygggttgaggatygygggggattttaggtygggayggagttttttttggttygttgtgygygtaygtttggaaaggygggatttaaggtagygatgttgygggaggttttgtagtgttaaygagttttygaayggtttygttttattttttttttgtgtgtttygtaagtttttgtttagtaaatygttatagtttyggygygygagagtggygttggtaygtttaaatttyggggtttttggttaggttaggggggygggygtgyggyggggtygggtygggtygggtgygtttagygggtttc

SEQ ID NO: 4353 - DNA, 203 bp, Artificial Sequence
  Description of Artificial Sequence: Synthetic polynucleotide
ttygattttagttygtygtygttttttaggyggattttttagaggtaggttttagttttyggygyggggaggyggygygttttagaggggygtagggtgygygggggtygttggtttttygggtattttttttttgyggttttttygttttttttyggagttggtgtttgaggtygttgggattttagtttggygtttttttt

SEQ ID NO: 4354 - DNA, 398 bp, Artificial Sequence
  Description of Artificial Sequence: Synthetic polynucleotide
gggttyggggataaagggtgaygtgtggttttggggaaggttygggatgagggagttgaatttagttgtttygygyggtgtttagagtgttttatygygygtaataaattttygtagatatygtatttttaatgyggtgtttttttgtgttagtgtttyggyggtttttgtagggtgttaatgttayggttgtatatygttttttttttttattatttttatttgaatagatttggaggaggyggaaatggaaattagggtatgtttataagttggattygttagatttttttgttyggyggtatgtttgtgtatgtttgtatgtyggtaaggagttayggatagggaaggtttaagagttggttatttgagygtagtagatgggttttygtagtttt

SEQ ID NO: 4355 - DNA, 286 bp, Artificial Sequence
  Description of Artificial Sequence: Synthetic polynucleotide
gtyggtttttttatatttaygtgtttttygtgtgygygttttyggtttgtagatgttataaggttggygtygtttggattttygggyggttttatttttygyggtygttaygtttygttttttgtatttagtttttttggygttttygttgtagtatttaagattaggygtygtttttgttagtygtgttgtttagtaygtttgagggtygttgtyggtaggttttatttttygttygggttttttatttatttttttttttggayggtggggtttaagttttgta

SEQ ID NO: 4356 - DNA, 267 bp, Artificial Sequence
  Description of Artificial Sequence: Synthetic polynucleotide
ttttattttttttttttttttttagtttggttgaagaaygtttttaaggaaattygggttgtttttttttatttggaagtggttttttttatatyggttygtaaattgattatgaaatataygatgttaattyggagttgtattttttagttgggtattttygygygttggttttyggggtttygttttttattttttgtttttttttttygygttttgtttttattttttatttttygygttggttatttygtttttttggtagtt

SEQ ID NO: 4357 - DNA, 260 bp, Artificial Sequence
  Description of Artificial Sequence: Synthetic polynucleotide
gaaattaygataggtttgtattatygtttttttttttaygttttygtttaggtttgtaaagtyggttgtttttggttaataggygttttttttgttttayggtgaaaattagtttgtggtgtattgagatttgtaaattattttttgaatgttaggggygttgtaaaatagtygtygggtgtagtgggtygggygttyggttattttggttgygattatygtagttttttaaaggatgygggtagatgtagayggttttg

SEQ ID NO: 4358 - DNA, 239 bp, Artificial Sequence
  Description of Artificial Sequence: Synthetic polynucleotide
gtgagyggggtaygagagtgtagggtttygttggtgtttttttttyggygttygtyggatttatygtttttatygttgyggtgttygaattygyggattyggatyggyggtagtagaagyggtagyggtaaagtattygtagaatggggtatygygaaatagttttttttttttttttttttgttggtggtgtagtygygatagttygttttttaggtaggggtttggagtttgttttt

SEQ ID NO: 4359 - DNA, 846 bp, Artificial Sequence
  Description of Artificial Sequence: Synthetic polynucleotide
ggtggtttttggggtagatagagtaggatttgtttttgttttttgtttttttygtttttttttttttagyggyggygatygtagtaatagyggtagtggyggttgttgttattgttttgtygttgtygagtyggttatttgggtattygyggagtygygtygttgttatygtttyggyggtttttyggagtgygyggagggggyggyggaggagygagatatttatagtaatygaggatgygaggggygtttagtagtagygagtgtttgggagttaggaggaggttttygygygtyggtaatttttagtgttaggygttttgtagttttygygygtygygtttgggttygtatygttttygtagtgagggttygttygagyggtaagtttttttyggyggttaagtygatatttttttttygtttygtygtttatttygggtagtagtygyggaataatggagagygtagttagtagttttggagayggygttygggggaggaygygtygtygtygtygtygttgtygttagggtaggygygygtygygtggagtygggygggtgygagggygygyggyggggggtggggggtaygygtygygyggggggygggggtagtggggggygygygygygggttyggggagttygyggggagagttyggygttyggygtagygyggygyggttaagtttygygtttttttygttttttttyggygygttygttttygtttygtygttygtattygttgggggygtttagaaagatgtatagaggtaayggttaggggagyggaggtttaagttatatgtttgygttttygggggttagagttygttagt

SEQ ID NO: 4360 - DNA, 526 bp, Artificial Sequence
  Description of Artificial Sequence: Synthetic polynucleotide
agttgtgaagaggygtgggggtygygggaatttttttttggtyggtgygatgaaagtygggyggaygaggtggtttaayggggttgagagtggttyggtygaggygygggttgagtttttagtatttggtttgagyggygtgggtagtagtttgtatygyggatatttttaattttgtygygtttgygtygtattttggtygtggtagygatttttygggtatttttgaggtygtttttagttttataagtatttagtygtttattttagagtagyggygtygatygttttaagaggagttagttttygatatygttttttatttatttttttatatttttatygttggagggggtgagtgtygtggataggygttttygttyggggatagtttagyggyggtagttagttygattttttttygygygggtygtttaaatttgattagtagagygagyggtttagygtagtagtygttttygyggtttttagttgtagaaaagtaaagygtygggaggaagtagta

SEQ ID NO: 4361 - DNA, 201 bp, Artificial Sequence
  Description of Artificial Sequence: Synthetic polynucleotide
gtttttygtagataagtaaataatttggaygtgaaatggaaatggtaattaatgtagtaatgttgttatatttygagtgtgtaaattttattgattygtygygttayggggggtgtygggygtayggggatyggtggygtgygtttaggttgtttattttttttttttttttttttttttttttaggttttygggyggggc

SEQ ID NO: 4362 - DNA, 523 bp, Artificial Sequence
  Description of Artificial Sequence: Synthetic polynucleotide
ttttaygagaagaataagaagggttggtaaaatagtattygttataattttagttttaaygagtgttttattaaggtgtygygygagggyggyggygagygtaagggtaattattggaygttggattyggtttgygaagatatgttygagaagggtaattatyggygtygtygtygtatgaagaggttttttyggtygtygttygygtatttttagttyggtaaggggtttttyggggtyggaggygtygtaggygggtgyggygtggygggygtyggggtygayggttayggttatttggygttttttaagtatttgtagtttggtttttttaataattygtggtygttatygtagttttttttatttatgttttatgttttttgttagatggyggtagtygtagyggttgtagtagttgyggttgtagtygygggtttyggtagttttggygyggtygttgtggttaaggggttggygggttyggtygtttygtaygggtygtatataygygtgtagagta

SEQ ID NO: 4363 - DNA, 276 bp, Artificial Sequence
  Description of Artificial Sequence: Synthetic polynucleotide
tygtttaggtagtattttygtagtagtygttaaygagttgtagtygtygtttattgttygygtyggttttygtttttyggtgtttgtygtatygtgggtygtttygtygtgttygatgggtgygtttttagygttgtygtygyggygttyggtttygggttttygtygttgygtygttagttygtyggtagtagtygygtttattggygyggattyggagyggtttaggygtttatttygggayggttygtgaygttayggagggagggaggtggt

SEQ ID NO: 4364 - DNA, 357 bp, Artificial Sequence
  Description of Artificial Sequence: Synthetic polynucleotide
attttttttttaggtaggagtagatatttgtttgtttttayggygygttagygttttgttttagtygtttttgggttagagttygaaatttatttattgygtttttatttyggtatagatagtttttaaagttgttygtattttttagatttygttttttgtttagttttyggatttygtttaggggttgagttgaygttygygggtggatttttttggttygttgygtagggaattgatttygggaatttagggygtatagaggttaaagaagttgyggtaagggagggtgggtaaatttagtttgagtttaggtttttgtygtttttatttttaagtttgttttgtttttttttt

SEQ ID NO: 4365 - DNA, 278 bp, Artificial Sequence
  Description of Artificial Sequence: Synthetic polynucleotide
tgtygygttgtygtygtagttagtygygtygtygtygttgtygtagygygggyggtygygygtyggtagtaggggtttggygaggaagtygttgagtttygygygtttygygtttttggyggtygtagygttgtttattaattgatttttttattgatttatttaatttttaggagyggttgttyggaggtaygggtttttttttaaatttgtagygaygttttyggygtgggtataaaggtttygayggyggtyggygggggttgtttagygttygg

SEQ ID NO: 4366 - DNA, 336 bp, Artificial Sequence
  Description of Artificial Sequence: Synthetic polynucleotide
ggtgatgaagtttgggtagaaattttttgtyggtygttygttttaygtttttttyggggtygatattgttaattttttygggtattgaggatatttttgygttttggagyggtgggaggaygyggagygtygttttttggttttygatattttgttygttttttttagtgggtttgtggttgygttttttygaaggaagtaataaatttttttgattttgggggttagaggagaygttttagtttttyggaggggtgtgygggygggatygttttttygttttattggatttttggtyggggttgtttttgttttattgtgttttatatgyggagt

SEQ ID NO: 4367 - DNA, 311 bp, Artificial Sequence
  Description of Artificial Sequence: Synthetic polynucleotide
gggagggyggtaaggagtgyggaggtttaaaygggtatgagtayggggyggttyggtyggaggyggttttgggygtttttagttgttttyggttgttttygttgyggtatttagyggtttatyggggttgtattgttgtagyggttttttgtgttatttgtagtttaggaggttgagtatagtgagtattagtagtagtgtatagttygygtataatattagygtttttttayggaatatttttatttygagaggggaygygggttagyggygttttgggygtyggggttattgygggagtagggtaygyg

SEQ ID NO: 4368 - DNA, 201 bp, Artificial Sequence
  Description of Artificial Sequence: Synthetic polynucleotide
aaygtyggtatyggttgggaagtttyggtgtttygggttttttttggygagggyggagaagtyggyggtttttgtttagaattttgtgattgtagggatygagatattaagggygggggtgtagaggattataagttttttagygygttttatttgtatataaatgtgttttgttttttaattttgtttttgttatttgtg

SEQ ID NO: 4369 - DNA, 201 bp, Artificial Sequence
  Description of Artificial Sequence: Synthetic polynucleotide
tttttatttygygtttttyggaattttagaattygggtggtyggtttttggaaagtygtagtyggygygatgtattttgtagattttattttgttgggayggattttttaatttttagaatygygggtygtagggagttaaattgttgtttttttttttttttttygtgyggttggtggtttgttttttaaaggaaygttt

SEQ ID NO: 4370 - DNA, 481 bp, Artificial Sequence
  Description of Artificial Sequence: Synthetic polynucleotide
tyggggtygtatygttatggygatttgtttatttgattygtttygggtggattygtygygatttttgggygtttaggtttttgagggtttaaygggygayggttttttagttttagttgtgygttttygttygggygaggtggggttgatygyggtygtttgtataygttttttttggttygygttttyggtttgggagggyggattygtttattttaygatggtttyggttttggaagggattgttttygtgattygtttttttaatagtygttaataattttttttaaygttttttgygyggttygtttttgagaattttggttygggagagygaygyggggttttyggggttgygtaggttgyggygttttgtttaygttggttygagggygyggttygtttygggtyggtttatatatttaygttttttgtygggaggyggttgggaygyggyggggttgttttaagtgtagtygyg

SEQ ID NO: 4371 - DNA, 280 bp, Artificial Sequence
  Description of Artificial Sequence: Synthetic polynucleotide
gagttagtyggaggggyggyggyggtttygygygtttagagttttagtttatgaatgggattttattttgagygttttttttygggtttggggaggyggyggygyggyggyggggggygtttygtaagttygyggttttgagyggttattygygtagtaagttgggygagttggtagtygtttgtatttgttttttggtttyggtttttgatttygttttyggttttaagygttygggttgygttttyggttgtttygygaggtagttttaggaggttta

SEQ ID NO: 4372 - DNA, 252 bp, Artificial Sequence
  Description of Artificial Sequence: Synthetic polynucleotide
gygtggggagtttggtattttatttaattagagygttggattgagaattgtttaattaggygygtagtyggagaggagggggyggtattygggatttggygyggtttttgttttttgygttagygtgagttyggttagggtttttayggtygtgtttttattttttagggaggygtyggtgattyggttatagttttagttttygtygttttgtgatttgygggtattggatgattygtagttgagatttyg

SEQ ID NO: 4373 - DNA, 239 bp, Artificial Sequence
  Description of Artificial Sequence: Synthetic polynucleotide
ataggygatggatttttygggttttygggggygttttaygtgggtgttggtygggggttttttggtagtggttttggygttggggggtygaggttgtttyggygttagtttaygttttygttggygttttttyggygygtagttatttygggatttttaggtggtttttaggtttgggttyggtttgaggattttttyggggyggagyggggyggggttygagagtagtaygtaggtaa

SEQ ID NO: 4374 - DNA, 405 bp, Artificial Sequence
  Description of Artificial Sequence: Synthetic polynucleotide
agtttttaattaggtttaaggagtygtagagtyggggtttygggttygtaggatttagaagttaygygtttygygtttttygtttygtygttgtttgttyggtygatttatttggtgtygygtgygttggyggttygygyggtagttaagttaaaggtygaggtygaggtygagygyggygtttagtagtayggygggggttagtagggygggygtyggtygtagygygtttygttttagtagtagtygygygtygtttttgtaggtygtttygtygygggttattyggggygtttaggttgtygtttygtygtatttygtygtttgttgtatygttttygttagggyggygaygygggatttggagttygggygggttaggggygyggttygtttygtagattt

SEQ ID NO: 4375 - DNA, 237 bp, Artificial Sequence
  Description of Artificial Sequence: Synthetic polynucleotide
ttaagttgttgtygtttaaggttattaagtagaatttttttaaygaygagggttgttagagygatttggaggataaygtttygtagggtagtagygaygygttgttgttgygyggggyggyggtygtygtgttttygggttygggagygtayggtggtggyggyggyggyggygygtaggataagygttygggtttttttaygttgggttatyggggtttttatattatygtgygyg

SEQ ID NO: 4376 - DNA, 204 bp, Artificial Sequence
  Description of Artificial Sequence: Synthetic polynucleotide
agtygagtagtagttttagagtttttygtaagttttttttatattttttygttttygttttaaaggagtagtagtttttttttgtttttttattgtygtygtygtatyggyggagtttttttttygygygtttttttttygatggagttygggygtygtygaygtygtygttgtttygaattttgagyggggtygtttyggtyg

SEQ ID NO: 4377 - DNA, 224 bp, Artificial Sequence
  Description of Artificial Sequence: Synthetic polynucleotide
ggtyggggtgygygygtgtgtatgttgtgaatgygttgygygatgtgygtttttattttatatttagtyggttttttgtttgtgttgttygagtgtggaygtgtgtaygygttgtattygttyggtgtggtagygtttygtgagtttttggaggtagggaaaggttatttgtgtttagaggttttgttgagggygggaggggtttagttttagtggggagtttt

SEQ ID NO: 4378 - DNA, 278 bp, Artificial Sequence
  Description of Artificial Sequence: Synthetic polynucleotide
agygggtttgttttttatttttttagtttygygtygtyggtttatagyggttttttttggggatagtttttttygggtgtygttttygttttttttgtgygttttttttttttttttttttttattaaatattatttgggaattgtttaaattttttttttaaaaaaagagagaggyggggaggagtyggagttgtggagaagtagagggatttaggtaagtatttgtggatttaaaygggygtttttggaaattttggagaaygtyggatgggagac

SEQ ID NO: 4379 - DNA, 232 bp, Artificial Sequence
  Description of Artificial Sequence: Synthetic polynucleotide
gggaaataggtyggygtgtygaaagatatygagtaggtagaaataaggtaaatttatagaggygtaataggttyggtttttygtggttagggygagtygyggtttygygtggygtttyggtygttgttttyggattttgagyggttattgttggggttttygaaagaggtgtyggttttttgggagtyggaagagttgtttgggtgggtttygttttgttttttattttatc

SEQ ID NO: 4380 - DNA, 331 bp, Artificial Sequence
  Description of Artificial Sequence: Synthetic polynucleotide
tgttttgtttggattttatygtggtygagaaggaggaatggtatatygttttygtgaatattatttaygtygagttygygtyggatttyggggtyggggyggygggyggyggyggygyggagttgtatayggagaagayggagtgygggygttayggagagtattygtttaagtaggaygttygyggggaggtggttatggttagttyggtttaygatygtttggtttgygattttaatattaagttygtygtttygattygyggtaagaattggatagtttttatttttaagggtaattgtaygtatagggataagattyggaaygygtt

SEQ ID NO: 4381 - DNA, 231 bp, Artificial Sequence
  Description of Artificial Sequence: Synthetic polynucleotide
gttgygttttgggygtatttgygygtttggtttygygtttygyggagagggygatgggtttyggttaggattgagtttttttttttttttttttagtttygtttggtatttttttttttgtttygagggygagttayggtttgygtygtygttttttttttyggtgttttyggttygtygttttttygygtttttttttttyggattygttttyggggttattatggtygc

SEQ ID NO: 4382 - DNA, 201 bp, Artificial Sequence
  Description of Artificial Sequence: Synthetic polynucleotide
tgttyggttttgggtttagttygtyggygttgttgggggyggtaagtttygtattagtttttattygttttatttttttyggttgaatgagtgttagttygygtattggggttatttagaggagaygggtaaagtygyggttttaygggttgtattattggtygyggagtttaggggagttgtaggagaaattattgygag

SEQ ID NO: 4383 - DNA, 201 bp, Artificial Sequence
  Description of Artificial Sequence: Synthetic polynucleotide
agttygatgattaggagttttyggttttygaagttgygttttatygtgtaaattttgttgatggyggtgtattgtagttatayggataygagygtttygygtagttyggggtagyggtggtattygaaggagatgtygtttttttgttgtagtygtyggygtygttttatgttygtygygggygtttygggtttttgggtt

SEQ ID NO: 4384 - DNA, 219 bp, Artificial Sequence
  Description of Artificial Sequence: Synthetic polynucleotide
tygttgtagttatgaggagaatttttatttttatggttggtttatyggttatttygagatgtygtttttygattatagtatggttttgttttatagtttygagtatgttagyggygtygtyggtttggattatttttattaygggggggtgtygtygggygtygggttttygggtttgggggggtygygttyggtgaagygtygaggtatygttaatyg

SEQ ID NO: 4385 - DNA, 284 bp, Artificial Sequence
  Description of Artificial Sequence: Synthetic polynucleotide
gtygggggaggtggggtygtyggggaggaggygagggaaayggggagttttagggagayggttttygagggagagtgagaggggagggtagttygggttyggtaygttttttttttyggtygtttttttttatataagygtaggtagagggygygttagttatgttttgtttttgygttygtygtygtygtygtygtygtttagttyggygygttttggaggattttgygtygyggygttttygggtttygtygtygttagtygtttygtygtttttttttygt

SEQ ID NO: 4386 - DNA, 429 bp, Artificial Sequence
  Description of Artificial Sequence: Synthetic polynucleotide
aaagtattttttttttaatttatgaayggatttygatttttgttttgttattatttatgygtttygtattygaggtgtygtttttatttataygttttayggtttygygaaattyggttttttagttygygggaygygttgtttgttaggygggttyggyggtatttygggggygggaggggtyggtygtagggtttttagtttggygttygyggggygttygtagygaaggggtgggtgtygttygtgaaygtagtagggattagtttagttygygttygtttttgggtttyggttatygttttttygttattttttyggtttttgygtggatyggttygtggygggggttgttttgygttttygttttygtagtagtygyggatttttattaaygttgaygagttagtgtygygattyggggagaga

SEQ ID NO: 4387 - DNA, 283 bp, Artificial Sequence
  Description of Artificial Sequence: Synthetic polynucleotide
aaaagatygyggtggagaagatggggygtttttygygatattyggttgtttagaggtgtaaagtyggtgggygtaygttyggggyggttttatagttttygggtygttagttttagggtgtygggttttaattaaggtttygaagtttttaygtatttgagggtattttgattagtttttgygggttgttttgyggtygtagtgggttttgaaagtttatttyggygtagggtggaaatyggygggaggygttgttgattttygattaaataatagtgaygag

SEQ ID NO: 4388 - DNA, 241 bp, Artificial Sequence
  Description of Artificial Sequence: Synthetic polynucleotide
ygygggtggyggyggttgtggggtygtttgggatttttygtagtattgattttgtaattttttgtgtttgygtttygtggtgaggggyggygggatgygygygatttttttttgatttagttaaayggaaaagttygygygtttyggttggaaggtggaggttaggtaggattyggtaaaggtatattttaaaygaagtagattttattttttatttgtagagggaaggyggtgtggaygg

SEQ ID NO: 4389 - DNA, 244 bp, Artificial Sequence
  Description of Artificial Sequence: Synthetic polynucleotide
gtagtagttttaygttgttggygtaggyggygygtaggagggtygtygttttygggaygtttttygggaygtttttygggaygtttttygygttttygaygtygtgttttttttygttttygaaagggtagaaagagtygttygaggygatgttgygggtgtttggtagattygagaagtttttaaatttttygtagttagyggggtttttttygatttgygygtttyggggtggggayggygg

SEQ ID NO: 4390 - DNA, 225 bp, Artificial Sequence
  Description of Artificial Sequence: Synthetic polynucleotide
gtagggggygttgygttygtygagttyggaggggtygtygggtygggygttgygtattygygtygggagtygtttttygttygyggygttygtttttgtygttygttagtattttttgtttygyggtygygtttagataataaaagyggaagatgttgtagttgggtaaggttaggattttgttttgaagtygggyggygtygygtaygttttttttyggattga

SEQ ID NO: 4391 - DNA, 249 bp, Artificial Sequence
  Description of Artificial Sequence: Synthetic polynucleotide
ygtygttttygyggyggtattgggtatgtttygtattyggggtyggtttyggyggyggggyggaygtttttttattagtygggygttygggtyggtygtygaggtttaggtggaggttgaggttgtygygygtygygggaggagtttygttttyggyggttgaggyggyggyggtataggtggygygggtygygygyggggygtagttygggagygttyggygtygggygtygyggyggttttaggttc

SEQ ID NO: 4392 - DNA, 255 bp, Artificial Sequence
  Description of Artificial Sequence: Synthetic polynucleotide
ttygatygggagtttagagttttgttagygtygtattgtgygtygygtaagtygttygatttttttagyggtatyggttttaagtagtaaatatttgtgygtttttgagttagggaygygygtggggggtgggygtgtaygygggtgggttagygtagagtgggagtttgtgggtgtttttygtygggatttttaatttagttgttttygagagtttaagttgagygtygtaygtgttygtgttatttgttgtat

SEQ ID NO: 4393 - DNA, 243 bp, Artificial Sequence
  Description of Artificial Sequence: Synthetic polynucleotide
aygtttgtttgagtygtgttgtyggggattagygattttttatttttttttttttataggagygtttyggttttygttttygttttaatygtyggygygygtttttatygygtaygygtttttttygygygygtataygttygygtatataygttttttygttttygttygyggagtttttttttattttttagtygtttygtyggttgaagtatyggygttgggaggyggyggygttgttga

SEQ ID NO: 4394 - DNA, 201 bp, Artificial Sequence
  Description of Artificial Sequence: Synthetic polynucleotide
yggtttgttttgggttygtgaggygaggtygtagygtttygaygtygggtgggygtgtgggtggagtggagatttgggtttttyggygtatgggagtttygtygtttgyggtagggaatygttttttatttttggttyggttygggtygggagtygtgtttygygttgattyggtgtaattttttagtttattttttttta

SEQ ID NO: 4395 - DNA, 208 bp, Artificial Sequence
  Description of Artificial Sequence: Synthetic polynucleotide
gagaattgaaaaggaaggygaggagtaggggttgygggtygggtttttgttgttygyggttttygggggtygygtygygtygggttaygtgggggttttygtttttygagygggygtyggtgggaaatttgygyggygagagatagggggatggggygtttttgaygygattgtggggtgygggtagttttggaggaggatgttyggt

SEQ ID NO: 4396 - DNA, 257 bp, Artificial Sequence
  Description of Artificial Sequence: Synthetic polynucleotide
tagygttttygttttggttatggagyggtyggygttyggygaggtggttatgagttaagttatttagtyggygtaygttattgygygyggygagttgagygyggggtagttgtttaagtggatygatattatygtttgtttggygggtaggygggygtyggggttgyggggaggygygggatyggggttgygggagyggyggyggttgggggttggggggggtaggaaggygaggaaggtatttgyggagagttgaa

SEQ ID NO: 4397 - DNA, 350 bp, Artificial Sequence
  Description of Artificial Sequence: Synthetic polynucleotide
aaagtgtttgtaaagtttgagtagagtgygyggggtygagyggggagaagggtgyggggtatyggggtgagatataggaaagaggaggayggtggggagyggtagaagatagygtttttaggattagygattttgtggtttattyggttattgggtttyggygtaaattttttttaggtagtgygggygatgttgattgtagaygtygggtagggttttygtgygggygggagygggggaagttagtgygttygggygttagttagttgatgygggaagaggttggggagttgtagggtygttygttttygggtgyggtgttttggygtagggtttgggttgagtygttc

SEQ ID NO: 4398 - DNA, 216 bp, Artificial Sequence
  Description of Artificial Sequence: Synthetic polynucleotide
ttattttgttygttagtatattttagagtttttaatttttttttgtatgtaagtttaggtagagttttgttaggttttatattagagtatatttttgtayggattttttaggatygyggygtyggttggttgtttyggtttttygyggtygygtgagtttttttttggtggtggagggygtattttaatttggaaatttttagtttttaatttggt

SEQ ID NO: 4399 - DNA, 269 bp, Artificial Sequence
  Description of Artificial Sequence: Synthetic polynucleotide
tygygaagggtataatttgagaagttygtggtagtttttygtagygtygggtgatatagggtttttttatttttaggagaagtgggtaggagagagggtygttygttgtttttygttgygtttagggatggagggttttattatttatggaattgttggtttttttgygtggttygggattttagtygtggtttygygttaagagggtattttttttaaaygaaatygtttygttygttygttygttygttygttygggtagtaatgtc

SEQ ID NO: 4400 - DNA, 258 bp, Artificial Sequence
  Description of Artificial Sequence: Synthetic polynucleotide
agtaaaatttttattattttttyggtgtttattagttygtttttttaggtttttgggattattttatttaaaagtagttttttttagyggggtttagatygtttttgagatttygttgagaaatttttagygggttagygtttgggygttgggygtygagttygatatggttttttggatgtygttgatttgttygtyggttgtttagtttttgttttatttyggggygtagaaaggggaygggtaggggttygattt

SEQ ID NO: 4401 - DNA, 224 bp, Artificial Sequence
  Description of Artificial Sequence: Synthetic polynucleotide
agtttttagggatatttgaggtattatttttgttattgtygggtattygyggygttgttaayggtttggttatatgtttttyggagagttaygggagggygttgggtaatttttattygagtygyggtygygaggaggagggaaaaggygagtaaaaaggaagagtgggaggaggaggggaagyggygaaggaggaagaggaggaggaggaagaggggagtata

SEQ ID NO: 4402 - DNA, 256 bp, Artificial Sequence
  Description of Artificial Sequence: Synthetic polynucleotide
ggtygtgtagttygtttygttttttttttygaagagagatttggtgttggtatgggtatttygyggttatyggagtggtttttyggatgagtttggtttyggygttgaygttttggttttgggggttgtttggttggtgttaggtagyggaagaygtttggagagttattygtttttttttttattygtttttatygttgttygtgttaggaygygtagtttgtagttgtagtttaggtattggygygggatggyg

SEQ ID NO: 4403 - DNA, 310 bp, Artificial Sequence
  Description of Artificial Sequence: Synthetic polynucleotide
tttygtygtttyggaggttggyggtgagggtattygggyggtaggggttygtygaggggtygtggtataygggtaagggggttaattyggaatggttttygagtagttttaygttttgttaaggayggtaggtgtaagggtygggggattttttgayggggtygttttttygggtayggggaggtttttatygagttttaattttgaayggggtagggggtagagtttttggtaggtaaggttttyggaggagggaayggttggggagtggyggagtttyggagtggtggttttgttaaygttttttttc

SEQ ID NO: 4404 - DNA, 410 bp, Artificial Sequence
  Description of Artificial Sequence: Synthetic polynucleotide
aaggatttatttagaygtaygttygygyggagaygtaygttggtataygygtttatataygygagtatatataygygtatattattyggttygtgygygygggtygttgtttttgttgtattatgtaaaggtggttgggaaagygygttgatttatatttatatagtttattttttttttatagtatgtgattaataygtatttyggggaggagggagygyggttgggggtgttaatyggaagggaatagatagtgagtgttattttgttgggaggttttagaagtaaagygttaaygaygatagtagyggtggttttagttttattagtaattgtygttggtaggagtattataygttttaggagtttttygggtattaagtatgggtttagttygttttagttatttt

SEQ ID NO: 4405 - DNA, 274 bp, Artificial Sequence
  Description of Artificial Sequence: Synthetic polynucleotide
agatygagggaaygttgtttatgyggtgagagttagygygggaggyggygagggygyggggagatyggggagggggtgggtttygyggygttygtygttygtttttaygygygttgtyggtatttgttygttttgttgtaatttgttgtagtgtttgaaagagtagtaggagygtatggaggtggggtyggggaaagattaggyggagtggttgtggggtgagygyggagtgggtggggaggyggyggyggtggggaggggggattggttttag

SEQ ID NO: 4406 - DNA, 201 bp, Artificial Sequence
  Description of Artificial Sequence: Synthetic polynucleotide
gtygtygtygtygttgygtygttttttatttagagttyggyggygtygttttttttttttttygygtggtggyggggtatggtattattaygggtatygygagggggtygttagygtttgyggygggggtagyggttttatgtgygtyggygggttttaaggaggaagtyggyggtygayggggygttygttagttagaga

SEQ ID NO: 4407 - DNA, 265 bp, Artificial Sequence
  Description of Artificial Sequence: Synthetic polynucleotide
ggtygggaggygyggagttagtygtttayggagtttaattgtttgtatyggggatyggygggyggggygygttygagtggtttygtygggaaagggyggygggygttggagaaggygtttggygygaagttgggyggygtttygagggyggaggataggtggtygygygatygtagttaggtagygaayggttygggggttgygtagygyggttttaaagtttagttyggtttygggtttagttygttgtygtttgttaygggag

SEQ ID NO: 4408 - DNA, 201 bp, Artificial Sequence
  Description of Artificial Sequence: Synthetic polynucleotide
gygtagggggtagttgygtataaygygtttttggtagygyggyggttgygggyggggygygttttaygtgtttgaaggyggaygtttttttyggggggayggagagtagagggaagtygygtagggttttagagtagggtaggttaggyggyggyggyggyggygggtttttagygagtaggtatttgggatggtggtggt

SEQ ID NO: 4409 - DNA, 362 bp, Artificial Sequence
  Description of Artificial Sequence: Synthetic polynucleotide
ttttaaatygagttttygggtgtgtagattygtagyggagtygygggagygaggtgggaaattttggtygyggygtygggtttygttygtyggggggygyggggyggygggygtatgygygtgygyggtgyggttttagttttggttgtygtygtttgtygtygtygtygygatgtttattttagttaaagyggttgygggtttggggattyggttygggtagyggagttttyggattygtygattygtygaggagygygygtygggttttygtygagtagttgagttygtgtgtttygygtttygygtttygaagttgtygtttygaattttggtyggygttgtttaggtttttygttagg

SEQ ID NO: 4410 - DNA, 298 bp, Artificial Sequence
  Description of Artificial Sequence: Synthetic polynucleotide
tagyggagayggttaagtgtttttttattaatttttttttttyggagtttaggggtgttgtatgggyggygtttggattygygttttggagttattaggyggagtaaagttagygygtttygyggttyggaatttagttggttygttatttttttatttttgygattttattttygatygygttttagggtagaagygtttgagttttygttagtgggtatttaaagtttatgttyggygggygtgttgaygttattygggggttgyggagygggagggggyggtggggggyggggat

SEQ ID NO: 4411 - DNA, 295 bp, Artificial Sequence
  Description of Artificial Sequence: Synthetic polynucleotide
gaaggataygtaaatttgtygagggttygggggtttygggttgttgttgttgttagygttttgggaagtgataggtattaggatttgttggtgyggyggyggyggyggyggtagttttagtygygttygttatatatatttttattygttyggtgtataygtygygtygygggtagtgtygtttgyggaggygygttyggggttygtaggggtagtagyggtagtttggtagygtygtygygttttygggtatttggttygygaagtttygtttttgtygtttttygygtygttc

SEQ ID NO: 4412 - DNA, 203 bp, Artificial Sequence
  Description of Artificial Sequence: Synthetic polynucleotide
ggatgyggtygygtaggygttygttttttggttttttggtygggtagygggygttyggttatyggagtttagtttaagggtttagtygaggttttttygygygaggyggttgygttaggtgagygggtatygyggtygygttttttttgttatttatttagyggttagaggtattttgygtttgggagttttaagtgttttyg

SEQ ID NO: 4413 - DNA, 215 bp, Artificial Sequence
  Description of Artificial Sequence: Synthetic polynucleotide
agttttaaattttaygttataaagtttygaagaggygggttgggggygggggtyggggyggatttttaggggygtggttgygygtttgygatttyggatygtgttaatttygtygtygttttaaaatttgtgggaaattttagttttgttatttattttttttggaggaygtagataggatttgttttgtaggagtttaggtyggtygattygyg

SEQ ID NO: 4414 - DNA, 201 bp, Artificial Sequence
  Description of Artificial Sequence: Synthetic polynucleotide
gggyggyggygygygggggatttatttygtttttatttgatttygggtgattgtttattgttatggtttgygatttygygtggggatygtttagggtttyggggttttggatgtttygggtggygtygtygtaattttygtgtttttygygtygtttttatttygtttttattygggtygattygagyggttgtagttttt

SEQ ID NO: 4415 - DNA, 340 bp, Artificial Sequence
  Description of Artificial Sequence: Synthetic polynucleotide
tttttygagtattygtttygggttttttttaagtagttgtttyggtttyggatttttatttgatttttttaatygatttggtagggtaygtatatttgaygtttattttgtagtygagtatataaggttygtygaagttatygagtaggttttgtagttgtaggtagttttygtygtygygttttattaygtygtggaaggtaggtaygtagtygygtagygygttagttattagtygygttaggtagtagygtttyggtttygagtagygttttaggattagttygttggtgttygtygttttaaaattttttgaggatyggtattygttagygtygtt

SEQ ID NO: 4416 - DNA, 201 bp, Artificial Sequence
  Description of Artificial Sequence: Synthetic polynucleotide
ggyggagggatagagttggattyggaagtygygggtgggagttgtttttygygagttygaggttgttggtattttgtygygggtagttygygttagtttygggagtttttgggtttygggagagygagtyggggtygtttggttataaagatgttygygygttygttttgygtaygggattygttttgygttttgagtttt

SEQ ID NO: 4417 - DNA, 236 bp, Artificial Sequence
  Description of Artificial Sequence: Synthetic polynucleotide
aaygttyggttaggttttagagttttygyggagagyggggygtttgttgggggyggtygggagggtygggttaggggygygggagatttygyggggaygygaggtgttgygggttttgtgyggttggttgggaaygaggagaatgtgttattaatagtgtttaatygattgattattttgggtgttgtgtttttttttttatttttttttatttttgggaaaatgtattgtttagg

SEQ ID NO: 4418 - DNA, 251 bp, Artificial Sequence
  Description of Artificial Sequence: Synthetic polynucleotide
gtgtttgaatttttygggatatttagayggttggagtttttygattttaaggygggygayggtaaagttaaaygttagygygttgyggttttygggtatygaggygttttygttttygttatttatatagggygttaagtgtttygattygygagtgaygaggaygtataggttagtgataygattygtagttagtattgagygggaygayggggttygagygtaggagggtgygyggggagttgaggagc

SEQ ID NO: 4419 - DNA, 201 bp, Artificial Sequence
  Description of Artificial Sequence: Synthetic polynucleotide
tgagtagtttaggtagtygyggtggtygtgaayggggygggagtggggggtgtttaggttattagaggyggtttygyggtttgtatyggttggagtgggygatttagagtttgagtggagggggyggggggyggygatagyggggggttttggtagygatggtttgaatttgygttggtgggggatggggygggggygggg

SEQ ID NO: 4420 - DNA, 206 bp, Artificial Sequence
  Description of Artificial Sequence: Synthetic polynucleotide
gygttggggaagggatttttyggaggtayggggtagygtgygggttgyggtagygatttygattygggttttygggttttgtygggttgagtttgygttygtttygtygtygttaagtttttttaattttgttygttgygttyggatygygygttaggtttgggggygtagtaggggttgggggygtaygttgygtattyggggac

SEQ ID NO: 4421 - DNA, 201 bp, Artificial Sequence
  Description of Artificial Sequence: Synthetic polynucleotide
gtttyggtttygggygtygattaggtttttttggttttygtygygygttttttaatttgttgttgtygtygtygygttttttaggttttgttagttattygygttttgagttyggggttagatttttatggaagygtygygatgttygtttttyggttgttggatttttagaagaygaaataygygaggtgagyggyggtc

SEQ ID NO: 4422 - DNA, 203 bp, Artificial Sequence
  Description of Artificial Sequence: Synthetic polynucleotide
tgggattttttttttaaaaaygtaggygttttttygggtygtagtygtagtygggagattgagggttagggygyggtygyggggttttttgggtyggggygyggtttaygttttaggtttttgyggttttgattagaagtygttgygtttttggtygttttttattygtttygttttygtaattttaggtttagggttatagc

SEQ ID NO: 4423 - DNA, 216 bp, Artificial Sequence
  Description of Artificial Sequence: Synthetic polynucleotide
taggggagaygaatygattggttgttyggtygtyggaayggtaggtttygtygtttttttygtttttygtattttyggttyggtttttttttattatygygtttygttttaattygtagttagtattttttttttatttttttttygttttygttgttatttttttttttggatgttggaagygtagttggtattttygtttttttaattttttaa

SEQ ID NO: 4424 - DNA, 335 bp, Artificial Sequence
  Description of Artificial Sequence: Synthetic polynucleotide
gtttattygttttttaggtgattyggygttttygtygygttygttggaagtttgtaaatttttttygggggtttygtygttaygttgggaagttggggaygyggggggaggtttttggttygtygttttygttgtygtttgatygtatttttggagggtttygtattttgttaggtttttggaggtaaatatatattttygatttataattggttttygygttaggggattygygygtttttatataygtaygtaygtygggyggattyggygtyggttttaygttagtatttttttaggygygyggygyggyggttatygagygtttyggtatt

SEQ ID NO: 4425 - DNA, 230 bp, Artificial Sequence
  Description of Artificial Sequence: Synthetic polynucleotide
tygggygttgatagaygattttttttatttgttagttttttygtttgttagtagagttgttggtaagtgagagaaaatagaggggygygaaggtaggygyggttagggagtgagyggggygttgggygyggggyggagtygggtgygyggygttygggttaggttttatygttygygtyggttttygttttgtttagtygtygtttttttttttttttttattttttttt

SEQ ID NO: 4426 - DNA, 224 bp, Artificial Sequence
  Description of Artificial Sequence: Synthetic polynucleotide
agygtagttatttgaaggtttttatggttttyggygtttgygtttgaagttygtttttaggttttggggggtatttgtagaaaatttttagtagyggttygttaattagattttagggtgtayggggggtggygtyggtaattatggtaatttttaaaataaaataatataaaataaagtaattaaygtttattaattattattttattttattttttgtattg

SEQ ID NO: 4427 - DNA, 211 bp, Artificial Sequence
  Description of Artificial Sequence: Synthetic polynucleotide
gggataygtagggggataygtagggattgttygygygaatggtttygaaygtatgygttttattttatattttatagtygttatgaygatygggaggttygttygttaayggttagttaayggttgyggggataagttygttgaggttgttaggygagttaggtttttttggatttygtttgattyggatgggttgtgtttgaaattgatt

SEQ ID NO: 4428 - DNA, 205 bp, Artificial Sequence
  Description of Artificial Sequence: Synthetic polynucleotide
ggyggtgttaggtyggggyggggggtttttttatttagtayggggtattaggtygggatgggatttttttttagaaagtygattggatgttaggagaggygtayggttgggggttttttttttttttttttttttttttttygyggttgaattaaattagaattgttatttagggtttgtgagttagaagggatyggattatayg

SEQ ID NO: 4429 - DNA, 398 bp, Artificial Sequence
  Description of Artificial Sequence: Synthetic polynucleotide
ggygygggtttyggygygtttagtagttyggttagygttagygygttygttagtaggttgagaayggttagygtttttagygtggtygtttgttttagtygtagygtgtagtygyggaatagygtttttagttttgggtaagygaatttttygtygtaygttyggagttygygtyggyggtttgtttyggtygttygttyggygttttygggttygttygygtygttttygtygtygttttygtygygyggygttttygttattttagygttatgtagyggtygyggtygygggygygtttttygtyggttyggggygtyggggygygggyggyggygtyggggygggygggyggygggyggygaggygtyggggygyggggygyggggygggyggag

SEQ ID NO: 4430 - DNA, 290 bp, Artificial Sequence
  Description of Artificial Sequence: Synthetic polynucleotide
tatygygtygyggtttygtaygggatgyggyggtyggygttgtgttygygggtygggtagttyggttyggtygyggygttgygggattygygygtaattygtgggggygyggygygggygataygtgygggtygttaggagggggagggggaygygygtygtygggttygttattttgtattyggggtygttggtyggtyggggtatttttaygttygtttygttggygagattggagggattygggatatygtaaagtattttttttagtgtttgggagygttygttgt

SEQ ID NO: 4431 - DNA, 307 bp, Artificial Sequence
  Description of Artificial Sequence: Synthetic polynucleotide
ttatygtagtyggtttyggtyggatttaaatagttttttttttattttygggatatttattttaygtatttattattttttagtttttagatgtttygtygttttttttatggattttttagtatttgtaggttataggataatagaagttatagtagagttatygaggaattttaggaayggaggagatggaatagtggagaygygaattaggattagagttyggaagttaggagataaaggtttygttatattgaagaggtygtttttttttttgtagttgygtatttgattggatagttttayg

SEQ ID NO: 4432 - DNA, 212 bp, Artificial Sequence
  Description of Artificial Sequence: Synthetic polynucleotide
gggggtggttgtgggttygaagtggaggaygagtatggtttgggagataaggaatygttttgagatagagaaggttttygggagyggatagagagtgggygaaatyggtgygtagtaatygyggygttagttttagygyggtttttggggygtagttttatttygttttagtagttgyggagttttttgaygagttttygtttggtagtatt

SEQ ID NO: 4433 - DNA, 375 bp, Artificial Sequence
  Description of Artificial Sequence: Synthetic polynucleotide
tagggygttttygtttggattataggagaaagtttgggaggtaggtttaattttttaatttggyggggaattttttttttttttatatagtttgtagygygggggyggyggggtgatagttttygtgtatgaattagttattttttaggtttygtttyggygggggtyggtyggaygttygtttygtataaagygggtattygggtygtttggagtagaaagtygygtattttttttygttaggygttttttyggaygttttgtttagygggtygttygattttttgtattatggatttygttygttttttggggttgtygattttgttgttttttttgayggaggttgtattgggygatgttgtttaggagtta

SEQ ID NO: 4434 - DNA, 201 bp, Artificial Sequence
  Description of Artificial Sequence: Synthetic polynucleotide
ggyggtatggagygtagtggttgggttyggtagattttttttttagygttgttgttgggggygaygttgagggygygygyggyggttggttattattttygtttttygttttttttttttttgtgtatttattayggggagttggaaggggatggggagtagggygaggtgtttatttttttgtatattgygggtaatttt

SEQ ID NO: 4435 - DNA, 356 bp, Artificial Sequence
  Description of Artificial Sequence: Synthetic polynucleotide
gggyggggyggygygygggggygggggagyggtygggataygtgtggyggyggygggggggaygyggygttyggggttttaagaaggtgtggagyggggygggygtttttttaggtttggtygaggggygtygygtagaggyggyggyggygtayggaggyggtagaygaygygttttyggygttygtagtttyggtttygygttttygyggtttaaagtaattttgggagtygtygtttttygyggaatttttyggygggggttygtttttaggttygttttygagttygtttygttttygttygtttttttttygtttttttttygygtggttttttygtttyggygtttttaa

SEQ ID NO: 4436 - DNA, 265 bp, Artificial Sequence
  Description of Artificial Sequence: Synthetic polynucleotide
atttttaggtattattygagtttgttaattttattttygtttaattttattttaaaattttttatagatgaggttttgtygttgtygygaggggtygggyggtygyggygggagggatagggggtttgggtgggaagggagygygagggtttttagyggttygyggtttygggyggatttttagaaygagtgygggtygttyggattggtagattgygagtttygaggggygygggaygtagtyggtttagataaagaaatyggc

SEQ ID NO: 4437 - DNA, 697 bp, Artificial Sequence
  Description of Artificial Sequence: Synthetic polynucleotide
gyggggaggyggygggggygggagygggygaggggtygyggtyggtyggygttygggtttygattttygggtyggttaggggygygtygagtagtaggtygtgygttaggyggaaatgttttagtaggttttygygtatygggtygttyggggggtagtaggggtaggyggyggygggtaggtygagygygtygggyggtggygtagyggggtaygagtattttttgtgygttaggtaggtttygaggttgtggaagtttaygyggtaggtygtgtattygtggtagtyggttagygtyggtgtyggggtttyggggagygggygtygyggttttttgtttaggtygatggggtygtyggtygyggggtygggygagygygtaggggygaggtyggggtygttttygttttygttttygggtygyggygattygggygygggggygtggtygggyggyggggggggyggggygtyggtygygtgtagttygtagagtttgyggygtttgygygtgygtataggygyggygggagagggggtygggggygyggtyggtttagggggtttygggggygyggtyggtyggygyggyggygggtygtggygygaggygtagtagtatygtttgtgtayggtgtaggtttygtggyggttgaagyggatgttgtaggtttygtatagygtgyggttggggtc

SEQ ID NO: 4438 - DNA, 226 bp, Artificial Sequence
  Description of Artificial Sequence: Synthetic polynucleotide
gtagaggygygtagaaaaygygygggtggygygygyggttatttagtgggtttygttygygtygtyggygtygtygtygtygtygtaygtgygtygtygtgagygygaagggygttyggattygygttttgttygttygtttgttygtyggggttattgtggatttttaggtaatagttaagtgagaagttttttttattatygaaaggtgtttgygtttttttta

SEQ ID NO: 4439 - DNA, 201 bp, Artificial Sequence
  Description of Artificial Sequence: Synthetic polynucleotide
tttagggaggatgggggtygygggggaagtygggygtttyggggttttygatatttatattttygtayggygtaygttttgtttygagtttgygtttttygagttagtayggygagtttgggattttygtgttttttttttgtggttttygagaaaygtyggagtttygtgttttgttgggggttggggggatggagaaaa

SEQ ID NO: 4440 - DNA, 201 bp, Artificial Sequence
  Description of Artificial Sequence: Synthetic polynucleotide
tttggagatgtgattttttaaaagtttagtyggygaatgggagattgaagggtgaygggaagggggtaggygygttyggygttttgattgggygtgyggyggtaggattttaaagygttttgtttyggatygtttgttttgggtgatttttyggatttgttttggtggaattyggatttgtttygtygagatgaygaggta

SEQ ID NO: 4441 - DNA, 215 bp, Artificial Sequence
  Description of Artificial Sequence: Synthetic polynucleotide
agaggaggaaggaaggaggaaagaggaagaygggyggtyggaggygyggggttgygyggygtyggtyggygyggygttggaaggygtyggygttaatttygygaggtaggygayggagggggagyggygttaatatataagagtattgtattaygttaatttttttttagaatagtatgygttagtagtatatttaygttttgattgaaggataa

SEQ ID NO: 4442 - DNA, 252 bp, Artificial Sequence
  Description of Artificial Sequence: Synthetic polynucleotide
tygtygttgttygggtttyggggttgggtggaggaaaggggtgttyggaatygatttttatttttygatttttttgttggatattaygtttattttggaygtygtaagagaagttgttaagtttygtaggttttgattyggygtttttygygtttttyggttgttttyggtttttttgtgtttyggtggagtatttgygttyggggttggggttggaggaggtagttataygygygtataygtataygttta

SEQ ID NO: 4443 - DNA, 203 bp, Artificial Sequence
  Description of Artificial Sequence: Synthetic polynucleotide
ggygggggagtgagyggagttttttataatgtttyggtgyggtgtagtygyggatggatgttgygggaaggggttgttatttgttgtttttgttagyggygygyggatttgttygygtttttgtagtygtygtygtygtygtygttagttygttyggtttttgtagyggygtygtttgygtttttttygyggtygtyggagyg

SEQ ID NO: 4444 - DNA, 201 bp, Artificial Sequence
  Description of Artificial Sequence: Synthetic polynucleotide
ggtyggttttatgyggggygtttygtygygtygygttygygtttttgtatyggggtgyggggtttagttygaygygtattyggygtttygygygttttgygggttttttaggtyggtttygggtgggttaggatygyggygttggtaggtyggggttgagttyggtttttygygttggagtttttgygtygggtgtygtyg

SEQ ID NO: 4445 - DNA, 201 bp, Artificial Sequence
  Description of Artificial Sequence: Synthetic polynucleotide
tgaattttagagggttgggttttgatttgagtgtygattygttaatgaggaygggaggataaggttgtygaygtagyggaaggtaggggggaagygattygaggatttgaygattatttttaggtaggggttttttaagtaggtayggaaattaattttattaaatygyggagtggggattgggttygggyggtgtttagt

SEQ ID NO: 4446 - DNA, 201 bp, Artificial Sequence
  Description of Artificial Sequence: Synthetic polynucleotide
ataattttyggaaggagggggttaaatgyggtagyggygggtttgaaaagggttaggagygtygtaggaattggggtgtataggttttygygtgtttagygtttygttttttttygttttaggtttgttaggggygygygtggygygggtagagtttggtgggtgggttggygyggatagaagttttgtyggggagygggg

SEQ ID NO: 4447 - DNA, 213 bp, Artificial Sequence
  Description of Artificial Sequence: Synthetic polynucleotide
tygatygygttttttgygttygttygygttttttttgtygtttygyggtttaggggtgtgagttattyggygatagtttygttaggttatttyggggygygtaggtggataygtataggaagatygttatttttaagatttttatattgtttatygtggggygaaattttataattttttgtataaaatgtataaataatattaaatgagttg

SEQ ID NO: 4448 - DNA, 385 bp, Artificial Sequence
  Description of Artificial Sequence: Synthetic polynucleotide
tttgtaygtatgagtaggtatttaatattttttggtttagttatatgtgatatgaggttatttaygttttttttaattaatttttatgataattatgtgygttatggagaaaattaatggaggaaaaattatagagttattygaaatagttgygttgtttattattyggtgtttgagtttgttttttttgtaattagattatatgtgaggtagttttagttaattgtttgtgttatttatyggggaattttagttttatttgtgaatatttaggttttttygtygtaggatagatgttgggtgaggtttgttttttaygtaaatatttgttttgttgtttygagttagttaygagagttagtyggtttagataagtaggggatga

SEQ ID NO: 4449 - DNA, 278 bp, Artificial Sequence
  Description of Artificial Sequence: Synthetic polynucleotide
agggtattaagaaaagaggggtatgygagtttggaagttggagagagttyggggttttttagagygggtgggaygtygygtttttaggatttygygttaygygtattttttttatttygatatttattgttatttttatagyggagygaggggtttygtygagggygagygtatttygtgyggttgagatgttyggaaygttttttygygtttyggtttttttagaaggggttatagtyggttygygagttttygggygggggttgagtygtagtgtt

SEQ ID NO: 4450 - DNA, 248 bp, Artificial Sequence
  Description of Artificial Sequence: Synthetic polynucleotide
tyggygtaggygagtttggtttaagggttyggatygggtttgggaaaagtttgtttttygagggggagagygagyggtygygttgaggygttygygttgygygggggygtttttygttgtttgtagggagygyggygyggaygyggygggyggttyggttatttggaaygggygttygttttggttttyggggttgtttttgtygtttygggaagtygtygatgggttttatygttggyggttygygt

SEQ ID NO: 4451 - DNA, 216 bp, Artificial Sequence
  Description of Artificial Sequence: Synthetic polynucleotide
tygtygtygttggtgggtggyggyggttygggtgttttttggattgygtagtaaagaggtattttgggagatggggttaaggttttagggggtgttattygygaayggtttattygttagattaggggggttttttggttgtgygtttggttagaattggttttgaygatggaagtttttggaattaaagygttgtttttttttttttgtgttata

SEQ ID NO: 4452 - DNA, 201 bp, Artificial Sequence
  Description of Artificial Sequence: Synthetic polynucleotide
gtatttattagggygtttygtaaaaaatttygttttygtttgtttttgggaattataggtaagttttgggttttygaggtgtagttttaggtagagtttygtgttgggaggtgggaagggggtttgattttggggatttaggtagtttggggatagttttattaggggtyggtgtttagaattggtgagggaggtatttta

SEQ ID NO: 4453 - DNA, 208 bp, Artificial Sequence
  Description of Artificial Sequence: Synthetic polynucleotide
ygagayggataggaatygaggagatttttttgtagygttttttatttttyggatagaaattttgtagattaygtttatttttttatttygtgtatygttygtggttygtgggtagtagttgtttttttgggatttttttygtttgttygygagttttygtayggtygygtttttgttgttggggtygttygttggttttggttgttyg

SEQ ID NO: 4454 - DNA, 201 bp, Artificial Sequence
  Description of Artificial Sequence: Synthetic polynucleotide
atttggtttaatygtygttagttttaagttayggtttyggttttttttttttaattgtgtgggatttygtygtttggtttyggtygggyggaggggtgaygttagtygtttatatagtgttttttggtygttggagttygggaaatttgtgygttygaatttggtttygttaagaagttgggtaaggattygggtttttga

SEQ ID NO: 4455 - DNA, 364 bp, Artificial Sequence
  Description of Artificial Sequence: Synthetic polynucleotide
ggyggttagtagggttttygttttyggggagaagtgtttaygatttaagggttgtttgttttaggaattttttaaagaattatagatattgagagtattyggggtttggtaggaagtgtagtgtattttttagttttagggtaattaggatagtatgaattttttattttgtggtagaataaayggttagygtttygatgtggygygttygatttttttttatagagtttaaaagttaygtttaattaaattgtagygttttygttttagttgggtatyggtttggaagyggtttggaattagattggattygaggaggtaagatttyggtagygygaggttaattataggttttattygyggt

SEQ ID NO: 4456 - DNA, 213 bp, Artificial Sequence
  Description of Artificial Sequence: Synthetic polynucleotide
ttttttaggtttttggygttttyggygyggttgttttygyggttgttttygtttatggtyggyggyggtgygtagygyggygttgttygtygtgttgagygttgattygygygttygttgttgttyggttttyggyggygagaatggaaagttgtygttttygttaatttygaggagagatagaagattttatatgttggggagaggttgggc

SEQ ID NO: 4457 - DNA, 201 bp, Artificial Sequence
  Description of Artificial Sequence: Synthetic polynucleotide
ggtttgtttttggaagaatyggttttttagtttttygtygtygtagttgtgatataagtaagtgtagtygygttgttyggggttygttagggtttttygygttygttttttatygtggttygyggyggtygygttttygtttygtttygttyggtygtttygtyggtttttgtttttagttgggttgtygtgaygaggaga

SEQ ID NO: 4458 - DNA, 201 bp, Artificial Sequence
  Description of Artificial Sequence: Synthetic polynucleotide
tttatttatygygtttaattattttgtatagttggtttttttttttttttaagtatagtttaagaaggtaaagggagataggaaagggtggtagtttgaygatttagygatgtattttagaatygtttttatttttttagtgtgaagttttttgggagaggtgagttaaatyggayggtyggtttttgtagtygtttagag

SEQ ID NO: 4459 - DNA, 296 bp, Artificial Sequence
  Description of Artificial Sequence: Synthetic polynucleotide
tattagtygggttggttgggyggttygggagttygagyggtggyggagyggygagtagygagtagygtttgygggagyggtyggtyggtygggttttygygtttygtaygttygtaygtttagyggggttygtattgagtatgggygyggyggtygtgygttggtatttgtgygtgttgttggttttgggtataygygggyggttggtygggggtagygggtttttaggtaagttttygatygaggtggggggyggygggygyggggggttygggyggtygaggygyggtttygga

SEQ ID NO: 4460 - DNA, 201 bp, Artificial Sequence
  Description of Artificial Sequence: Synthetic polynucleotide
gtttttagtaggtttttattttatttttttygtygttygtygagttgggttttattaagggtatgygaagtygtaaggaaggtaagatgtagygggygtygygygatagtgaygygggtygggagggttaggaattatagtygyggttttaggaygaatttygggtttagtagtttygggygtaggagtygttaggtaggg

SEQ ID NO: 4461 - DNA, 297 bp, Artificial Sequence
  Description of Artificial Sequence: Synthetic polynucleotide
tgtattttygatayggagttggtgtttygggaaggttgttttttgaagttttttttgttttgttgtggttttgttttttygyggatttttttttygtgtygaggtttagtttttggttttaaggaataaattygttggtttgaaagggagttayggtagaagtttaggggtagagyggygggagygygygattygygyggttggagtttygggggtatttggagagtagygygtttaagyggggttattggtttygyggttgygtttttttttttttygygtygygttttttttttc

SEQ ID NO: 4462 - DNA, 268 bp, Artificial Sequence
  Description of Artificial Sequence: Synthetic polynucleotide
gtgtagyggggtttggygtyggtttttttttattaygygttyggtttagggtygtttagtygtygttatygtygtygttttttgggtygatggagtyggygyggaaggttygygygttttgygtygtygtygtttagtgtygtygttagtatttttttygttttttygtttttygggtttatttygygggggyggygttattttttygttgtttaggttygggtatygygggygtttygygggyggtagtygtttttttygagygyga

SEQ ID NO: 4463 - DNA, 201 bp, Artificial Sequence
  Description of Artificial Sequence: Synthetic polynucleotide
aaggagygggattgttttttyggttggaygatagygtyggggattygtagygtgygygggtyggaattaaaaaagtagttygggagygygagggttgagyggggtaagtatgggttgtttttygtagttttttttttgttygaggttygggttggtygtttgtttgtttatgattgtttagttgttttttygattgtttag

SEQ ID NO: 4464 - DNA, 201 bp, Artificial Sequence
  Description of Artificial Sequence: Synthetic polynucleotide
ttaattygttygtagttgttygttttggattaagtygtttygyggttygtgttaggtagtgggttygtttttttttttttttttttttttaaattgggaygtgygaaggygtagttgttttttyggggttttttttattttttatatattttgttttygttttttgttttttaggttygtggyggagagatgttgatygyg

SEQ ID NO: 4465 - DNA, 201 bp, Artificial Sequence
  Description of Artificial Sequence: Synthetic polynucleotide
gttttggagtttagtagagttggagygtatattttygttttttttttttygttttygagtattaggyggatatattygtatttygaatgttttagtgggygtagagtttattagaaatggatagtyggatttttyggygtttgttgggggtatygttgttaggtgtttggggttygttttttyggttttgttygtataggg

SEQ ID NO: 4466 - DNA, 201 bp, Artificial Sequence
  Description of Artificial Sequence: Synthetic polynucleotide
ggtygtygggygttgtagtgggaygygygyggttgtgagtttgygggatatgtttttygygtyggttttttgttggyggttatgaagaggtagaaygtgyggattttgttttttatygtttgtatttttatttatttgttggtgggygtygtygtgttygaygttttygagtyggattaygagatgygygaggaggagaaa

SEQ ID NO: 4467 - DNA, 302 bp, Artificial Sequence
  Description of Artificial Sequence: Synthetic polynucleotide
ygttyggaygtyggagggtttygattttygygyggtttatgygttygygttygtttygttgtttygygaggttygygggatttttttygtygtygtygtygygttygtygttttyggaggagygggttggtygatygttatygygtygtttttyggtygttttygaagtygttttatygyggtttttgtygttttggggtygygtttygttttygygttttgggggttgagtygagtaaatttygygtatyggtygaygttyggyggggatttygttgygtattygygygttygggtgggyg

SEQ ID NO: 4468 - DNA, 201 bp, Artificial Sequence
  Description of Artificial Sequence: Synthetic polynucleotide
tttttttggggttttttatgttaggtttygyggttgtgttygtaagygtagatggtttygggattygggttattttgaygtygtagatttagtaygttgyggatygggtaygttggatttygggataagtgyggagggtygggggttggaagggattygagagtagagttygygtttttattttayggaygyggttatyga

SEQ ID NO: 4469 - DNA, 220 bp, Artificial Sequence
  Description of Artificial Sequence: Synthetic polynucleotide
yggttygtygtttygtatttgygttygtagtygygygttygttygttygtygtygttaggtttygyggttygggygtttatgtygygttttgygttygtygtygtygtygttgagagtygyggagygtagttygagggagygtygggygggggagtygagygatygggggyggggyggggggygagagttggttyggggttyggtagtygttygtttygc

SEQ ID NO: 4470 - DNA, 347 bp, Artificial Sequence
  Description of Artificial Sequence: Synthetic polynucleotide
ggyggtatatyggtagggyggtyggttttgttgggttttttgggygtyggtttygggggttygggyggtttttttyggttttyggtttggattygygaaygygygggygygaggggttgggaygygggagttttttgagtgyggagygyggagttttggtgtttyggygtattgtagttatattttygggtygygygttttygtygttttttattygygtygtagggtttttttttttgaggygtygttygygtatygtygggggggagggggtagygttaataaattggggagttyggttygtygygtttaggttttygtttggagtygtygtattygggayggtg

SEQ ID NO: 4471 - DNA, 201 bp, Artificial Sequence
  Description of Artificial Sequence: Synthetic polynucleotide
ygtgtaygtttygtttttattggtttygtttygtgattaygttttygtaattttgatagattttattttygaggattttttttaggagtatagtgatttygtttttatagggttygtttygttatattgattttttygtgtygttygygggattttatttttgttygtttgtttyggtgtttatggggaagtttggtgtta

SEQ ID NO: 4472 - DNA, 201 bp, Artificial Sequence
  Description of Artificial Sequence: Synthetic polynucleotide
tagattygggggaattaggaaaygygttyggygattttygggtagtagtatygggttaggtttgttttyggaatygttgaygttattygtygtttttttygtttgggtttttygygggtygtaggggtggaagttygatttgggttagggttyggatttttttttttyggtttttgygtygtygttttyggtgttaggayg

SEQ ID NO: 4473 - DNA, 225 bp, Artificial Sequence
  Description of Artificial Sequence: Synthetic polynucleotide
ttgtagtttgggtaatygagygagattttatttaaaaaaaaaaaaaaaaaaaaaaattaaggttgaattygggttttygtaygttygtatttatttgygyggttattaygygttgtttttyggygattaggttgtattttttgtattggtagtygygttatatgtagaagygtttgtggtttttgagyggygaggygtagtygtggtttttgtagygtgygtatt

SEQ ID NO: 4474 - DNA, 318 bp, Artificial Sequence
  Description of Artificial Sequence: Synthetic polynucleotide
ggttttggtagagygygtagygagtyggggatgaggttttttaagttttygttggtttgttgtyggygtagygttatttgygtagttatgattygttgtygttygatgatgaggatgtatttttygtaggtgtagtttttgaagyggtagtaaygtttgtggtttttgagttaggataggaygttatggttgyggtagygygygtatttgggygtgygttgtaggggygttygtggyggttgygatatygggtygtttatgtataggtagggggagtygtagtygtttatgtttygggttttygaatgagttggtagt

SEQ ID NO: 4475 - DNA, 265 bp, Artificial Sequence
  Description of Artificial Sequence: Synthetic polynucleotide
gtggagggaaggagggaggaagttagttaagtttttagygatttagtttagtatatttygaattttgtaaagttttgttyggttttttgtagtttygggygttttattttgttgaggtygttttyggttttttttgatttaggttgggygggaaaggtygggtygttttygtttggtttagatygttggtttattyggygggygygygtagttgtatttagygtagygttattggttttagtttgtagattgygttttttttttt

SEQ ID NO: 4476 - DNA, 259 bp, Artificial Sequence
  Description of Artificial Sequence: Synthetic polynucleotide
gggtygyggggtygggggyggtygtygtttggttgggggatyggggtygtgttgggygtygyggagtygggatagtagtagtggyggyggggatagygtygyggttggggtttygygttttttggagygttttttgtttagataygaygatttygttyggaggtatatyggttttggggataaagattagagagagatgttgtagattttggggttggyggtaaggatttttattyggtttttygyggtttttttttyg

SEQ ID NO: 4477 - DNA, 201 bp, Artificial Sequence
  Description of Artificial Sequence: Synthetic polynucleotide
gagygtagattaggtttttagggygygggagtttgttgtttttttttgtaggggtygttttyggaygttttattygtygttaygtggtttygggatgtgygggttgyggtagagagtgggtagtaatgtttttggttttgygttttygttttagtygyggggatttygaggygagtygttaattggtatyggtgtttygtt

SEQ ID NO: 4478 - DNA, 323 bp, Artificial Sequence
  Description of Artificial Sequence: Synthetic polynucleotide
aygygtttgtyggggaagggttygtyggygtygygttttygaggtttttgyggygaatygygttaygygygatttttggtygggggygggaggyggyggyggyggtaggagaagtttaaggttygagyggttygtagtttttaygtttgtatttttttattttygttagttygatggttygtttygyggygtgtattggagtaagtaggtttygtttygagygygygygttttgggaagtgttgtaagtttggagatttggagtgagtttygggygttgttggttygattgttygyggtgttttttyggtgaggtygyggggg

SEQ ID NO: 4479 - DNA, 201 bp, Artificial Sequence
  Description of Artificial Sequence: Synthetic polynucleotide
tagyggyggyggtygagtttagttygtagggtgggaattgagataggygttttaygttgtttatygyggttgtygyggtygtygtygtygtygtygttayggtygtygttttttgtattttgtyggggtgagayggttgttgaggttgygattgttggggyggttgttgygggggttgtgaygggaggtgyggaggyggtt

SEQ ID NO: 4480 - DNA, 355 bp, Artificial Sequence
  Description of Artificial Sequence: Synthetic polynucleotide
tagygtygtatagaagtygtagagtagyggygtgaagtygyggttyggygygtatygggtygtygygaagtatagtgttattattttgttttgtagygtygtttyggtttttatygtygygtttttataggttattaggtgtygttygtttagaatgttaattatggygtagataygtagttatttgagattygaggatatttgtaggaggatgattatttgyggggaggyggyggygagygtygyggtgtttygtttttgttygtattatygggygttggattttttaagatttgttttagatgygtttatattttggttaggtttygtttgtggttggagtaattgtgttygc

SEQ ID NO: 4481 - DNA, 201 bp, Artificial Sequence
  Description of Artificial Sequence: Synthetic polynucleotide
tgtatttgygtygtttttggtttttttaggaatgygttgaagtttgtaattagttttgtgaagttattgagtgtayggttgagtgaaatttttaaagttygaggaaaaygggtyggttgaatgggagttagtatggggtttttttttaagttttygygttgttaaattttagtagagttttttataatygtttygygyggg

SEQ ID NO: 4482 - DNA, 290 bp, Artificial Sequence
  Description of Artificial Sequence: Synthetic polynucleotide
ttgttatgygyggtagttygygtyggggtyggtattagtagygttygggyggatgtagygagtttayggaggggtatgtttttaygtattaagtataatygttttaggaatgattyggtgatatyggtygatgattttttttatagtttgtyggtgagyggyggyggaggtaaggtttyggyggygygygygatttyggyggyggttttttatttggtgttyggygaggygttgygtaaggygttygaygatgggttyggtagtttgggttatttgttttataaggtgtt

SEQ ID NO: 4483 - DNA, 201 bp, Artificial Sequence
  Description of Artificial Sequence: Synthetic polynucleotide
ttattyggyggaaattygygagtyggttttttygygtttaagaagtttattttttaagtttttttattatgattttgaatgyggataattggggttaaaygaggaaggatatagatttaaaagttagatttaggttttagygygtttttgggttttaatttgggagattygtatttagttyggyggaagttatagttttta

SEQ ID NO: 4484 - DNA, 201 bp, Artificial Sequence
  Description of Artificial Sequence: Synthetic polynucleotide
ttttagygtttaggtygattgygttttgatygggagttattgygtttagygtagttygagggygttgagttyggaggatgyggygyggggygggggtttygggagtaatagagattgggattygagggttyggttygygttgttgtttaygtagygtttttattttggaaagagtgtttttygygyggygggtyggttttt

SEQ ID NO: 4485 - DNA, 288 bp, Artificial Sequence
  Description of Artificial Sequence: Synthetic polynucleotide
gtttaggagaattygtaagttagyggygtttgygttygagttgtagtygttttttgtygtttaygygagttygagagyggttttyggagttygggttagygtygagttgtaggygygygtttaatygttttgttgggtttaygyggtttgagaggtyggagygtttaattgttggtaygygagtaayggtttagttaagtttattyggtttgagaggtyggaggttgygagtgtygttgttgaaggttgtggtggatygggttggatygyggattttgagttatatyg

SEQ ID NO: 4486 - DNA, 212 bp, Artificial Sequence
  Description of Artificial Sequence: Synthetic polynucleotide
ttttgygtggtagatatttagggataggttaattattatttttaattattygtttttgagaggtttaggatttgtttttatttgatggatagtggtgtayggattaaagaygaygtaggataggtaatttttttttttaatttttygggattagggtagttttgaagatttttagaggtagttaagtagttttttttygtagyggggagtga

SEQ ID NO: 4487 - DNA, 201 bp, Artificial Sequence
  Description of Artificial Sequence: Synthetic polynucleotide
gaggtagggaggygggggtgygggaggtttygyggttgygygggygygtgttggtggtttyggyggaggtttagtttyggttygygttygyggygttttygttgyggttygagyggtttggttgygggatttgtgygtayggatggygyggtygtttyggtagtattygggggtttgggygtygttgtttttgttgttatt

SEQ ID NO: 4488 - DNA, 246 bp, Artificial Sequence
  Description of Artificial Sequence: Synthetic polynucleotide
ygtttagtttygygtaygtttttttgygagttyggtygtttagygttttttttygttygagtygtygtttgygtttyggggtagtygttttgtttttagygygatgtggtttygtttggttttttgttgttggggtttggygttygtttygggttgggygattttttagtagatgttttygtygygtaattttagttttygtttttttttygagatygygttyggggttttygggagtattttygc

SEQ ID NO: 4489 - DNA, 201 bp, Artificial Sequence
  Description of Artificial Sequence: Synthetic polynucleotide
ttttttagggatggagtagttaygtttttygagtgtgtttattttatygatggagtaaagtgaggtttttagttygttyggatgtttttgygtygttygyggggtagttttygtatagataygttygtaagttttygattygttygttattygygtttagatattygygagtttttggggtygtagggayggtgtagygtt

SEQ ID NO: 4490 - DNA, 201 bp, Artificial Sequence
  Description of Artificial Sequence: Synthetic polynucleotide
attttagatatataggtagtygggattttygttyggtgygtttgtttatttatttttttgygttaggttgggaygygtttygtttgtaaaaggtttaaaygtatttttygtygyggggygggatttaggggtttaggtttyggggtttagaggygggtaattttgttaattttttttagyggyggggaaygtygygtaatc

SEQ ID NO: 4491 - DNA, 358 bp, Artificial Sequence
  Description of Artificial Sequence: Synthetic polynucleotide
ttaaygggttyggtgtatygttatygyggtttyggtttygttygagttyggttgagtttttaggtygggtttygggtttygggygttygyggggtaggaygtttttygtygaggygtaggggtagttatattgyggggygtttgggygayggygttaaagttagggttataagggtaygggataagyggggyggggggagtaggagattaggatagaggtyggygttygtygygggygtttttaygtygygggtatygttygttyggttttagygttyggggygtaaagtaagggygtaaattttgttygaggyggygayggttgyggtyggggtttattttgaagtygttaggtgtt

SEQ ID NO: 4492 - DNA, 201 bp, Artificial Sequence
  Description of Artificial Sequence: Synthetic polynucleotide
gttgygtgttygtygtttatagtygtagttaaagagaygtaggyggttttaygyggtttggtttatygtygtttgtagtgttygyggygyggggygtttygaggttgggtttatygtttttttygygtttttgaagatttttygggttttttygaaggagtattgtttttttttgtattttttttttagggagttyggtyg

SEQ ID NO: 4493 - DNA, 201 bp, Artificial Sequence
  Description of Artificial Sequence: Synthetic polynucleotide
ygttttttygttttyggttygagyggtygttatygygggygggyggygttgygttygggtgyggtttttygtyggyggyggyggygyggtygagaggtgygggtttygygygggygggaygyggggygttgttygtaggagygattaggtgggygtygggtygatygtagtygtygtygygttttttttygygtttygggt

SEQ ID NO: 4494 - DNA, 201 bp, Artificial Sequence
  Description of Artificial Sequence: Synthetic polynucleotide
gtygaggtttagagtyggtttttgttygtaggyggygaayggtattttgtttygttaggtttttgygggtgtgattygtgattygtagattttttygggygtttttggtttatgaygygggggttgttygttttaygtaggyggtttygggatgttttttygtttagattttagyggtagaaatagtttyggatttttttt

SEQ ID NO: 4495 - DNA, 277 bp, Artificial Sequence
  Description of Artificial Sequence: Synthetic polynucleotide
aggggagtaaaayggagttttygggggtaygtaggtttygtttttgggtgttggttttgtttttggtttttttagtyggtgtagtgattyggaatagygyggtygttttttygaygttygyggttttttattgygtygaggygagygttayggttaaagtttaagtttyggygttygttgygtttgtyggagttttgtttgttygagtaggtagyggggtttaggtayggyggygaygtygaagggttagtyggtagatagggttgggtttttgygg

SEQ ID NO: 4496 - DNA, 201 bp, Artificial Sequence
  Description of Artificial Sequence: Synthetic polynucleotide
tattttgtttttagttygattttttttgygttyggagtttgggttyggygygtaggagattgygtgtattttggygttttygatttttgttagggygtayggggattttagagyggattttttaygagttttaataggaggttagggagtygggatattagagataaattttttygaagttttttttyggttttattgatt

SEQ ID NO: 4497 - DNA, 247 bp, Artificial Sequence
  Description of Artificial Sequence: Synthetic polynucleotide
gtygttatagtygtttygagttygygygtagttttagttgttaygyggattttttgtttagattgygttgttgaagtyggygtttygttttataygggtygygttaattyggtygttgtgtayggtygggtgygaaattttttygygggtttayggggttgtygaggyggggtygtagyggtygtyggggttggggttggtttyggtttgagatagttttatggaaggttaggttttyggtttttgc

SEQ ID NO: 4498 - DNA, 201 bp, Artificial Sequence
  Description of Artificial Sequence: Synthetic polynucleotide
ygtygtttygygygtttyggttatygtygtgtttttttygggygttagggaaggtggttaggtggtttttgttygtygygttttgygtttygygtygttygttttgygttttgttttgttyggttgygttttttygggttttttygtygttatygggaagygtygttyggttttgagygttgygygggttgygygyggggg

SEQ ID NO: 4499 - DNA, 201 bp, Artificial Sequence
  Description of Artificial Sequence: Synthetic polynucleotide
tttgaagtyggyggtgtttaggagygygtygtttttygygtagggtygtttgygggtataygttagygttttttagttygygtygggygttttygyggaygygygtagttttyggttygttaggttyggttygygtagygtagttygyggttatygygatttatygggygggygggyggtygggygggggygggtttggyg

SEQ ID NO: 4500 - DNA, 201 bp, Artificial Sequence
  Description of Artificial Sequence: Synthetic polynucleotide
taggtttggttttagaatygtygggttaaggagaagaggttgaagaaggaygtyggtyggtagygttgggggtagtattttygtaatatgaagygttttygyggyggttttaagtyggataaggatagygtttaggaggggtaggatagygaygttgaggttttttttttyggtaggyggagggatygyggagttyggggg

SEQ ID NO: 4501 - DNA, 356 bp, Artificial Sequence
  Description of Artificial Sequence: Synthetic polynucleotide
ttgatygtgatgataagaaggttggggaggttaagagaaaagggaagagagagtgtagttgtaaattttttttygggttygagaagtatygtttttttgygtgtttaattggtatttgttattaatatgtttgtttttatttaaatggtttagagtaaggttttgattaaattagtatttttaygttaatatttagtagygtttttggtttttggtagattttttttttagttgttaaagtaaaattatagaagygttttggttttatttaaggtttgttggggttttttgttttttttyggagattygaatagttygtagatgtgyggtatttgtttatgttygtgtttygtgtt

SEQ ID NO: 4502 - DNA, 201 bp, Artificial Sequence
  Description of Artificial Sequence: Synthetic polynucleotide
agtygataygygygatgygygagaaagygyggtgtatygggtygttgtygyggtaaaattgtagtaygtggyggtataygttgtttaygyggtygtataygtagygygttttgtgggygttttagttttygyggyggtataggygygagtagtagtaggtgtagtagttgtggtaggatttgaagtagaggtaggygttga

SEQ ID NO: 4503 - DNA, 281 bp, Artificial Sequence
  Description of Artificial Sequence: Synthetic polynucleotide
gggttttatyggggygtagggttggggaatyggagtttygttygtygattyggagtatygtttaygtagattygtttygggygagggaggggtygggygygtattygyggggagggyggygagyggggattagtygaagtygggagaggggygtttttayggggygggaaattggygygygattttgggggaagtgtaggatggggggataggggygttttygygggggtggatgggggattatagyggggttggyggggtaggggtyggygtaygaggtt

SEQ ID NO: 4504 - DNA, 222 bp, Artificial Sequence
  Description of Artificial Sequence: Synthetic polynucleotide
tatygatttttygtgtagyggtttygtttygtyggattttaattattgttttaaggattgggattataatggtttttttgtgtttattattaaygttatyggttaggtgaggyggttaggygggtygygggtttgggggygggtagagagyggygagggyggggttttaygttygttgtattttttttatatttttagtgggatttggtgtgtgatttgggt

SEQ ID NO: 4505 - DNA, 237 bp, Artificial Sequence
  Description of Artificial Sequence: Synthetic polynucleotide
gyggttyggaggyggttatgattatgtatatgaaggggyggtyggtgygtyggttygtggggtagatggtggtgggygtgaagygtttgttggtttygaygaattygtaaagttgttygtagaygygygggaattygtggygtaggaagaygtygygtagtygtagttygygttggatgtggatgaaggttatttygygygygygtyggttygtttygtygttttgatttaggttyg

SEQ ID NO: 4506 - DNA, 201 bp, Artificial Sequence
  Description of Artificial Sequence: Synthetic polynucleotide
ggtttggaatagagattttagttgatttataaggayggggtttgagatttggggttttttgttatagtggtataatttagtttgtattgattaatatagttttttgtgaatttyggttttaatatttaaattaaggtattyggttgttttattaagttgttataygtttatttaaaagtattgttagattgaggaattagg

SEQ ID NO: 4507 - DNA, 364 bp, Artificial Sequence
  Description of Artificial Sequence: Synthetic polynucleotide
gygttygggttttgtagttttttgttgttgttygygttygggtaygygtgtttygygggttgygtttgtatygattygtatatygtggattgtygygatygygggttgtttagygtgttagattttttttttttggaygtgygtaagttgttggtggtyggtaatygtatttagyggattttygaggatttttttattttttayggygatttggtttatttggattttaggaataattygttgygttygttggaggagggtaygtttagyggttyggttaagttygtgtttttygattttagttataataatttgatttagttgggygtyggygtttttygttyggtygggaggttggtgaagt

SEQ ID NO: 4508 - DNA, 201 bp, Artificial Sequence
  Description of Artificial Sequence: Synthetic polynucleotide
tygggataygttttagggaaatygtttttgggtttggtagttgaatttagaygtygagtgtagttygttyggtgygygyggygttttattgttagatttyggaaattagttgttagggtggggtygygttttggygayggttattyggttatttttgtygttttygttttttttaagagatttttttagygggttaatttt

SEQ ID NO: 4509 - DNA, 201 bp, Artificial Sequence
  Description of Artificial Sequence: Synthetic polynucleotide
gttttagaggggagtyggggtggatttttatggaagggagaygtttgygttagtttaggagtggagttygtgttttatyggttttttaaattgygagtaygaaatttttagaggggagttgagttggtgtttygygtgttttttattttttattttttattygtaggttagatttgygttgtttattttaggagggagygt

SEQ ID NO: 4510 - DNA, 201 bp, Artificial Sequence
  Description of Artificial Sequence: Synthetic polynucleotide
tygttttatygatgyggagygygagttgtttattgttttttattatgtttaggattttggtttgggggygagagaggtgataaagagttgtatgatgygyggggggygygyggtygggtattttyggttttatttgttgtgtttttygyggttyggtttygttygygtttygatttttaggtatyggtagygtyggttttt

SEQ ID NO: 4511 - DNA, 222 bp, Artificial Sequence
  Description of Artificial Sequence: Synthetic polynucleotide
agygtatatatatagatataggtttatatagatagattyggttttaaaaataygtattygtagaggtaaaggttagygtataagtaygtatagatatatygataggyggttttyggatatygygttttttgtygtatttayggtttaygtaagggtttatatayggttttayggaggatagttataaaatatttagatataygttatataygtaygygygta

SEQ ID NO: 4512 - DNA, 201 bp, Artificial Sequence
  Description of Artificial Sequence: Synthetic polynucleotide
gtttatatatattagtgaaayggttaaatggtagtattaggtgttaagtgatygtataggygtgtttttgttagttgtgagtaagataaggtagtttatygtttttagggagtttagtttttatgggggtgtattygtttgttagggttgttgtatttaagtattattaattyggtggygttaataatagattttattgtt

SEQ ID NO: 4513 - DNA, 265 bp, Artificial Sequence
  Description of Artificial Sequence: Synthetic polynucleotide
ggygggygtyggyggggyggttttttagtaagatgtgygyggygtygyggggygttttttatttgtagyggygttygggagtygggyggttgggttaggyggygttttyggggttgttgygygttygygtttagagttgtygttttagggagttygttayggtygygtttygggtaygttyggyggygtttaaygatgatygttttttggyggygttttyggagtttggtttgggaatattgggtygggtttttygtgtgygttt

SEQ ID NO: 4514 - DNA, 242 bp, Artificial Sequence
  Description of Artificial Sequence: Synthetic polynucleotide
gttttygtyggyggygttgtattattattattattatatattgttyggtttagtgtagtgatttygygggtygggttttygtyggygygttgtagggygygggygygtagttygttygygyggtttggattttttttgttyggttgttttggattttataaaaaaaaaaaaaagtttagaaattttygaataaaattaaatattyggaygatttttttyggtgagyggygaagatagttygg

SEQ ID NO: 4515 - DNA, 201 bp, Artificial Sequence
  Description of Artificial Sequence: Synthetic polynucleotide
ttttttttygttttttttttgtttttttttttgttttgtggtttttttttttttttttagagatatttgggagttgtttttaagttttggggygtttygyggggttttgttaagggtgygtgtgagagagggyggyggagtyggygtygggtgttaggggtygagggtgggagygggagttygtggttttgygttttggag

SEQ ID NO: 4516 - DNA, 261 bp, Artificial Sequence
  Description of Artificial Sequence: Synthetic polynucleotide
ygggttgtaygygtaggyggtttattyggggggyggyggyggyggtttggtygggatgttggyggygggyggtggyggygyggggtygggtttgtattaygygttgtaygaggatggttaygaggygtagttggagtygtygtygtygtygtatttgggygtttayggataygtatayggatatgtataygygggyggtttgtaygyggyggyggygtatttgtattygggygygggyggyggyggtttatyggtgggyga

SEQ ID NO: 4517 - DNA, 201 bp, Artificial Sequence
  Description of Artificial Sequence: Synthetic polynucleotide
ggggattygygtaggttagygtgtyggttttttttagtttatygttgtygtygtyggggttgttttaagggagttaagyggagtgggagygggtttgygygtttttgttttgygygtaggggygggggggtttaggayggggygtttttttttatttatatgttgatttaggatttttaagyggttyggtttaggatatyg

SEQ ID NO: 4518 - DNA, 337 bp, Artificial Sequence
  Description of Artificial Sequence: Synthetic polynucleotide
gtaagagyggtgtagtygagtyggygttttagaagtygagaggttatataagtttaygtagagaggygtatyggatayggtaattaggagtaatttataygttttygggygtayggaaattatttgttaggaaatttttaaygttttttttygtttatttttttttattttttttttggygygttttttttttttttagaggtaygtagtggagtttttggagtttygaatttttyggatattgtagaatgyggggtttttygggygygggttyggttaattagagygtygtttgttttttttggttaatggtaggygttatattgttgtttaattt

SEQ ID NO: 4519 - DNA, 201 bp, Artificial Sequence
  Description of Artificial Sequence: Synthetic polynucleotide
aagttttgggtggygygtaaaggygtaggygagggtygtygtatagagtygtttaagttgtggtyggagygttagggygatttttgggaattttttaagyggaatttttygagataagyggtttttgttttttgatattttagtygaggtygagttgaygygtagttatttaattttttttgtttyggggaaataatttta

SEQ ID NO: 4520 - DNA, 201 bp, Artificial Sequence
  Description of Artificial Sequence: Synthetic polynucleotide
atgagtygagagggttgagyggagagtgtggttttyggyggttggaggtaggagaatatgttgygttygttygtygyggygtgagaggttygaggtgggygygtyggggtaggggyggtygygggygtttgttygtttagtgggygttgttyggatttggygaggtggtggtttgtaatattgtgttygtattgtttattg

SEQ ID NO: 4521 - DNA, 201 bp, Artificial Sequence
  Description of Artificial Sequence: Synthetic polynucleotide
gtagygtygyggyggttagtagygtygggtagtggattygyggtggygyggygtygggtygyggtgtttagggygggagtagtagtaygaggtttagggygagygtttaggatagygttagtatgttygtygtgtggygtttttggtatagygtttggtaggtggygggygttygggtgatgagtaggtagyggtttaggg

SEQ ID NO: 4522 - DNA, 201 bp, Artificial Sequence
  Description of Artificial Sequence: Synthetic polynucleotide
gttttaggagggaaggaggygayggtgtttaaggaygtyggaagtyggggattttygtttttttygggtttyggttaggttattagtgttggttygyggygygggtgtttagttgygtttgggatattgygggtayggttgtggyggtaayggtagyggtygtygygtygtygaygttyggtaggattgagygtayggagc

SEQ ID NO: 4523 - DNA, 386 bp, Artificial Sequence
  Description of Artificial Sequence: Synthetic polynucleotide
ggtggtatgtaygttttatttaaaaagtagatttttttttgtaattgttagtaagtggaaggatagtaaattttatattatttygagatttgtgygtttygagyggttttaatttygtttygtttgttgttgttgttgttggtgttgtttyggttgtagttgttgtygttttaygatttyggggygttgaggtaatagggttttttttttttattttttatttttttyggtttttttatagaagygtygtttttagtaatttttygtgtattttttatttttgtygtygtttattttattttttttttttttgttttttttttaaatygtttttaagtatatttttygtygttggaagtgattataatgttgttttttaataagta

SEQ ID NO: 4524 - DNA, 201 bp, Artificial Sequence
  Description of Artificial Sequence: Synthetic polynucleotide
tttttygtttttygyggygygygtygttttygggggtttygygttttygygtttaggttttttttttttggygggygtttataggyggygygggtagygygagtttyggagtttyggaggtttgtgygttttgagtyggtatggatttygagtattgygygttttttygygtggggtttgtattyggtttttatgtggttt

SEQ ID NO: 4525 - DNA, 201 bp, Artificial Sequence
  Description of Artificial Sequence: Synthetic polynucleotide
ggggygattyggagttgygygtyggygtaygygatttygttygttttttattttttgttttattattagttttaatttggttttygttygtygygygttyggggtttaggggagyggygyggggatttaggttttayggyggagagagygygygggattgygaagattggggtygagtgtygttttttttgygttttggta

SEQ ID NO: 4526 - DNA, 309 bp, Artificial Sequence
  Description of Artificial Sequence: Synthetic polynucleotide
aggygtagaygttggagttggagyggygttttyggtagtagyggtatttgtttgygttygagygygagtagttggygagtttgtttygttttaygtttaygtaggttaagatttggttttagaattatygttataagttgaagygygttygygttttaggggyggyggagtygtttgatttggtagtattygtygagttgtaygtygygttyggtttgttgygtygygtggtggtgtyggtgtttgttygygaygggtagtygtgyggyggyggyggyggtggygaggtgggaatygtygyggtttagg

SEQ ID NO: 4527 - DNA, 203 bp, Artificial Sequence
  Description of Artificial Sequence: Synthetic polynucleotide
agygtatattgtygttagttagttagtygtygtygtattggtttagtttygaaaatttttaggyggygtagaggtgtttaattttggttattayggygtygygtygtyggtaygtygygtgggttttagatagygttagtygttygggtaygaagaatatttggtttggggattatagygggttatygatygagggtagggtg

SEQ ID NO: 4528 - DNA, 388 bp, Artificial Sequence
  Description of Artificial Sequence: Synthetic polynucleotide
ggttyggttygyggagttagygtttttttygygtygatttygggtttygggyggtygtyggggggygtygggygtatttttygttgttaatttttygttygtgttttygttygygtttgggtttygtygtattttagtagaagttattatagagaataaattatttttttgttttygagatgggttttyggggaggaaggtaaattgtttgtttygtgtataataagttaggygtggagagtagygyggaggaggtygyggtagttatygagygggtagagtttttygtttttattygtygttygygtttgtygagttttttgtygagygggyggygygtaggttyggagaattttaaaaggtttggaatatygggttgtttttyggt

SEQ ID NO: 4529 - DNA, 241 bp, Artificial Sequence
  Description of Artificial Sequence: Synthetic polynucleotide
agttttttatttagatygygttagtgygtttygggttttattagtttttattaggygttgtttttttygtttttatttagtttttttttttygttttttygygagtgtatttaagygttttygttttatttatttttagygtttttttaagtttggaggagygtttagagtagtagaaatagtaggtattttatatygttyggygtggggatttygyggagygtygttgygygtygttttt

SEQ ID NO: 4530 - DNA, 232 bp, Artificial Sequence
  Description of Artificial Sequence: Synthetic polynucleotide
ygtttttttttttagygtttaggttgggggyggygtyggtgttagtttagtttagggygaagtttttagggtyggttygggtygggttgygggattygtygtggagygtaaagtgtttgaagttttygygygtattyggttttgtttttaaaggttttttagaaatgtaagaggttaggygtagaaatatatayggayggtagttttatgagaaaatgtagataaagagttc

SEQ ID NO: 4531 - DNA, 214 bp, Artificial Sequence
  Description of Artificial Sequence: Synthetic polynucleotide
gtttttttgttttygygttttttggattagttttggtggggagttggaaggtatygagtgygtttyggttaagaagggyggatagttttgtgygagtagygttyggttggygyggygyggggtgttttttatgttaaaggaaaggatggattttttgtttgtttagggtttttattttttaaaatttttttaattgyggtattggaagggattt

SEQ ID NO: 4532 - DNA, 250 bp, Artificial Sequence
  Description of Artificial Sequence: Synthetic polynucleotide
ygtagyggggtygttttattgtygtatttttatttygygttttgygygtttatttgtttaygaagttttygagtatygagtttttgtyggygttttggtygtttattayggygatttgyggtagttttagtaggtagttttgttttagygtygaaaaygygttttgtagayggtttattagygggattagtttttttatttttyggttttttattttgttygaggggtyggygattagttggtttttgtt

SEQ ID NO: 4533 - DNA, 201 bp, Artificial Sequence
  Description of Artificial Sequence: Synthetic polynucleotide
tggtyggtgaagttttaggattygttygtttggggttaaggtaaggggtgyggtaygaggagygtagggagtttygagttttaggygtagatttagttgyggattygtygtatagttttggtgttgtaagygtggatygtgggygtaaggtttyggygggaggtattyggttyggtygyggtygggtttgtagggttttgg

SEQ ID NO: 4534 - DNA, 467 bp, Artificial Sequence
  Description of Artificial Sequence: Synthetic polynucleotide
tygggtatyggygggagaggggggagaagyggygtggagaggatttggtaagggtttgtttttaaatttagattatgatttaatattttggaygygaagygaagatgggaaayggtygtttgttgagagggggtatttgtagtttttttagaaaaggttggggtaggagagygtgyggttagaggggtgggggtatyggagggggggttttattttttgttttatagtygggtttttttygygaggygttgggaagtatgaggtatgtagtatttaaaatgttttttgaaaaagayggatttgaagtttttttttataaataygttattgtatttattttttatttagagaygggttgygygtttygagttgtaygggtaggtatttttttyggttttgttttataaggtggggagagyggggttggaygygggagggggygggggggggagygtgagaagaaayga

SEQ ID NO: 4535 - DNA, 201 bp, Artificial Sequence
  Description of Artificial Sequence: Synthetic polynucleotide
ygtatagttagygaagygattygagggttagygaataagygttggattttygtaggtttyggygattttagattyggtttttyggygaagataggaaaaygtgtgtygagagtygttggagggaatygttygtaaatygaagaagaaattaaattagtagygaatatttgtaaattagtgttaagttgtgagtttttygag

SEQ ID NO: 4536 - DNA, 232 bp, Artificial Sequence
  Description of Artificial Sequence: Synthetic polynucleotide
tygggygygggggaggygtgggtgttggggygggygagtttagatttttygtgggttggtttgtgggtgttttttyggaaataaatgaggttgtaggagyggtgatyggtttgattgtttttgggggtttygaattygtgggtggagagggtaaggyggaggtygtggttagtatttttttagtgataatgtygtyggggatttttttttttattttttgggagtattttag

SEQ ID NO: 4537 - DNA, 222 bp, Artificial Sequence
  Description of Artificial Sequence: Synthetic polynucleotide
taygattttaggttygttgatgatygttgtggtatgaatgaggttatygtattyggagaggtggatgtttagatgtggatttaggaaatggttttatttygaaagtttygggttagtgggygtgttttttggttagtgtttttaygttygygttagaagggtagtaggttttygtagggttyggygttttatttattygtgttttttttgttgtttttagtt

SEQ ID NO: 4538 - DNA, 239 bp, Artificial Sequence
  Description of Artificial Sequence: Synthetic polynucleotide
tagygtygygttttaygttygttatygtygtygtygttttagtatatygtaggygtgagtttygtygygatygggagagtttttttagttgtgygttttygaggtatttggtygggyggggaggygtygggtyggggygtataggggttaggygggggygttgttgtttatttttygtttttygggygtgygtttygtttyggagttygtatttygygttygygtttygtttggaagtt

SEQ ID NO: 4539 - DNA, 209 bp, Artificial Sequence
  Description of Artificial Sequence: Synthetic polynucleotide
gtttattygtygtagtagtttatttttgttygttagggagtttagggtagtttttgaagttgttagatttttttaygtaggyggyggygttttgtattgyggagtygygttttgggggagtagtatttttagtttyggygtttygtagttagatagttttttttagggtggtagtatttttyggttagggtgtagggattttyggggyg

SEQ ID NO: 4540 - DNA, 380 bp, Artificial Sequence
  Description of Artificial Sequence: Synthetic polynucleotide
gtttagatagataaaattattttattaaagtgtaatgggagagaggaagaggagtaatgagaaggtatgtgagyggggagaaagaaaaagttygggaggygaaaaygaaatttatttttttgygtttatttttgttagaggtttgtaggaygtgttttaatttggtatttygagtttagaataaaagttaygggggttgyggtatgggtagggggaaggygygyggtggttgaygyggggtaggggttttggygagygygggaggggyggttagtagtygttygyggggttggattgggagtttygtgygatttygggtttggygtttgggtygggggtggttttygggtttttttygggggtygtygaggttyggtttc

SEQ ID NO: 4541 - DNA, 394 bp, Artificial Sequence
  Description of Artificial Sequence: Synthetic polynucleotide
ggtttttttttatgagggtttygagtagatgaggtttaaaagtygttttaaggagttttttttaagtttgattygagtgggygygaatttttatagtagygttaagtagtaggattatagygttagygtttggtttyggaggaaagataagttggagtaygtaagggygattygttttygggggtttyggttaggtatttgtygtatgtatttttttygtggtggtggtatgagygygygyggggygyggggggtaggygaggggattttggtaggygtygaygttttaggtyggattygggggtttttttgtttgtagttttttgttttaatgatygggttgyggggaggggagggtaggtttttttttaggtttttggtttttgtygattyg

SEQ ID NO: 4542 - DNA, 201 bp, Artificial Sequence
  Description of Artificial Sequence: Synthetic polynucleotide
ttyggtttttttatttyggttttttatggggttttygggtttgttygttgtgagtagttttattttggggtgttggygggatggttgtttygtgtagggygttygggagtttagatttygtggaaatgtttggggtttttttttgtttagaggggatagtgagtagttaygttgygatatgtttgagggattyggaygaag

SEQ ID NO: 4543 - DNA, 557 bp, Artificial Sequence
  Description of Artificial Sequence: Synthetic polynucleotide
ygggggaaaggtyggygttttagggyggggaggatttgggagtggagttyggagataaaatyggggttaggtagaggagttagagggaaagttagtaaaygygagttygggtgagagttatyggaatgygggaaygtagtttagtygggaatagggttttygataggggtygttygtggttaggaygyggtygttgaatagaggtygygyggyggtttttgttygagggatttygtgggygggggttatayggaggtygygtayggttttyggggttggygggggtaggtgggaggatttttttygggttygygaatttgatttggtagyggttaggtgtttggaagygtttttaaatgatagggttataaagatatgttggttaggtttgtagttagygtagtaaygtggtttgtaggagygtagaaygaggttagatagggttattyggaygtygtgttgttagtgggtgggggtygggagtaagyggtattggtttggagatttygyggtaggtgattttttttatttgggtagygaggttgaaygatggygat

SEQ ID NO: 4544 - DNA, 212 bp, Artificial Sequence
  Description of Artificial Sequence: Synthetic polynucleotide
ttggagggagttgggggattttggagggtgggaagtggttgattttyggtggtyggatatttatttagagtttgattygtattygtgtttttttggaagygttataattgyggggaaggagtttttagaaatygtgttagttttaatatggygggttaaggtggtttttaaaaattgaaaataaaggttttgaggtgggaaaaaatttagtt

SEQ ID NO: 4545 - DNA, 201 bp, Artificial Sequence
  Description of Artificial Sequence: Synthetic polynucleotide
aatagtttttttyggtttttttagttttgtttaaggggtttggaaatgttygtagttttaagaaaggttttatttaagtataggatggggtggggygggyggggttaagattgttttggggattgaatttattttygtttttagygattttyggyggataaagygtaagtttgtgtatayggtygattgagttattggaaa

SEQ ID NO: 4546 - DNA, 201 bp, Artificial Sequence
  Description of Artificial Sequence: Synthetic polynucleotide
gggggagttaggggtttttygtttggggattttygtgttgggtatttygtaygttttggaygygygtagttttatygggagygaattttgtttygtttgygggtgttayggagaggggttgggaagtygagttagttttggyggygattgggggygtttttggttttttgggggggygggggygygtattgttgtttagga

SEQ ID NO: 4547 - DNA, 294 bp, Artificial Sequence
  Description of Artificial Sequence: Synthetic polynucleotide
tttgaaagtttttgaagyggttttttttttttttttttttttttygtaggtagagttgtggtgtggttgggtggtttgygtgggygttygggggattygygggtattygggaygaggygagggygtagaaaatttggagtttaattagtayggagttgagttttygygttttaatttttaggtgatttygtgyggyggyggyggtagtagtagtggtagyggygatyggagttygtagtagtttygagygttttygggaggataggyggygagttyggygaatygttatttgtt

SEQ ID NO: 4548 - DNA, 244 bp, Artificial Sequence
  Description of Artificial Sequence: Synthetic polynucleotide
ggygggygtgagyggyggaggagtygggygyggygataygyggttatggagygggagtyggyggggatygaggagttygggttttygggayggyggaggygtygagagggtaggaygygtayggtgygttttaatttgttgtygttttygggygtygaggattttgyggttggygyggttaagggygagyggygayggyggygygggtgtgtttagtatttggtygataatyggtttaagatta

SEQ ID NO: 4549 - DNA, 303 bp, Artificial Sequence
  Description of Artificial Sequence: Synthetic polynucleotide
yggggtagtyggggtygggagagygggygtagygyggyggggatyggagtygygggygtygggaaaggttttygttaggaggggagggaatttygggagygygagttagggggaggygygtyggaaagygagagtgataagtagtttataagtygaaaagtttttygygggaggygygygtygygtgggtttygatttagtygttgygygtygtygtggtatataggttgaaaagtttgygaagttatagaagttaggttyggygtttagggggttttgattttgtttttatggttttagatt

SEQ ID NO: 4550 - DNA, 286 bp, Artificial Sequence
  Description of Artificial Sequence: Synthetic polynucleotide
ygyggaggttggttttggtagtggttagggagtggagaaagtaaattagagtyggttyggttatygattttgygaagttttttygattttagtttagygygggagggtggyggaaggtggtgtatygtagygtggttttygtygttgtygtygyggttttgtaaagtgttagygggggygaaagygagagtttaaaggaataggaggtttattgaattttttatyggagtttttaggggttttggttttttagtttgtttttgtttttttagttyggggatttgtt

SEQ ID NO: 4551 - DNA, 261 bp, Artificial Sequence
  Description of Artificial Sequence: Synthetic polynucleotide
gggaatygagaagaggaagaagygaaygygagtaggagygtagygtttttyggatttttgaggttttttttgtaatttgttatattygtagtttttattygatattgaataataatygyggggaggagaggttatttgtagtygaggttygtaaattgtyggttttattygggtagygttaattyggtgttygyggayggtgattttygagttttagygatgygttttattgggtttaaaatagatttaattttatagtta

SEQ ID NO: 4552 - DNA, 201 bp, Artificial Sequence
  Description of Artificial Sequence: Synthetic polynucleotide
tattgaaaggtagaaatggggagtaggtatttagttygyggtgggtagggttttaggaggtagttttygttyggygatagttttyggggygtaatttttygtaggaygygtatttgttaggatagttattaagaggatgyggaggttgggggttttttyggggataaaattagggtattttaaggaattttttgygygttt

SEQ ID NO: 4553 - DNA, 201 bp, Artificial Sequence
  Description of Artificial Sequence: Synthetic polynucleotide
gttggattgggtgyggttgtatttgtggagtgggtggttyggtgattgttattygggttagtgttgttagtagatgtgtatattttgggygggggttggyggtygagtgttattagtaggggyggyggttaggtagttattygtygttttttaagttyggygttgygygtagggtttggagtattyggtgttgagaygyga

SEQ ID NO: 4554 - DNA, 201 bp, Artificial Sequence
  Description of Artificial Sequence: Synthetic polynucleotide
taagttgttttttgttttgggtttttgatatttttatagtttttgaaagggttttyggagattttagagagaggygggtgtygaggggttaygagttygyggttgatattygygttgyggaagagaatggtattgattgagggttttggggatttgggttttggygttttggattttaggattatgtatttttyggggygc

SEQ ID NO: 4555 - DNA, 201 bp, Artificial Sequence
  Description of Artificial Sequence: Synthetic polynucleotide
ygttyggttygygggttttaattttatygtygtyggtygaattttgttygttygyggygygtatagtyggygttygygtataygygygtataaattttaygtaattygyggtygtttygtttygtygtygtygtagttygtttgtygygygtttatagttyggttygagtygyggggttygagygatagygayggygtygg

SEQ ID NO: 4556 - DNA, 201 bp, Artificial Sequence
  Description of Artificial Sequence: Synthetic polynucleotide
ygttyggygtagagtygyggtttttttgtttgygttygtagtttgygtygttygatatagtgggggtggaggtagttygtttagttgggygttttggtgyggtgtygygtttaaagttttatttttgygtygagggtttgtgatttgtagagagygatygtttgattttaagttggttgtagagygaggttagtygggata

SEQ ID NO: 4557 - DNA, 201 bp, Artificial Sequence
  Description of Artificial Sequence: Synthetic polynucleotide
tttygaggtgagtygtygttgygtttatttgttttygtagttggattgtggagtygygttyggaggagygttggatayggatatttttaatttttttttygatttygttttttggttttttgtatatatattttygttaggaggggaggggaaggtttagtaattgtttggtttggttttgatttatyggttttttygtag

SEQ ID NO: 4558 - DNA, 201 bp, Artificial Sequence
  Description of Artificial Sequence: Synthetic polynucleotide
gygtygtttaygttattygttatttygggtygyggtttyggttygggtttagtggttgygtygtttttygttagtaaygttygygyggaatgagygygtygygttgttygygtttttattygtagggttyggygtttttttttygttygtygtttttatagtygygygtttattggttyggttagtttayggggagtygyg

SEQ ID NO: 4559 - DNA, 201 bp, Artificial Sequence
  Description of Artificial Sequence: Synthetic polynucleotide
gyggaatttygyggtygagagtyggtyggtttagttgggyggggatayggyggtttygggtttgtgttttagttttagtygggttttttygygtygttgyggttgttgygyggtgyggtygtgataagttatagtaaatttgtttttygygtygttttaagttattaggaagygtaatyggtgtttttggggatyggygaa

SEQ ID NO: 4560 - DNA, 344 bp, Artificial Sequence
  Description of Artificial Sequence: Synthetic polynucleotide
ttttgattagatgaayggagtggtyggaggtaagtygygtgttttygtaggttyggatttgygyggttyggaggtggtggatggggtgtagtgggtgtgygggaatygtaggagaggattggggttttaggtggayggtgttgattgtattggttttgaagattggaagtgggtgtaggaggaatttgygatagttgagattagggygygygggtagatgygttaggtygttagtaaatyggygtgygtgygtttyggygygtttagtttygggygagygtagggatgggggtggaagaggygttttttygggtttygaggtttgygtaggttttttggtyggt

SEQ ID NO: 4561 - DNA, 201 bp, Artificial Sequence
  Description of Artificial Sequence: Synthetic polynucleotide
ggygtttgttygaggygggagtygttgggttatgtttttgtttattaggtttttygaatttttggtagggtagygtttgttygtgttttygatttttttygtaggtaattygygygaatttggggttygtagagagygagygttygyggatatyggttgaatagtttggaggttgygygagggggygtygyggggagggat

SEQ ID NO: 4562 - DNA, 218 bp, Artificial Sequence
  Description of Artificial Sequence: Synthetic polynucleotide
ygggtgtygtggtgyggggtggggatagttaatttagyggggayggaggaagttgggggtagttgggtgygtgttttgtatygtttatttgtyggggttyggtttttggyggtgggygagagggagtatattygtttatattttaggaatttgttggggagatgagttygtggggttagaaagaagggaaaaattttttgggtaagggagagaataat

SEQ ID NO: 4563 - DNA, 234 bp, Artificial Sequence
  Description of Artificial Sequence: Synthetic polynucleotide
ygttgttgttygttatygtygtygtygttyggttatygtatygtatatattaattatttatygttygtttttagtttttygggygaagttaattataggyggaggtttygttaatggggtygtygtygtygtygtygaggaggtagttagtygygygttygggygtaagygatagttttttagggayggggatgggtygggggygygyggggggygggggygtayggggygygt

SEQ ID NO: 4564 - DNA, 201 bp, Artificial Sequence
  Description of Artificial Sequence: Synthetic polynucleotide
tgaggyggagagaggtygtttygygtttggggttttygaaagyggttagttgtttttttgttttttttgagyggggagygttgygttttttgygggttgygggagatttttttagattttygggtgggaaaattatattgagygtttygggaggttgttagatataatattgtatttggtatttttgttygggtgttttyg

SEQ ID NO: 4565 - DNA, 201 bp, Artificial Sequence
  Description of Artificial Sequence: Synthetic polynucleotide
agttagggtygggggygtaygtyggaatatttgggtygtygggtatygagygtyggggggttgygyggygygtatttggagagggygtagttatgygggyggyggyggygggggggggygtgyggayggtygygttggygttgttgttgggggygttgtattgggygtyggygygttgygaggagtaygattattatggtt

SEQ ID NO: 4566 - DNA, 235 bp, Artificial Sequence
  Description of Artificial Sequence: Synthetic polynucleotide
gtaggggtgttttgttygtaygtatttaygatagtgagtagtatgttgtttagtagtagygttaggaataygatgaataggatgagttttygygagyggyggtttttttgtagttagyggattagygttagttygtttagggttatggtttyggggtttygttgygggygyggtgygyggtgaggatttaaggyggtygtggattttttattttttygttttttaggtygyggaa

SEQ ID NO: 4567 - DNA, 201 bp, Artificial Sequence
  Description of Artificial Sequence: Synthetic polynucleotide
ttttttaatagggygygttggttygygagtyggaggaattttygtttaggttttgttaagygtttattyggagtaggtygggggtagtgaaggatgyggygggagyggygygttgtagtttygygaygtggtaygtattttggaagygatgatttagatatyggtagyggtggatgagttaggggtagaaggtggayggat

SEQ ID NO: 4568 - DNA, 241 bp, Artificial Sequence
  Description of Artificial Sequence: Synthetic polynucleotide
agttttyggttygaggttgygttaattyggygtyggatgttaatgatgaaattaaaatgttatttaagttaaatgyggggagtatayggygattgggygygtataatggtaaatgggattaggtaggygaaggtttagtygagtttyggtttygtagtygttttygttatygtttttttttygttttttttyggattttggygttttggtttygggttataagagttygttygttattggt

SEQ ID NO: 4569 - DNA, 201 bp, Artificial Sequence
  Description of Artificial Sequence: Synthetic polynucleotide
gaygatttgggtgatttgggtggaaggtggtgtagtaggtaggtagtggggaggggyggggaggaaatttagggggagggggygtygaggttggtgaggygtttttttygygttagggatatgtaggtatyggatggttgygtaggggtttttgttygtttggttttgggtgygttygtttagtttyggtgtaaatgtttt

SEQ ID NO: 4570 - DNA, 201 bp, Artificial Sequence
  Description of Artificial Sequence: Synthetic polynucleotide
tygtttygatttattaggygygtagggttygttttygaaattygygygggttttygtagtyggtygygyggtttttagtygygaagagagygtygygtayggtggygtygttatagtygtgggtygtygygtttaggtagygttttagttgttygtaaagtttttgtagygtygtttygtyggggtttaygygygtyggtt

SEQ ID NO: 4571 - DNA, 217 bp, Artificial Sequence
  Description of Artificial Sequence: Synthetic polynucleotide
ttaaggttggtttgtgttagaayggygygygygygygtaygtaygtatatatayggggggaaatttttttaaaaatgaaaggttagaagagtttagyggyggygygggygttgygygagggtttyggagttgattygtygaggtaggaaattttttyggtygygaygttyggtttyggttyggygttygygtgggatggtgtagygttygtygtygg

SEQ ID NO: 4572 - DNA, 201 bp, Artificial Sequence
  Description of Artificial Sequence: Synthetic polynucleotide
ttatattgygtaagagatygtaatgaagttygtagatttttaggttggagtygtagagygaggtggygaggtggagaaygyggggttgggtttggatagyggttttggggtygtttggagttttygtttttttaattyggaaggtagyggattgatatttgygtygaagtygygygtattttayggagggtygggattttg

SEQ ID NO: 4573 - DNA, 201 bp, Artificial Sequence
  Description of Artificial Sequence: Synthetic polynucleotide
gaggggtggttttgttttatttagggggtgtygtgggtaaaggttttggggttatttgtttggtgttttggagggygtagggtaggagtygtygaggttygygggttattgtggggygyggaattttagattaggtattygyggtttaattttygggttaggggattygygggggttttaygaatttgtttggtttatttg

SEQ ID NO: 4574 - DNA, 201 bp, Artificial Sequence
  Description of Artificial Sequence: Synthetic polynucleotide
attyggggtyggaggtaggygygtaattatggggatyggggygggygatggyggygggygggtttttgtygtagggtggggatggtttttttagtygggyggtygtygttatattgtagagygtatttaaagagatatttygtttygygttygttttttagtattagattttygttygaaaaygtygtygggyggattgta

SEQ ID NO: 4575 - DNA, 317 bp, Artificial Sequence
  Description of Artificial Sequence: Synthetic polynucleotide
tatygttygggttttygtttggttatagtattaggttatagtgygttggtttttgattatttttttggttyggtggtygtttttygtttttttttagttygygtygttgttttgttttaggtttyggtgyggttttaagttttagtttagggtttttaggtttttttaggyggyggtggyggtatttatttgggtygyggagtyggggtttggtayggtttygtaggtggtaaatgaaattttggtagttgtygtgttttagggttttaygggtatagagttyggttagtagttgtagygtttggtgatagagygyg

SEQ ID NO: 4576 - DNA, 221 bp, Artificial Sequence
  Description of Artificial Sequence: Synthetic polynucleotide
atttatagygaygggtaattaygygggaggagtaggttaattttygatagtggaggtgaagatgygtgygtttygygtattttgtttttygygygaygtygttygygtygttygyggttyggtygggagyggtagttygtgtttyggtttyggtttyggtttyggttggygtttgtatttgygattatygtgagtagttatggygtattttatagtgtaga

SEQ ID NO: 4577 - DNA, 201 bp, Artificial Sequence
  Description of Artificial Sequence: Synthetic polynucleotide
gtgggyggttattatttttttagagtatttggtatatygggttggggttygtattygtagggtattgyggggyggygttyggtgattgggtggggtygtygttgttttttttttygttgggggyggtagttttttgtttgygyggaggygatttagaaggtaygttygttagtaggagggygggygtygtagggttttygg

SEQ ID NO: 4578 - DNA, 201 bp, Artificial Sequence
  Description of Artificial Sequence: Synthetic polynucleotide
gttttttygaaayggagatttgttatttttttagagggyggggaagtttatattattttttgttttatagtgttygtttygtttygtttgttggtttttygtttattygagatattttaggtayggttygtattggagagggtygygttgttgttgygatygtayggygttyggggtaggaatatgttygtttttttttgc

SEQ ID NO: 4579 - DNA, 201 bp, Artificial Sequence
  Description of Artificial Sequence: Synthetic polynucleotide
atygaagttaggtggaagtaaatgagtttggattttgaggygygtttggtttggagtygttaaatttgttagygggyggygggggaggtggttyggtagygtygggtgttgygttygtatatgygttygggaaggtagtttyggtygtttygtttttagttygttttttatygttggygyggyggyggyggygtggggttc

SEQ ID NO: 4580 - DNA, 201 bp, Artificial Sequence
  Description of Artificial Sequence: Synthetic polynucleotide
tgygttttttttttgttatttygatgttgggagtggygttttggttttggygttttttgggtaagtattagtyggyggtatttgyggaggtggttggtaygttgttattttttgaaatgagtgaggagggaggtttagatttaggyggttttaygygttygttttggtattagtagattgggaattgtygtggttatgttc

SEQ ID NO: 4581 - DNA, 230 bp, Artificial Sequence
  Description of Artificial Sequence: Synthetic polynucleotide
tttttyggttgtagaaygtttttygttgtyggagaaggggtttagtaaaattgatttttttttatttgtttttatttataattgatggggagatgagaaygtaatatattttagtatygagtttttgtygtttggyggagattttgtttaagaygttttygtaaagtatttttagtyggggaataaagtayggaaagttgttgggtagagyggtygggaggagatatygg

SEQ ID NO: 4582 - DNA, 201 bp, Artificial Sequence
  Description of Artificial Sequence: Synthetic polynucleotide
gatagtggtagaggygatygtttttttttttattatttatattttagttttagatttttttttttttttttyggtgatattaagttttagatyggyggtygtatttggttttatagtgtaaaatgtgtttggygaggaagtygaggyggygttgtagtagttgagygtgggggtttgtaagggyggttagttyggggaagc

SEQ ID NO: 4583 - DNA, 201 bp, Artificial Sequence
  Description of Artificial Sequence: Synthetic polynucleotide
ygaaggttatyggttgygttttgaagygagattggygyggtygtygtagtyggtttyggtttttgggtagtttggygggtygtaygggttgygggaattygtyggttaggtataygaagtgyggtattatygtttggtaattggagtagatgtttattagttygtygggtttggyggttatggygttttyggygtttgygg

SEQ ID NO: 4584 - DNA, 201 bp, Artificial Sequence
  Description of Artificial Sequence: Synthetic polynucleotide
tgttgttgttgttgttgttggygttggyggygygygyggayggtttggagttyggyggyggtttygggtagtgggttygttaygygygttgggygggygyggygagtagyggygagtttagttttagtttgygtattaaygttaygygygygttgttgttttatttggaygayggyggygattgygattttttggagttgt

SEQ ID NO: 4585 - DNA, 201 bp, Artificial Sequence
  Description of Artificial Sequence: Synthetic polynucleotide
agtttygagtygttagtttttaggtttgggggtygtygttttyggagttgttggygtttattygtttygygttggagatgtttaatygyggtygggttgyggggaygygggtygtgttgggttttgtgygyggtygygttygtygggtgaggaygygtygggggygggggygttaggttygggtttaagggataggagttt

SEQ ID NO: 4586 - DNA, 201 bp, Artificial Sequence
  Description of Artificial Sequence: Synthetic polynucleotide
ttttgaygyggggttggggaygtagatatttttggtttyggtagtttagygtaatttttgaggtygggygtygtttttygtttttagaaattygggtttygagygtygaattttagygttttygttygtgggtatagggygygyggtgtagttatagggggttygagataygygtttyggtttggtttaggttggggaatc

SEQ ID NO: 4587 - DNA, 201 bp, Artificial Sequence
  Description of Artificial Sequence: Synthetic polynucleotide
yggygattatttgttgggtattaagyggttgyggyggttttattgtaaygtgggtatyggtttttatttttaggygtttttygayggtygtatyggyggygygtaygyggatattygygatagtgagtggygyggttaggygygaaggggygggggyggggggtaayggtygtygggttaattygtttagttatattttga

SEQ ID NO: 4588 - DNA, 201 bp, Artificial Sequence
  Description of Artificial Sequence: Synthetic polynucleotide
gttgtattaagttataattttatttatatggtgtgagaattttttgggttttttttttttagtaagatttggtattttttgatatttattagtttaatgygtgggaaatggtgtttttttttaatttgtattttttttgatttatagaaagttgtttttagtttyggtttatygattatttagttttttattttttgaatg

SEQ ID NO: 4589 - DNA, 201 bp, Artificial Sequence
  Description of Artificial Sequence: Synthetic polynucleotide
gttttttyggtattygtagtttygatagtttagttttttttatttgaaagttttatttgaggttttttttaattttgtttttttgtatttttggygtygyggggagttaggggttaaatttygtggttygygtggtttttttttttttygtagttttttygtttttattyggygtygygtttggagygttygtttyggaga

SEQ ID NO: 4590 - DNA, 201 bp, Artificial Sequence
  Description of Artificial Sequence: Synthetic polynucleotide
tttygggggtgtygagtyggyggggggtgaggtggttgygtyggyggtygggttaggaggtgygggtattgggggygygggaggggaygtggtaggtttygygggggttayggygattttaggggttaggaaggtttygttgygggtaygtaatttgttttygtttttttttayggagtygtttygggtaggyggyggygg

SEQ ID NO: 4591 - DNA, 268 bp, Artificial Sequence
  Description of Artificial Sequence: Synthetic polynucleotide
agttggygttggataagtygggtaagtygaagyggaaggtgaattatygtaagtatttgtagaagtagattaagygttgtagyggttttatgggygtygygtttttyggttygtttttttygagygtygtygataygttagttaaayggtygttggtygtttttagygtttygatagtygyggtttyggtttayggtaaggttgtttttyggygggaggygtygtaggtygtygyggtygttagtttgtaaagtygaagtttggtygc

SEQ ID NO: 4592 - DNA, 614 bp, Artificial Sequence
  Description of Artificial Sequence: Synthetic polynucleotide
atyggtyggggttgttgtygtygggggtttgggttttttagttagttgtggattaaayggtttttttttatttaaattaattgygttaygygtaggyggygtaygggttgggtttgggaatggggatygygaggttttagtatttygatgttttgaaagttttttygtttyggggatttgtttttgtgttgtagttggtaggggtygtttgaagtgggagtagygtttggagaaggygggaggagttyggttygggggaygggyggygggatagygggatttyggyggygyggtgygttttagggygtagyggyggtygtagatygagtttygggygyggtaagaggyggygggagtyggtggyggttyggtattatgygtygagggygtttgttggagatygttttgggatttatygtgtttttagygttttataygagttatggggyggaygttaatttggaggttgggaaygtgaaggaaattagagttagtygggttaagagaagaggyggtggaggataygaygygtttaaagggtaaaggaatyggtttttttttttggtgtgggttttttaagttttaagatttagaataaygggtaggatgatttt

SEQ ID NO: 4593 - DNA, 201 bp, Artificial Sequence
  Description of Artificial Sequence: Synthetic polynucleotide
agatgtattttagtttagygatttttattggyggaattttygygtttatygygygtygygttaagatggtttaggttatttttattgttttttygttagygttttttagttttttatatttgttttgtatatatattggtttgtagaggggattygtttygaatygttygggagtggggtttgagttyggagttggtgttt

SEQ ID NO: 4594 - DNA, 201 bp, Artificial Sequence
  Description of Artificial Sequence: Synthetic polynucleotide
gttttgttttttttataagaggttaagtygatattaygygagtgtgtaygygttggggattgagttttygaagygaagttttgtyggaggagttttaggygggagtgggaayggttgggygtggggttagtaayggygttattyggtagggtggggggagttaggtttgttagagttagagygygttatygtygtygygag

SEQ ID NO: 4595 - DNA, 201 bp, Artificial Sequence
  Description of Artificial Sequence: Synthetic polynucleotide
gtattgyggagtagygaggtagygygtaagtaagttagggtaggggtygggggtaggggygggggttggagttatggttaggggtggttgtttaggtygygtgagttgttttttttattygtatttggtygttaggttattyggttattagaagtttttatttatattttgttttttatttggatygtyggttggttgtaa

SEQ ID NO: 4596 - DNA, 201 bp, Artificial Sequence
  Description of Artificial Sequence: Synthetic polynucleotide
ggggatyggtygtagggyggggttttttttggyggtgagtgagygagatygttaggttgaagtatygggagattgttttggtagtttttggtygttattygygtygtaataaaagtttttygyggtttttygtttagttagtttygtattgattggtygtygtgggagggattygagttggttggaggyggyggtygagyg

SEQ ID NO: 4597 - DNA, 201 bp, Artificial Sequence
  Description of Artificial Sequence: Synthetic polynucleotide
aagtttyggygygyggygttygttgggyggtgygttttttttyggttttttatttatygtagtygagtygggtattgtggggtgggtgtgygtgtttgtyggggggtgtgtgtttgtgtyggggaggggtgttgttggggaattgttgtttttygtattayggyggtagygatagtatygttyggtagttygtagtattyg

SEQ ID NO: 4598 - DNA, 261 bp, Artificial Sequence
  Description of Artificial Sequence: Synthetic polynucleotide
gygttyggtttaagtayggtgygagygtttyggggaggyggygagygagtyggtgyggagygtttygtgygttygggtggtttygygggtyggygggatygtgygtattttaagygygtgygggagtgtgygaggygttgtgygagttagyggygggygygttagggtgggaaaggtatttygaaygtattaggtgtagagatyggtatttatygagagyggtygggagygtayggygagtttyggtgttatygtyggttt

SEQ ID NO: 4599 - DNA, 201 bp, Artificial Sequence
  Description of Artificial Sequence: Synthetic polynucleotide
gtttgggttttaggttatygtagaggaygtgttttygggygygtagatggygggagatgaggyggtygaatttygygtttttgygtggtggagtatataygttttaataagtttagygttatttgtttagttttttaatttttttttttttygtttyggggyggtttttttttttttttgttttggttgttgttttggtyg

SEQ ID NO: 4600 - DNA, 201 bp, Artificial Sequence
  Description of Artificial Sequence: Synthetic polynucleotide
ggtttaygtattgttygtyggtttaygygggagtttygaggggygaggyggaggttgggygtagtttttgtagttagtagttattttygygygtttygtygyggtttagttaattatttgttgyggyggyggtygtgttttttagggtgtattagtattttygtygygggygttgttttygyggygtyggtatygatgttc

SEQ ID NO: 4601 - DNA, 201 bp, Artificial Sequence
  Description of Artificial Sequence: Synthetic polynucleotide
taggtagtttygygtggyggyggtygggatagttgggygygttggtaggagagtaggtatagygttttttataggtaggatgaygygggtttygtagttygtttttttaygttgtttygtattattgtttyggttttgaygtgygtgygatagatttatygtaaatagtttttagygggagtaygaggtygggataggagg

SEQ ID NO: 4602 - DNA, 201 bp, Artificial Sequence
  Description of Artificial Sequence: Synthetic polynucleotide
atatagttttaagggattgagyggttyggaygggatttgaaatttttggaggattagttaygttygtatagttygtttatgygygttggtattaggattygtaggttgttagyggygagttttygtygyggttttttagggtattttyggagaagggggyggttttgaggaattttttgtatttyggatgttttatttttt

SEQ ID NO: 4603 - DNA, 219 bp, Artificial Sequence
  Description of Artificial Sequence: Synthetic polynucleotide
gtygtygttttttygggagtyggagtygtygtttttttagtgggtgtagtyggggtttygaygggggtygggyggttatyggggttggagttgyggttayggaggtttttgygtttgygtygygtygagggtagggatagggattggggtgaggggttgtttyggaaygtttatagttggygttggtttttttttgtttgatagttttttggttygggg

SEQ ID NO: 4604 - DNA, 268 bp, Artificial Sequence
  Description of Artificial Sequence: Synthetic polynucleotide
ttagtygtyggygaggttattygggaggggygggagtygtttgttagttattyggtagtttttttggggtttttttygygygttygtttgtttttttttygttgygttttttygtttgttggygtttttgttttagygggattyggtagttaggggttttagggggyggtgtagtaaatttttagyggtttgygtttagtagattaggttggggagtyggtttggygttgtagggaggtagagagygggaggaagaggtagtggtagg

SEQ ID NO: 4605 - DNA, 201 bp, Artificial Sequence
  Description of Artificial Sequence: Synthetic polynucleotide
ggttgttttygggygtattttgyggttygggtatttgtagggygggtagyggtyggttttttattatgttggtygtyggtatgggggtygtygtttttgygttttttttgagtttttygttagyggtttggttygygtttttttttggttgttttttattttyggtttygyggtatattttttaattttggggtygaagga

SEQ ID NO: 4606 - DNA, 517 bp, Artificial Sequence
  Description of Artificial Sequence: Synthetic polynucleotide
tagygtttattgtyggggaagattyggaygaaaatygaggtaaattaattattaaaaagtgtatttaataagaatttttttatttaggtttttygttgtygagaygyggtagatttttagagyggtttatttatttatygaagyggattttgggyggtttygggttgattygygttgttagggygyggattttatttygggygtattgttaggagaaggggtttttyggggyggygygtttygattttgggttttyggtgttygtagagggyggagattygyggygttttaggttatttattygtattttttygagttaaatttttagygtttattyggattygayggtttaagtattgatttttaggtaagagtygttttttttggtttttagggaattgatattatygygggaygttttttttaggatagttagtaggttttaggagygtagtaygtaatagygtagagtagatttagatttttttyggggtgagattyggaggttygygttttg

SEQ ID NO: 4607 - DNA, 226 bp, Artificial Sequence
  Description of Artificial Sequence: Synthetic polynucleotide
ygtyggggggttttgtttttygggaggagaaggaatyggtygttttygtttttttttttttttaggygttttygggagggggtygttgggyggyggaatygygttttygttyggggagttattaygyggttttttygyggaattttgaygttatttataygtgggggaaggggttgggagagtaagaggaagyggygggggagggggtygyggttgggagagygyg

SEQ ID NO: 4608 - DNA, 201 bp, Artificial Sequence
  Description of Artificial Sequence: Synthetic polynucleotide
atttyggaggtagagatgagagygttttaaaattttttttttttattttaattttygaggagtaggtgggtgtatagtgtyggyggyggyggggaygygyggygyggagtttggttttgggaggtagtggtygttttagtagtygaatttttygyggttttagttttygygtttagtagttygyggttygtttttyggaaa

SEQ ID NO: 4609 - DNA, 212 bp, Artificial Sequence
  Description of Artificial Sequence: Synthetic polynucleotide
tgygtagtggggyggaggaggtggygatggtygggggaggyggggggattgttgtttatttgtagttgggttaatttygyggygtaggyggyggyggagygyggggagttygyggygggtttagttgtygtagtattatgttygagttttttttygggtagaygtygygygtygtyggggtttyggtaggggaggatgttagaygttyggga

SEQ ID NO: 4610 - DNA, 388 bp, Artificial Sequence
  Description of Artificial Sequence: Synthetic polynucleotide
ggtagtygtagttttttygygygttttttttttttttaygtttttygttttygttatggggttaaygtggggtttttaagagttgtyggtttttagyggygtaatttttagttaaagttatygygggyggattatggtttagggygttagaggggttagaggtaygggaagaggaaaagayggttaattgggaaaaaaagagaaaaygaaagaaaagttaaaygatgagtttttataaggaggayggagtgaatagtttgtgttagaaggttttgtatatygttatygagttgtgtttygtyggttaggtggagtgggagaagtgttygggtattttttttygggataggggtagttagggyggaagtagtataggtaatygggaggg

SEQ ID NO: 4611 - DNA, 201 bp, Artificial Sequence
  Description of Artificial Sequence: Synthetic polynucleotide
tttttttttttttgttttttaagataygygttygaaatygaggggtgagagtaaagatygtttattaatttagtattttggatttagagtttttaatttygaaaggaggttggtattgttygggttatygagagagggagggagaagagttgaggttgtaayggtttttgggttttttagatygggtttggtatttaggag

SEQ ID NO: 4612 - DNA, 201 bp, Artificial Sequence
  Description of Artificial Sequence: Synthetic polynucleotide
ttattttttttggaagtttattagttgtttaagtgataattaatatyggagagttagggttygtttaataggagtaygyggagatattttagaygatagygygttttttttatttttatttygtttttygggygttttaggttagygtttattagattttaygtttgggggattgtttgggttttagygagagtgttaygg

SEQ ID NO: 4613 - DNA, 212 bp, Artificial Sequence
  Description of Artificial Sequence: Synthetic polynucleotide
aggtgtagagatagtggagatgaggttttgatgttyggttttggttttaygygggtagygttagttggtyggtgttayggagttttygygtttttygttygtttagttttygyggatttatttattggggttgtttygtagygygatttttttttatttygggggagggttaagggyggyggtggggggyggggtgggggggaagyggyggg

SEQ ID NO: 4614 - DNA, 250 bp, Artificial Sequence
  Description of Artificial Sequence: Synthetic polynucleotide
tttttygtgtttttygtagggtaggttatagttttttagattttygtttaggtggtaaagaagatggagttgggggtygygtttyggyggygyggggttygaaggygaggtygtttagttygtattttattttaygtayggtataygtygtygyggtttttgttaygtatattttygygttgtttygtttaygtgggygtyggggaggaggttygagagatgggaagaaaggttggtatttatttttttg

SEQ ID NO: 4615 - DNA, 488 bp, Artificial Sequence
  Description of Artificial Sequence: Synthetic polynucleotide
ttgtaaatattggaggaaagttgygttgttttaattaaataygtttttttaaaatayggagatgyggggagtgggggttygggaaagaaatttttaaagyggtagtgtttttttaagaaggggtaaaaaaatttgtttatggttatttttttttygttttattttttttttttttgatagtttyggttttggttgttygagtygggggtgtgttttyggttttttttagatttgggyggggggygggaggagtgagygatttgggaagtttygggggtggagagggggygtttyggggtttgggggygaygtggatattttttttggagtayggyggtgygtttgggatttgaaggaagggtygaaggaagyggggtgygggygggygagttgttygttaagttgtttggygggygyggygaggggagatgygtaagtttgtagatygggggttyggagttyggygtttaggttggyggggggygtgt

SEQ ID NO: 4616 - DNA, 201 bp, Artificial Sequence
  Description of Artificial Sequence: Synthetic polynucleotide
gtagagttgtagtttttgyggttttttttttttygttgtttagtygagttttgggtttttagtttaagtttttygtatygtygttgttgttgtygttatygtygtygtygtygygygttgttagagtygttttttygtttttttttttttttttyggtygggtttttttttttttttgtttttttttttttttttttagtt

SEQ ID NO: 4617 - DNA, 364 bp, Artificial Sequence
  Description of Artificial Sequence: Synthetic polynucleotide
attgygtatgtgggtttggggtttgygygtatyggaggttgtaggygttggggagggtgtggggggttgtgygtggggttgtttttatyggaagttgtaygttttgggaagygtagaggygggggtgttgttygygttggggagtaygtgaggggatatttagggattgttygygygaatggtttttaaygtatgygttttattttatattttatagtygttatgaygatygggaggttygtaayggttgyggggataagttygttgaggttgttaggygagttaggtttttttggatttygtttgattyggttgggttgtgtttgaaattgatttagttttattatattttttgattatgaga

SEQ ID NO: 4618 - DNA, 220 bp, Artificial Sequence
  Description of Artificial Sequence: Synthetic polynucleotide
gtgtaattttttggttaaaatgttatagttaagattaaattygaagaaaagaatgaaattaygggaagttttttagatagtygtygtaaggttatgggtygaagtggtgtaggggyggygttyggggaagygattggtagagttgtgygtattgggggtgttgtaggygttggggagagtgtggagaggttgygtggagttgygygttyggggtgggggt

SEQ ID NO: 4619 - DNA, 201 bp, Artificial Sequence
  Description of Artificial Sequence: Synthetic polynucleotide
gyggttgagttygyggagttgggtgagtgtttgyggttgatyggttygtgggagtagggagygtatagtyggttggtgttggagggttayggggatttayggggtatygygggagtygtygagygtagggaagttagtaggtatttgtagtgyggagtttgtaaggttgaggtaggagatygttygaggyggggagggygg

SEQ ID NO: 4620 - DNA, 201 bp, Artificial Sequence
  Description of Artificial Sequence: Synthetic polynucleotide
tttgagggttygggtagttattygtattttttygttaygyggagaaagtygagtatataggtygtagggtgggggttygyggggagagggtggaagtagygggtttttygygtttggggtggtygttgttttatttaggttttygtttgttttttatttttttagattaatygttttttgtaggtgttaaygyggtgtttc

SEQ ID NO: 4621 - DNA, 201 bp, Artificial Sequence
  Description of Artificial Sequence: Synthetic polynucleotide
gttttagtttttatttgtttaggtgttttyggygttttggygaattyggttattttagttttttaygtggtgagtatttagggtagygggtygatttttygaggttttatatttgggtttgaggggygyggttygtagyggygggtgtaggggygattgttagtttttatttygtttyggggtgygttyggaggtygatat

SEQ ID NO: 4622 - DNA, 358 bp, Artificial Sequence
  Description of Artificial Sequence: Synthetic polynucleotide
atttagggttattgtagtttyggggtatttyggaggttaygattygygagtagatgtttyggaagaggttttttatgtaggttgttaggtagatggyggygtgttygtggatgygtagygttaygyggttgtttattatttagygatataygyggtttayggagaaggtgaggtygtagygggtygatttgtygyggtttaggyggtygtygtyggygttgtttatgttgtagagggatagtgyggttagygtagtygtygtatagtgygyggttaggttttaggatagtaygatttttatggygttttggatttygtatttggtgtatttggygaagygtaggtttaggygttgygt

SEQ ID NO: 4623 - DNA, 201 bp, Artificial Sequence
  Description of Artificial Sequence: Synthetic polynucleotide
agygtttttttatggtygyggtagttaatygatgattgaatygaataaagagtagyggygagattaatttttaatatttatygatgggtagygggyggtygagtttyggygagtttyggtagtygtygttygtygttttagggygttygtttgttygttyggggatttttttaatgygtttagggygygttygggggtttt

SEQ ID NO: 4624 - DNA, 328 bp, Artificial Sequence
  Description of Artificial Sequence: Synthetic polynucleotide
ttttttagtttygttggtttgggagtygggagtttyggaggagtttttygttaagtttttttggttaygagygygtttggttttggtttgggagtagatygtgygttygagtggggtatttgttygaggtyggggattgtgaatygaaagattttatttagttttgttgtttttttggtattgygatttgggggygggttattttatttttttgaatttygtttttygttttgtttatggaaggttgtaagtttttttggggttygggatttttttttatttttatttttygagtagagaaataggygatgttttttttttttttgyg

SEQ ID NO: 4625 - DNA, 201 bp, Artificial Sequence
  Description of Artificial Sequence: Synthetic polynucleotide
gaggtgtgtgttggaggtgggtagtygtygyggaggttttagyggtaggtgygttttagtaggtagtagtagtygttattttgggtaagtagtaaatttygtataaatttyggagttattatgtttgttttttygttttatygtyggtttttttgttaggagtagtagaggatgtggtgaatgtatyggttttatygaayg

SEQ ID NO: 4626 - DNA, 319 bp, Artificial Sequence
  Description of Artificial Sequence: Synthetic polynucleotide
gggygtatatataygtttatttagatatttygygygttttttygygtttttgtttgttygttygtygtygtttgtttttttttttttgttttygtyggtygttttttttttttttttttttttttttttttttttttttttttttttttttttttggtattatagagttgttttgaaaatagaagatagagggagtttyggagttygttatttttagygatttttatattgggaaaaaatatggagttagtttyggtagttttygatttygtygttagygagttaggtagtagyggygyggaygyggtygtyggtttta

SEQ ID NO: 4627 - DNA, 201 bp, Artificial Sequence
  Description of Artificial Sequence: Synthetic polynucleotide
ttaagtttaattttaygtttttttyggtgttygattttgyggtygaatygtaattgygagtygtaggtaatggyggagtttttggtattgttagttgttygyggttgggggttygaggttgggagggtttygttttyggaatatygtttyggtttggtttttaattttgygaggagtttttttgygtttttttttygyggt

SEQ ID NO: 4628 - DNA, 370 bp, Artificial Sequence
  Description of Artificial Sequence: Synthetic polynucleotide
ttggattttyggggtgygggtttttttttttgttttgttttttagtatttttggtaattgygtaaagttgtttgggttgtaatggtggggtgtagggggygttyggttgttgtatttgttagtgttgggtttaggttgagaggygatttttagtttttataataatgtttygggttttttggtttgggttttygtagygttygattgatygttagygataygaygagaaygaggatttgtyggaygtggaggagatygttagygttygyggttttagtttggaggagaagtttygtagttagttgtattagggggatttygtgtaygttatggagggtaaaggtgaggygtttttatttygggtygtttt

SEQ ID NO: 4629 - DNA, 201 bp, Artificial Sequence
  Description of Artificial Sequence: Synthetic polynucleotide
ttttttygttttaggygtygttaagttttagtattatgygtttttttagatgttygaaagygtttttttagggtagtttatgtttttttgtgtttttttygygaygggtygggtttattattttatatttttygggtttttttatgtttattatygtgtgtttttttagtatttttttttttttttaagttttaatatagt

SEQ ID NO: 4630 - DNA, 201 bp, Artificial Sequence
  Description of Artificial Sequence: Synthetic polynucleotide
gttgggygtaggggtygtygttygaggattatgggtgggttagygtttygtygggttgttagttggyggggatygtyggygtttgtgtygggtygygttygaggttgygtygttygtgtygtagyggttaatgyggtagtattygygaaygttatygyggygggtttygttggttygggttgyggygtgggggygggggat

SEQ ID NO: 4631 - DNA, 201 bp, Artificial Sequence
  Description of Artificial Sequence: Synthetic polynucleotide
gtgtagygaygtttagttttygtgyggttagygygtygygtyggyggattttgtagtttagagagtttagggagtttagggaggggagyggggygygggyggggtagtgtygtataatygtaggygygtttygygtygttttygtttygggtttattttttttygtygygttttttttagtttatttayggaygagyggat

SEQ ID NO: 4632 - DNA, 263 bp, Artificial Sequence
  Description of Artificial Sequence: Synthetic polynucleotide
gygyggtttygyggggattttgygggygggygggyggtygggygygygyggggygggggyggygygygygyggggagygtgtgggtygggygggygyggyggggaaagttgggygygygagtygaggttgttgtttatttgtagtygygtygtttatttgtygyggagtgygygtttygygttttttyggttygtttyggagttyggtygttttttttttgttatagygggtaattgygtygatatgygataygagtagttta

SEQ ID NO: 4633 - DNA, 201 bp, Artificial Sequence
  Description of Artificial Sequence: Synthetic polynucleotide
ggygggagaggagtttyggtygygtggattttagtttgygyggtaattatygygttttgattttaggttyggttgtttagggaaggatagtttagggygygtttagygagttttagggggtayggaagtggttagggtagattttagggtgaataattaatattttatttattaattygttaaaaataaagaaaataaaat

SEQ ID NO: 4634 - DNA, 201 bp, Artificial Sequence
  Description of Artificial Sequence: Synthetic polynucleotide
tgtyggggtygygttttygggttygygtygttagtatttttttaygygygttyggtttygggttattygttttygtyggttttygttttttttygtagtygtagggaagygagtttgggaggaagaagagggtaggtggggaggyggatgaggggtgggggattttttgaygttattagaaggaggtgtyggggtaggaag

SEQ ID NO: 4635 - DNA, 201 bp, Artificial Sequence
  Description of Artificial Sequence: Synthetic polynucleotide
aggggttaggagyggygggatagygygggaagagtaggtaaggggagatagtyggattgygttttagtttttygtgttaagaatatygtygyggaggygyggttagttttttttggatyggatttttygtttttagggttaggyggyggagttttagttttgttttttttttagtttygggyggtttttagagttgagtaa

SEQ ID NO: 4636 - DNA, 201 bp, Artificial Sequence
  Description of Artificial Sequence: Synthetic polynucleotide
ygggygtyggygtgaattygygtttttyggagtttagygtygtgtttttaggtttyggttttgattttagggygtttaggtggaatggtttygtagttgygygttgttttygygttttygttttgtttygyggaaatygttttygatagttaattygatygggygygyggygttttyggtyggttttygttygatttygyg

SEQ ID NO: 4637 - DNA, 215 bp, Artificial Sequence
  Description of Artificial Sequence: Synthetic polynucleotide
gattttttygygtataygtatatgtataygttgygygtttttaygygtatatataygttttttttgtygygttygtygtygyggttattatygyggagtygagttttgyggagygggaatygaggtyggagyggggatyggaggtagtygagtygggggatgtyggttyggagyggagtygygygyggayggygygttygggayggtgagtgtgg

SEQ ID NO: 4638 - DNA, 201 bp, Artificial Sequence
  Description of Artificial Sequence: Synthetic polynucleotide
tygygtaatttttgaagtggtyggttagggygyggttggtttagtygtygtaggygttttgtaggygttggggtaggttttagtggtatagggtgattaygggttgtaygtttagttttygtagtygttttagtaggygtyggtagtagygtagtttttygyggttggggaygttygygttgttattggggagtattygyg

SEQ ID NO: 4639 - DNA, 201 bp, Artificial Sequence
  Description of Artificial Sequence: Synthetic polynucleotide
ggaygggagttgyggggagggyggtygggggatttygtagagttygtttygttygtagtygyggggygtygagggtagggygggygtttagtttggtttygtygtttygttygtagtttttygaaaggyggtygttttgttttggttagtttggttygattygggggygttgygtgygggyggtttyggggttgttggtat

SEQ ID NO: 4640 - DNA, 201 bp, Artificial Sequence
  Description of Artificial Sequence: Synthetic polynucleotide
aatttaatatttttttttttttttttggagttattttttttttyggaatatgtaagttttgggtggtttagttttgtygttagatttagtttttaagtgygggggaaggagatgggygtttttagtygygattttttgggaaggtggttatttatttgygttttgaaatagaagaatagggygaygttgtagataatttgg

SEQ ID NO: 4641 - DNA, 217 bp, Artificial Sequence
  Description of Artificial Sequence: Synthetic polynucleotide
attggttgaagtttttttagygatttgtatgaatygagagggagtgttttttgtygttttttttttaagagygttttgattgtagttttttagggaatgygyggtygagggaatgygygtagtttataggttttgggagtgagttggtgttyggygatttggtattygygtttggatatggggygtttatatygttttaggagtagtattagttata

SEQ ID NO: 4642 - DNA, 317 bp, Artificial Sequence
  Description of Artificial Sequence: Synthetic polynucleotide
agtaaaagtttttatttgtagtatygggtatgttgttygtttaaygygtttyggggatttgttggttygtgtttttaatttaggggtggttataygtttygygtttttgtttttgggtagatttttttatttgtgtattttggtttttttatttagtaaagagatgtgygaagtgtgygtttggagaygagtygtttyggtgatttttattygttygtagyggtggttttggtttttyggattygygttygygttttgygggtttttygygtygtttttgttygtyggattattygggtttagagggtygttygttt

SEQ ID NO: 4643 - DNA, 201 bp, Artificial Sequence
  Description of Artificial Sequence: Synthetic polynucleotide
gaggggaggtayggagygggaggagggggaygyggagaagattgtttggtttygtyggtttygttaaygtgayggttagtttygtygagygttygtattygtttatatttatgattattygtatattygttttaataygtgttaaggygygatygyggggtttttggtagttttygttgtatttttttttttataggggta

SEQ ID NO: 4644 - DNA, 201 bp, Artificial Sequence
  Description of Artificial Sequence: Synthetic polynucleotide
tygtttaatayggagaygyggagttttatagyggtggtagaaagtgagtattaatttagtaatagggggaaggaaggggaygtygggyggttagtgggaygtgyggtagtygagggttgtagtttgtttttgtagygygttygygtttatttgygattttttggtaggggatgttygttaggttgaattttttggtatygt

SEQ ID NO: 4645 - DNA, 201 bp, Artificial Sequence
  Description of Artificial Sequence: Synthetic polynucleotide
tagtygggtygagygygttgtttgagttgagtygtygtaggtgaggggttygygttttygttygttttgggygtygygtttggtattgattttgtyggtygtttattgtygtygtygtygtygttygygggtattatgatagttttgagygttggggttataggttggttatygtygtyggtgttygggaggttgyggygc

SEQ ID NO: 4646 - DNA, 201 bp, Artificial Sequence
  Description of Artificial Sequence: Synthetic polynucleotide
agtgtgattgatgtatttattatttaataatttyggggtgaaatttgaggtgaayggttttatttttttatatttaggaatggaattagttttyggtatygtgtatagtttgattttaygttygtaygttgggttttyggttttttggtagtgtatttaagtgtatttygygtgtgttyggyggattttygtgtatatygt

SEQ ID NO: 4647 - DNA, 201 bp, Artificial Sequence
  Description of Artificial Sequence: Synthetic polynucleotide
gygtagttttatttyggatggtttttgttttttygygggttygagggygttggaaatttagyggyggygaagyggagaggagtttygygygttttygttygtayggttttaggtttggggtttgygttggagtygygyggggagaggtygtttttgygatygtygygttygttttygatygttygggttygyggttagttc

SEQ ID NO: 4648 - DNA, 221 bp, Artificial Sequence
  Description of Artificial Sequence: Synthetic polynucleotide
agtttaggtttgygtttataygygyggygtttataygygyggygtttatttggttgtagtttyggttagggttagygygtygyggttgaagggggygttyggatttttttggggyggygygtagtygggatagtttygtatgaygttygygttttagyggtttygggaygyggttttatttttaatttttggyggttttagtttyggtttttgtgtttygg

SEQ ID NO: 4649 - DNA, 311 bp, Artificial Sequence
  Description of Artificial Sequence: Synthetic polynucleotide
gtttygtttygtattygtatatatttttttygtygttgttttgagygtagygataagggtttttatattttygyggttygtaatgtttyggggttaagtygaggtagggaggygttttygtagtttttgattttataattygygygygtgtgtatygagtygygggtatatygygaatatatatatatatatatatattygtgygttttygtttttygttyggttygggtttttygaatttattttygaggygtttygggygtagggttygtttttttttgygggtttttagyggttgttyggtagtggtt

SEQ ID NO: 4650 - DNA, 308 bp, Artificial Sequence
  Description of Artificial Sequence: Synthetic polynucleotide
ggtggygggtagtgtggtgatggtttttgaggaggtttgttyggagygtatygatttgatttataaaaattatyggaaattttgtaatttgttgatygaygtggaggagtggggttaggtggttattattagtatgtttattygttaygttygtaygtagtttttgagttttatttagaaygtaagtgggtttagtttaggtagagygggtygaagtgtgtttyggggaggygtttatagattygtyggttttttygtttaggaatttttattagaggagaaygyggaaaaagttttttayggtttag

SEQ ID NO: 4651 - DNA, 201 bp, Artificial Sequence
  Description of Artificial Sequence: Synthetic polynucleotide
ygagaattttgygggtttagaaygttygygyggaygttttttttayggygtyggaagtyggygtygagtttgttatygggtatttttttgttgttttgaygayggygggygttgtaagagtggagaagttgtaggtgttgaggygyggtgaaagaaattttgggagttaagagtaygaggagttggtgtttgtgttatatt

SEQ ID NO: 4652 - DNA, 201 bp, Artificial Sequence
  Description of Artificial Sequence: Synthetic polynucleotide
aggtgatttyggttttggygaggygygattyggttatgygtgtgtgtgttttttttyggagaggatttyggtygtygagggtaygyggggtttagttatygttygttttttaattagttgttggttygtttygatggtgtaaattgtttttttttgttttttattaaatagtaatagtttggttaygtttaagtggaataa

SEQ ID NO: 4653 - DNA, 201 bp, Artificial Sequence
  Description of Artificial Sequence: Synthetic polynucleotide
gggatttggtgattttagtattattttttttttttttttttttttttttgtttttttatygtttgttgtaattttgtaaagtttyggagtyggagagygygtttygtttttagagttttyggattyggygagttagygatygtygagtyggttattatgttyggtagatygygttattaggygtttttygyggtttttatt

SEQ ID NO: 4654 - DNA, 630 bp, Artificial Sequence
  Description of Artificial Sequence: Synthetic polynucleotide
agtttttttttgttattyggagtagagygygttagygygaggtygggtyggtygtttgygtagygtygggttaattttaattgttgattatatttttagygtgtttttttataggttttatttgtaattgagaygaatgattatagtggggygggaaggagtagttgtttattaattaatttttaattaaaagtgtttttygttttygggtgattaaagagaaatatygttygttgggygatattgattyggatggaatttatttgttaaygttyggaggaatggttttttygtttatygygyggtygggattgttttggtttttttyggtttgagtygtyggygagtgatyggygagtttgyggttaggtygggttgygygaggtggggttgaygttagagtttttttygttttaagtygygtatatttgatttgaygggttygygygattygtttttttttttttttttttygtaaaatatgtatttttgtygtygttgygaggtygttyggttttagagttttttygagttttyggaatgygaagttaaaggaatygyggyggttatygttgtttattttgttattyggttagaaaagtttgyggagygyggggatggattaatygg

SEQ ID NO: 4655 - DNA, 201 bp, Artificial Sequence
  Description of Artificial Sequence: Synthetic polynucleotide
gagggyggggygggyggyggtygygtttttaatttyggygttgygtgtgggagyggtyggattagggaattagygttgtaatttyggattagtaaygttygttaaatgagtgtttaatttygattttttatgttttttagygtygyggttgagttttaggaggttttttggttaggtttttttygygttttggttttattt

SEQ ID NO: 4656 - DNA, 239 bp, Artificial Sequence
  Description of Artificial Sequence: Synthetic polynucleotide
ttygtgaatttygttyggggatattttatagtagtygygtttttatttttttttttttaaatygtttygggtttttgtygtygttattttttgttaaatygtttttatttttttagyggagttatagyggggygyggygtatataaagggggtyggagggtggagagtatagaaggagggagagatttygttagggttygtggtaygggtttgggagtagttatttattygattttttt

SEQ ID NO: 4657 - DNA, 201 bp, Artificial Sequence
  Description of Artificial Sequence: Synthetic polynucleotide
gaygttagtygygygggtttttygagttygygtygygtttagggatttggttygttttttgygtttttatttttttattttttttagaaatatagtaygygggttttttttatgtaggttattttttayggagttttaggttagttttggggyggtgaaaygaaggtgttaaggtatagtattttttygggaggttggata

SEQ ID NO: 4658 - DNA, 221 bp, Artificial Sequence
  Description of Artificial Sequence: Synthetic polynucleotide
tagttgttaatttygygygyggagtttttyggyggtgtagtttygtttyggyggygygggyggtatgaagattagtygtygyggtygagygtttttggtygtggttttgaatttgttggygttgttgttygttattatygttttttttattaygtattggtgttagggtaygtagygggtttttaagtygggttgyggttagggygggygygttaattgtt

SEQ ID NO: 4659 - DNA, 201 bp, Artificial Sequence
  Description of Artificial Sequence: Synthetic polynucleotide
gyggggaggggatggggtggygggagaattgtttttttttttagttataaatttattaggtttttaaattttttttggattttttttttygygttttygygagttygggatttaggggatggagaattyggggyggaggagygtygagttaggygggagggaggtygagtygtgggygggaggyggatyggygtggggttg

SEQ ID NO: 4660 - DNA, 246 bp, Artificial Sequence
  Description of Artificial Sequence: Synthetic polynucleotide
gtttygggggtttttagttaagtatygtttggtgttttyggtttagggtygtgtgagtyggaggttgagtttaygtaaggtttttatttgtatagattaygagttggagaattatagtatgtattgygtgtaatgtaagatgttygtgtgttattagtgtttggaggagggtaaatattttagttaygaagttaaggttttgggggttatgtggaaattatataaggtgagttttaagaaaattta

SEQ ID NO: 4661 - DNA, 223 bp, Artificial Sequence
  Description of Artificial Sequence: Synthetic polynucleotide
tygattatgattatttggatttggataagatgagtttatatagygaggyggatagyggttatggtttttayggggggttygttagygtttttattatttygtgttagaagttttttaayggygttygygtgtttttttyggttatgtygttatyggttatttatttgttatyggttttggtttyggtgtttygtaatttttgtattatttgtttttagtgtta

SEQ ID NO: 4662 - DNA, 201 bp, Artificial Sequence
  Description of Artificial Sequence: Synthetic polynucleotide
ttagggtayggygttagyggatttayggagaaggagaaaagttttattgtygtgtagaagtttaggttygggtgagaygtttgygaaggttgttagtagyggaagagaaggggygtttttygtgttgygtagtattygttygyggtaggtgggygyggagtttagagttgggagttaaaygtaaaygttggygagaagttt

SEQ ID NO: 4663 - DNA, 244 bp, Artificial Sequence
  Description of Artificial Sequence: Synthetic polynucleotide
gtttygttgttttagyggtygttgttttagaaaagttaaygagaattagatgtggtggttattgtygaatttttttagagtyggtgattggtttttagtygagggttttagttaattagtttgttgggtgggtttggagtttygtttygtttaggygttygyggagatttaggttygaggttggygyggygyggagagtgggttggaggtyggggygggaygygttgtgtagygggtaagygta

SEQ ID NO: 4664 - DNA, 201 bp, Artificial Sequence
  Description of Artificial Sequence: Synthetic polynucleotide
tttgttyggttygttgaaggttggttttgggtttgggggtagtgttygygaagggttgygatggtaggtttygttgttatayggtatygagggttttttygtttyggygttaggygtaygtttttttgttatatttttygyggggygygtygttagggttatttgtttttttaagtttygttaggtagttaagggtgagga

SEQ ID NO: 4665 - DNA, 457 bp, Artificial Sequence
  Description of Artificial Sequence: Synthetic polynucleotide
ttgagggaggggtygggttttygggtttgtagattygttatygygygtgygtatgygtyggtygygagttttygggtgtaggtttgggyggtttyggttygygtatttgtttaggygttgyggtttagygygttttaatttttagttygggyggagagygggggygggattgaagtatygtgttttttaaagtattttttygtygtyggtagttttggtttygtaaatgttttagygygtttaggygtaygtagagattggygyggtagttttygggttaayggtaygygagtaaagttggttggygatttgggataygtagtagaagttgaggttgtatygattttygtygtttygggggaggtatgggttygggtaggtttaggaggaagttgtatagttygaggttygggygggagtggygggtygygggtaagggaaygtatatttggaaggg

SEQ ID NO: 4666 - DNA, 244 bp, Artificial Sequence
  Description of Artificial Sequence: Synthetic polynucleotide
gygttttttttgygygyggygaggtygagaygtttttygyggtgatagygtgtaaggyggagattyggygygtttttagtttagggaaagtttaggygaygygatygtaagttygagtttaggtttttyggagtygttagggygygtygggttgtttgtttttttgtttttttttgtaggaatttttygtygttygyggtygggatttygggtttttttygggygtagattttagttatygttt

SEQ ID NO: 4667 - DNA, 206 bp, Artificial Sequence
  Description of Artificial Sequence: Synthetic polynucleotide
gagygtagyggyggggtatggaagaagagggttgggggygygygttatttgtaaaggttttygaggtttttttttagttttggtggtaatttygtttagygtygygtttttttttagatttaaatttttgttgggtttttygggtggyggyggyggygayggyggyggttgttggagttaagttttgtygttygtagygtyggggc

SEQ ID NO: 4668 - DNA, 203 bp, Artificial Sequence
  Description of Artificial Sequence: Synthetic polynucleotide
agagagatagtatgagaaygygtagagttgtatttygygggggtygggygttagtagtatygygttgttttatttayggygygtttgtttttygygttgygygtttagyggggygtygagttttagaaattttagtatatggtyggttyggyggttayggtggtygtagttgttttgtttttygagygttttttattgttttt

SEQ ID NO: 4669 - DNA, 266 bp, Artificial Sequence
  Description of Artificial Sequence: Synthetic polynucleotide
ygtgattatttttygttttattttyggggyggggttygttagaaattttaagygttygtaatygttttttttygtgggygggatggggaaattgaggttygaggtygtttygttggttggtgtaagaattagtttgtaatttaagttttgagttgttggygtttygtttygtgtagttgaatttaatttattyggggttgtgggtagygtttttttggggttgataygttatttygagtttgaggattaagatyggagtgatttgg

SEQ ID NO: 4670 - DNA, 242 bp, Artificial Sequence
  Description of Artificial Sequence: Synthetic polynucleotide
ttygaatttttttaaatttggyggttyggggygygtgggggggaygtttygttatttgygyggttataaaggagagatttatggtgtygttgtagttagygttygagttttygttgttgtygttgtygttgygggttagtygtttgtatagttggyggggatygggttgagtagygagygttyggagatygtayggygtattyggttgtttttgggtttttggttttagatttttattaggc

SEQ ID NO: 4671 - DNA, 201 bp, Artificial Sequence
  Description of Artificial Sequence: Synthetic polynucleotide
taaagtaaaataggataaaygatygyggygygtygaygtttggygggttayggttataaagygggttttagagttttttttaggyggyggtaaagggggygttygaggttatyggtaagagatagattattggygtttygggaaaatagagtggggaagggygagattgtgtgtttatttaygttygygygggtttgagtt

SEQ ID NO: 4672 - DNA, 201 bp, Artificial Sequence
  Description of Artificial Sequence: Synthetic polynucleotide
aygttggygaatgattatggaaataatatttaatagtagtgttttttatgttaggtatataatygttttggygtgggttgataattatgtttattttatygygtggtattgagtygatygtatatttagggtttyggtttttagggttygtttattygtttattgygtgaagtatttattttygtaggagtyggagtagga

SEQ ID NO: 4673 - DNA, 312 bp, Artificial Sequence
  Description of Artificial Sequence: Synthetic polynucleotide
tggtygtttttttygyggttaggygtattttgtagygtttagatygtygygtttttattygygtttttaatygygagygttygtttgggtygggtygggygttygagattygggagagattaggggttygtaaagtagaagagtagatttagaaagaaaaaaaaaaaagygagaagtgygagaaaaatatattgaatttagttaaatatayggtagatgaaaaaaatattttgtttagaagttaaaaaygagttttygagtygtgagatattgttgygttttygttaggygtgtaggtyggatgttaggggg

SEQ ID NO: 4674 - DNA, 203 bp, Artificial Sequence
  Description of Artificial Sequence: Synthetic polynucleotide
gygttggtagggggaggtttyggtaaygtttgggggttttaggttagtttttttygggttggaaggtatygtataggggttttygttaatttyggttttygygyggtygggatayggttatatttgttygygggggtttgttttttaggtygtygtaggtttttyggagtttaagaggattttataagtagttaaagttagyg

SEQ ID NO: 4675 - DNA, 201 bp, Artificial Sequence
  Description of Artificial Sequence: Synthetic polynucleotide
tttyggggygggyggygaggggygggagtttagagagtgtttygtttttgtttagtgttgggyggygygtggggggggtagggttttygtttttttaygyggtttygygtattttaaggattttaatttgttaggtgagtttttgtttyggggaggggygttgggggyggyggygaggatttagttgygygygygtatgyg

SEQ ID NO: 4676 - DNA, 283 bp, Artificial Sequence
  Description of Artificial Sequence: Synthetic polynucleotide
gtggtaaggtttggggattgagaggttyggtgagtgttagtttygtaggttgygtyggtgttyggtttttattttagttygggggttttaggtttttygygggttttggggygttggtgttygygtagttttagtygttttygtagttatygtygttyggtttygyggaggyggygygtagygggggygttygggygttgtttttttgaggtttygggggtttagggtggttygtagtgttattggttagggtttgygatttttggggttygtygtygtygtt

SEQ ID NO: 4677 - DNA, 201 bp, Artificial Sequence
  Description of Artificial Sequence: Synthetic polynucleotide
gaaygttttttagttyggtttggtattggygtyggtgttttttattttggttattayggtttttagggatttgtgggaggattatagtygttatygtttygattataagattaattatttgggttgtttggtttttagtaggtgagttgggygggygggygagygagygygyggtggygtagggtagggygtttygggaat

SEQ ID NO: 4678 - DNA, 247 bp, Artificial Sequence
  Description of Artificial Sequence: Synthetic polynucleotide
aggygtagatttaygagttggagyggygttttyggtagtagyggtatttgtyggygttygagygygaatatttggttagttttattygttttaygtttaygtaggttaagatttggttttagaattatygttataagatgaagygygttygggtygagaaaggtatggaggtgaygtttttgttttygtygygtygggtggtygtgttygttttggttagggayggtaaattatgttaygygtttaa

SEQ ID NO: 4679 - DNA, 427 bp, Artificial Sequence
  Description of Artificial Sequence: Synthetic polynucleotide
tagygygtttygggtttygygygtygttagtttttggttygttygtyggtttygtygygttygttagtttygtagyggagtttyggttyggtttygggtygtygttattaygtygygygtygtatttygygttaagaatggggyggttaagttgtttaagtygttygtygtygtygtygtygtygyggtygaggygttyggygtyggygygggtatggagygttygtagagtygttttagtttgttygtttttttygaggygttygttatttatttttygtgtatgaattttttygaygaygaggaygtaggtaagygygyggttygttttttagattttyggggtgtttygggatttaggttyggtagtttttttttygattygtgygtttttttttttatttttaattttttgggaaggygtttt

SEQ ID NO: 4680 - DNA, 246 bp, Artificial Sequence
  Description of Artificial Sequence: Synthetic polynucleotide
ttygggggyggttgtaygtggtygtggttttgaattttttgygggggtttygaaattygtttgyggggaggttagggygatagaggattygggagttatygttggtgygtggyggygtggagygygtttgttayggttaaggtgygggttyggtttyggtttattttaaggggttatygggatgygaagttygggaygttygtygtygyggtgatttyggygggggygtatttyggttgtgggtyg

SEQ ID NO: 4681 - DNA, 384 bp, Artificial Sequence
  Description of Artificial Sequence: Synthetic polynucleotide
tggtggyggaattttyggggyggtyggaggyggyggtyggggagtygagaagtaagtattagygttttaggatygygygygtygtttygygtygtttygygtygtttttyggtttagagtttttattttyggtttgtgagtttgyggygttggtggagttyggttttaggaagaggagtttattyggttttttttgattggatagtagygaggttttatygggygttttygyggtttaaaatygaagygggggygagggggaggtagagttygttttttgygygtygyggttgggagggagaggaggtgggagagaaggaagaggyggaggaggtagygggygtygaggttttgggattygtaggtaagttagatygaygygta

SEQ ID NO: 4682 - DNA, 415 bp, Artificial Sequence
  Description of Artificial Sequence: Synthetic polynucleotide
yggggggggtaggggtttygggtygyggggtgygggggttgygttaaattttygyggggygtttygggygtayggagggttyggygtttattygttygayggygttttatttattggygtttayggttygtaggtaaagygtggaaggagttgaaygyggyggagaagyggtttttygtggaggaagtygaayggttgygygtgtagtatttgygygattattttaattataagtatyggtygygtygtaagaagtaggygygtaaggttyggyggttggagttyggttttttgttttygggattagygttttygtagttatygttygagttttttttygyggygtttggttyggttygygtttttygygagttgttttygttgggygtygagttygayggtttggggttgttta

SEQ ID NO: 4683 - DNA, 543 bp, Artificial Sequence
  Description of Artificial Sequence: Synthetic polynucleotide
ygttggaagaaaaatttttygygygtyggtagaattgtagygtttttttttagtgatttygggagtttyggttgtagtyggttttgygygtttttttaaygaataatagaaattgttaattttaataatttagagtaggttaaygaggttttgttttttygattygaattaaaggtttttygtttygtgygttgttaygagyggtgttttttggggttttaatgtagygagttgtgttygaggggttyggaaggygtaagttgggtagygatatggggaaygyggagygggtttyggggtttyggagttttgggttagtatttaygttgttgttgttygtygyggygttattggtygtgtyggaygtattygggygttttttygaggaggaygaggagttagtggtgtyggagttggagygygtttygggataygggattaygygttttygtttgtaygtttttgattagtagttggatttggagttgyggttygatagtagttttttggygttyggttttaygttttagaaygtggggygta

SEQ ID NO: 4684 - DNA, 227 bp, Artificial Sequence
  Description of Artificial Sequence: Synthetic polynucleotide
tttagggygtagattttttattgtttttygggtttttttygggttttttttttgatttttttttttttttttttygagtttttgtttatatttaggttgygtttyggtttggttgttaaatagaaygaygtttttgygtagagttgattaggggtggyggygggaggtaaggttttyggtatyggaaagtaaagtaaagaaaaaggtattgtagttatygtttttgg

SEQ ID NO: 4685 - DNA, 323 bp, Artificial Sequence
  Description of Artificial Sequence: Synthetic polynucleotide
ttttgtttygygattggygggagtyggagtttttttgaattyggygtttatattatgggttgagttygtyggygtygagggagttagtgygattyggttyggygygtayggttaaggtaygygygttggtataygygggygyggataygygyggatatataygtgygggataygttttttttygayggyggygttaatttttyggtaagtttagygttttaygygatttgttyggtttttaygttggttatagyggttgyggggayggggaggaaggtagyggggtggttttaggggtttattttgtagggttttttygaygg

SEQ ID NO: 4686 - DNA, 279 bp, Artificial Sequence
  Description of Artificial Sequence: Synthetic polynucleotide
ggygtagattatttggaaggggttgtggatgtygtgygtggtgtagagtatygggtatatgtagtgtaaagtgtaygattyggtgttggttttgagtatygaggtgtaggyggygygggygtttatygtgagygtygtgttgttggygttygttgygtttttygtgattttggygggygygtagtgtattatttgygtggtttygggttyggttaaggygygtgtggtttttaygggaggygtgttttatttgttttgygggttgttggygttygtgtt

SEQ ID NO: 4687 - DNA, 261 bp, Artificial Sequence
  Description of Artificial Sequence: Synthetic polynucleotide
ttttygtyggtggaggtygyggttggyggagatygttaagttagaggaggggattygaggtttyggttgggygaaggttttggagggggagaagayggtygaggygtggaggggtagtygyggyggggygatttttatttgtttattgyggggtttgttygtggggtyggggtagatttygtaaaggaygygtagtttgtaagttygyggttygygyggygyggggatggggagygtgtgygtygaggagygygygtygag

SEQ ID NO: 4688 - DNA, 364 bp, Artificial Sequence
  Description of Artificial Sequence: Synthetic polynucleotide
tgtaygygygygtggttygaygygaggttyggtyggttygggttyggggygagattgggggtttgtygttgtygttatygttygagygtaggaaatygtygttatttgatttygttattaagtttaaggtgttttggatttayggtaagtatagygtygttgtagttggtygtgygtttttattatygtygttaggtttygaggtygygtttagttttagtaagaggaaayggaygtttagygataaatyggygtatayggtygaatayggtagttttyggattygygatttaaygtygygtttttyggggttgttygaggaggygatagttttygttgygttttygtygtttagggttygagc

SEQ ID NO: 4689 - DNA, 242 bp, Artificial Sequence
  Description of Artificial Sequence: Synthetic polynucleotide
tagggtggaggyggtgtttgattgtttttttgygtgtgttttgggaggtgggtttgttttggggatagaggtgttggaygtgtaggagtagatatgtygygygtttygaggaagygtyggaattattagaagtatagggaygygggtgtygagagtttttagtattgaaaayggggatttttttttttgtaagggattttttttttttgttttaatttatttttttagatttaagggaygtt

SEQ ID NO: 4690 - DNA, 285 bp, Artificial Sequence
  Description of Artificial Sequence: Synthetic polynucleotide
tagtttygggtyggggtggttgttttattttygtggtttagggaggaggygttgggtgygtatgtttaggggtgtgttygttgttagggttgtagyggtygttatttttaattagttgtaagtygagttgtttatttgggatygggtyggttyggygggtttggttttyggygaaggyggyggygttggtgygyggyggttggggygygggaygtaggtagtgygtggygyggttggygttttygggygtygttatygagygagggtgyggtttygggyggtygt

SEQ ID NO: 4691 - DNA, 222 bp, Artificial Sequence
  Description of Artificial Sequence: Synthetic polynucleotide
ygttatygttgtygtygttttttygyggagtgaygygttttgtagttaatyggggtagtygggggggaggttygggaggggttttgggyggagtygggtygtttttttattttaygggttyggggttgtttttttygaaaattttagttttaattgttttgggaatgttygaggtagagaaagggagygagggagtaagtaagaagttggaggattagtgtt

SEQ ID NO: 4692 - DNA, 201 bp, Artificial Sequence
  Description of Artificial Sequence: Synthetic polynucleotide
gtagygttttttggtttygygygtygttygggggtygttggttyggtgygtgtggtygtttygtygtttggttggagtttgtttygyggygtagggttgygtttygagggttygttggttyggtggtttggggtttgttyggtttagyggtttatggttyggttttygygttttagttttygtygtygtygtygtygtygt

SEQ ID NO: 4693 - DNA, 298 bp, Artificial Sequence
  Description of Artificial Sequence: Synthetic polynucleotide
tyggttttgggtggyggygtyggggtagygygttyggtygagtyggggagaggagygygggagattyggagyggagyggtaggagagygyggagygaagyggtaggagtagtttatagttaggagygttttttygtttttaaygtygygtttttttttttaaaayggtttaaaaaaatttattaattgtatggtygygtatttttaaaaaggtattygtygttatttggtttyggtgaattttaggaggyggaggaagggygyggggtgggtgyggtgatatygtgggaggtggtttt

SEQ ID NO: 4694 - DNA, 272 bp, Artificial Sequence
  Description of Artificial Sequence: Synthetic polynucleotide
tatttatttygattygaggttgtttattyggtttggtatgtttyggygtttttggggtttttgtatttygttggtttttygttgtggtgtttygtagttygattatttttgtgtttttaggagtttattttgggyggtagggaggygttgygtggggtttaygagttttaygttgttatttttattagtttttattttttaggygtttgttttttygtattgttaggttttgttttygtagtatttggtagatttgagttyggtttttgtta

SEQ ID NO: 4695 - DNA, 201 bp, Artificial Sequence
  Description of Artificial Sequence: Synthetic polynucleotide
tttagtaatatttgtagggttggtttttyggtygtttatttygttagtttgggtttttgtgtggagtgygtttttgtgtttttggttagtygtyggttaygtgtattttttgttaggggttggtaggttttttatttgtttaaattagaaatataaggtatagtggtttttagttgagggatggtatttttttttatgttt

SEQ ID NO: 4696 - DNA, 251 bp, Artificial Sequence
  Description of Artificial Sequence: Synthetic polynucleotide
taygtttttygygttygttygygtttgttttaggtttttatygyggttttttttgttttyggggtygttttgttttttatagattttattttygggggtygtttttaggattttygttygtttttttttgattyggtttttgttygtttygtttttttttttygggttttttatttttttttygtyggtttygatttygggggygtttyggatttgtttttygaatatttttagtttygtttttagtttgc

SEQ ID NO: 4697 - DNA, 249 bp, Artificial Sequence
  Description of Artificial Sequence: Synthetic polynucleotide
yggyggtttttatttggagtygtatttggggygtygagtttyggggtygyggaaagaatgygygtygttygtgygtttygtttgtygygtttggttattygtagtygtygygttygtatttgattatggagtgygtttttttgttygygtgtgttttttyggttgygggttygggttygtygaggggtttggygggattggggygygtggttaaggtaggtgtygtygagyggagtttygagagygggt

SEQ ID NO: 4698 - DNA, 249 bp, Artificial Sequence
  Description of Artificial Sequence: Synthetic polynucleotide
tttttagagttaattttttagatttggaggtttttaaggttttygtaatttagtgagtttyggggtattaataaattttygygggggttatygygttygygaaygtagagtttataygtggattttygygtttgtgatgtttygattygtttygggttttygtatagataatgtygygygtttttttygtagttatttygggattygygtttygygtygttyggaygtttttttgygtttgtyggggat

SEQ ID NO: 4699 - DNA, 201 bp, Artificial Sequence
  Description of Artificial Sequence: Synthetic polynucleotide
ggtygyggyggtyggggtyggtgtyggygtttttttgggyggtagyggygaggagatgggtttygtygtygtygtggtgttygtygtgatygtygyggtygtygygtagagyggygygggttygtattattattattattattattaygtygtyggttattattattattygayggtyggygygttyggygtygygggtag

SEQ ID NO: 4700 - DNA, 201 bp, Artificial Sequence
  Description of Artificial Sequence: Synthetic polynucleotide
atggtttaggyggtygtttygygygttttagtttygtygygygtttgagttyggtgyggygttagaagatagygygtagtygtttttgagtygtggaggyggggattaagttggaaggagtagygattttyggatygagtygygagtgtgygtygttygtygttygtyggatttttyggatttttygatygtaagtgtygt

SEQ ID NO: 4701 - DNA, 251 bp, Artificial Sequence
  Description of Artificial Sequence: Synthetic polynucleotide
atygygtagttygygttttattgtygatyggattttaygttgttgtttttagygttgygygttttgygyggattygygttgttggaygtygttatttygygtttggggtttaygygagtygygagtttttgtttgtttttgygttatttygatttygygttttgtattygtttygggttygygtttygygttygtaygtaayggtattyggttttgtataygyggttggttttaygygttgttyggygtyg

SEQ ID NO: 4702 - DNA, 201 bp, Artificial Sequence
  Description of Artificial Sequence: Synthetic polynucleotide
ggggtttygttgagttgagttttgygattyggtttatgtgaygtgagttttattttaatttaagtgtgaggaagygaatagygttttgaaaygtagaaaygtgtttattygaattgttaaygygagygtagagtttattgataaagtaaaataagataaatygggagttagaaaatttagygatttataggatttatygtg

SEQ ID NO: 4703 - DNA, 201 bp, Artificial Sequence
  Description of Artificial Sequence: Synthetic polynucleotide
ttttagaattygygggttattygggagtttttttygtagtattagtygaaagtttttagtgtygaggagggygggtagttgtttttttygatttygtttygttygygyggaygttttyggttttaygyggggattatttygggattttygtyggatttygygygttygyggttaatttgygtgtatttgygtttygygtta

SEQ ID NO: 4704 - DNA, 201 bp, Artificial Sequence
  Description of Artificial Sequence: Synthetic polynucleotide
aggtygagttygtayggygttttygtgtagttagyggttagtgatygygyggttygggygtttttygygygttttagttttttagayggggttyggaygyggaygttttttttgtagttttgttttgatygttagggatgggttttgggtatttagyggttgagggtggggagyggttagygtttgatgtttagtttttta

SEQ ID NO: 4705 - DNA, 337 bp, Artificial Sequence
  Description of Artificial Sequence: Synthetic polynucleotide
gtggtttygttttagggtygyggggaggygttttygtgyggggyggagttgttatygttttttttttaattttyggggattgtggtttttttttaagttygyggygtttttagttgttttttattygtttygttygttagtttttttttygygygatggtttyggygttgagttatgtttttaagtttaagtttttygtgattttgttygttatttygtttttgttgttgttattygttattttgatgttygttaaggttagttgtatttttaggtagtttttyggatattyggygttttgtgtttattaaygggtatygatttygggagttttgag

SEQ ID NO: 4706 - DNA, 201 bp, Artificial Sequence
  Description of Artificial Sequence: Synthetic polynucleotide
tgttttyggygttttaygtgtggyggyggttagyggyggtttaggaggtagtyggtgagygtttgygagtagagtggygggggtygttgataggtttygygtagtttagtttagtttagttaygyggtttataggtggggtttaagagtagtttggagtaattyggygttayggagaggggtggayggttttgtaygggtt

SEQ ID NO: 4707 - DNA, 201 bp, Artificial Sequence
  Description of Artificial Sequence: Synthetic polynucleotide
ttttttgyggygaggtygtttgatgaatttaagggtattagtgtttygygagaattttttgtgggttgtgaygagaattaagyggagygtaatttttatygtattyggataggatgygttgygtaatttgtygtagtttttttgttttatttygggtggttygaagttgtaattttgttaattttttattataygttatgt

SEQ ID NO: 4708 - DNA, 201 bp, Artificial Sequence
  Description of Artificial Sequence: Synthetic polynucleotide
ttttgtagttttgtttagattyggaagtygtygaggaagggaggaaggygggggtggggagagygygattttaagygttggygggyggygaggaggggtygtagyggttygaggaagygtttggaggygttaggggygtygagtttttagggaggtygygttttygggaagttttttatyggttgttyggagtaggatygg

SEQ ID NO: 4709 - DNA, 1216 bp, Artificial Sequence
  Description of Artificial Sequence: Synthetic polynucleotide
gaagcgaagaggggttttttgatttgtaatatagaggaaagcgtcgttttcgtttagtttggtatttacgcgtttatacgtattcggcgtcggtcgggtcgtttatttgagttttaaaagttgttgaatttatatggttacgtttcggggagcggggttttagatttggttcgtttaggttatttgcgcggcgttcgcgttcgttcgttttcgtttcgcggcgtcggttttcggttttcggttcgtcgtttttcgtcgttcgtcggtcgcggggcgtatagcgagttagagcgcggtcgcgcggggttttatgtcggtcggcgcgtcgtcgtcgttggggcgtatggtttaggttgggcggttcgcgggggcgtatatttttcggtcggggcgcggggttcgcggtttttttcgtcggcggtatagcgaaggcggtagcgaggcggggcgtgtttcggcgttgtcgcggcgtagtaaagggttggggagtcgcggtttcgtttttcggggcggcgaggagggaggtcggcggcgttgtcgtttacggtgcgtgtttttcggcgcgcggtttttgtttttagtcggagtttcgcgtcgatggggcggcgttgtttagggtttggggtgacgcgacgcggacggacgcgagtttttttcgcgttgtcgggtcggggggttttgttagaggtttcgtcgtcgatcggcgttatttaagttgttcgggggtttcgtttgagcgttcgttttgtagacggtcgcggttcggagattggtaggaggcgggtacgagaggcgcgcggggcgagggcgtcgtggagcgcggggcgtggggacgcgcggcggcggcgtcgcgcggaggaggcgcgcggggatttcggggtttcgtcgttcgcgtttatcgcgttcgtcgtagagtcgttcgcgttgtttagtcgttttttttttcgcgtttgttttttcgcgcgttcgttttcgtttttcggagtcggttttaatttcgttcgttcggttcggtttacgttattcgtttttttcgtttttcgaacgggagttcgagtttttggtttggtttcggtttttgttcgtcgttttattttgcgggggtcggggtcgtcgcgggtggtggggggcgttgtgtttagtaggggcgatagcgtaggcggggttttttgtagtttttttttttattttcggtcgcgtttcggtttttattttg

SEQ ID NO: 4710 - DNA, 365 bp, Artificial Sequence
  Description of Artificial Sequence: Synthetic polynucleotide
ggtcggtggcgtttatttcgtatcgcgttgtttcgttcggggtattatggtttggggttggattatgttttttttattttagtcggcgttttttatttacgcgcgttgagggtgcggtgagttgagtgcggggttaagtatgttttggcgtcgatttcgtttaggggtttaggatttggcgtttaaggggttttttggcgacggagattttcgacgtagtagcgattcgcggttgtttaagttgatttcgttcgcgtttcgagcggttttgggcgcgcggggtttcggggattggaggatttcggggggcggcgtcgcgtggtggtcggaaggggacgttaagttcggggtgggcgtcggacgtt

SEQ ID NO: 4711 - DNA, 201 bp, Artificial Sequence
  Description of Artificial Sequence: Synthetic polynucleotide
gcggaaagtaaggcgcgtttatagtcgtttttttttttggaagttcgcgtttatttttgcgcggcggtcgtttcggaggcgtcgggttgggcgtgaggacgtcgtatttattattgggttcgcgagcgtcgttagtttagtcgttttttttcgtaggttcgggggtagcgtatttcgtaggttttataagtcgttacgtta

SEQ ID NO: 4712 - DNA, 201 bp, Artificial Sequence
  Description of Artificial Sequence: Synthetic polynucleotide
gcgttggttgggtagtttttgggagatgaagcgacgtaggcgttttaggtattggttgtagagttcgatgtcgttgtgttcggcgttttttatttatagcggttttatcgttttggggtagcgttcgtagagcgttagttcgtgcgagaagtcgattatttcgtttttcgtgtcgtggatgatgagtacgggcgacgtgat

SEQ ID NO: 4713 - DNA, 201 bp, Artificial Sequence
  Description of Artificial Sequence: Synthetic polynucleotide
tcgttttggtcgaagcgtagttcgagcgtcgcgacgcgttttacgcgtaggaagtcgtcggggtcgcggtcgtatatttcgaatatttcgcgtaggcggcgtacggagcgtagtagagtcgcgggggcgttcgattagttcgcgtcgttcgttattcgggtcggttcgtagtttagttcggatttttcgttcgtcgcgttc

SEQ ID NO: 4714 - DNA, 201 bp, Artificial Sequence
  Description of Artificial Sequence: Synthetic polynucleotide
cgtttcgcgttatgtatatttattgtggtgatgagagttcgcgtttcgtgttcgttacggttattgtgcgtttaataaaaataaatattgtcgaggagtcgtcgcgatgcggggcggacgcgcggttcggaaaggggagggggttttaggaagagttatattcgcgagtcgggtttgggttaggggcgaggggagagcgtt

SEQ ID NO: 4715 - DNA, 201 bp, Artificial Sequence
  Description of Artificial Sequence: Synthetic polynucleotide
gtggttttttggtttttttaggtagttaatattataattttttttgggagggggttcgtagaagggcgcgcgttgtttttttcgttttttaagttgtagcggggcgggtcgggagttagggttagggtttggagatttgggaggggatcggtgttagaagcgaagagttagggttagaaagttaggttaattaaggggggg

SEQ ID NO: 4716 - DNA, 201 bp, Artificial Sequence
  Description of Artificial Sequence: Synthetic polynucleotide
ggagaagggggttcgtgtaaattttaggttgacgatcgcgtacgcgtttttcgggttattagttttgtcgtttttggtggggtatatcgaggagatcgtcgtggggaatcggggatcggattgtttgatagtcgagcgttgaagattattttttttgagtttagggaggtttggttgttttgagttttttatttttgggtt

SEQ ID NO: 4717 - DNA, 213 bp, Artificial Sequence
  Description of Artificial Sequence: Synthetic polynucleotide
ttttgcggttggttaggaggagtttttcgtcgtttttattttagtcgcgtcgggcgttgggttcgatttttagtatttttggtattgatgtgtttggtgcgcgttgagacgcgaacgttttgtaagatgagtttttatttattcgtttttttttttttttatttgtttattttataaattgagtgtttggttattttggtttaggtaagaggt

SEQ ID NO: 4718 - DNA, 201 bp, Artificial Sequence
  Description of Artificial Sequence: Synthetic polynucleotide
gtttagcggtttgtatcgagagttaggagaggtttagatcggatttcgatttttcgaggcgcgggagtttacggagcgcggtgggcgcggcgttcgggtcgcgtagttaggtggggagcggcgcgtagttttagattcgtaggtaggtagcggcggattgtatttgtttcgtttcgtagcgttttttgtttgtcgtttttc

SEQ ID NO: 4719 - DNA, 201 bp, Artificial Sequence
  Description of Artificial Sequence: Synthetic polynucleotide
gcgttcgaggtcggcgcggtggggatcgcgggtttattattagttaagtttagttatttaattatttgtagagttgttgtaggtataggtttaggttttcgttttttattttttcgcgggtgatgcgttttgatagcggtcgcgggagcgggggtaaaggcggtagttggggcggcggcggcggtacggtcgagtgtttcg

SEQ ID NO: 4720 - DNA, 201 bp, Artificial Sequence
  Description of Artificial Sequence: Synthetic polynucleotide
tcgtaaggggtattcggttttgtgcgcgggggcggcgggggttttgcgcggggtcgggttgggtcgggttgagttggttcgtttcggcgtcggggattacgcgcgattggttagattttgtcgtgatttttggaaaattgtgattattttatatgttttgtttagttcggattttttgcgttaacgagttaggtttttttt

SEQ ID NO: 4721 - DNA, 324 bp, Artificial Sequence
  Description of Artificial Sequence: Synthetic polynucleotide
cggggttcgggttgggatcgcggggtgggcggtttcgagagcgtttcgtagtggttggagttttgggcgttgtaaagcgtgtttcgtcgggttttcgagcgtttcgcgttttcgtttcgttatgtttttgttgttggggttgtgtttggggttgtttttgtgtgtggggtcgtaggaagaggcgtagagttggggttatttttcggagtaggtaagtggagtcgaggggagtcgggtttcgggcgcggtcgttttttttttttcgtcggttcggtcgcggagtttttgttcgggtttttttcgatcgttttttaggtttttatt

SEQ ID NO: 4722 - DNA, 201 bp, Artificial Sequence
  Description of Artificial Sequence: Synthetic polynucleotide
gagggggcggttggaggattcggatttttaagaatttggttttgggttttgattcgggcggtcggagagaaggcgaagaagaggtcgagtagataggcgcgcggcggacgcgagagaaggacgcgggcgaagcgtttaagacgttcgtttttagggtcgtcgagttttttttttttttcgtttggcgcggtagtatcgcgg

SEQ ID NO: 4723 - DNA, 330 bp, Artificial Sequence
  Description of Artificial Sequence: Synthetic polynucleotide
agtttagtttagttaagtagtagagagaataggacggaggtttttattttttagggattgtagcgtttttaaatcgtttatttgcgacggtttcgcgagcgtgcgtagtttagtttttttcggacgttttcgttttcgttcgggtatatcgtgtttcgtatcgaggtagagaggggtacgcggattttagtttttgcgagtttttttgttcgtcgttattttatatttcgtattgttttagttgtcgttttagaagatgtatcgtttggcgcgtaaagcggtgtacggtttttagttcgcgcgtagtagtttggaggggcgttagagttt

SEQ ID NO: 4724 - DNA, 293 bp, Artificial Sequence
  Description of Artificial Sequence: Synthetic polynucleotide
gcgttttagttcgtggcgttgtcggcgtagatttcgcgtggggatcggcgaggttaattttttttgcggttcggggtcggtagagtacgtaaggggtcgcgggtcgcgtgggtttgggcgcgtcgtggtgggtaagcggggttagcggagcgggaattcgtatatttttcgagcggagtcgaggataggttcgtgcgggtcgcggggtttttttggcgttaggaagcggcggtcgaaggagataacgagaacgtagtttcggtttagggaggtttaaaagttgagatgttgaa

SEQ ID NO: 4725 - DNA, 201 bp, Artificial Sequence
  Description of Artificial Sequence: Synthetic polynucleotide
atcgtcggcgtcggtagttagagcgggatttagtttttatcgcgttttttattggagtttttttcggtttttcggcgagtgcggttcgtggggagtgggcgtcggcgcgaggaagtttttcggttcgggcgatttcggtttttgagcggtttttttttacgtcgtcgttcgttaggtcgacggaggatcggggcggggacg

SEQ ID NO: 4726 - DNA, 201 bp, Artificial Sequence
  Description of Artificial Sequence: Synthetic polynucleotide
cggcgttttacgttttttttttggagtaaattcgtttcgttttttttttggagtaaattcgtcgtattttcgtttgtatcgaaattttgagcgtcgtttcgcgttatttttagttcgcgttcgcgttgttttttttttcgggtcgtaggttgagaggttgggtcgtattttggttacgttttgttcggttttagcgggata

SEQ ID NO: 4727 - DNA, 226 bp, Artificial Sequence
  Description of Artificial Sequence: Synthetic polynucleotide
tcggggttgttagggcgtcgggttcgtgcgcggatattgggggcgtattcggttttcgggttaggcgcggttggagatttcgaggttggggttttgaagcgcgtaagtatttttttttttatcgcgtttttgtaagtagtttgaagttttaagtcgttgtttacggattttcgtttttaattttttaattgaaaaaatttgtcgaggagagtggaggtatcgttat

SEQ ID NO: 4728 - DNA, 363 bp, Artificial Sequence
  Description of Artificial Sequence: Synthetic polynucleotide
tattcgggcgcgggagtacgggcgggtcgggggcgtttgggtcggtttgtcgtggttcgggggttcggggcggcgcgatttatttggcgttttcggggtcgcgatttttttcgggaggtgtttgcgaaggcggttttgtcgcggtgggggtggggaggttagggtttcggatcgttggagttggggtcgtagttagtttttggcgagtgttttttggttgttgtcgtaggggtttgttttttcggattttttttttaatttcgtcggatttttttttttttttttttacgttcgttaagtttatggtttttgtaatgcggtgggtgtggttatttagtaaattgtaattgtggttttttgtaa

SEQ ID NO: 4729 - DNA, 201 bp, Artificial Sequence
  Description of Artificial Sequence: Synthetic polynucleotide
tttttcggagtgggggattgcgagggggtttcggttttacgaggtgcggaggaagagttcgaggtttggggcgaggcgcgcgggatagtggggttgacgcgtggtttcggcgtcgcgcggtttttcgaatttcgagtttcgcgttcggcgcggtcggggtttttaatcgttttttcgttcgtcgggatttttatcgggtcg

SEQ ID NO: 4730 - DNA, 201 bp, Artificial Sequence
  Description of Artificial Sequence: Synthetic polynucleotide
ttcgttcggcgttgtattttttcgtggttcggttgtaaggatttgcggtggaggtttggcggaggcgggttcgcgttttagagagagcgttacgttattcgagaaggcgacgttgggggttgttgagttttttaattttttttggcgcgttttgtttagaagtcggggagtttttggtcggcggttggcggggaagcgcgg

SEQ ID NO: 4731 - DNA, 267 bp, Artificial Sequence
  Description of Artificial Sequence: Synthetic polynucleotide
ggtgagttattgggatttcgttgttagggagtaagttggtaggtaggaagtagttaagatttgggggaattttttttagggaacgaatatagagaaggacgtatttgaaaatttcgtcgtagttattttttttttatgggaaagtttcgatttcggcgggtttagcgttattcggtttttcggggtgtggaatattgagcgaggtaggtgcggcgggagtatgcgcgcggggcgggtagggggcggttttcgcgtttttatttcgcg

SEQ ID NO: 4732 - DNA, 707 bp, Artificial Sequence
  Description of Artificial Sequence: Synthetic polynucleotide
agggaatggggagggttacgtatattttgtgcggttcgagtggttcggatggtatagtttaggtgttcgggttaaagttggtatttttaaagtttagaacgtaatttgggcgcgttagtataaattcggttttcggtttttttgaagttagttaagttcgtatagggtttttagcgtttggaaatttgagaggcgtggaagggtggggagtttcgcgaagtttttagtttttgggtgtttttcggtttcgcgggggagcgggtttggagttaaatcggtcggtcgtaggttggagtagcgggcgtcggagcgcgcggtggggatgttcgaaaaggagttagaggtttagtcggagagttcgagaatacgagggatgtttattttgtaatatggttttaagtttttttttgtttacgcggaagcgtttttcgttttatttcgggttgtgtagggtcgtttcggcgattaagtcgttttcggagtcgggtattggggagtcggtgttgcgttcgttgttggagtcggggttcgattgcgtcgttaggtagtcgggttttttttgggcggttatggtgggcgcgtagcgttcgggttttcgttgtcgtcgtcgttttgtttgcgttgtcgttttcgttcgtcggtcgggtttaattggtttttagcgtcgcggcgttagttcgtttttttgtagtcgtcgacgttatcgt

SEQ ID NO: 4733 - DNA, 201 bp, Artificial Sequence
  Description of Artificial Sequence: Synthetic polynucleotide
tggtgttgagtgcgggtcgggtcgtttttcggcggcggtgggtgggcgcgcgagggcggagggggtcgggagttttggtttcgaggtagcgaggagagacgggtaaatagtagagcgttaagttaagtttttaaagtgttaatagttgtagaagttcgaattttagcggttttaggggcgcgggtatagggttttgggttt

SEQ ID NO: 4734 - DNA, 201 bp, Artificial Sequence
  Description of Artificial Sequence: Synthetic polynucleotide
gttgttcggggttgttgtataagtcggtgatattgttttgcgggtttacggtttgtgagcgttgcgtggagttggggttcgcgcggttacgggcgcgggcgcgggcgcgggcgcgtgaacgtagtgttgagtcgtttgttggagaggtttttttcggtcgagtgttcgttgcgtaggttggagggttaggcgcggagtttg

SEQ ID NO: 4735 - DNA, 201 bp, Artificial Sequence
  Description of Artificial Sequence: Synthetic polynucleotide
agttagcgcggttttcgggtttttgcgtttatggcgagggtcgcgggggaatagtttttggtaggtaatttgtcgggtatttatttgagtttttcgtatcgcggttcgaaaatttgggagcgttttaggataaagggttagttttttggaattagtcgtgtgtgattagtgtgtgttagttcgtatgtgggggttttagtg

SEQ ID NO: 4736 - DNA, 201 bp, Artificial Sequence
  Description of Artificial Sequence: Synthetic polynucleotide
gttgcgtaggtatcgggtttcgttcgggcgtcggggtagggttgtcggggttagtaggtttttcgcgttttttttggcggggttttaggggttggattgcgggttttttttgtttttttttcggggtcgagtaagttcgcggggggtgtttttaggtagtaggagggtgaggtaggataatttttaggttttgtagttttt

SEQ ID NO: 4737 - DNA, 203 bp, Artificial Sequence
  Description of Artificial Sequence: Synthetic polynucleotide
atttttaaagaatgataaaataaagaagcgtacgttaggtttttaaggagatatcgtttttttttttttattattttttatttttattagattttttatcgcggattaaagatgaatttgttattaattaagtttttgtttaagttattttatttttcgtagtttttttatttgtcggggcggtgttcggcgtattttaggtt

SEQ ID NO: 4738 - DNA, 201 bp, Artificial Sequence
  Description of Artificial Sequence: Synthetic polynucleotide
tgatcgggcgtcgaaacgtcgggagtcgggggttaagggttcgagttaggaggtttcggagtagtagtcgttcgttttttacgtcgtcgtcgtcgttttcgcggttgtttggatacgggataatcgatttggggtttcgatcgtagtagagtcggaggggtgggtaggcgcgggttcgggagacgcgcggggaaacgcgcg

SEQ ID NO: 4739 - DNA, 201 bp, Artificial Sequence
  Description of Artificial Sequence: Synthetic polynucleotide
ttattttaaagcggtagcgtatttttagagttggttttttttttcgtttcgggttttcggatcggttgtaggagttttttttttcgggtcgggcggcggcgtttggcgttttcgggttgggttattgttttatgtttttttttgggcgtttggcgcgtgttttatcgtcgttatcgcgtttaaaggttaggttggaagttc

SEQ ID NO: 4740 - DNA, 208 bp, Artificial Sequence
  Description of Artificial Sequence: Synthetic polynucleotide
gggggcgttttattgattttttttggcgtttgtttttttttttaggttgcgttttttttatttattgcgagcgtgagttagcgttgaaggtttagagcgcgttgtacgagtagaagattttgttcggggtaagtggcgttcgtcgtggcgtaagcggtcgacgcgtcgatagggggcgatttcgggaggtcgggcggcggcgcggcgc

SEQ ID NO: 4741 - DNA, 201 bp, Artificial Sequence
  Description of Artificial Sequence: Synthetic polynucleotide
tattgatgaatgcgcgttcggattttcgggcggattttttttaagtcggttcgtttttttagtttaaataaataaataaagttagatggaagaaaaaagcgtttattttattttcgtcgtcgtttcgttcgttatttttgtttttgtttcgttcgtttggcgttttaatagagtatagtttggtggataaagtttttttat

SEQ ID NO: 4742 - DNA, 201 bp, Artificial Sequence
  Description of Artificial Sequence: Synthetic polynucleotide
gaaaggaaaaagcgatatttttgtttcgtatagagttaaatattggaagtacgagatagtcgacgtggattaggattattttggtttttcgtgcggcggcggcggcggcggttgcgcgcgggttttttgtggcgcggttttggggcgcgggcgcgggcggcggcggggttgcgggagtcgtcggggcgggaggcggagcgc

SEQ ID NO: 4743 - DNA, 595 bp, Artificial Sequence
  Description of Artificial Sequence: Synthetic polynucleotide
tttggttttcggcgttcggggttagcgtagttcggggcgagcggggcgcgggtcggggagggggagttgttcgcgtattttatttttttttttttcgggcgggcggcggcggttcgttgtatatatttcggcgtatttcgttaggtcgcgtatagcgtttcgagtttaggcgttttttcgtttttttttcgcgttttgcggcggcggcggcggcggtagtagtagtagtaatatggttgttgatgggtgtttggggtggcgttggcggcgggaggagttttttcgagtttttgcgtcggttgttcgttgttagttatggtaaatggtggcggcggcggcggcggtagtagcggcggcggcggcggcggcggaggtagtagttttagaatgagtagtaatatttacgcgaattattttagtttagacgcgttttttttttttttttttttttttttttttttttttttttttttttttttttttttttcgtttttggtttacgagtttaagatggatgcgtttattatttcggtgattatggaggtgtcgtgcgatagtcggggttaacgtatgtggtgggtttttttggtttttt

SEQ ID NO: 4744 - DNA, 201 bp, Artificial Sequence
  Description of Artificial Sequence: Synthetic polynucleotide
tttttttttttcgtttttttttttttttggagaagagagttggtgttaagagttagggattttggttgtgtgtttgcggatttgtagtggcggcggcggcggcggcggcggggaggtagtaggcgcgggagcgggcgtaggagtaggcggcggcggtggcggcggcggttagatatgaacgtcgtttcggcgtcggcggtg

SEQ ID NO: 4745 - DNA, 269 bp, Artificial Sequence
  Description of Artificial Sequence: Synthetic polynucleotide
tttatcgatcgtattatttgatcgcgggaaacgaaatttgagtttaggaatttgaattgttttacgtacgttcgttttcggataaattttttagaggatcgtgatttttttatttagagattatttagggagatgttttggatgggataagtagataaatggcggttcgaggaaaatgtaggaaattttatattgtagacgtttaagtattaattgtttgggtttcggggtagggaacgggagatattatttatcggaaatattatatt

SEQ ID NO: 4746 - DNA, 201 bp, Artificial Sequence
  Description of Artificial Sequence: Synthetic polynucleotide
cgcggtcgcgaggcggggttggagggcgttgcgggttgcgcggaggttgcgggaagcgcggggagtacgcggagttcgattagtagggagatcgcgtcgcgtcgggtataggtacgggattcgcgttttaggagggcgtagcgagaggcgtattgcgtatttaggggttgcggtttcggtcgtcgtgcggtgataagttga

SEQ ID NO: 4747 - DNA, 267 bp, Artificial Sequence
  Description of Artificial Sequence: Synthetic polynucleotide
tgaaatttagaggaaaataaaaatgtagcggtttttacggaggtttttggtttgtaggatatttgagggtggagataaggatgtcgcggagggaggattcgggagttcggtcgcgttttttagtttcggtattcgcgtttagcgcgtcgcgtttcgcgtttttcgcgcgtggtcgtttttcgcgggtcgggtcggggttgcgttgttatttagcggtcgcgcgtttagcgtcgcgttatcgtttttgtaggtcgtcggggtttttgt

SEQ ID NO: 4748 - DNA, 287 bp, Artificial Sequence
  Description of Artificial Sequence: Synthetic polynucleotide
ggtttagatttcgcgagtttcgggtttcgtttattcggtcggcggttttttcggggcggagcgcggcgtttttggagtcggtatttcggatttcggcgtcgtttcgcgtatcgttttcgttttagtttttagtggcgcggcgttttttcgcgatattcgcgggtttttaggagcgagtcgattttcggttgggtttggagtcggggttaagtttattcggagggagtacggagtttatttagttgtttttgggggtaggaggtttaggttttattttgtatatcgtt

SEQ ID NO: 4749 - DNA, 201 bp, Artificial Sequence
  Description of Artificial Sequence: Synthetic polynucleotide
cgatttggtattagcgcggaggttattttgcgtagtcgggtaggtacggcggtttttaggtattttcgtagtagttttagtttttggttcgcggcgtcgcgagggcgagaattcgtgggcgtcggttttttttttcgtcgtcggtgttttgtaaagtggaggtcggcgttttcggcgttttcgtcgcgttcggggtaggtc

SEQ ID NO: 4750 - DNA, 201 bp, Artificial Sequence
  Description of Artificial Sequence: Synthetic polynucleotide
cggaggtttacgttgagttcgcgtagcgcgtacggttcgtcggcggcggtggttttcgcgttgcgttgtgttcgattcggttcgcgcggatttcgttcgcgttattttacgcgtaggttttgtagcgtttttaggagtagtagcgttcgtaggggatcgtcgaggtcgtcggggttatttgggtagagcgcgagtaggcgc

SEQ ID NO: 4751 - DNA, 286 bp, Artificial Sequence
  Description of Artificial Sequence: Synthetic polynucleotide
gcgcgggaggcgtcgggggtcgcggaggcggggcggggaggggtcggcggcggcggcggcgcgcggaggagatcgtagtgcggtcggcgttaggattcgcgggggttttttaggtcgcggcgtttttcgtttttttttatttttcgattttttttcgtttttaaaatgaggaaacggagtaattcgttttaagttgtgtagtcgggatcgtttcggggtgtgtagtcggttcgcggaggtttttttgggggcgggcgcggggcgcggttcgggggcgttttttgag

SEQ ID NO: 4752 - DNA, 244 bp, Artificial Sequence
  Description of Artificial Sequence: Synthetic polynucleotide
aatgtttagtattatttaaaaagaaaattatatatattagttaatgatatattttaatttttaataaagttggtatttttttttgattatagattttgtcgtggtaaattcgggtttcgacgatagaggtagcgtagaagttcgtttttaaatgagataattttattaaaattataattttttgtatttttatagcgtttttttagtggcggagattttaggtgttttacgttagggtttatta

SEQ ID NO: 4753 - DNA, 201 bp, Artificial Sequence
  Description of Artificial Sequence: Synthetic polynucleotide
gttttaattttttttcgagatttcgggcggcggggattttttttcgggtggttgcgtgcgcgtttagtaattcggtgggtggaggtttggagtttcgttcgcggtcgttttcgttgattttttagtgtttttgtttgttttttagagtttaggtagttagtttttcgttaggaaggtagagtagcgagattttcggtttac

SEQ ID NO: 4754 - DNA, 372 bp, Artificial Sequence
  Description of Artificial Sequence: Synthetic polynucleotide
ggattcgtcgtttaggttcgcgtggggatcgtagggaattcgcgttacgtcgggggttattgtttatcgcgaggtgttgaagtggtttcgtgatcgtcgcgggtcgtggttgatatcgcggagaagttaggatttttatagtttttgttagatttgaaagtaagttggaaatcgatagttgttttagttgttttagattttaatttggtttgggttttttttttttttatttgaaaatagatttagggtaatgtttaagagaattttaatcgacggaagtggtcgggaaattttgttttcggtattgagggatgttatcggagatttttttgttttaggtttgtcggagtttattatattcgttaatgttat

SEQ ID NO: 4755 - DNA, 201 bp, Artificial Sequence
  Description of Artificial Sequence: Synthetic polynucleotide
aattttttcgtgttttttgtataatttgggagagacgtagcgttgtgggtgtagagttgtttagagagggttttaggttagggtagggaagagataggacgtcgcggggttcggttgtcggcgttgttgttattttatggttgaaggggattgaggtcgaattgggtaaggagaagtcggtcgtagattgtggagttgatt

SEQ ID NO: 4756 - DNA, 247 bp, Artificial Sequence
  Description of Artificial Sequence: Synthetic polynucleotide
ggggtaggattttagaagttatttaattagggacgttgggttggaaatcgtttaattaggtacggggtaggagaggatagggcggttttcgggatgtggcggggtttttgtttttggttgtagttggagttttgcgtttcgttttcgtttttttgtgttttttgttgttagaggtttagtttttgtggttttgtgatttgcgggtattgggggatttatagttaagacgttaggatttttcggaagt

SEQ ID NO: 4757 - DNA, 201 bp, Artificial Sequence
  Description of Artificial Sequence: Synthetic polynucleotide
tcgttttttttttcgggatgtcggatcggtatttttattatttttaggtttttagggggttttggcgttttagttgtggattttttaatattcgtaggtcgtagggttatataggttgggtttttacgtgtagaggatataaagtagatagacgaaaattggagtttcggcggtagcgagaaataaaggtcgcgttaaatt

SEQ ID NO: 4758 - DNA, 201 bp, Artificial Sequence
  Description of Artificial Sequence: Synthetic polynucleotide
ggattttgagttggggatcgtttaattaggtacgtaattggagcggatagggcggttttcgggatttggcggggtttttgtttttcgttgtagttggagcgtttggtttcgttttttttgttttgtgttttttgtttttagaggtttagtttttgtggttttttgatttgtaagtattgggagatttatagttaagacgtt

SEQ ID NO: 4759 - DNA, 235 bp, Artificial Sequence
  Description of Artificial Sequence: Synthetic polynucleotide
atttcgttttttgtaagtttgtaatatttcgtatttagattcgtaatttaggcggaggataaagggttgtagcggagggcgtagagtagatgtttagggcggggtagagggggcgggaagttggcgttacggtcgcggcgagggcgagtagtcgcgcgttttcggtgttaggaggaatgttcgtagagcggaggttggtaggcgcgagaggttttaagcgcgtagttcgattaag

SEQ ID NO: 4760 - DNA, 201 bp, Artificial Sequence
  Description of Artificial Sequence: Synthetic polynucleotide
gcggtatttcgttttcggttttgcgcgtttatttcggggcgcgtcgaggttatcgtagggtatttatttggtatttgtttttgagtgtgtagatcgtcgcggtttttatttgggtttttaaataagttttagggagaaagaaggaggtaaaaaaaaaaaatttaattatgtaaatggatttcggattgggaggcgcgggat

SEQ ID NO: 4761 - DNA, 201 bp, Artificial Sequence
  Description of Artificial Sequence: Synthetic polynucleotide
gtcgcgttaacgaacgtaggcggcgggaggttcggcggcggggttcgcgtttttgtatcgcgatcgcgttagaaaatatttcggggttgggcggcgtttcggagacgtatttttttgttatttttatcgtttttggtaacgattattaatgttattatgttttatttttttttattttttttcgtttttagagtcgcgttc

SEQ ID NO: 4762 - DNA, 201 bp, Artificial Sequence
  Description of Artificial Sequence: Synthetic polynucleotide
aaagagggagaaagagattaaaaaaagaaaaagataaggggagggggaaggaaggaaggagagaaggaggaagaagtttggggtttgttgttttaggagcgtttaggtagtcggtgttggagcgcggggcgttcgttttcgtcgggattgtcggtttcggggtttgcgagagcgttagagttttagtcggcgcgttcgggc

SEQ ID NO: 4763 - DNA, 201 bp, Artificial Sequence
  Description of Artificial Sequence: Synthetic polynucleotide
gtttttgcgcgcggaaaggcgttggaggcggttttatagtcggggaggttagcggcggcgtatttgtattttgggagacgtttggatttagtttaagttcgtaggttgggcgagcggagatttttgattttatcgtgtgggtgagattattgtttttcggtttaaaagaaaagaaagtatgttgtgaatttttgaaataaa

SEQ ID NO: 4764 - DNA, 201 bp, Artificial Sequence
  Description of Artificial Sequence: Synthetic polynucleotide
tggaatttacggcgtttcgttcgtttcgcgtttaggaatattgtgcgtttagcgtagatgcgtttttacgattttttgtttggttcggggttatgtggtcgcgtatcggtttttgaagtttttatttgattgttggggaaggcgtttagaattaggagcgggttggttggggattggttttcgcgttgggtcgtttcgttt

SEQ ID NO: 4765 - DNA, 296 bp, Artificial Sequence
  Description of Artificial Sequence: Synthetic polynucleotide
tcgggggtgggggtaagcgttacgtgcgcgttaggtttttggtgtgttcggtaggcggcgttgcgtggttgcggttggtttcgagggtgcggggggcggcgattcgggagggaaaatttttgttttttttcggggtttgttttgttcgttttttaaattcgttttatatttttttcgattttcgtttttgtaagcgttatttgtagttttatcggttttcgtaacggtggtggtggttggtggggggtttcgaagtttgtttttggttagtcggatttcggtgggagatggaggta

SEQ ID NO: 4766 - DNA, 201 bp, Artificial Sequence
  Description of Artificial Sequence: Synthetic polynucleotide
gtcggtcgagtttcgggagtcgaggttggaaacgttggagcgggcgttgtttatcgaaggcggttcgggatcgggacgcgggttcgagcgatcggagcgcgggttgtcgtggcgttggtcgtagtttaggttgatgtcgttggatcgggcgttgtcgttatcgtcgtcgtcgtcggatttcgttaggttggttcgtgggtt

SEQ ID NO: 4767 - DNA, 201 bp, Artificial Sequence
  Description of Artificial Sequence: Synthetic polynucleotide
attcgttattgtgtatttggacgttatttgtagatttagcgtttgcggggatttcggaaacgggagagcgggttttcggaaacggtgattaatgggaaacgtgattagatgttattaggcgaatagttcgtttttaggtaatatagaaggaagagacgtttttagttattttaaaatagacggagtttttagttaatggat

SEQ ID NO: 4768 - DNA, 266 bp, Artificial Sequence
  Description of Artificial Sequence: Synthetic polynucleotide
ggaaatcgttagttttgagcgtcggattttttgtgttgggtgggagtgggggttcgcggttttggtgttttaatttttggaggaggacgtcgggcggggcgatgtttgtgtttgtggttttttgaggtagtgggagtggcgtgtgaaggattgtgagagtttggcgtgaagtgattgttatttgttagatattcgtttggttgagtgtggtttcgggatcgtgttcgtaagcggatttcgtggaggcgtttttttttttatttttt

SEQ ID NO: 4769 - DNA, 201 bp, Artificial Sequence
  Description of Artificial Sequence: Synthetic polynucleotide
taaagaagtcgcgggtatcggtttaataaggtgtagcgaatagtcgttcgttttcgttttaatttatagttttatattttacggtgttattgattttttcgtatttagttatataggacgtggataggtatacggggtgatagtttcgtattgaacggtattaatttttattcgtatcggagttatatagatggtttgcga

SEQ ID NO: 4770 - DNA, 228 bp, Artificial Sequence
  Description of Artificial Sequence: Synthetic polynucleotide
aggatacgttggatagtttcgaaaagatatagtgggtggtttcgggcgtgggtaatcgggtgcggaattatagcgtattcggagttgcgaatttagacgcgggtgattgttgattttttgttttgtcgtttttatttgtgtatgtaggtggcggttagttggggttagggaagcgtggagggtgggttttaatcgagttaagaaaagtttggggtgttttgaattttg

SEQ ID NO: 4771 - DNA, 248 bp, Artificial Sequence
  Description of Artificial Sequence: Synthetic polynucleotide
tcgggattgagtttttgtagttttgaggtttggaggttcgggcggtagtaattgtgtcggattaggttcgtgggtgcggtttgtggtgtagttggagatcgaggtttcgcgtattttcgttcgcgttttagttatttaggttcggtcgtagcgaaaaggtttaagagggaagttagaggtgaacgttttaggatgaaggttttttgtaaaacgttgggatttagatttggggtgggtgtttggggttt

SEQ ID NO: 4772 - DNA, 387 bp, Artificial Sequence
  Description of Artificial Sequence: Synthetic polynucleotide
aagtcgaggtgttggaggacgtgttgcgggagtagttcgggtcgttgttttagttggtcgttgtttgtcggtttaagcggttgttttcgggcggttattcgtttattgaaaatttttagttggtgttggagcggcggcgtgtggttaacgttaaggagcgtgagcgggtgagggatttttagggtcgacgttcgttttttttttttttgttttattattaaatatttggttaatattcgggggttcgtttatcgtttattttcgttcgaggcgatttcgagttttcgaggttttttacgtttttagtttgttaggagaatggtagtggttttttttttttgtattttcgtgtagttgttcgttggcggtcgttgcggtggtcgtttc

SEQ ID NO: 4773 - DNA, 203 bp, Artificial Sequence
  Description of Artificial Sequence: Synthetic polynucleotide
cgatttaggttttttagttttcgtttagtttttcgcgtgcgggcgtcgggatcgtagtatttgtgacgtcgaagtttagtaggtcgtagacgggagttacgcgcggttttggtatagggtaaaaatttacgtttaggtaggcgggtagttacgatgtcgggtaagtttagggtagattttcggtggcgtatagggaagtagcg

SEQ ID NO: 4774 - DNA, 203 bp, Artificial Sequence
  Description of Artificial Sequence: Synthetic polynucleotide
tgcgaataagattaaggcgaggtgaggtttaggttttcgggattgatagcgtcgcggtagggggttcgaggcgggagttggggattttagcgttttttacgcgcgttttacgggggttgtcgttaataaaggcggagggtaagggtgcgtttatttaagtaagggggacggtgggtcgttcgggttgagtagcggagcgtagc

SEQ ID NO: 4775 - DNA, 312 bp, Artificial Sequence
  Description of Artificial Sequence: Synthetic polynucleotide
ggtttaggaggagtcgcgtcgggttcggttataagaggtcggttagtaggcgtttcgttagtattcgttcgatttcggttcggagtatcgggcgtttagcgcgggtgaaggcggagtcgtagggttggtttttaaagggatgttttcgttcgagcggcgagattagtttcgttcgtttttcgtcgcggtcgcgtcgtagtcgtttacggtcgtcgatatggttttttattgcggcgataatttcggagtgtattcgtagttcggtttgttttcgttcgtcgttatcgtcgtcgtttcgggcgttttttcggt

SEQ ID NO: 4776 - DNA, 407 bp, Artificial Sequence
  Description of Artificial Sequence: Synthetic polynucleotide
tttcggttcgcgggaggtagttgtattaagaaggtgaggacgttgagcgggggttcgtgtttttcgtcgtcgtagtttttattgtcggcgcgcgtttttcgcgttcgttatagtagcgcgttaggcggacgtcgcgggaatttgacgttcgaggttcgcggtttttaatgagagttttagaatatttttcgtttttgacggttagcggtagcgtcgtcgtttttcgtagagcgttcgttttttcgtttttagagttttagttttttttcgagcgatttcgtagtttttttttcgtttttattcgtcgtcggttttgtagttcggttttttttttagtttaggcgcgcgggttgtagtgggcgatcgttttttttcgatttttcgtcgtgtttttgggtttttcgaag

SEQ ID NO: 4777 - DNA, 295 bp, Artificial Sequence
  Description of Artificial Sequence: Synthetic polynucleotide
attttgggtcgcgggagaagtgcgtgtagttcgggtaaggtcgggcggggtcgggcgcgggcgggcggtcgagggatgcgatagggtcgggtacggtttcgtattttttcgtattcggcgtcgtcgtttcgtcgttttttttcgtttgtagggtcgtttcgggtattttagggttgttgaggggcgggcgggtcgtaaaagttacgagagaggggcggtagggcggcgcggtttgcgagcgtcgcgggatttcgaggagcggcgcggggagtataggggcgcgcggggcgggcgc

SEQ ID NO: 4778 - DNA, 435 bp, Artificial Sequence
  Description of Artificial Sequence: Synthetic polynucleotide
ataattttggttttatatattttatatgtttcgtataaagaaatagaaagcgggcgatacgttttgggagggcgggttggcggtttttttagttcggagcgcgtggaggttgcgcgtaggggttcgggacgcgggatagggatttcgcgtagtttaggcgtcggggaatcggggttggagtcggggatttgagtttagcggacgtttttttcgtttggaggttcggtacggatcgggatattagggcgttcgtggtcgtggttcggtttttggttgttgcgggtcgcggtttttagtgggtttttaggatttttttttacggcgggtatttatcgaggttgagaggttacgtcgtgttgttggggtttttcgtcgattatatttttgggcgttagttcgggtagagatcgcggggattggttaggtcgggttagg

SEQ ID NO: 4779 - DNA, 410 bp, Artificial Sequence
  Description of Artificial Sequence: Synthetic polynucleotide
tggttgtgttagtcgatatgagtttttttttttttaggaaggcgtaggattcggggaagttttcgcggttaggtcgtttgtttattcgtagatttcgggcgtcgttcgcgttttttgttttttattttttaatttttgcgtggttttagggtttatatttttggagtttttttttttagtaaatagtgttgttttttatttaatagtagaggcgtttaggagtttaggcgatgtgtttaaggtcgaatagagggatagtagtgagttgtttaatttttttagttgcgtagttaggatacggttgggggcgggtggagatgtggcgtagggttagggttcgggtttcgggaagtaatgatcgagggcggtgattattgtttttagtttttcggcgggtttttttttaaggg

SEQ ID NO: 4780 - DNA, 392 bp, Artificial Sequence
  Description of Artificial Sequence: Synthetic polynucleotide
tggaagtattcgttttatcgcggggtttggtatttaggttttgggatttttgttattgttaaggattttttcggggattcgagttttcgggttgaggatcgcgggggattttaggtcgggacggagttttttttggttcgttgtgcgcgtacgtttggaaaggcgggatttaaggtagcgatgttgcgggaggttttgtagtgttaacgagttttcgaacggtttcgttttattttttttttgtgtgtttcgtaagtttttgtttagtaaatcgttatagtttcggcgcgcgagagtggcgttggtacgtttaaatttcggggtttttggttaggttaggggggcgggcgtgcggcggggtcgggtcgggtcgggtgcgtttagcgggtttc

SEQ ID NO: 4781 - DNA, 203 bp, Artificial Sequence
  Description of Artificial Sequence: Synthetic polynucleotide
ttcgattttagttcgtcgtcgttttttaggcggattttttagaggtaggttttagttttcggcgcggggaggcggcgcgttttagaggggcgtagggtgcgcgggggtcgttggtttttcgggtattttttttttgcggttttttcgttttttttcggagttggtgtttgaggtcgttgggattttagtttggcgtttttttt

SEQ ID NO: 4782 - DNA, 398 bp, Artificial Sequence
  Description of Artificial Sequence: Synthetic polynucleotide
gggttcggggataaagggtgacgtgtggttttggggaaggttcgggatgagggagttgaatttagttgtttcgcgcggtgtttagagtgttttatcgcgcgtaataaattttcgtagatatcgtatttttaatgcggtgtttttttgtgttagtgtttcggcggtttttgtagggtgttaatgttacggttgtatatcgttttttttttttattatttttatttgaatagatttggaggaggcggaaatggaaattagggtatgtttataagttggattcgttagatttttttgttcggcggtatgtttgtgtatgtttgtatgtcggtaaggagttacggatagggaaggtttaagagttggttatttgagcgtagtagatgggttttcgtagtttt

SEQ ID NO: 4783 - DNA, 286 bp, Artificial Sequence
  Description of Artificial Sequence: Synthetic polynucleotide
gtcggtttttttatatttacgtgtttttcgtgtgcgcgttttcggtttgtagatgttataaggttggcgtcgtttggattttcgggcggttttatttttcgcggtcgttacgtttcgttttttgtatttagtttttttggcgttttcgttgtagtatttaagattaggcgtcgtttttgttagtcgtgttgtttagtacgtttgagggtcgttgtcggtaggttttatttttcgttcgggttttttatttatttttttttttggacggtggggtttaagttttgta

SEQ ID NO: 4784 - DNA, 267 bp, Artificial Sequence
  Description of Artificial Sequence: Synthetic polynucleotide
ttttattttttttttttttttttagtttggttgaagaacgtttttaaggaaattcgggttgtttttttttatttggaagtggttttttttatatcggttcgtaaattgattatgaaatatacgatgttaattcggagttgtattttttagttgggtattttcgcgcgttggttttcggggtttcgttttttattttttgtttttttttttcgcgttttgtttttattttttatttttcgcgttggttatttcgtttttttggtagtt

SEQ ID NO: 4785 - DNA, 260 bp, Artificial Sequence
  Description of Artificial Sequence: Synthetic polynucleotide
gaaattacgataggtttgtattatcgtttttttttttacgttttcgtttaggtttgtaaagtcggttgtttttggttaataggcgttttttttgttttacggtgaaaattagtttgtggtgtattgagatttgtaaattattttttgaatgttaggggcgttgtaaaatagtcgtcgggtgtagtgggtcgggcgttcggttattttggttgcgattatcgtagttttttaaaggatgcgggtagatgtagacggttttg

SEQ ID NO: 4786 - DNA, 239 bp, Artificial Sequence
  Description of Artificial Sequence: Synthetic polynucleotide
gtgagcggggtacgagagtgtagggtttcgttggtgtttttttttcggcgttcgtcggatttatcgtttttatcgttgcggtgttcgaattcgcggattcggatcggcggtagtagaagcggtagcggtaaagtattcgtagaatggggtatcgcgaaatagttttttttttttttttttttgttggtggtgtagtcgcgatagttcgttttttaggtaggggtttggagtttgttttt

SEQ ID NO: 4787 - DNA, 846 bp, Artificial Sequence
  Description of Artificial Sequence: Synthetic polynucleotide
ggtggtttttggggtagatagagtaggatttgtttttgttttttgtttttttcgtttttttttttttagcggcggcgatcgtagtaatagcggtagtggcggttgttgttattgttttgtcgttgtcgagtcggttatttgggtattcgcggagtcgcgtcgttgttatcgtttcggcggtttttcggagtgcgcggagggggcggcggaggagcgagatatttatagtaatcgaggatgcgaggggcgtttagtagtagcgagtgtttgggagttaggaggaggttttcgcgcgtcggtaatttttagtgttaggcgttttgtagttttcgcgcgtcgcgtttgggttcgtatcgttttcgtagtgagggttcgttcgagcggtaagtttttttcggcggttaagtcgatatttttttttcgtttcgtcgtttatttcgggtagtagtcgcggaataatggagagcgtagttagtagttttggagacggcgttcgggggaggacgcgtcgtcgtcgtcgtcgttgtcgttagggtaggcgcgcgtcgcgtggagtcgggcgggtgcgagggcgcgcggcggggggtggggggtacgcgtcgcgcggggggcgggggtagtggggggcgcgcgcgcgggttcggggagttcgcggggagagttcggcgttcggcgtagcgcggcgcggttaagtttcgcgtttttttcgttttttttcggcgcgttcgttttcgtttcgtcgttcgtattcgttgggggcgtttagaaagatgtatagaggtaacggttaggggagcggaggtttaagttatatgtttgcgttttcgggggttagagttcgttagt

SEQ ID NO: 4788 - DNA, 526 bp, Artificial Sequence
  Description of Artificial Sequence: Synthetic polynucleotide
agttgtgaagaggcgtgggggtcgcgggaatttttttttggtcggtgcgatgaaagtcgggcggacgaggtggtttaacggggttgagagtggttcggtcgaggcgcgggttgagtttttagtatttggtttgagcggcgtgggtagtagtttgtatcgcggatatttttaattttgtcgcgtttgcgtcgtattttggtcgtggtagcgatttttcgggtatttttgaggtcgtttttagttttataagtatttagtcgtttattttagagtagcggcgtcgatcgttttaagaggagttagttttcgatatcgttttttatttatttttttatatttttatcgttggagggggtgagtgtcgtggataggcgttttcgttcggggatagtttagcggcggtagttagttcgattttttttcgcgcgggtcgtttaaatttgattagtagagcgagcggtttagcgtagtagtcgttttcgcggtttttagttgtagaaaagtaaagcgtcgggaggaagtagta

SEQ ID NO: 4789 - DNA, 201 bp, Artificial Sequence
  Description of Artificial Sequence: Synthetic polynucleotide
gtttttcgtagataagtaaataatttggacgtgaaatggaaatggtaattaatgtagtaatgttgttatatttcgagtgtgtaaattttattgattcgtcgcgttacggggggtgtcgggcgtacggggatcggtggcgtgcgtttaggttgtttattttttttttttttttttttttttttttaggttttcgggcggggc

SEQ ID NO: 4790 - DNA, 523 bp, Artificial Sequence
  Description of Artificial Sequence: Synthetic polynucleotide
ttttacgagaagaataagaagggttggtaaaatagtattcgttataattttagttttaacgagtgttttattaaggtgtcgcgcgagggcggcggcgagcgtaagggtaattattggacgttggattcggtttgcgaagatatgttcgagaagggtaattatcggcgtcgtcgtcgtatgaagaggttttttcggtcgtcgttcgcgtatttttagttcggtaaggggtttttcggggtcggaggcgtcgtaggcgggtgcggcgtggcgggcgtcggggtcgacggttacggttatttggcgttttttaagtatttgtagtttggtttttttaataattcgtggtcgttatcgtagttttttttatttatgttttatgttttttgttagatggcggtagtcgtagcggttgtagtagttgcggttgtagtcgcgggtttcggtagttttggcgcggtcgttgtggttaaggggttggcgggttcggtcgtttcgtacgggtcgtatatacgcgtgtagagta

SEQ ID NO: 4791 - DNA, 276 bp, Artificial Sequence
  Description of Artificial Sequence: Synthetic polynucleotide
tcgtttaggtagtattttcgtagtagtcgttaacgagttgtagtcgtcgtttattgttcgcgtcggttttcgtttttcggtgtttgtcgtatcgtgggtcgtttcgtcgtgttcgatgggtgcgtttttagcgttgtcgtcgcggcgttcggtttcgggttttcgtcgttgcgtcgttagttcgtcggtagtagtcgcgtttattggcgcggattcggagcggtttaggcgtttatttcgggacggttcgtgacgttacggagggagggaggtggt

SEQ ID NO: 4792 - DNA, 357 bp, Artificial Sequence
  Description of Artificial Sequence: Synthetic polynucleotide
attttttttttaggtaggagtagatatttgtttgtttttacggcgcgttagcgttttgttttagtcgtttttgggttagagttcgaaatttatttattgcgtttttatttcggtatagatagtttttaaagttgttcgtattttttagatttcgttttttgtttagttttcggatttcgtttaggggttgagttgacgttcgcgggtggatttttttggttcgttgcgtagggaattgatttcgggaatttagggcgtatagaggttaaagaagttgcggtaagggagggtgggtaaatttagtttgagtttaggtttttgtcgtttttatttttaagtttgttttgtttttttttt

SEQ ID NO: 4793 - DNA, 278 bp, Artificial Sequence
  Description of Artificial Sequence: Synthetic polynucleotide
tgtcgcgttgtcgtcgtagttagtcgcgtcgtcgtcgttgtcgtagcgcgggcggtcgcgcgtcggtagtaggggtttggcgaggaagtcgttgagtttcgcgcgtttcgcgtttttggcggtcgtagcgttgtttattaattgatttttttattgatttatttaatttttaggagcggttgttcggaggtacgggtttttttttaaatttgtagcgacgttttcggcgtgggtataaaggtttcgacggcggtcggcgggggttgtttagcgttcgg

SEQ ID NO: 4794 - DNA, 336 bp, Artificial Sequence
  Description of Artificial Sequence: Synthetic polynucleotide
ggtgatgaagtttgggtagaaattttttgtcggtcgttcgttttacgtttttttcggggtcgatattgttaattttttcgggtattgaggatatttttgcgttttggagcggtgggaggacgcggagcgtcgttttttggttttcgatattttgttcgttttttttagtgggtttgtggttgcgttttttcgaaggaagtaataaatttttttgattttgggggttagaggagacgttttagtttttcggaggggtgtgcgggcgggatcgttttttcgttttattggatttttggtcggggttgtttttgttttattgtgttttatatgcggagt

SEQ ID NO: 4795 - DNA, 311 bp, Artificial Sequence
  Description of Artificial Sequence: Synthetic polynucleotide
gggagggcggtaaggagtgcggaggtttaaacgggtatgagtacggggcggttcggtcggaggcggttttgggcgtttttagttgttttcggttgttttcgttgcggtatttagcggtttatcggggttgtattgttgtagcggttttttgtgttatttgtagtttaggaggttgagtatagtgagtattagtagtagtgtatagttcgcgtataatattagcgtttttttacggaatatttttatttcgagaggggacgcgggttagcggcgttttgggcgtcggggttattgcgggagtagggtacgcg

SEQ ID NO: 4796 - DNA, 201 bp, Artificial Sequence
  Description of Artificial Sequence: Synthetic polynucleotide
aacgtcggtatcggttgggaagtttcggtgtttcgggttttttttggcgagggcggagaagtcggcggtttttgtttagaattttgtgattgtagggatcgagatattaagggcgggggtgtagaggattataagttttttagcgcgttttatttgtatataaatgtgttttgttttttaattttgtttttgttatttgtg

SEQ ID NO: 4797 - DNA, 201 bp, Artificial Sequence
  Description of Artificial Sequence: Synthetic polynucleotide
tttttatttcgcgtttttcggaattttagaattcgggtggtcggtttttggaaagtcgtagtcggcgcgatgtattttgtagattttattttgttgggacggattttttaatttttagaatcgcgggtcgtagggagttaaattgttgtttttttttttttttttcgtgcggttggtggtttgttttttaaaggaacgttt

SEQ ID NO: 4798 - DNA, 481 bp, Artificial Sequence
  Description of Artificial Sequence: Synthetic polynucleotide
tcggggtcgtatcgttatggcgatttgtttatttgattcgtttcgggtggattcgtcgcgatttttgggcgtttaggtttttgagggtttaacgggcgacggttttttagttttagttgtgcgttttcgttcgggcgaggtggggttgatcgcggtcgtttgtatacgttttttttggttcgcgttttcggtttgggagggcggattcgtttattttacgatggtttcggttttggaagggattgttttcgtgattcgtttttttaatagtcgttaataattttttttaacgttttttgcgcggttcgtttttgagaattttggttcgggagagcgacgcggggttttcggggttgcgtaggttgcggcgttttgtttacgttggttcgagggcgcggttcgtttcgggtcggtttatatatttacgttttttgtcgggaggcggttgggacgcggcggggttgttttaagtgtagtcgcg

SEQ ID NO: 4799 - DNA, 280 bp, Artificial Sequence
  Description of Artificial Sequence: Synthetic polynucleotide
gagttagtcggaggggcggcggcggtttcgcgcgtttagagttttagtttatgaatgggattttattttgagcgttttttttcgggtttggggaggcggcggcgcggcggcggggggcgtttcgtaagttcgcggttttgagcggttattcgcgtagtaagttgggcgagttggtagtcgtttgtatttgttttttggtttcggtttttgatttcgttttcggttttaagcgttcgggttgcgttttcggttgtttcgcgaggtagttttaggaggttta

SEQ ID NO: 4800 - DNA, 252 bp, Artificial Sequence
  Description of Artificial Sequence: Synthetic polynucleotide
gcgtggggagtttggtattttatttaattagagcgttggattgagaattgtttaattaggcgcgtagtcggagaggagggggcggtattcgggatttggcgcggtttttgttttttgcgttagcgtgagttcggttagggtttttacggtcgtgtttttattttttagggaggcgtcggtgattcggttatagttttagttttcgtcgttttgtgatttgcgggtattggatgattcgtagttgagatttcg

SEQ ID NO: 4801 - DNA, 239 bp, Artificial Sequence
  Description of Artificial Sequence: Synthetic polynucleotide
ataggcgatggatttttcgggttttcgggggcgttttacgtgggtgttggtcgggggttttttggtagtggttttggcgttggggggtcgaggttgtttcggcgttagtttacgttttcgttggcgttttttcggcgcgtagttatttcgggatttttaggtggtttttaggtttgggttcggtttgaggattttttcggggcggagcggggcggggttcgagagtagtacgtaggtaa

SEQ ID NO: 4802 - DNA, 405 bp, Artificial Sequence
  Description of Artificial Sequence: Synthetic polynucleotide
agtttttaattaggtttaaggagtcgtagagtcggggtttcgggttcgtaggatttagaagttacgcgtttcgcgtttttcgtttcgtcgttgtttgttcggtcgatttatttggtgtcgcgtgcgttggcggttcgcgcggtagttaagttaaaggtcgaggtcgaggtcgagcgcggcgtttagtagtacggcgggggttagtagggcgggcgtcggtcgtagcgcgtttcgttttagtagtagtcgcgcgtcgtttttgtaggtcgtttcgtcgcgggttattcggggcgtttaggttgtcgtttcgtcgtatttcgtcgtttgttgtatcgttttcgttagggcggcgacgcgggatttggagttcgggcgggttaggggcgcggttcgtttcgtagattt

SEQ ID NO: 4803 - DNA, 237 bp, Artificial Sequence
  Description of Artificial Sequence: Synthetic polynucleotide
ttaagttgttgtcgtttaaggttattaagtagaatttttttaacgacgagggttgttagagcgatttggaggataacgtttcgtagggtagtagcgacgcgttgttgttgcgcggggcggcggtcgtcgtgttttcgggttcgggagcgtacggtggtggcggcggcggcggcgcgtaggataagcgttcgggtttttttacgttgggttatcggggtttttatattatcgtgcgcg

SEQ ID NO: 4804 - DNA, 204 bp, Artificial Sequence
  Description of Artificial Sequence: Synthetic polynucleotide
agtcgagtagtagttttagagtttttcgtaagttttttttatattttttcgttttcgttttaaaggagtagtagtttttttttgtttttttattgtcgtcgtcgtatcggcggagtttttttttcgcgcgtttttttttcgatggagttcgggcgtcgtcgacgtcgtcgttgtttcgaattttgagcggggtcgtttcggtcg

SEQ ID NO: 4805 - DNA, 224 bp, Artificial Sequence
  Description of Artificial Sequence: Synthetic polynucleotide
ggtcggggtgcgcgcgtgtgtatgttgtgaatgcgttgcgcgatgtgcgtttttattttatatttagtcggttttttgtttgtgttgttcgagtgtggacgtgtgtacgcgttgtattcgttcggtgtggtagcgtttcgtgagtttttggaggtagggaaaggttatttgtgtttagaggttttgttgagggcgggaggggtttagttttagtggggagtttt

SEQ ID NO: 4806 - DNA, 278 bp, Artificial Sequence
  Description of Artificial Sequence: Synthetic polynucleotide
agcgggtttgttttttatttttttagtttcgcgtcgtcggtttatagcggttttttttggggatagtttttttcgggtgtcgttttcgttttttttgtgcgttttttttttttttttttttttattaaatattatttgggaattgtttaaattttttttttaaaaaaagagagaggcggggaggagtcggagttgtggagaagtagagggatttaggtaagtatttgtggatttaaacgggcgtttttggaaattttggagaacgtcggatgggagac

SEQ ID NO: 4807 - DNA, 232 bp, Artificial Sequence
  Description of Artificial Sequence: Synthetic polynucleotide
gggaaataggtcggcgtgtcgaaagatatcgagtaggtagaaataaggtaaatttatagaggcgtaataggttcggtttttcgtggttagggcgagtcgcggtttcgcgtggcgtttcggtcgttgttttcggattttgagcggttattgttggggttttcgaaagaggtgtcggttttttgggagtcggaagagttgtttgggtgggtttcgttttgttttttattttatc

SEQ ID NO: 4808 - DNA, 331 bp, Artificial Sequence
  Description of Artificial Sequence: Synthetic polynucleotide
tgttttgtttggattttatcgtggtcgagaaggaggaatggtatatcgttttcgtgaatattatttacgtcgagttcgcgtcggatttcggggtcggggcggcgggcggcggcggcgcggagttgtatacggagaagacggagtgcgggcgttacggagagtattcgtttaagtaggacgttcgcggggaggtggttatggttagttcggtttacgatcgtttggtttgcgattttaatattaagttcgtcgtttcgattcgcggtaagaattggatagtttttatttttaagggtaattgtacgtatagggataagattcggaacgcgtt

SEQ ID NO: 4809 - DNA, 231 bp, Artificial Sequence
  Description of Artificial Sequence: Synthetic polynucleotide
gttgcgttttgggcgtatttgcgcgtttggtttcgcgtttcgcggagagggcgatgggtttcggttaggattgagtttttttttttttttttttagtttcgtttggtatttttttttttgtttcgagggcgagttacggtttgcgtcgtcgttttttttttcggtgttttcggttcgtcgttttttcgcgtttttttttttcggattcgttttcggggttattatggtcgc

SEQ ID NO: 4810 - DNA, 201 bp, Artificial Sequence
  Description of Artificial Sequence: Synthetic polynucleotide
tgttcggttttgggtttagttcgtcggcgttgttgggggcggtaagtttcgtattagtttttattcgttttatttttttcggttgaatgagtgttagttcgcgtattggggttatttagaggagacgggtaaagtcgcggttttacgggttgtattattggtcgcggagtttaggggagttgtaggagaaattattgcgag

SEQ ID NO: 4811 - DNA, 201 bp, Artificial Sequence
  Description of Artificial Sequence: Synthetic polynucleotide
agttcgatgattaggagttttcggttttcgaagttgcgttttatcgtgtaaattttgttgatggcggtgtattgtagttatacggatacgagcgtttcgcgtagttcggggtagcggtggtattcgaaggagatgtcgtttttttgttgtagtcgtcggcgtcgttttatgttcgtcgcgggcgtttcgggtttttgggtt

SEQ ID NO: 4812 - DNA, 219 bp, Artificial Sequence
  Description of Artificial Sequence: Synthetic polynucleotide
tcgttgtagttatgaggagaatttttatttttatggttggtttatcggttatttcgagatgtcgtttttcgattatagtatggttttgttttatagtttcgagtatgttagcggcgtcgtcggtttggattatttttattacgggggggtgtcgtcgggcgtcgggttttcgggtttgggggggtcgcgttcggtgaagcgtcgaggtatcgttaatcg

SEQ ID NO: 4813 - DNA, 284 bp, Artificial Sequence
  Description of Artificial Sequence: Synthetic polynucleotide
gtcgggggaggtggggtcgtcggggaggaggcgagggaaacggggagttttagggagacggttttcgagggagagtgagaggggagggtagttcgggttcggtacgttttttttttcggtcgtttttttttatataagcgtaggtagagggcgcgttagttatgttttgtttttgcgttcgtcgtcgtcgtcgtcgtcgtttagttcggcgcgttttggaggattttgcgtcgcggcgttttcgggtttcgtcgtcgttagtcgtttcgtcgtttttttttcgt

SEQ ID NO: 4814 - DNA, 429 bp, Artificial Sequence
  Description of Artificial Sequence: Synthetic polynucleotide
aaagtattttttttttaatttatgaacggatttcgatttttgttttgttattatttatgcgtttcgtattcgaggtgtcgtttttatttatacgttttacggtttcgcgaaattcggttttttagttcgcgggacgcgttgtttgttaggcgggttcggcggtatttcgggggcgggaggggtcggtcgtagggtttttagtttggcgttcgcggggcgttcgtagcgaaggggtgggtgtcgttcgtgaacgtagtagggattagtttagttcgcgttcgtttttgggtttcggttatcgttttttcgttattttttcggtttttgcgtggatcggttcgtggcgggggttgttttgcgttttcgttttcgtagtagtcgcggatttttattaacgttgacgagttagtgtcgcgattcggggagaga

SEQ ID NO: 4815 - DNA, 283 bp, Artificial Sequence
  Description of Artificial Sequence: Synthetic polynucleotide
aaaagatcgcggtggagaagatggggcgtttttcgcgatattcggttgtttagaggtgtaaagtcggtgggcgtacgttcggggcggttttatagttttcgggtcgttagttttagggtgtcgggttttaattaaggtttcgaagtttttacgtatttgagggtattttgattagtttttgcgggttgttttgcggtcgtagtgggttttgaaagtttatttcggcgtagggtggaaatcggcgggaggcgttgttgattttcgattaaataatagtgacgag

SEQ ID NO: 4816 - DNA, 241 bp, Artificial Sequence
  Description of Artificial Sequence: Synthetic polynucleotide
cgcgggtggcggcggttgtggggtcgtttgggatttttcgtagtattgattttgtaattttttgtgtttgcgtttcgtggtgaggggcggcgggatgcgcgcgatttttttttgatttagttaaacggaaaagttcgcgcgtttcggttggaaggtggaggttaggtaggattcggtaaaggtatattttaaacgaagtagattttattttttatttgtagagggaaggcggtgtggacgg

SEQ ID NO: 4817 - DNA, 244 bp, Artificial Sequence
  Description of Artificial Sequence: Synthetic polynucleotide
gtagtagttttacgttgttggcgtaggcggcgcgtaggagggtcgtcgttttcgggacgtttttcgggacgtttttcgggacgtttttcgcgttttcgacgtcgtgttttttttcgttttcgaaagggtagaaagagtcgttcgaggcgatgttgcgggtgtttggtagattcgagaagtttttaaatttttcgtagttagcggggtttttttcgatttgcgcgtttcggggtggggacggcgg

SEQ ID NO: 4818 - DNA, 225 bp, Artificial Sequence
  Description of Artificial Sequence: Synthetic polynucleotide
gtagggggcgttgcgttcgtcgagttcggaggggtcgtcgggtcgggcgttgcgtattcgcgtcgggagtcgtttttcgttcgcggcgttcgtttttgtcgttcgttagtattttttgtttcgcggtcgcgtttagataataaaagcggaagatgttgtagttgggtaaggttaggattttgttttgaagtcgggcggcgtcgcgtacgttttttttcggattga

SEQ ID NO: 4819 - DNA, 249 bp, Artificial Sequence
  Description of Artificial Sequence: Synthetic polynucleotide
cgtcgttttcgcggcggtattgggtatgtttcgtattcggggtcggtttcggcggcggggcggacgtttttttattagtcgggcgttcgggtcggtcgtcgaggtttaggtggaggttgaggttgtcgcgcgtcgcgggaggagtttcgttttcggcggttgaggcggcggcggtataggtggcgcgggtcgcgcgcggggcgtagttcgggagcgttcggcgtcgggcgtcgcggcggttttaggttc

SEQ ID NO: 4820 - DNA, 255 bp, Artificial Sequence
  Description of Artificial Sequence: Synthetic polynucleotide
ttcgatcgggagtttagagttttgttagcgtcgtattgtgcgtcgcgtaagtcgttcgatttttttagcggtatcggttttaagtagtaaatatttgtgcgtttttgagttagggacgcgcgtggggggtgggcgtgtacgcgggtgggttagcgtagagtgggagtttgtgggtgtttttcgtcgggatttttaatttagttgttttcgagagtttaagttgagcgtcgtacgtgttcgtgttatttgttgtat

SEQ ID NO: 4821 - DNA, 243 bp, Artificial Sequence
  Description of Artificial Sequence: Synthetic polynucleotide
acgtttgtttgagtcgtgttgtcggggattagcgattttttatttttttttttttataggagcgtttcggttttcgttttcgttttaatcgtcggcgcgcgtttttatcgcgtacgcgtttttttcgcgcgcgtatacgttcgcgtatatacgttttttcgttttcgttcgcggagtttttttttattttttagtcgtttcgtcggttgaagtatcggcgttgggaggcggcggcgttgttga

SEQ ID NO: 4822 - DNA, 201 bp, Artificial Sequence
  Description of Artificial Sequence: Synthetic polynucleotide
cggtttgttttgggttcgtgaggcgaggtcgtagcgtttcgacgtcgggtgggcgtgtgggtggagtggagatttgggtttttcggcgtatgggagtttcgtcgtttgcggtagggaatcgttttttatttttggttcggttcgggtcgggagtcgtgtttcgcgttgattcggtgtaattttttagtttattttttttta

SEQ ID NO: 4823 - DNA, 208 bp, Artificial Sequence
  Description of Artificial Sequence: Synthetic polynucleotide
gagaattgaaaaggaaggcgaggagtaggggttgcgggtcgggtttttgttgttcgcggttttcgggggtcgcgtcgcgtcgggttacgtgggggttttcgtttttcgagcgggcgtcggtgggaaatttgcgcggcgagagatagggggatggggcgtttttgacgcgattgtggggtgcgggtagttttggaggaggatgttcggt

SEQ ID NO: 4824 - DNA, 257 bp, Artificial Sequence
  Description of Artificial Sequence: Synthetic polynucleotide
tagcgttttcgttttggttatggagcggtcggcgttcggcgaggtggttatgagttaagttatttagtcggcgtacgttattgcgcgcggcgagttgagcgcggggtagttgtttaagtggatcgatattatcgtttgtttggcgggtaggcgggcgtcggggttgcggggaggcgcgggatcggggttgcgggagcggcggcggttgggggttggggggggtaggaaggcgaggaaggtatttgcggagagttgaa

SEQ ID NO: 4825 - DNA, 350 bp, Artificial Sequence
  Description of Artificial Sequence: Synthetic polynucleotide
aaagtgtttgtaaagtttgagtagagtgcgcggggtcgagcggggagaagggtgcggggtatcggggtgagatataggaaagaggaggacggtggggagcggtagaagatagcgtttttaggattagcgattttgtggtttattcggttattgggtttcggcgtaaattttttttaggtagtgcgggcgatgttgattgtagacgtcgggtagggttttcgtgcgggcgggagcgggggaagttagtgcgttcgggcgttagttagttgatgcgggaagaggttggggagttgtagggtcgttcgttttcgggtgcggtgttttggcgtagggtttgggttgagtcgttc

SEQ ID NO: 4826 - DNA, 216 bp, Artificial Sequence
  Description of Artificial Sequence: Synthetic polynucleotide
ttattttgttcgttagtatattttagagtttttaatttttttttgtatgtaagtttaggtagagttttgttaggttttatattagagtatatttttgtacggattttttaggatcgcggcgtcggttggttgtttcggtttttcgcggtcgcgtgagtttttttttggtggtggagggcgtattttaatttggaaatttttagtttttaatttggt

SEQ ID NO: 4827 - DNA, 269 bp, Artificial Sequence
  Description of Artificial Sequence: Synthetic polynucleotide
tcgcgaagggtataatttgagaagttcgtggtagtttttcgtagcgtcgggtgatatagggtttttttatttttaggagaagtgggtaggagagagggtcgttcgttgtttttcgttgcgtttagggatggagggttttattatttatggaattgttggtttttttgcgtggttcgggattttagtcgtggtttcgcgttaagagggtattttttttaaacgaaatcgtttcgttcgttcgttcgttcgttcgttcgggtagtaatgtc

SEQ ID NO: 4828 - DNA, 258 bp, Artificial Sequence
  Description of Artificial Sequence: Synthetic polynucleotide
agtaaaatttttattattttttcggtgtttattagttcgtttttttaggtttttgggattattttatttaaaagtagttttttttagcggggtttagatcgtttttgagatttcgttgagaaatttttagcgggttagcgtttgggcgttgggcgtcgagttcgatatggttttttggatgtcgttgatttgttcgtcggttgtttagtttttgttttatttcggggcgtagaaaggggacgggtaggggttcgattt

SEQ ID NO: 4829 - DNA, 224 bp, Artificial Sequence
  Description of Artificial Sequence: Synthetic polynucleotide
agtttttagggatatttgaggtattatttttgttattgtcgggtattcgcggcgttgttaacggtttggttatatgtttttcggagagttacgggagggcgttgggtaatttttattcgagtcgcggtcgcgaggaggagggaaaaggcgagtaaaaaggaagagtgggaggaggaggggaagcggcgaaggaggaagaggaggaggaggaagaggggagtata

SEQ ID NO: 4830 - DNA, 256 bp, Artificial Sequence
  Description of Artificial Sequence: Synthetic polynucleotide
ggtcgtgtagttcgtttcgttttttttttcgaagagagatttggtgttggtatgggtatttcgcggttatcggagtggtttttcggatgagtttggtttcggcgttgacgttttggttttgggggttgtttggttggtgttaggtagcggaagacgtttggagagttattcgtttttttttttattcgtttttatcgttgttcgtgttaggacgcgtagtttgtagttgtagtttaggtattggcgcgggatggcg

SEQ ID NO: 4831 - DNA, 310 bp, Artificial Sequence
  Description of Artificial Sequence: Synthetic polynucleotide
tttcgtcgtttcggaggttggcggtgagggtattcgggcggtaggggttcgtcgaggggtcgtggtatacgggtaagggggttaattcggaatggttttcgagtagttttacgttttgttaaggacggtaggtgtaagggtcgggggattttttgacggggtcgttttttcgggtacggggaggtttttatcgagttttaattttgaacggggtagggggtagagtttttggtaggtaaggttttcggaggagggaacggttggggagtggcggagtttcggagtggtggttttgttaacgttttttttc

SEQ ID NO: 4832 - DNA, 410 bp, Artificial Sequence
  Description of Artificial Sequence: Synthetic polynucleotide
aaggatttatttagacgtacgttcgcgcggagacgtacgttggtatacgcgtttatatacgcgagtatatatacgcgtatattattcggttcgtgcgcgcgggtcgttgtttttgttgtattatgtaaaggtggttgggaaagcgcgttgatttatatttatatagtttattttttttttatagtatgtgattaatacgtatttcggggaggagggagcgcggttgggggtgttaatcggaagggaatagatagtgagtgttattttgttgggaggttttagaagtaaagcgttaacgacgatagtagcggtggttttagttttattagtaattgtcgttggtaggagtattatacgttttaggagtttttcgggtattaagtatgggtttagttcgttttagttatttt

SEQ ID NO: 4833 - DNA, 274 bp, Artificial Sequence
  Description of Artificial Sequence: Synthetic polynucleotide
agatcgagggaacgttgtttatgcggtgagagttagcgcgggaggcggcgagggcgcggggagatcggggagggggtgggtttcgcggcgttcgtcgttcgtttttacgcgcgttgtcggtatttgttcgttttgttgtaatttgttgtagtgtttgaaagagtagtaggagcgtatggaggtggggtcggggaaagattaggcggagtggttgtggggtgagcgcggagtgggtggggaggcggcggcggtggggaggggggattggttttag

SEQ ID NO: 4834 - DNA, 201 bp, Artificial Sequence
  Description of Artificial Sequence: Synthetic polynucleotide
gtcgtcgtcgtcgttgcgtcgttttttatttagagttcggcggcgtcgttttttttttttttcgcgtggtggcggggtatggtattattacgggtatcgcgagggggtcgttagcgtttgcggcgggggtagcggttttatgtgcgtcggcgggttttaaggaggaagtcggcggtcgacggggcgttcgttagttagaga

SEQ ID NO: 4835 - DNA, 265 bp, Artificial Sequence
  Description of Artificial Sequence: Synthetic polynucleotide
ggtcgggaggcgcggagttagtcgtttacggagtttaattgtttgtatcggggatcggcgggcggggcgcgttcgagtggtttcgtcgggaaagggcggcgggcgttggagaaggcgtttggcgcgaagttgggcggcgtttcgagggcggaggataggtggtcgcgcgatcgtagttaggtagcgaacggttcgggggttgcgtagcgcggttttaaagtttagttcggtttcgggtttagttcgttgtcgtttgttacgggag

SEQ ID NO: 4836 - DNA, 201 bp, Artificial Sequence
  Description of Artificial Sequence: Synthetic polynucleotide
gcgtagggggtagttgcgtataacgcgtttttggtagcgcggcggttgcgggcggggcgcgttttacgtgtttgaaggcggacgtttttttcggggggacggagagtagagggaagtcgcgtagggttttagagtagggtaggttaggcggcggcggcggcggcgggtttttagcgagtaggtatttgggatggtggtggt

SEQ ID NO: 4837 - DNA, 362 bp, Artificial Sequence
  Description of Artificial Sequence: Synthetic polynucleotide
ttttaaatcgagttttcgggtgtgtagattcgtagcggagtcgcgggagcgaggtgggaaattttggtcgcggcgtcgggtttcgttcgtcggggggcgcggggcggcgggcgtatgcgcgtgcgcggtgcggttttagttttggttgtcgtcgtttgtcgtcgtcgtcgcgatgtttattttagttaaagcggttgcgggtttggggattcggttcgggtagcggagttttcggattcgtcgattcgtcgaggagcgcgcgtcgggttttcgtcgagtagttgagttcgtgtgtttcgcgtttcgcgtttcgaagttgtcgtttcgaattttggtcggcgttgtttaggtttttcgttagg

SEQ ID NO: 4838 - DNA, 298 bp, Artificial Sequence
  Description of Artificial Sequence: Synthetic polynucleotide
tagcggagacggttaagtgtttttttattaatttttttttttcggagtttaggggtgttgtatgggcggcgtttggattcgcgttttggagttattaggcggagtaaagttagcgcgtttcgcggttcggaatttagttggttcgttatttttttatttttgcgattttattttcgatcgcgttttagggtagaagcgtttgagttttcgttagtgggtatttaaagtttatgttcggcgggcgtgttgacgttattcgggggttgcggagcgggagggggcggtggggggcggggat

SEQ ID NO: 4839 - DNA, 295 bp, Artificial Sequence
  Description of Artificial Sequence: Synthetic polynucleotide
gaaggatacgtaaatttgtcgagggttcgggggtttcgggttgttgttgttgttagcgttttgggaagtgataggtattaggatttgttggtgcggcggcggcggcggcggtagttttagtcgcgttcgttatatatatttttattcgttcggtgtatacgtcgcgtcgcgggtagtgtcgtttgcggaggcgcgttcggggttcgtaggggtagtagcggtagtttggtagcgtcgtcgcgttttcgggtatttggttcgcgaagtttcgtttttgtcgtttttcgcgtcgttc

SEQ ID NO: 4840 - DNA, 203 bp, Artificial Sequence
  Description of Artificial Sequence: Synthetic polynucleotide
ggatgcggtcgcgtaggcgttcgttttttggttttttggtcgggtagcgggcgttcggttatcggagtttagtttaagggtttagtcgaggttttttcgcgcgaggcggttgcgttaggtgagcgggtatcgcggtcgcgttttttttgttatttatttagcggttagaggtattttgcgtttgggagttttaagtgttttcg

SEQ ID NO: 4841 - DNA, 215 bp, Artificial Sequence
  Description of Artificial Sequence: Synthetic polynucleotide
agttttaaattttacgttataaagtttcgaagaggcgggttgggggcgggggtcggggcggatttttaggggcgtggttgcgcgtttgcgatttcggatcgtgttaatttcgtcgtcgttttaaaatttgtgggaaattttagttttgttatttattttttttggaggacgtagataggatttgttttgtaggagtttaggtcggtcgattcgcg

SEQ ID NO: 4842 - DNA, 201 bp, Artificial Sequence
  Description of Artificial Sequence: Synthetic polynucleotide
gggcggcggcgcgcgggggatttatttcgtttttatttgatttcgggtgattgtttattgttatggtttgcgatttcgcgtggggatcgtttagggtttcggggttttggatgtttcgggtggcgtcgtcgtaattttcgtgtttttcgcgtcgtttttatttcgtttttattcgggtcgattcgagcggttgtagttttt

SEQ ID NO: 4843 - DNA, 340 bp, Artificial Sequence
  Description of Artificial Sequence: Synthetic polynucleotide
tttttcgagtattcgtttcgggttttttttaagtagttgtttcggtttcggatttttatttgatttttttaatcgatttggtagggtacgtatatttgacgtttattttgtagtcgagtatataaggttcgtcgaagttatcgagtaggttttgtagttgtaggtagttttcgtcgtcgcgttttattacgtcgtggaaggtaggtacgtagtcgcgtagcgcgttagttattagtcgcgttaggtagtagcgtttcggtttcgagtagcgttttaggattagttcgttggtgttcgtcgttttaaaattttttgaggatcggtattcgttagcgtcgtt

SEQ ID NO: 4844 - DNA, 201 bp, Artificial Sequence
  Description of Artificial Sequence: Synthetic polynucleotide
ggcggagggatagagttggattcggaagtcgcgggtgggagttgtttttcgcgagttcgaggttgttggtattttgtcgcgggtagttcgcgttagtttcgggagtttttgggtttcgggagagcgagtcggggtcgtttggttataaagatgttcgcgcgttcgttttgcgtacgggattcgttttgcgttttgagtttt

SEQ ID NO: 4845 - DNA, 236 bp, Artificial Sequence
  Description of Artificial Sequence: Synthetic polynucleotide
aacgttcggttaggttttagagttttcgcggagagcggggcgtttgttgggggcggtcgggagggtcgggttaggggcgcgggagatttcgcggggacgcgaggtgttgcgggttttgtgcggttggttgggaacgaggagaatgtgttattaatagtgtttaatcgattgattattttgggtgttgtgtttttttttttatttttttttatttttgggaaaatgtattgtttagg

SEQ ID NO: 4846 - DNA, 251 bp, Artificial Sequence
  Description of Artificial Sequence: Synthetic polynucleotide
gtgtttgaatttttcgggatatttagacggttggagtttttcgattttaaggcgggcgacggtaaagttaaacgttagcgcgttgcggttttcgggtatcgaggcgttttcgttttcgttatttatatagggcgttaagtgtttcgattcgcgagtgacgaggacgtataggttagtgatacgattcgtagttagtattgagcgggacgacggggttcgagcgtaggagggtgcgcggggagttgaggagc

SEQ ID NO: 4847 - DNA, 201 bp, Artificial Sequence
  Description of Artificial Sequence: Synthetic polynucleotide
tgagtagtttaggtagtcgcggtggtcgtgaacggggcgggagtggggggtgtttaggttattagaggcggtttcgcggtttgtatcggttggagtgggcgatttagagtttgagtggagggggcggggggcggcgatagcggggggttttggtagcgatggtttgaatttgcgttggtgggggatggggcgggggcgggg

SEQ ID NO: 4848 - DNA, 206 bp, Artificial Sequence
  Description of Artificial Sequence: Synthetic polynucleotide
gcgttggggaagggatttttcggaggtacggggtagcgtgcgggttgcggtagcgatttcgattcgggttttcgggttttgtcgggttgagtttgcgttcgtttcgtcgtcgttaagtttttttaattttgttcgttgcgttcggatcgcgcgttaggtttgggggcgtagtaggggttgggggcgtacgttgcgtattcggggac

SEQ ID NO: 4849 - DNA, 201 bp, Artificial Sequence
  Description of Artificial Sequence: Synthetic polynucleotide
gtttcggtttcgggcgtcgattaggtttttttggttttcgtcgcgcgttttttaatttgttgttgtcgtcgtcgcgttttttaggttttgttagttattcgcgttttgagttcggggttagatttttatggaagcgtcgcgatgttcgtttttcggttgttggatttttagaagacgaaatacgcgaggtgagcggcggtc

SEQ ID NO: 4850 - DNA, 203 bp, Artificial Sequence
  Description of Artificial Sequence: Synthetic polynucleotide
tgggattttttttttaaaaacgtaggcgttttttcgggtcgtagtcgtagtcgggagattgagggttagggcgcggtcgcggggttttttgggtcggggcgcggtttacgttttaggtttttgcggttttgattagaagtcgttgcgtttttggtcgttttttattcgtttcgttttcgtaattttaggtttagggttatagc

SEQ ID NO: 4851 - DNA, 216 bp, Artificial Sequence
  Description of Artificial Sequence: Synthetic polynucleotide
taggggagacgaatcgattggttgttcggtcgtcggaacggtaggtttcgtcgtttttttcgtttttcgtattttcggttcggtttttttttattatcgcgtttcgttttaattcgtagttagtattttttttttatttttttttcgttttcgttgttatttttttttttggatgttggaagcgtagttggtattttcgtttttttaattttttaa

SEQ ID NO: 4852 - DNA, 335 bp, Artificial Sequence
  Description of Artificial Sequence: Synthetic polynucleotide
gtttattcgttttttaggtgattcggcgttttcgtcgcgttcgttggaagtttgtaaatttttttcgggggtttcgtcgttacgttgggaagttggggacgcggggggaggtttttggttcgtcgttttcgttgtcgtttgatcgtatttttggagggtttcgtattttgttaggtttttggaggtaaatatatattttcgatttataattggttttcgcgttaggggattcgcgcgtttttatatacgtacgtacgtcgggcggattcggcgtcggttttacgttagtatttttttaggcgcgcggcgcggcggttatcgagcgtttcggtatt

SEQ ID NO: 4853 - DNA, 230 bp, Artificial Sequence
  Description of Artificial Sequence: Synthetic polynucleotide
tcgggcgttgatagacgattttttttatttgttagttttttcgtttgttagtagagttgttggtaagtgagagaaaatagaggggcgcgaaggtaggcgcggttagggagtgagcggggcgttgggcgcggggcggagtcgggtgcgcggcgttcgggttaggttttatcgttcgcgtcggttttcgttttgtttagtcgtcgtttttttttttttttttattttttttt

SEQ ID NO: 4854 - DNA, 224 bp, Artificial Sequence
  Description of Artificial Sequence: Synthetic polynucleotide
agcgtagttatttgaaggtttttatggttttcggcgtttgcgtttgaagttcgtttttaggttttggggggtatttgtagaaaatttttagtagcggttcgttaattagattttagggtgtacggggggtggcgtcggtaattatggtaatttttaaaataaaataatataaaataaagtaattaacgtttattaattattattttattttattttttgtattg

SEQ ID NO: 4855 - DNA, 211 bp, Artificial Sequence
  Description of Artificial Sequence: Synthetic polynucleotide
gggatacgtagggggatacgtagggattgttcgcgcgaatggtttcgaacgtatgcgttttattttatattttatagtcgttatgacgatcgggaggttcgttcgttaacggttagttaacggttgcggggataagttcgttgaggttgttaggcgagttaggtttttttggatttcgtttgattcggatgggttgtgtttgaaattgatt

SEQ ID NO: 4856 - DNA, 205 bp, Artificial Sequence
  Description of Artificial Sequence: Synthetic polynucleotide
ggcggtgttaggtcggggcggggggtttttttatttagtacggggtattaggtcgggatgggatttttttttagaaagtcgattggatgttaggagaggcgtacggttgggggttttttttttttttttttttttttttttcgcggttgaattaaattagaattgttatttagggtttgtgagttagaagggatcggattatacg

SEQ ID NO: 4857 - DNA, 398 bp, Artificial Sequence
  Description of Artificial Sequence: Synthetic polynucleotide
ggcgcgggtttcggcgcgtttagtagttcggttagcgttagcgcgttcgttagtaggttgagaacggttagcgtttttagcgtggtcgtttgttttagtcgtagcgtgtagtcgcggaatagcgtttttagttttgggtaagcgaatttttcgtcgtacgttcggagttcgcgtcggcggtttgtttcggtcgttcgttcggcgttttcgggttcgttcgcgtcgttttcgtcgtcgttttcgtcgcgcggcgttttcgttattttagcgttatgtagcggtcgcggtcgcgggcgcgtttttcgtcggttcggggcgtcggggcgcgggcggcggcgtcggggcgggcgggcggcgggcggcgaggcgtcggggcgcggggcgcggggcgggcggag

SEQ ID NO: 4858 - DNA, 290 bp, Artificial Sequence
  Description of Artificial Sequence: Synthetic polynucleotide
tatcgcgtcgcggtttcgtacgggatgcggcggtcggcgttgtgttcgcgggtcgggtagttcggttcggtcgcggcgttgcgggattcgcgcgtaattcgtgggggcgcggcgcgggcgatacgtgcgggtcgttaggagggggagggggacgcgcgtcgtcgggttcgttattttgtattcggggtcgttggtcggtcggggtatttttacgttcgtttcgttggcgagattggagggattcgggatatcgtaaagtattttttttagtgtttgggagcgttcgttgt

SEQ ID NO: 4859 - DNA, 307 bp, Artificial Sequence
  Description of Artificial Sequence: Synthetic polynucleotide
ttatcgtagtcggtttcggtcggatttaaatagttttttttttattttcgggatatttattttacgtatttattattttttagtttttagatgtttcgtcgttttttttatggattttttagtatttgtaggttataggataatagaagttatagtagagttatcgaggaattttaggaacggaggagatggaatagtggagacgcgaattaggattagagttcggaagttaggagataaaggtttcgttatattgaagaggtcgtttttttttttgtagttgcgtatttgattggatagttttacg

SEQ ID NO: 4860 - DNA, 212 bp, Artificial Sequence
  Description of Artificial Sequence: Synthetic polynucleotide
gggggtggttgtgggttcgaagtggaggacgagtatggtttgggagataaggaatcgttttgagatagagaaggttttcgggagcggatagagagtgggcgaaatcggtgcgtagtaatcgcggcgttagttttagcgcggtttttggggcgtagttttatttcgttttagtagttgcggagttttttgacgagttttcgtttggtagtatt

SEQ ID NO: 4861 - DNA, 375 bp, Artificial Sequence
  Description of Artificial Sequence: Synthetic polynucleotide
tagggcgttttcgtttggattataggagaaagtttgggaggtaggtttaattttttaatttggcggggaattttttttttttttatatagtttgtagcgcgggggcggcggggtgatagttttcgtgtatgaattagttattttttaggtttcgtttcggcgggggtcggtcggacgttcgtttcgtataaagcgggtattcgggtcgtttggagtagaaagtcgcgtattttttttcgttaggcgttttttcggacgttttgtttagcgggtcgttcgattttttgtattatggatttcgttcgttttttggggttgtcgattttgttgttttttttgacggaggttgtattgggcgatgttgtttaggagtta

SEQ ID NO: 4862 - DNA, 201 bp, Artificial Sequence
  Description of Artificial Sequence: Synthetic polynucleotide
ggcggtatggagcgtagtggttgggttcggtagattttttttttagcgttgttgttgggggcgacgttgagggcgcgcgcggcggttggttattattttcgtttttcgttttttttttttttgtgtatttattacggggagttggaaggggatggggagtagggcgaggtgtttatttttttgtatattgcgggtaatttt

SEQ ID NO: 4863 - DNA, 356 bp, Artificial Sequence
  Description of Artificial Sequence: Synthetic polynucleotide
gggcggggcggcgcgcgggggcgggggagcggtcgggatacgtgtggcggcggcgggggggacgcggcgttcggggttttaagaaggtgtggagcggggcgggcgtttttttaggtttggtcgaggggcgtcgcgtagaggcggcggcggcgtacggaggcggtagacgacgcgttttcggcgttcgtagtttcggtttcgcgttttcgcggtttaaagtaattttgggagtcgtcgtttttcgcggaatttttcggcgggggttcgtttttaggttcgttttcgagttcgtttcgttttcgttcgtttttttttcgtttttttttcgcgtggttttttcgtttcggcgtttttaa

SEQ ID NO: 4864 - DNA, 265 bp, Artificial Sequence
  Description of Artificial Sequence: Synthetic polynucleotide
atttttaggtattattcgagtttgttaattttattttcgtttaattttattttaaaattttttatagatgaggttttgtcgttgtcgcgaggggtcgggcggtcgcggcgggagggatagggggtttgggtgggaagggagcgcgagggtttttagcggttcgcggtttcgggcggatttttagaacgagtgcgggtcgttcggattggtagattgcgagtttcgaggggcgcgggacgtagtcggtttagataaagaaatcggc

SEQ ID NO: 4865 - DNA, 697 bp, Artificial Sequence
  Description of Artificial Sequence: Synthetic polynucleotide
gcggggaggcggcgggggcgggagcgggcgaggggtcgcggtcggtcggcgttcgggtttcgattttcgggtcggttaggggcgcgtcgagtagtaggtcgtgcgttaggcggaaatgttttagtaggttttcgcgtatcgggtcgttcggggggtagtaggggtaggcggcggcgggtaggtcgagcgcgtcgggcggtggcgtagcggggtacgagtattttttgtgcgttaggtaggtttcgaggttgtggaagtttacgcggtaggtcgtgtattcgtggtagtcggttagcgtcggtgtcggggtttcggggagcgggcgtcgcggttttttgtttaggtcgatggggtcgtcggtcgcggggtcgggcgagcgcgtaggggcgaggtcggggtcgttttcgttttcgttttcgggtcgcggcgattcgggcgcgggggcgtggtcgggcggcggggggggcggggcgtcggtcgcgtgtagttcgtagagtttgcggcgtttgcgcgtgcgtataggcgcggcgggagagggggtcgggggcgcggtcggtttagggggtttcgggggcgcggtcggtcggcgcggcggcgggtcgtggcgcgaggcgtagtagtatcgtttgtgtacggtgtaggtttcgtggcggttgaagcggatgttgtaggtttcgtatagcgtgcggttggggtc

SEQ ID NO: 4866 - DNA, 226 bp, Artificial Sequence
  Description of Artificial Sequence: Synthetic polynucleotide
gtagaggcgcgtagaaaacgcgcgggtggcgcgcgcggttatttagtgggtttcgttcgcgtcgtcggcgtcgtcgtcgtcgtcgtacgtgcgtcgtcgtgagcgcgaagggcgttcggattcgcgttttgttcgttcgtttgttcgtcggggttattgtggatttttaggtaatagttaagtgagaagttttttttattatcgaaaggtgtttgcgtttttttta

SEQ ID NO: 4867 - DNA, 201 bp, Artificial Sequence
  Description of Artificial Sequence: Synthetic polynucleotide
tttagggaggatgggggtcgcgggggaagtcgggcgtttcggggttttcgatatttatattttcgtacggcgtacgttttgtttcgagtttgcgtttttcgagttagtacggcgagtttgggattttcgtgttttttttttgtggttttcgagaaacgtcggagtttcgtgttttgttgggggttggggggatggagaaaa

SEQ ID NO: 4868 - DNA, 201 bp, Artificial Sequence
  Description of Artificial Sequence: Synthetic polynucleotide
tttggagatgtgattttttaaaagtttagtcggcgaatgggagattgaagggtgacgggaagggggtaggcgcgttcggcgttttgattgggcgtgcggcggtaggattttaaagcgttttgtttcggatcgtttgttttgggtgatttttcggatttgttttggtggaattcggatttgtttcgtcgagatgacgaggta

SEQ ID NO: 4869 - DNA, 215 bp, Artificial Sequence
  Description of Artificial Sequence: Synthetic polynucleotide
agaggaggaaggaaggaggaaagaggaagacgggcggtcggaggcgcggggttgcgcggcgtcggtcggcgcggcgttggaaggcgtcggcgttaatttcgcgaggtaggcgacggagggggagcggcgttaatatataagagtattgtattacgttaatttttttttagaatagtatgcgttagtagtatatttacgttttgattgaaggataa

SEQ ID NO: 4870 - DNA, 252 bp, Artificial Sequence
  Description of Artificial Sequence: Synthetic polynucleotide
tcgtcgttgttcgggtttcggggttgggtggaggaaaggggtgttcggaatcgatttttatttttcgatttttttgttggatattacgtttattttggacgtcgtaagagaagttgttaagtttcgtaggttttgattcggcgtttttcgcgtttttcggttgttttcggtttttttgtgtttcggtggagtatttgcgttcggggttggggttggaggaggtagttatacgcgcgtatacgtatacgttta

SEQ ID NO: 4871 - DNA, 203 bp, Artificial Sequence
  Description of Artificial Sequence: Synthetic polynucleotide
ggcgggggagtgagcggagttttttataatgtttcggtgcggtgtagtcgcggatggatgttgcgggaaggggttgttatttgttgtttttgttagcggcgcgcggatttgttcgcgtttttgtagtcgtcgtcgtcgtcgtcgttagttcgttcggtttttgtagcggcgtcgtttgcgtttttttcgcggtcgtcggagcg

SEQ ID NO: 4872 - DNA, 201 bp, Artificial Sequence
  Description of Artificial Sequence: Synthetic polynucleotide
ggtcggttttatgcggggcgtttcgtcgcgtcgcgttcgcgtttttgtatcggggtgcggggtttagttcgacgcgtattcggcgtttcgcgcgttttgcgggttttttaggtcggtttcgggtgggttaggatcgcggcgttggtaggtcggggttgagttcggtttttcgcgttggagtttttgcgtcgggtgtcgtcg

SEQ ID NO: 4873 - DNA, 201 bp, Artificial Sequence
  Description of Artificial Sequence: Synthetic polynucleotide
tgaattttagagggttgggttttgatttgagtgtcgattcgttaatgaggacgggaggataaggttgtcgacgtagcggaaggtaggggggaagcgattcgaggatttgacgattatttttaggtaggggttttttaagtaggtacggaaattaattttattaaatcgcggagtggggattgggttcgggcggtgtttagt

SEQ ID NO: 4874 - DNA, 201 bp, Artificial Sequence
  Description of Artificial Sequence: Synthetic polynucleotide
ataattttcggaaggagggggttaaatgcggtagcggcgggtttgaaaagggttaggagcgtcgtaggaattggggtgtataggttttcgcgtgtttagcgtttcgttttttttcgttttaggtttgttaggggcgcgcgtggcgcgggtagagtttggtgggtgggttggcgcggatagaagttttgtcggggagcgggg

SEQ ID NO: 4875 - DNA, 213 bp, Artificial Sequence
  Description of Artificial Sequence: Synthetic polynucleotide
tcgatcgcgttttttgcgttcgttcgcgttttttttgtcgtttcgcggtttaggggtgtgagttattcggcgatagtttcgttaggttatttcggggcgcgtaggtggatacgtataggaagatcgttatttttaagatttttatattgtttatcgtggggcgaaattttataattttttgtataaaatgtataaataatattaaatgagttg

SEQ ID NO: 4876 - DNA, 385 bp, Artificial Sequence
  Description of Artificial Sequence: Synthetic polynucleotide
tttgtacgtatgagtaggtatttaatattttttggtttagttatatgtgatatgaggttatttacgttttttttaattaatttttatgataattatgtgcgttatggagaaaattaatggaggaaaaattatagagttattcgaaatagttgcgttgtttattattcggtgtttgagtttgttttttttgtaattagattatatgtgaggtagttttagttaattgtttgtgttatttatcggggaattttagttttatttgtgaatatttaggttttttcgtcgtaggatagatgttgggtgaggtttgttttttacgtaaatatttgttttgttgtttcgagttagttacgagagttagtcggtttagataagtaggggatga

SEQ ID NO: 4877 - DNA, 278 bp, Artificial Sequence
  Description of Artificial Sequence: Synthetic polynucleotide
agggtattaagaaaagaggggtatgcgagtttggaagttggagagagttcggggttttttagagcgggtgggacgtcgcgtttttaggatttcgcgttacgcgtattttttttatttcgatatttattgttatttttatagcggagcgaggggtttcgtcgagggcgagcgtatttcgtgcggttgagatgttcggaacgttttttcgcgtttcggtttttttagaaggggttatagtcggttcgcgagttttcgggcgggggttgagtcgtagtgtt

SEQ ID NO: 4878 - DNA, 248 bp, Artificial Sequence
  Description of Artificial Sequence: Synthetic polynucleotide
tcggcgtaggcgagtttggtttaagggttcggatcgggtttgggaaaagtttgtttttcgagggggagagcgagcggtcgcgttgaggcgttcgcgttgcgcgggggcgtttttcgttgtttgtagggagcgcggcgcggacgcggcgggcggttcggttatttggaacgggcgttcgttttggttttcggggttgtttttgtcgtttcgggaagtcgtcgatgggttttatcgttggcggttcgcgt

SEQ ID NO: 4879 - DNA, 216 bp, Artificial Sequence
  Description of Artificial Sequence: Synthetic polynucleotide
tcgtcgtcgttggtgggtggcggcggttcgggtgttttttggattgcgtagtaaagaggtattttgggagatggggttaaggttttagggggtgttattcgcgaacggtttattcgttagattaggggggttttttggttgtgcgtttggttagaattggttttgacgatggaagtttttggaattaaagcgttgtttttttttttttgtgttata

SEQ ID NO: 4880 - DNA, 201 bp, Artificial Sequence
  Description of Artificial Sequence: Synthetic polynucleotide
gtatttattagggcgtttcgtaaaaaatttcgttttcgtttgtttttgggaattataggtaagttttgggttttcgaggtgtagttttaggtagagtttcgtgttgggaggtgggaagggggtttgattttggggatttaggtagtttggggatagttttattaggggtcggtgtttagaattggtgagggaggtatttta

SEQ ID NO: 4881 - DNA, 208 bp, Artificial Sequence
  Description of Artificial Sequence: Synthetic polynucleotide
cgagacggataggaatcgaggagatttttttgtagcgttttttatttttcggatagaaattttgtagattacgtttatttttttatttcgtgtatcgttcgtggttcgtgggtagtagttgtttttttgggatttttttcgtttgttcgcgagttttcgtacggtcgcgtttttgttgttggggtcgttcgttggttttggttgttcg

SEQ ID NO: 4882 - DNA, 201 bp, Artificial Sequence
  Description of Artificial Sequence: Synthetic polynucleotide
atttggtttaatcgtcgttagttttaagttacggtttcggttttttttttttaattgtgtgggatttcgtcgtttggtttcggtcgggcggaggggtgacgttagtcgtttatatagtgttttttggtcgttggagttcgggaaatttgtgcgttcgaatttggtttcgttaagaagttgggtaaggattcgggtttttga

SEQ ID NO: 4883 - DNA, 364 bp, Artificial Sequence
  Description of Artificial Sequence: Synthetic polynucleotide
ggcggttagtagggttttcgttttcggggagaagtgtttacgatttaagggttgtttgttttaggaattttttaaagaattatagatattgagagtattcggggtttggtaggaagtgtagtgtattttttagttttagggtaattaggatagtatgaattttttattttgtggtagaataaacggttagcgtttcgatgtggcgcgttcgatttttttttatagagtttaaaagttacgtttaattaaattgtagcgttttcgttttagttgggtatcggtttggaagcggtttggaattagattggattcgaggaggtaagatttcggtagcgcgaggttaattataggttttattcgcggt

SEQ ID NO: 4884 - DNA, 213 bp, Artificial Sequence
  Description of Artificial Sequence: Synthetic polynucleotide
ttttttaggtttttggcgttttcggcgcggttgttttcgcggttgttttcgtttatggtcggcggcggtgcgtagcgcggcgttgttcgtcgtgttgagcgttgattcgcgcgttcgttgttgttcggttttcggcggcgagaatggaaagttgtcgttttcgttaatttcgaggagagatagaagattttatatgttggggagaggttgggc

SEQ ID NO: 4885 - DNA, 201 bp, Artificial Sequence
  Description of Artificial Sequence: Synthetic polynucleotide
ggtttgtttttggaagaatcggttttttagtttttcgtcgtcgtagttgtgatataagtaagtgtagtcgcgttgttcggggttcgttagggtttttcgcgttcgttttttatcgtggttcgcggcggtcgcgttttcgtttcgtttcgttcggtcgtttcgtcggtttttgtttttagttgggttgtcgtgacgaggaga

SEQ ID NO: 4886 - DNA, 201 bp, Artificial Sequence
  Description of Artificial Sequence: Synthetic polynucleotide
tttatttatcgcgtttaattattttgtatagttggtttttttttttttttaagtatagtttaagaaggtaaagggagataggaaagggtggtagtttgacgatttagcgatgtattttagaatcgtttttatttttttagtgtgaagttttttgggagaggtgagttaaatcggacggtcggtttttgtagtcgtttagag

SEQ ID NO: 4887 - DNA, 296 bp, Artificial Sequence
  Description of Artificial Sequence: Synthetic polynucleotide
tattagtcgggttggttgggcggttcgggagttcgagcggtggcggagcggcgagtagcgagtagcgtttgcgggagcggtcggtcggtcgggttttcgcgtttcgtacgttcgtacgtttagcggggttcgtattgagtatgggcgcggcggtcgtgcgttggtatttgtgcgtgttgttggttttgggtatacgcgggcggttggtcgggggtagcgggtttttaggtaagttttcgatcgaggtggggggcggcgggcgcggggggttcgggcggtcgaggcgcggtttcgga

SEQ ID NO: 4888 - DNA, 201 bp, Artificial Sequence
  Description of Artificial Sequence: Synthetic polynucleotide
gtttttagtaggtttttattttatttttttcgtcgttcgtcgagttgggttttattaagggtatgcgaagtcgtaaggaaggtaagatgtagcgggcgtcgcgcgatagtgacgcgggtcgggagggttaggaattatagtcgcggttttaggacgaatttcgggtttagtagtttcgggcgtaggagtcgttaggtaggg

SEQ ID NO: 4889 - DNA, 297 bp, Artificial Sequence
  Description of Artificial Sequence: Synthetic polynucleotide
tgtattttcgatacggagttggtgtttcgggaaggttgttttttgaagttttttttgttttgttgtggttttgttttttcgcggatttttttttcgtgtcgaggtttagtttttggttttaaggaataaattcgttggtttgaaagggagttacggtagaagtttaggggtagagcggcgggagcgcgcgattcgcgcggttggagtttcgggggtatttggagagtagcgcgtttaagcggggttattggtttcgcggttgcgtttttttttttttcgcgtcgcgttttttttttc

SEQ ID NO: 4890 - DNA, 268 bp, Artificial Sequence
  Description of Artificial Sequence: Synthetic polynucleotide
gtgtagcggggtttggcgtcggtttttttttattacgcgttcggtttagggtcgtttagtcgtcgttatcgtcgtcgttttttgggtcgatggagtcggcgcggaaggttcgcgcgttttgcgtcgtcgtcgtttagtgtcgtcgttagtatttttttcgttttttcgtttttcgggtttatttcgcgggggcggcgttattttttcgttgtttaggttcgggtatcgcgggcgtttcgcgggcggtagtcgtttttttcgagcgcga

SEQ ID NO: 4891 - DNA, 201 bp, Artificial Sequence
  Description of Artificial Sequence: Synthetic polynucleotide
aaggagcgggattgttttttcggttggacgatagcgtcggggattcgtagcgtgcgcgggtcggaattaaaaaagtagttcgggagcgcgagggttgagcggggtaagtatgggttgtttttcgtagttttttttttgttcgaggttcgggttggtcgtttgtttgtttatgattgtttagttgttttttcgattgtttag

SEQ ID NO: 4892 - DNA, 201 bp, Artificial Sequence
  Description of Artificial Sequence: Synthetic polynucleotide
ttaattcgttcgtagttgttcgttttggattaagtcgtttcgcggttcgtgttaggtagtgggttcgtttttttttttttttttttttttaaattgggacgtgcgaaggcgtagttgttttttcggggttttttttattttttatatattttgttttcgttttttgttttttaggttcgtggcggagagatgttgatcgcg

SEQ ID NO: 4893 - DNA, 201 bp, Artificial Sequence
  Description of Artificial Sequence: Synthetic polynucleotide
gttttggagtttagtagagttggagcgtatattttcgttttttttttttcgttttcgagtattaggcggatatattcgtatttcgaatgttttagtgggcgtagagtttattagaaatggatagtcggatttttcggcgtttgttgggggtatcgttgttaggtgtttggggttcgttttttcggttttgttcgtataggg

SEQ ID NO: 4894 - DNA, 201 bp, Artificial Sequence
  Description of Artificial Sequence: Synthetic polynucleotide
ggtcgtcgggcgttgtagtgggacgcgcgcggttgtgagtttgcgggatatgtttttcgcgtcggttttttgttggcggttatgaagaggtagaacgtgcggattttgttttttatcgtttgtatttttatttatttgttggtgggcgtcgtcgtgttcgacgttttcgagtcggattacgagatgcgcgaggaggagaaa

SEQ ID NO: 4895 - DNA, 302 bp, Artificial Sequence
  Description of Artificial Sequence: Synthetic polynucleotide
cgttcggacgtcggagggtttcgattttcgcgcggtttatgcgttcgcgttcgtttcgttgtttcgcgaggttcgcgggatttttttcgtcgtcgtcgtcgcgttcgtcgttttcggaggagcgggttggtcgatcgttatcgcgtcgtttttcggtcgttttcgaagtcgttttatcgcggtttttgtcgttttggggtcgcgtttcgttttcgcgttttgggggttgagtcgagtaaatttcgcgtatcggtcgacgttcggcggggatttcgttgcgtattcgcgcgttcgggtgggcg

SEQ ID NO: 4896 - DNA, 201 bp, Artificial Sequence
  Description of Artificial Sequence: Synthetic polynucleotide
tttttttggggttttttatgttaggtttcgcggttgtgttcgtaagcgtagatggtttcgggattcgggttattttgacgtcgtagatttagtacgttgcggatcgggtacgttggatttcgggataagtgcggagggtcgggggttggaagggattcgagagtagagttcgcgtttttattttacggacgcggttatcga

SEQ ID NO: 4897 - DNA, 220 bp, Artificial Sequence
  Description of Artificial Sequence: Synthetic polynucleotide
cggttcgtcgtttcgtatttgcgttcgtagtcgcgcgttcgttcgttcgtcgtcgttaggtttcgcggttcgggcgtttatgtcgcgttttgcgttcgtcgtcgtcgtcgttgagagtcgcggagcgtagttcgagggagcgtcgggcgggggagtcgagcgatcgggggcggggcggggggcgagagttggttcggggttcggtagtcgttcgtttcgc

SEQ ID NO: 4898 - DNA, 347 bp, Artificial Sequence
  Description of Artificial Sequence: Synthetic polynucleotide
ggcggtatatcggtagggcggtcggttttgttgggttttttgggcgtcggtttcgggggttcgggcggtttttttcggttttcggtttggattcgcgaacgcgcgggcgcgaggggttgggacgcgggagttttttgagtgcggagcgcggagttttggtgtttcggcgtattgtagttatattttcgggtcgcgcgttttcgtcgttttttattcgcgtcgtagggtttttttttttgaggcgtcgttcgcgtatcgtcgggggggagggggtagcgttaataaattggggagttcggttcgtcgcgtttaggttttcgtttggagtcgtcgtattcgggacggtg

SEQ ID NO: 4899 - DNA, 201 bp, Artificial Sequence
  Description of Artificial Sequence: Synthetic polynucleotide
cgtgtacgtttcgtttttattggtttcgtttcgtgattacgttttcgtaattttgatagattttattttcgaggattttttttaggagtatagtgatttcgtttttatagggttcgtttcgttatattgattttttcgtgtcgttcgcgggattttatttttgttcgtttgtttcggtgtttatggggaagtttggtgtta

SEQ ID NO: 4900 - DNA, 201 bp, Artificial Sequence
  Description of Artificial Sequence: Synthetic polynucleotide
tagattcgggggaattaggaaacgcgttcggcgattttcgggtagtagtatcgggttaggtttgttttcggaatcgttgacgttattcgtcgtttttttcgtttgggtttttcgcgggtcgtaggggtggaagttcgatttgggttagggttcggatttttttttttcggtttttgcgtcgtcgttttcggtgttaggacg

SEQ ID NO: 4901 - DNA, 225 bp, Artificial Sequence
  Description of Artificial Sequence: Synthetic polynucleotide
ttgtagtttgggtaatcgagcgagattttatttaaaaaaaaaaaaaaaaaaaaaaattaaggttgaattcgggttttcgtacgttcgtatttatttgcgcggttattacgcgttgtttttcggcgattaggttgtattttttgtattggtagtcgcgttatatgtagaagcgtttgtggtttttgagcggcgaggcgtagtcgtggtttttgtagcgtgcgtatt

SEQ ID NO: 4902 - DNA, 318 bp, Artificial Sequence
  Description of Artificial Sequence: Synthetic polynucleotide
ggttttggtagagcgcgtagcgagtcggggatgaggttttttaagttttcgttggtttgttgtcggcgtagcgttatttgcgtagttatgattcgttgtcgttcgatgatgaggatgtatttttcgtaggtgtagtttttgaagcggtagtaacgtttgtggtttttgagttaggataggacgttatggttgcggtagcgcgcgtatttgggcgtgcgttgtaggggcgttcgtggcggttgcgatatcgggtcgtttatgtataggtagggggagtcgtagtcgtttatgtttcgggttttcgaatgagttggtagt

SEQ ID NO: 4903 - DNA, 265 bp, Artificial Sequence
  Description of Artificial Sequence: Synthetic polynucleotide
gtggagggaaggagggaggaagttagttaagtttttagcgatttagtttagtatatttcgaattttgtaaagttttgttcggttttttgtagtttcgggcgttttattttgttgaggtcgttttcggttttttttgatttaggttgggcgggaaaggtcgggtcgttttcgtttggtttagatcgttggtttattcggcgggcgcgcgtagttgtatttagcgtagcgttattggttttagtttgtagattgcgttttttttttt

SEQ ID NO: 4904 - DNA, 259 bp, Artificial Sequence
  Description of Artificial Sequence: Synthetic polynucleotide
gggtcgcggggtcgggggcggtcgtcgtttggttgggggatcggggtcgtgttgggcgtcgcggagtcgggatagtagtagtggcggcggggatagcgtcgcggttggggtttcgcgttttttggagcgttttttgtttagatacgacgatttcgttcggaggtatatcggttttggggataaagattagagagagatgttgtagattttggggttggcggtaaggatttttattcggtttttcgcggtttttttttcg

SEQ ID NO: 4905 - DNA, 201 bp, Artificial Sequence
  Description of Artificial Sequence: Synthetic polynucleotide
gagcgtagattaggtttttagggcgcgggagtttgttgtttttttttgtaggggtcgttttcggacgttttattcgtcgttacgtggtttcgggatgtgcgggttgcggtagagagtgggtagtaatgtttttggttttgcgttttcgttttagtcgcggggatttcgaggcgagtcgttaattggtatcggtgtttcgtt

SEQ ID NO: 4906 - DNA, 323 bp, Artificial Sequence
  Description of Artificial Sequence: Synthetic polynucleotide
acgcgtttgtcggggaagggttcgtcggcgtcgcgttttcgaggtttttgcggcgaatcgcgttacgcgcgatttttggtcgggggcgggaggcggcggcggcggtaggagaagtttaaggttcgagcggttcgtagtttttacgtttgtatttttttattttcgttagttcgatggttcgtttcgcggcgtgtattggagtaagtaggtttcgtttcgagcgcgcgcgttttgggaagtgttgtaagtttggagatttggagtgagtttcgggcgttgttggttcgattgttcgcggtgttttttcggtgaggtcgcggggg

SEQ ID NO: 4907 - DNA, 201 bp, Artificial Sequence
  Description of Artificial Sequence: Synthetic polynucleotide
tagcggcggcggtcgagtttagttcgtagggtgggaattgagataggcgttttacgttgtttatcgcggttgtcgcggtcgtcgtcgtcgtcgtcgttacggtcgtcgttttttgtattttgtcggggtgagacggttgttgaggttgcgattgttggggcggttgttgcgggggttgtgacgggaggtgcggaggcggtt

SEQ ID NO: 4908 - DNA, 355 bp, Artificial Sequence
  Description of Artificial Sequence: Synthetic polynucleotide
tagcgtcgtatagaagtcgtagagtagcggcgtgaagtcgcggttcggcgcgtatcgggtcgtcgcgaagtatagtgttattattttgttttgtagcgtcgtttcggtttttatcgtcgcgtttttataggttattaggtgtcgttcgtttagaatgttaattatggcgtagatacgtagttatttgagattcgaggatatttgtaggaggatgattatttgcggggaggcggcggcgagcgtcgcggtgtttcgtttttgttcgtattatcgggcgttggattttttaagatttgttttagatgcgtttatattttggttaggtttcgtttgtggttggagtaattgtgttcgc

SEQ ID NO: 4909 - DNA, 201 bp, Artificial Sequence
  Description of Artificial Sequence: Synthetic polynucleotide
tgtatttgcgtcgtttttggtttttttaggaatgcgttgaagtttgtaattagttttgtgaagttattgagtgtacggttgagtgaaatttttaaagttcgaggaaaacgggtcggttgaatgggagttagtatggggtttttttttaagttttcgcgttgttaaattttagtagagttttttataatcgtttcgcgcggg

SEQ ID NO: 4910 - DNA, 290 bp, Artificial Sequence
  Description of Artificial Sequence: Synthetic polynucleotide
ttgttatgcgcggtagttcgcgtcggggtcggtattagtagcgttcgggcggatgtagcgagtttacggaggggtatgtttttacgtattaagtataatcgttttaggaatgattcggtgatatcggtcgatgattttttttatagtttgtcggtgagcggcggcggaggtaaggtttcggcggcgcgcgcgatttcggcggcggttttttatttggtgttcggcgaggcgttgcgtaaggcgttcgacgatgggttcggtagtttgggttatttgttttataaggtgtt

SEQ ID NO: 4911 - DNA, 201 bp, Artificial Sequence
  Description of Artificial Sequence: Synthetic polynucleotide
ttattcggcggaaattcgcgagtcggttttttcgcgtttaagaagtttattttttaagtttttttattatgattttgaatgcggataattggggttaaacgaggaaggatatagatttaaaagttagatttaggttttagcgcgtttttgggttttaatttgggagattcgtatttagttcggcggaagttatagttttta

SEQ ID NO: 4912 - DNA, 201 bp, Artificial Sequence
  Description of Artificial Sequence: Synthetic polynucleotide
ttttagcgtttaggtcgattgcgttttgatcgggagttattgcgtttagcgtagttcgagggcgttgagttcggaggatgcggcgcggggcgggggtttcgggagtaatagagattgggattcgagggttcggttcgcgttgttgtttacgtagcgtttttattttggaaagagtgtttttcgcgcggcgggtcggttttt

SEQ ID NO: 4913 - DNA, 288 bp, Artificial Sequence
  Description of Artificial Sequence: Synthetic polynucleotide
gtttaggagaattcgtaagttagcggcgtttgcgttcgagttgtagtcgttttttgtcgtttacgcgagttcgagagcggttttcggagttcgggttagcgtcgagttgtaggcgcgcgtttaatcgttttgttgggtttacgcggtttgagaggtcggagcgtttaattgttggtacgcgagtaacggtttagttaagtttattcggtttgagaggtcggaggttgcgagtgtcgttgttgaaggttgtggtggatcgggttggatcgcggattttgagttatatcg

SEQ ID NO: 4914 - DNA, 212 bp, Artificial Sequence
  Description of Artificial Sequence: Synthetic polynucleotide
ttttgcgtggtagatatttagggataggttaattattatttttaattattcgtttttgagaggtttaggatttgtttttatttgatggatagtggtgtacggattaaagacgacgtaggataggtaatttttttttttaatttttcgggattagggtagttttgaagatttttagaggtagttaagtagttttttttcgtagcggggagtga

SEQ ID NO: 4915 - DNA, 201 bp, Artificial Sequence
  Description of Artificial Sequence: Synthetic polynucleotide
gaggtagggaggcgggggtgcgggaggtttcgcggttgcgcgggcgcgtgttggtggtttcggcggaggtttagtttcggttcgcgttcgcggcgttttcgttgcggttcgagcggtttggttgcgggatttgtgcgtacggatggcgcggtcgtttcggtagtattcgggggtttgggcgtcgttgtttttgttgttatt

SEQ ID NO: 4916 - DNA, 246 bp, Artificial Sequence
  Description of Artificial Sequence: Synthetic polynucleotide
cgtttagtttcgcgtacgtttttttgcgagttcggtcgtttagcgttttttttcgttcgagtcgtcgtttgcgtttcggggtagtcgttttgtttttagcgcgatgtggtttcgtttggttttttgttgttggggtttggcgttcgtttcgggttgggcgattttttagtagatgttttcgtcgcgtaattttagttttcgtttttttttcgagatcgcgttcggggttttcgggagtattttcgc

SEQ ID NO: 4917 - DNA, 201 bp, Artificial Sequence
  Description of Artificial Sequence: Synthetic polynucleotide
ttttttagggatggagtagttacgtttttcgagtgtgtttattttatcgatggagtaaagtgaggtttttagttcgttcggatgtttttgcgtcgttcgcggggtagttttcgtatagatacgttcgtaagttttcgattcgttcgttattcgcgtttagatattcgcgagtttttggggtcgtagggacggtgtagcgtt

SEQ ID NO: 4918 - DNA, 201 bp, Artificial Sequence
  Description of Artificial Sequence: Synthetic polynucleotide
attttagatatataggtagtcgggattttcgttcggtgcgtttgtttatttatttttttgcgttaggttgggacgcgtttcgtttgtaaaaggtttaaacgtatttttcgtcgcggggcgggatttaggggtttaggtttcggggtttagaggcgggtaattttgttaattttttttagcggcggggaacgtcgcgtaatc

SEQ ID NO: 4919 - DNA, 358 bp, Artificial Sequence
  Description of Artificial Sequence: Synthetic polynucleotide
ttaacgggttcggtgtatcgttatcgcggtttcggtttcgttcgagttcggttgagtttttaggtcgggtttcgggtttcgggcgttcgcggggtaggacgtttttcgtcgaggcgtaggggtagttatattgcggggcgtttgggcgacggcgttaaagttagggttataagggtacgggataagcggggcggggggagtaggagattaggatagaggtcggcgttcgtcgcgggcgtttttacgtcgcgggtatcgttcgttcggttttagcgttcggggcgtaaagtaagggcgtaaattttgttcgaggcggcgacggttgcggtcggggtttattttgaagtcgttaggtgtt

SEQ ID NO: 4920 - DNA, 201 bp, Artificial Sequence
  Description of Artificial Sequence: Synthetic polynucleotide
gttgcgtgttcgtcgtttatagtcgtagttaaagagacgtaggcggttttacgcggtttggtttatcgtcgtttgtagtgttcgcggcgcggggcgtttcgaggttgggtttatcgtttttttcgcgtttttgaagatttttcgggttttttcgaaggagtattgtttttttttgtattttttttttagggagttcggtcg

SEQ ID NO: 4921 - DNA, 201 bp, Artificial Sequence
  Description of Artificial Sequence: Synthetic polynucleotide
cgttttttcgttttcggttcgagcggtcgttatcgcgggcgggcggcgttgcgttcgggtgcggtttttcgtcggcggcggcggcgcggtcgagaggtgcgggtttcgcgcgggcgggacgcggggcgttgttcgtaggagcgattaggtgggcgtcgggtcgatcgtagtcgtcgtcgcgttttttttcgcgtttcgggt

SEQ ID NO: 4922 - DNA, 201 bp, Artificial Sequence
  Description of Artificial Sequence: Synthetic polynucleotide
gtcgaggtttagagtcggtttttgttcgtaggcggcgaacggtattttgtttcgttaggtttttgcgggtgtgattcgtgattcgtagattttttcgggcgtttttggtttatgacgcgggggttgttcgttttacgtaggcggtttcgggatgttttttcgtttagattttagcggtagaaatagtttcggatttttttt

SEQ ID NO: 4923 - DNA, 277 bp, Artificial Sequence
  Description of Artificial Sequence: Synthetic polynucleotide
aggggagtaaaacggagttttcgggggtacgtaggtttcgtttttgggtgttggttttgtttttggtttttttagtcggtgtagtgattcggaatagcgcggtcgttttttcgacgttcgcggttttttattgcgtcgaggcgagcgttacggttaaagtttaagtttcggcgttcgttgcgtttgtcggagttttgtttgttcgagtaggtagcggggtttaggtacggcggcgacgtcgaagggttagtcggtagatagggttgggtttttgcgg

SEQ ID NO: 4924 - DNA, 201 bp, Artificial Sequence
  Description of Artificial Sequence: Synthetic polynucleotide
tattttgtttttagttcgattttttttgcgttcggagtttgggttcggcgcgtaggagattgcgtgtattttggcgttttcgatttttgttagggcgtacggggattttagagcggattttttacgagttttaataggaggttagggagtcgggatattagagataaattttttcgaagttttttttcggttttattgatt

SEQ ID NO: 4925 - DNA, 247 bp, Artificial Sequence
  Description of Artificial Sequence: Synthetic polynucleotide
gtcgttatagtcgtttcgagttcgcgcgtagttttagttgttacgcggattttttgtttagattgcgttgttgaagtcggcgtttcgttttatacgggtcgcgttaattcggtcgttgtgtacggtcgggtgcgaaattttttcgcgggtttacggggttgtcgaggcggggtcgtagcggtcgtcggggttggggttggtttcggtttgagatagttttatggaaggttaggttttcggtttttgc

SEQ ID NO: 4926 - DNA, 201 bp, Artificial Sequence
  Description of Artificial Sequence: Synthetic polynucleotide
cgtcgtttcgcgcgtttcggttatcgtcgtgtttttttcgggcgttagggaaggtggttaggtggtttttgttcgtcgcgttttgcgtttcgcgtcgttcgttttgcgttttgttttgttcggttgcgttttttcgggttttttcgtcgttatcgggaagcgtcgttcggttttgagcgttgcgcgggttgcgcgcggggg

SEQ ID NO: 4927 - DNA, 201 bp, Artificial Sequence
  Description of Artificial Sequence: Synthetic polynucleotide
tttgaagtcggcggtgtttaggagcgcgtcgtttttcgcgtagggtcgtttgcgggtatacgttagcgttttttagttcgcgtcgggcgttttcgcggacgcgcgtagttttcggttcgttaggttcggttcgcgtagcgtagttcgcggttatcgcgatttatcgggcgggcgggcggtcgggcgggggcgggtttggcg

SEQ ID NO: 4928 - DNA, 201 bp, Artificial Sequence
  Description of Artificial Sequence: Synthetic polynucleotide
taggtttggttttagaatcgtcgggttaaggagaagaggttgaagaaggacgtcggtcggtagcgttgggggtagtattttcgtaatatgaagcgttttcgcggcggttttaagtcggataaggatagcgtttaggaggggtaggatagcgacgttgaggttttttttttcggtaggcggagggatcgcggagttcggggg

SEQ ID NO: 4929 - DNA, 356 bp, Artificial Sequence
  Description of Artificial Sequence: Synthetic polynucleotide
ttgatcgtgatgataagaaggttggggaggttaagagaaaagggaagagagagtgtagttgtaaattttttttcgggttcgagaagtatcgtttttttgcgtgtttaattggtatttgttattaatatgtttgtttttatttaaatggtttagagtaaggttttgattaaattagtatttttacgttaatatttagtagcgtttttggtttttggtagattttttttttagttgttaaagtaaaattatagaagcgttttggttttatttaaggtttgttggggttttttgttttttttcggagattcgaatagttcgtagatgtgcggtatttgtttatgttcgtgtttcgtgtt

SEQ ID NO: 4930 - DNA, 201 bp, Artificial Sequence
  Description of Artificial Sequence: Synthetic polynucleotide
agtcgatacgcgcgatgcgcgagaaagcgcggtgtatcgggtcgttgtcgcggtaaaattgtagtacgtggcggtatacgttgtttacgcggtcgtatacgtagcgcgttttgtgggcgttttagttttcgcggcggtataggcgcgagtagtagtaggtgtagtagttgtggtaggatttgaagtagaggtaggcgttga

SEQ ID NO: 4931 - DNA, 281 bp, Artificial Sequence
  Description of Artificial Sequence: Synthetic polynucleotide
gggttttatcggggcgtagggttggggaatcggagtttcgttcgtcgattcggagtatcgtttacgtagattcgtttcgggcgagggaggggtcgggcgcgtattcgcggggagggcggcgagcggggattagtcgaagtcgggagaggggcgtttttacggggcgggaaattggcgcgcgattttgggggaagtgtaggatggggggataggggcgttttcgcgggggtggatgggggattatagcggggttggcggggtaggggtcggcgtacgaggtt

SEQ ID NO: 4932 - DNA, 222 bp, Artificial Sequence
  Description of Artificial Sequence: Synthetic polynucleotide
tatcgatttttcgtgtagcggtttcgtttcgtcggattttaattattgttttaaggattgggattataatggtttttttgtgtttattattaacgttatcggttaggtgaggcggttaggcgggtcgcgggtttgggggcgggtagagagcggcgagggcggggttttacgttcgttgtattttttttatatttttagtgggatttggtgtgtgatttgggt

SEQ ID NO: 4933 - DNA, 237 bp, Artificial Sequence
  Description of Artificial Sequence: Synthetic polynucleotide
gcggttcggaggcggttatgattatgtatatgaaggggcggtcggtgcgtcggttcgtggggtagatggtggtgggcgtgaagcgtttgttggtttcgacgaattcgtaaagttgttcgtagacgcgcgggaattcgtggcgtaggaagacgtcgcgtagtcgtagttcgcgttggatgtggatgaaggttatttcgcgcgcgcgtcggttcgtttcgtcgttttgatttaggttcg

SEQ ID NO: 4934 - DNA, 201 bp, Artificial Sequence
  Description of Artificial Sequence: Synthetic polynucleotide
ggtttggaatagagattttagttgatttataaggacggggtttgagatttggggttttttgttatagtggtataatttagtttgtattgattaatatagttttttgtgaatttcggttttaatatttaaattaaggtattcggttgttttattaagttgttatacgtttatttaaaagtattgttagattgaggaattagg

SEQ ID NO: 4935 - DNA, 364 bp, Artificial Sequence
  Description of Artificial Sequence: Synthetic polynucleotide
gcgttcgggttttgtagttttttgttgttgttcgcgttcgggtacgcgtgtttcgcgggttgcgtttgtatcgattcgtatatcgtggattgtcgcgatcgcgggttgtttagcgtgttagattttttttttttggacgtgcgtaagttgttggtggtcggtaatcgtatttagcggattttcgaggatttttttattttttacggcgatttggtttatttggattttaggaataattcgttgcgttcgttggaggagggtacgtttagcggttcggttaagttcgtgtttttcgattttagttataataatttgatttagttgggcgtcggcgtttttcgttcggtcgggaggttggtgaagt

SEQ ID NO: 4936 - DNA, 201 bp, Artificial Sequence
  Description of Artificial Sequence: Synthetic polynucleotide
tcgggatacgttttagggaaatcgtttttgggtttggtagttgaatttagacgtcgagtgtagttcgttcggtgcgcgcggcgttttattgttagatttcggaaattagttgttagggtggggtcgcgttttggcgacggttattcggttatttttgtcgttttcgttttttttaagagatttttttagcgggttaatttt

SEQ ID NO: 4937 - DNA, 201 bp, Artificial Sequence
  Description of Artificial Sequence: Synthetic polynucleotide
gttttagaggggagtcggggtggatttttatggaagggagacgtttgcgttagtttaggagtggagttcgtgttttatcggttttttaaattgcgagtacgaaatttttagaggggagttgagttggtgtttcgcgtgttttttattttttattttttattcgtaggttagatttgcgttgtttattttaggagggagcgt

SEQ ID NO: 4938 - DNA, 201 bp, Artificial Sequence
  Description of Artificial Sequence: Synthetic polynucleotide
tcgttttatcgatgcggagcgcgagttgtttattgttttttattatgtttaggattttggtttgggggcgagagaggtgataaagagttgtatgatgcgcggggggcgcgcggtcgggtattttcggttttatttgttgtgtttttcgcggttcggtttcgttcgcgtttcgatttttaggtatcggtagcgtcggttttt

SEQ ID NO: 4939 - DNA, 222 bp, Artificial Sequence
  Description of Artificial Sequence: Synthetic polynucleotide
agcgtatatatatagatataggtttatatagatagattcggttttaaaaatacgtattcgtagaggtaaaggttagcgtataagtacgtatagatatatcgataggcggttttcggatatcgcgttttttgtcgtatttacggtttacgtaagggtttatatacggttttacggaggatagttataaaatatttagatatacgttatatacgtacgcgcgta

SEQ ID NO: 4940 - DNA, 201 bp, Artificial Sequence
  Description of Artificial Sequence: Synthetic polynucleotide
gtttatatatattagtgaaacggttaaatggtagtattaggtgttaagtgatcgtataggcgtgtttttgttagttgtgagtaagataaggtagtttatcgtttttagggagtttagtttttatgggggtgtattcgtttgttagggttgttgtatttaagtattattaattcggtggcgttaataatagattttattgtt

SEQ ID NO: 4941 - DNA, 265 bp, Artificial Sequence
  Description of Artificial Sequence: Synthetic polynucleotide
ggcgggcgtcggcggggcggttttttagtaagatgtgcgcggcgtcgcggggcgttttttatttgtagcggcgttcgggagtcgggcggttgggttaggcggcgttttcggggttgttgcgcgttcgcgtttagagttgtcgttttagggagttcgttacggtcgcgtttcgggtacgttcggcggcgtttaacgatgatcgttttttggcggcgttttcggagtttggtttgggaatattgggtcgggtttttcgtgtgcgttt

SEQ ID NO: 4942 - DNA, 242 bp, Artificial Sequence
  Description of Artificial Sequence: Synthetic polynucleotide
gttttcgtcggcggcgttgtattattattattattatatattgttcggtttagtgtagtgatttcgcgggtcgggttttcgtcggcgcgttgtagggcgcgggcgcgtagttcgttcgcgcggtttggattttttttgttcggttgttttggattttataaaaaaaaaaaaaagtttagaaattttcgaataaaattaaatattcggacgatttttttcggtgagcggcgaagatagttcgg

SEQ ID NO: 4943 - DNA, 201 bp, Artificial Sequence
  Description of Artificial Sequence: Synthetic polynucleotide
ttttttttcgttttttttttgtttttttttttgttttgtggtttttttttttttttttagagatatttgggagttgtttttaagttttggggcgtttcgcggggttttgttaagggtgcgtgtgagagagggcggcggagtcggcgtcgggtgttaggggtcgagggtgggagcgggagttcgtggttttgcgttttggag

SEQ ID NO: 4944 - DNA, 261 bp, Artificial Sequence
  Description of Artificial Sequence: Synthetic polynucleotide
cgggttgtacgcgtaggcggtttattcggggggcggcggcggcggtttggtcgggatgttggcggcgggcggtggcggcgcggggtcgggtttgtattacgcgttgtacgaggatggttacgaggcgtagttggagtcgtcgtcgtcgtcgtatttgggcgtttacggatacgtatacggatatgtatacgcgggcggtttgtacgcggcggcggcgtatttgtattcgggcgcgggcggcggcggtttatcggtgggcga

SEQ ID NO: 4945 - DNA, 201 bp, Artificial Sequence
  Description of Artificial Sequence: Synthetic polynucleotide
ggggattcgcgtaggttagcgtgtcggttttttttagtttatcgttgtcgtcgtcggggttgttttaagggagttaagcggagtgggagcgggtttgcgcgtttttgttttgcgcgtaggggcgggggggtttaggacggggcgtttttttttatttatatgttgatttaggatttttaagcggttcggtttaggatatcg

SEQ ID NO: 4946 - DNA, 337 bp, Artificial Sequence
  Description of Artificial Sequence: Synthetic polynucleotide
gtaagagcggtgtagtcgagtcggcgttttagaagtcgagaggttatataagtttacgtagagaggcgtatcggatacggtaattaggagtaatttatacgttttcgggcgtacggaaattatttgttaggaaatttttaacgttttttttcgtttatttttttttattttttttttggcgcgttttttttttttttagaggtacgtagtggagtttttggagtttcgaatttttcggatattgtagaatgcggggtttttcgggcgcgggttcggttaattagagcgtcgtttgttttttttggttaatggtaggcgttatattgttgtttaattt

SEQ ID NO: 4947 - DNA, 201 bp, Artificial Sequence
  Description of Artificial Sequence: Synthetic polynucleotide
aagttttgggtggcgcgtaaaggcgtaggcgagggtcgtcgtatagagtcgtttaagttgtggtcggagcgttagggcgatttttgggaattttttaagcggaatttttcgagataagcggtttttgttttttgatattttagtcgaggtcgagttgacgcgtagttatttaattttttttgtttcggggaaataatttta

SEQ ID NO: 4948 - DNA, 201 bp, Artificial Sequence
  Description of Artificial Sequence: Synthetic polynucleotide
atgagtcgagagggttgagcggagagtgtggttttcggcggttggaggtaggagaatatgttgcgttcgttcgtcgcggcgtgagaggttcgaggtgggcgcgtcggggtaggggcggtcgcgggcgtttgttcgtttagtgggcgttgttcggatttggcgaggtggtggtttgtaatattgtgttcgtattgtttattg

SEQ ID NO: 4949 - DNA, 201 bp, Artificial Sequence
  Description of Artificial Sequence: Synthetic polynucleotide
gtagcgtcgcggcggttagtagcgtcgggtagtggattcgcggtggcgcggcgtcgggtcgcggtgtttagggcgggagtagtagtacgaggtttagggcgagcgtttaggatagcgttagtatgttcgtcgtgtggcgtttttggtatagcgtttggtaggtggcgggcgttcgggtgatgagtaggtagcggtttaggg

SEQ ID NO: 4950 - DNA, 201 bp, Artificial Sequence
  Description of Artificial Sequence: Synthetic polynucleotide
gttttaggagggaaggaggcgacggtgtttaaggacgtcggaagtcggggattttcgtttttttcgggtttcggttaggttattagtgttggttcgcggcgcgggtgtttagttgcgtttgggatattgcgggtacggttgtggcggtaacggtagcggtcgtcgcgtcgtcgacgttcggtaggattgagcgtacggagc

SEQ ID NO: 4951 - DNA, 386 bp, Artificial Sequence
  Description of Artificial Sequence: Synthetic polynucleotide
ggtggtatgtacgttttatttaaaaagtagatttttttttgtaattgttagtaagtggaaggatagtaaattttatattatttcgagatttgtgcgtttcgagcggttttaatttcgtttcgtttgttgttgttgttgttggtgttgtttcggttgtagttgttgtcgttttacgatttcggggcgttgaggtaatagggttttttttttttattttttatttttttcggtttttttatagaagcgtcgtttttagtaatttttcgtgtattttttatttttgtcgtcgtttattttattttttttttttttgttttttttttaaatcgtttttaagtatatttttcgtcgttggaagtgattataatgttgttttttaataagta

SEQ ID NO: 4952 - DNA, 201 bp, Artificial Sequence
  Description of Artificial Sequence: Synthetic polynucleotide
tttttcgtttttcgcggcgcgcgtcgttttcgggggtttcgcgttttcgcgtttaggttttttttttttggcgggcgtttataggcggcgcgggtagcgcgagtttcggagtttcggaggtttgtgcgttttgagtcggtatggatttcgagtattgcgcgttttttcgcgtggggtttgtattcggtttttatgtggttt

SEQ ID NO: 4953 - DNA, 201 bp, Artificial Sequence
  Description of Artificial Sequence: Synthetic polynucleotide
ggggcgattcggagttgcgcgtcggcgtacgcgatttcgttcgttttttattttttgttttattattagttttaatttggttttcgttcgtcgcgcgttcggggtttaggggagcggcgcggggatttaggttttacggcggagagagcgcgcgggattgcgaagattggggtcgagtgtcgttttttttgcgttttggta

SEQ ID NO: 4954 - DNA, 309 bp, Artificial Sequence
  Description of Artificial Sequence: Synthetic polynucleotide
aggcgtagacgttggagttggagcggcgttttcggtagtagcggtatttgtttgcgttcgagcgcgagtagttggcgagtttgtttcgttttacgtttacgtaggttaagatttggttttagaattatcgttataagttgaagcgcgttcgcgttttaggggcggcggagtcgtttgatttggtagtattcgtcgagttgtacgtcgcgttcggtttgttgcgtcgcgtggtggtgtcggtgtttgttcgcgacgggtagtcgtgcggcggcggcggcggtggcgaggtgggaatcgtcgcggtttagg

SEQ ID NO: 4955 - DNA, 203 bp, Artificial Sequence
  Description of Artificial Sequence: Synthetic polynucleotide
agcgtatattgtcgttagttagttagtcgtcgtcgtattggtttagtttcgaaaatttttaggcggcgtagaggtgtttaattttggttattacggcgtcgcgtcgtcggtacgtcgcgtgggttttagatagcgttagtcgttcgggtacgaagaatatttggtttggggattatagcgggttatcgatcgagggtagggtg

SEQ ID NO: 4956 - DNA, 388 bp, Artificial Sequence
  Description of Artificial Sequence: Synthetic polynucleotide
ggttcggttcgcggagttagcgtttttttcgcgtcgatttcgggtttcgggcggtcgtcggggggcgtcgggcgtatttttcgttgttaatttttcgttcgtgttttcgttcgcgtttgggtttcgtcgtattttagtagaagttattatagagaataaattatttttttgttttcgagatgggttttcggggaggaaggtaaattgtttgtttcgtgtataataagttaggcgtggagagtagcgcggaggaggtcgcggtagttatcgagcgggtagagtttttcgtttttattcgtcgttcgcgtttgtcgagttttttgtcgagcgggcggcgcgtaggttcggagaattttaaaaggtttggaatatcgggttgtttttcggt

SEQ ID NO: 4957 - DNA, 241 bp, Artificial Sequence
  Description of Artificial Sequence: Synthetic polynucleotide
agttttttatttagatcgcgttagtgcgtttcgggttttattagtttttattaggcgttgtttttttcgtttttatttagtttttttttttcgttttttcgcgagtgtatttaagcgttttcgttttatttatttttagcgtttttttaagtttggaggagcgtttagagtagtagaaatagtaggtattttatatcgttcggcgtggggatttcgcggagcgtcgttgcgcgtcgttttt

SEQ ID NO: 4958 - DNA, 232 bp, Artificial Sequence
  Description of Artificial Sequence: Synthetic polynucleotide
cgtttttttttttagcgtttaggttgggggcggcgtcggtgttagtttagtttagggcgaagtttttagggtcggttcgggtcgggttgcgggattcgtcgtggagcgtaaagtgtttgaagttttcgcgcgtattcggttttgtttttaaaggttttttagaaatgtaagaggttaggcgtagaaatatatacggacggtagttttatgagaaaatgtagataaagagttc

SEQ ID NO: 4959 - DNA, 214 bp, Artificial Sequence
  Description of Artificial Sequence: Synthetic polynucleotide
gtttttttgttttcgcgttttttggattagttttggtggggagttggaaggtatcgagtgcgtttcggttaagaagggcggatagttttgtgcgagtagcgttcggttggcgcggcgcggggtgttttttatgttaaaggaaaggatggattttttgtttgtttagggtttttattttttaaaatttttttaattgcggtattggaagggattt

SEQ ID NO: 4960 - DNA, 250 bp, Artificial Sequence
  Description of Artificial Sequence: Synthetic polynucleotide
cgtagcggggtcgttttattgtcgtatttttatttcgcgttttgcgcgtttatttgtttacgaagttttcgagtatcgagtttttgtcggcgttttggtcgtttattacggcgatttgcggtagttttagtaggtagttttgttttagcgtcgaaaacgcgttttgtagacggtttattagcgggattagtttttttatttttcggttttttattttgttcgaggggtcggcgattagttggtttttgtt

SEQ ID NO: 4961 - DNA, 201 bp, Artificial Sequence
  Description of Artificial Sequence: Synthetic polynucleotide
tggtcggtgaagttttaggattcgttcgtttggggttaaggtaaggggtgcggtacgaggagcgtagggagtttcgagttttaggcgtagatttagttgcggattcgtcgtatagttttggtgttgtaagcgtggatcgtgggcgtaaggtttcggcgggaggtattcggttcggtcgcggtcgggtttgtagggttttgg

SEQ ID NO: 4962 - DNA, 467 bp, Artificial Sequence
  Description of Artificial Sequence: Synthetic polynucleotide
tcgggtatcggcgggagaggggggagaagcggcgtggagaggatttggtaagggtttgtttttaaatttagattatgatttaatattttggacgcgaagcgaagatgggaaacggtcgtttgttgagagggggtatttgtagtttttttagaaaaggttggggtaggagagcgtgcggttagaggggtgggggtatcggagggggggttttattttttgttttatagtcgggtttttttcgcgaggcgttgggaagtatgaggtatgtagtatttaaaatgttttttgaaaaagacggatttgaagtttttttttataaatacgttattgtatttattttttatttagagacgggttgcgcgtttcgagttgtacgggtaggtatttttttcggttttgttttataaggtggggagagcggggttggacgcgggagggggcgggggggggagcgtgagaagaaacga

SEQ ID NO: 4963 - DNA, 201 bp, Artificial Sequence
  Description of Artificial Sequence: Synthetic polynucleotide
cgtatagttagcgaagcgattcgagggttagcgaataagcgttggattttcgtaggtttcggcgattttagattcggtttttcggcgaagataggaaaacgtgtgtcgagagtcgttggagggaatcgttcgtaaatcgaagaagaaattaaattagtagcgaatatttgtaaattagtgttaagttgtgagtttttcgag

SEQ ID NO: 4964 - DNA, 232 bp, Artificial Sequence
  Description of Artificial Sequence: Synthetic polynucleotide
tcgggcgcgggggaggcgtgggtgttggggcgggcgagtttagatttttcgtgggttggtttgtgggtgttttttcggaaataaatgaggttgtaggagcggtgatcggtttgattgtttttgggggtttcgaattcgtgggtggagagggtaaggcggaggtcgtggttagtatttttttagtgataatgtcgtcggggatttttttttttattttttgggagtattttag

SEQ ID NO: 4965 - DNA, 222 bp, Artificial Sequence
  Description of Artificial Sequence: Synthetic polynucleotide
tacgattttaggttcgttgatgatcgttgtggtatgaatgaggttatcgtattcggagaggtggatgtttagatgtggatttaggaaatggttttatttcgaaagtttcgggttagtgggcgtgttttttggttagtgtttttacgttcgcgttagaagggtagtaggttttcgtagggttcggcgttttatttattcgtgttttttttgttgtttttagtt

SEQ ID NO: 4966 - DNA, 239 bp, Artificial Sequence
  Description of Artificial Sequence: Synthetic polynucleotide
tagcgtcgcgttttacgttcgttatcgtcgtcgtcgttttagtatatcgtaggcgtgagtttcgtcgcgatcgggagagtttttttagttgtgcgttttcgaggtatttggtcgggcggggaggcgtcgggtcggggcgtataggggttaggcgggggcgttgttgtttatttttcgtttttcgggcgtgcgtttcgtttcggagttcgtatttcgcgttcgcgtttcgtttggaagtt

SEQ ID NO: 4967 - DNA, 209 bp, Artificial Sequence
  Description of Artificial Sequence: Synthetic polynucleotide
gtttattcgtcgtagtagtttatttttgttcgttagggagtttagggtagtttttgaagttgttagatttttttacgtaggcggcggcgttttgtattgcggagtcgcgttttgggggagtagtatttttagtttcggcgtttcgtagttagatagttttttttagggtggtagtatttttcggttagggtgtagggattttcggggcg

SEQ ID NO: 4968 - DNA, 380 bp, Artificial Sequence
  Description of Artificial Sequence: Synthetic polynucleotide
gtttagatagataaaattattttattaaagtgtaatgggagagaggaagaggagtaatgagaaggtatgtgagcggggagaaagaaaaagttcgggaggcgaaaacgaaatttatttttttgcgtttatttttgttagaggtttgtaggacgtgttttaatttggtatttcgagtttagaataaaagttacgggggttgcggtatgggtagggggaaggcgcgcggtggttgacgcggggtaggggttttggcgagcgcgggaggggcggttagtagtcgttcgcggggttggattgggagtttcgtgcgatttcgggtttggcgtttgggtcgggggtggttttcgggtttttttcgggggtcgtcgaggttcggtttc

SEQ ID NO: 4969 - DNA, 394 bp, Artificial Sequence
  Description of Artificial Sequence: Synthetic polynucleotide
ggtttttttttatgagggtttcgagtagatgaggtttaaaagtcgttttaaggagttttttttaagtttgattcgagtgggcgcgaatttttatagtagcgttaagtagtaggattatagcgttagcgtttggtttcggaggaaagataagttggagtacgtaagggcgattcgttttcgggggtttcggttaggtatttgtcgtatgtatttttttcgtggtggtggtatgagcgcgcgcggggcgcggggggtaggcgaggggattttggtaggcgtcgacgttttaggtcggattcgggggtttttttgtttgtagttttttgttttaatgatcgggttgcggggaggggagggtaggtttttttttaggtttttggtttttgtcgattcg

SEQ ID NO: 4970 - DNA, 201 bp, Artificial Sequence
  Description of Artificial Sequence: Synthetic polynucleotide
ttcggtttttttatttcggttttttatggggttttcgggtttgttcgttgtgagtagttttattttggggtgttggcgggatggttgtttcgtgtagggcgttcgggagtttagatttcgtggaaatgtttggggtttttttttgtttagaggggatagtgagtagttacgttgcgatatgtttgagggattcggacgaag

SEQ ID NO: 4971 - DNA, 557 bp, Artificial Sequence
  Description of Artificial Sequence: Synthetic polynucleotide
cgggggaaaggtcggcgttttagggcggggaggatttgggagtggagttcggagataaaatcggggttaggtagaggagttagagggaaagttagtaaacgcgagttcgggtgagagttatcggaatgcgggaacgtagtttagtcgggaatagggttttcgataggggtcgttcgtggttaggacgcggtcgttgaatagaggtcgcgcggcggtttttgttcgagggatttcgtgggcgggggttatacggaggtcgcgtacggttttcggggttggcgggggtaggtgggaggatttttttcgggttcgcgaatttgatttggtagcggttaggtgtttggaagcgtttttaaatgatagggttataaagatatgttggttaggtttgtagttagcgtagtaacgtggtttgtaggagcgtagaacgaggttagatagggttattcggacgtcgtgttgttagtgggtgggggtcgggagtaagcggtattggtttggagatttcgcggtaggtgattttttttatttgggtagcgaggttgaacgatggcgat

SEQ ID NO: 4972 - DNA, 212 bp, Artificial Sequence
  Description of Artificial Sequence: Synthetic polynucleotide
ttggagggagttgggggattttggagggtgggaagtggttgattttcggtggtcggatatttatttagagtttgattcgtattcgtgtttttttggaagcgttataattgcggggaaggagtttttagaaatcgtgttagttttaatatggcgggttaaggtggtttttaaaaattgaaaataaaggttttgaggtgggaaaaaatttagtt

SEQ ID NO: 4973 - DNA, 201 bp, Artificial Sequence
  Description of Artificial Sequence: Synthetic polynucleotide
aatagtttttttcggtttttttagttttgtttaaggggtttggaaatgttcgtagttttaagaaaggttttatttaagtataggatggggtggggcgggcggggttaagattgttttggggattgaatttattttcgtttttagcgattttcggcggataaagcgtaagtttgtgtatacggtcgattgagttattggaaa

SEQ ID NO: 4974 - DNA, 201 bp, Artificial Sequence
  Description of Artificial Sequence: Synthetic polynucleotide
gggggagttaggggtttttcgtttggggattttcgtgttgggtatttcgtacgttttggacgcgcgtagttttatcgggagcgaattttgtttcgtttgcgggtgttacggagaggggttgggaagtcgagttagttttggcggcgattgggggcgtttttggttttttgggggggcgggggcgcgtattgttgtttagga

SEQ ID NO: 4975 - DNA, 294 bp, Artificial Sequence
  Description of Artificial Sequence: Synthetic polynucleotide
tttgaaagtttttgaagcggttttttttttttttttttttttttcgtaggtagagttgtggtgtggttgggtggtttgcgtgggcgttcgggggattcgcgggtattcgggacgaggcgagggcgtagaaaatttggagtttaattagtacggagttgagttttcgcgttttaatttttaggtgatttcgtgcggcggcggcggtagtagtagtggtagcggcgatcggagttcgtagtagtttcgagcgttttcgggaggataggcggcgagttcggcgaatcgttatttgtt

SEQ ID NO: 4976 - DNA, 244 bp, Artificial Sequence
  Description of Artificial Sequence: Synthetic polynucleotide
ggcgggcgtgagcggcggaggagtcgggcgcggcgatacgcggttatggagcgggagtcggcggggatcgaggagttcgggttttcgggacggcggaggcgtcgagagggtaggacgcgtacggtgcgttttaatttgttgtcgttttcgggcgtcgaggattttgcggttggcgcggttaagggcgagcggcgacggcggcgcgggtgtgtttagtatttggtcgataatcggtttaagatta

SEQ ID NO: 4977 - DNA, 303 bp, Artificial Sequence
  Description of Artificial Sequence: Synthetic polynucleotide
cggggtagtcggggtcgggagagcgggcgtagcgcggcggggatcggagtcgcgggcgtcgggaaaggttttcgttaggaggggagggaatttcgggagcgcgagttagggggaggcgcgtcggaaagcgagagtgataagtagtttataagtcgaaaagtttttcgcgggaggcgcgcgtcgcgtgggtttcgatttagtcgttgcgcgtcgtcgtggtatataggttgaaaagtttgcgaagttatagaagttaggttcggcgtttagggggttttgattttgtttttatggttttagatt

SEQ ID NO: 4978 - DNA, 286 bp, Artificial Sequence
  Description of Artificial Sequence: Synthetic polynucleotide
cgcggaggttggttttggtagtggttagggagtggagaaagtaaattagagtcggttcggttatcgattttgcgaagttttttcgattttagtttagcgcgggagggtggcggaaggtggtgtatcgtagcgtggttttcgtcgttgtcgtcgcggttttgtaaagtgttagcgggggcgaaagcgagagtttaaaggaataggaggtttattgaattttttatcggagtttttaggggttttggttttttagtttgtttttgtttttttagttcggggatttgtt

SEQ ID NO: 4979 - DNA, 261 bp, Artificial Sequence
  Description of Artificial Sequence: Synthetic polynucleotide
gggaatcgagaagaggaagaagcgaacgcgagtaggagcgtagcgtttttcggatttttgaggttttttttgtaatttgttatattcgtagtttttattcgatattgaataataatcgcggggaggagaggttatttgtagtcgaggttcgtaaattgtcggttttattcgggtagcgttaattcggtgttcgcggacggtgattttcgagttttagcgatgcgttttattgggtttaaaatagatttaattttatagtta

SEQ ID NO: 4980 - DNA, 201 bp, Artificial Sequence
  Description of Artificial Sequence: Synthetic polynucleotide
tattgaaaggtagaaatggggagtaggtatttagttcgcggtgggtagggttttaggaggtagttttcgttcggcgatagttttcggggcgtaatttttcgtaggacgcgtatttgttaggatagttattaagaggatgcggaggttgggggttttttcggggataaaattagggtattttaaggaattttttgcgcgttt

SEQ ID NO: 4981 - DNA, 201 bp, Artificial Sequence
  Description of Artificial Sequence: Synthetic polynucleotide
gttggattgggtgcggttgtatttgtggagtgggtggttcggtgattgttattcgggttagtgttgttagtagatgtgtatattttgggcgggggttggcggtcgagtgttattagtaggggcggcggttaggtagttattcgtcgttttttaagttcggcgttgcgcgtagggtttggagtattcggtgttgagacgcga

SEQ ID NO: 4982 - DNA, 201 bp, Artificial Sequence
  Description of Artificial Sequence: Synthetic polynucleotide
taagttgttttttgttttgggtttttgatatttttatagtttttgaaagggttttcggagattttagagagaggcgggtgtcgaggggttacgagttcgcggttgatattcgcgttgcggaagagaatggtattgattgagggttttggggatttgggttttggcgttttggattttaggattatgtatttttcggggcgc

SEQ ID NO: 4983 - DNA, 201 bp, Artificial Sequence
  Description of Artificial Sequence: Synthetic polynucleotide
cgttcggttcgcgggttttaattttatcgtcgtcggtcgaattttgttcgttcgcggcgcgtatagtcggcgttcgcgtatacgcgcgtataaattttacgtaattcgcggtcgtttcgtttcgtcgtcgtcgtagttcgtttgtcgcgcgtttatagttcggttcgagtcgcggggttcgagcgatagcgacggcgtcgg

SEQ ID NO: 4984 - DNA, 201 bp, Artificial Sequence
  Description of Artificial Sequence: Synthetic polynucleotide
cgttcggcgtagagtcgcggtttttttgtttgcgttcgtagtttgcgtcgttcgatatagtgggggtggaggtagttcgtttagttgggcgttttggtgcggtgtcgcgtttaaagttttatttttgcgtcgagggtttgtgatttgtagagagcgatcgtttgattttaagttggttgtagagcgaggttagtcgggata

SEQ ID NO: 4985 - DNA, 201 bp, Artificial Sequence
  Description of Artificial Sequence: Synthetic polynucleotide
tttcgaggtgagtcgtcgttgcgtttatttgttttcgtagttggattgtggagtcgcgttcggaggagcgttggatacggatatttttaatttttttttcgatttcgttttttggttttttgtatatatattttcgttaggaggggaggggaaggtttagtaattgtttggtttggttttgatttatcggttttttcgtag

SEQ ID NO: 4986 - DNA, 201 bp, Artificial Sequence
  Description of Artificial Sequence: Synthetic polynucleotide
gcgtcgtttacgttattcgttatttcgggtcgcggtttcggttcgggtttagtggttgcgtcgtttttcgttagtaacgttcgcgcggaatgagcgcgtcgcgttgttcgcgtttttattcgtagggttcggcgtttttttttcgttcgtcgtttttatagtcgcgcgtttattggttcggttagtttacggggagtcgcg

SEQ ID NO: 4987 - DNA, 201 bp, Artificial Sequence
  Description of Artificial Sequence: Synthetic polynucleotide
gcggaatttcgcggtcgagagtcggtcggtttagttgggcggggatacggcggtttcgggtttgtgttttagttttagtcgggttttttcgcgtcgttgcggttgttgcgcggtgcggtcgtgataagttatagtaaatttgtttttcgcgtcgttttaagttattaggaagcgtaatcggtgtttttggggatcggcgaa

SEQ ID NO: 4988 - DNA, 344 bp, Artificial Sequence
  Description of Artificial Sequence: Synthetic polynucleotide
ttttgattagatgaacggagtggtcggaggtaagtcgcgtgttttcgtaggttcggatttgcgcggttcggaggtggtggatggggtgtagtgggtgtgcgggaatcgtaggagaggattggggttttaggtggacggtgttgattgtattggttttgaagattggaagtgggtgtaggaggaatttgcgatagttgagattagggcgcgcgggtagatgcgttaggtcgttagtaaatcggcgtgcgtgcgtttcggcgcgtttagtttcgggcgagcgtagggatgggggtggaagaggcgttttttcgggtttcgaggtttgcgtaggttttttggtcggt

SEQ ID NO: 4989 - DNA, 201 bp, Artificial Sequence
  Description of Artificial Sequence: Synthetic polynucleotide
ggcgtttgttcgaggcgggagtcgttgggttatgtttttgtttattaggtttttcgaatttttggtagggtagcgtttgttcgtgttttcgatttttttcgtaggtaattcgcgcgaatttggggttcgtagagagcgagcgttcgcggatatcggttgaatagtttggaggttgcgcgagggggcgtcgcggggagggat

SEQ ID NO: 4990 - DNA, 218 bp, Artificial Sequence
  Description of Artificial Sequence: Synthetic polynucleotide
cgggtgtcgtggtgcggggtggggatagttaatttagcggggacggaggaagttgggggtagttgggtgcgtgttttgtatcgtttatttgtcggggttcggtttttggcggtgggcgagagggagtatattcgtttatattttaggaatttgttggggagatgagttcgtggggttagaaagaagggaaaaattttttgggtaagggagagaataat

SEQ ID NO: 4991 - DNA, 234 bp, Artificial Sequence
  Description of Artificial Sequence: Synthetic polynucleotide
cgttgttgttcgttatcgtcgtcgtcgttcggttatcgtatcgtatatattaattatttatcgttcgtttttagtttttcgggcgaagttaattataggcggaggtttcgttaatggggtcgtcgtcgtcgtcgtcgaggaggtagttagtcgcgcgttcgggcgtaagcgatagttttttagggacggggatgggtcgggggcgcgcggggggcgggggcgtacggggcgcgt

SEQ ID NO: 4992 - DNA, 201 bp, Artificial Sequence
  Description of Artificial Sequence: Synthetic polynucleotide
tgaggcggagagaggtcgtttcgcgtttggggttttcgaaagcggttagttgtttttttgttttttttgagcggggagcgttgcgttttttgcgggttgcgggagatttttttagattttcgggtgggaaaattatattgagcgtttcgggaggttgttagatataatattgtatttggtatttttgttcgggtgttttcg

SEQ ID NO: 4993 - DNA, 201 bp, Artificial Sequence
  Description of Artificial Sequence: Synthetic polynucleotide
agttagggtcgggggcgtacgtcggaatatttgggtcgtcgggtatcgagcgtcggggggttgcgcggcgcgtatttggagagggcgtagttatgcgggcggcggcggcgggggggggcgtgcggacggtcgcgttggcgttgttgttgggggcgttgtattgggcgtcggcgcgttgcgaggagtacgattattatggtt

SEQ ID NO: 4994 - DNA, 235 bp, Artificial Sequence
  Description of Artificial Sequence: Synthetic polynucleotide
gtaggggtgttttgttcgtacgtatttacgatagtgagtagtatgttgtttagtagtagcgttaggaatacgatgaataggatgagttttcgcgagcggcggtttttttgtagttagcggattagcgttagttcgtttagggttatggtttcggggtttcgttgcgggcgcggtgcgcggtgaggatttaaggcggtcgtggattttttattttttcgttttttaggtcgcggaa

SEQ ID NO: 4995 - DNA, 201 bp, Artificial Sequence
  Description of Artificial Sequence: Synthetic polynucleotide
ttttttaatagggcgcgttggttcgcgagtcggaggaattttcgtttaggttttgttaagcgtttattcggagtaggtcgggggtagtgaaggatgcggcgggagcggcgcgttgtagtttcgcgacgtggtacgtattttggaagcgatgatttagatatcggtagcggtggatgagttaggggtagaaggtggacggat

SEQ ID NO: 4996 - DNA, 241 bp, Artificial Sequence
  Description of Artificial Sequence: Synthetic polynucleotide
agttttcggttcgaggttgcgttaattcggcgtcggatgttaatgatgaaattaaaatgttatttaagttaaatgcggggagtatacggcgattgggcgcgtataatggtaaatgggattaggtaggcgaaggtttagtcgagtttcggtttcgtagtcgttttcgttatcgtttttttttcgttttttttcggattttggcgttttggtttcgggttataagagttcgttcgttattggt

SEQ ID NO: 4997 - DNA, 201 bp, Artificial Sequence
  Description of Artificial Sequence: Synthetic polynucleotide
gacgatttgggtgatttgggtggaaggtggtgtagtaggtaggtagtggggaggggcggggaggaaatttagggggagggggcgtcgaggttggtgaggcgtttttttcgcgttagggatatgtaggtatcggatggttgcgtaggggtttttgttcgtttggttttgggtgcgttcgtttagtttcggtgtaaatgtttt

SEQ ID NO: 4998 - DNA, 201 bp, Artificial Sequence
  Description of Artificial Sequence: Synthetic polynucleotide
tcgtttcgatttattaggcgcgtagggttcgttttcgaaattcgcgcgggttttcgtagtcggtcgcgcggtttttagtcgcgaagagagcgtcgcgtacggtggcgtcgttatagtcgtgggtcgtcgcgtttaggtagcgttttagttgttcgtaaagtttttgtagcgtcgtttcgtcggggtttacgcgcgtcggtt

SEQ ID NO: 4999 - DNA, 217 bp, Artificial Sequence
  Description of Artificial Sequence: Synthetic polynucleotide
ttaaggttggtttgtgttagaacggcgcgcgcgcgcgtacgtacgtatatatacggggggaaatttttttaaaaatgaaaggttagaagagtttagcggcggcgcgggcgttgcgcgagggtttcggagttgattcgtcgaggtaggaaattttttcggtcgcgacgttcggtttcggttcggcgttcgcgtgggatggtgtagcgttcgtcgtcgg

SEQ ID NO: 5000 - DNA, 201 bp, Artificial Sequence
  Description of Artificial Sequence: Synthetic polynucleotide
ttatattgcgtaagagatcgtaatgaagttcgtagatttttaggttggagtcgtagagcgaggtggcgaggtggagaacgcggggttgggtttggatagcggttttggggtcgtttggagttttcgtttttttaattcggaaggtagcggattgatatttgcgtcgaagtcgcgcgtattttacggagggtcgggattttg

SEQ ID NO: 5001 - DNA, 201 bp, Artificial Sequence
  Description of Artificial Sequence: Synthetic polynucleotide
gaggggtggttttgttttatttagggggtgtcgtgggtaaaggttttggggttatttgtttggtgttttggagggcgtagggtaggagtcgtcgaggttcgcgggttattgtggggcgcggaattttagattaggtattcgcggtttaattttcgggttaggggattcgcgggggttttacgaatttgtttggtttatttg

SEQ ID NO: 5002 - DNA, 201 bp, Artificial Sequence
  Description of Artificial Sequence: Synthetic polynucleotide
attcggggtcggaggtaggcgcgtaattatggggatcggggcgggcgatggcggcgggcgggtttttgtcgtagggtggggatggtttttttagtcgggcggtcgtcgttatattgtagagcgtatttaaagagatatttcgtttcgcgttcgttttttagtattagattttcgttcgaaaacgtcgtcgggcggattgta

SEQ ID NO: 5003 - DNA, 317 bp, Artificial Sequence
  Description of Artificial Sequence: Synthetic polynucleotide
tatcgttcgggttttcgtttggttatagtattaggttatagtgcgttggtttttgattatttttttggttcggtggtcgtttttcgtttttttttagttcgcgtcgttgttttgttttaggtttcggtgcggttttaagttttagtttagggtttttaggtttttttaggcggcggtggcggtatttatttgggtcgcggagtcggggtttggtacggtttcgtaggtggtaaatgaaattttggtagttgtcgtgttttagggttttacgggtatagagttcggttagtagttgtagcgtttggtgatagagcgcg

SEQ ID NO: 5004 - DNA, 221 bp, Artificial Sequence
  Description of Artificial Sequence: Synthetic polynucleotide
atttatagcgacgggtaattacgcgggaggagtaggttaattttcgatagtggaggtgaagatgcgtgcgtttcgcgtattttgtttttcgcgcgacgtcgttcgcgtcgttcgcggttcggtcgggagcggtagttcgtgtttcggtttcggtttcggtttcggttggcgtttgtatttgcgattatcgtgagtagttatggcgtattttatagtgtaga

SEQ ID NO: 5005 - DNA, 201 bp, Artificial Sequence
  Description of Artificial Sequence: Synthetic polynucleotide
gtgggcggttattatttttttagagtatttggtatatcgggttggggttcgtattcgtagggtattgcggggcggcgttcggtgattgggtggggtcgtcgttgttttttttttcgttgggggcggtagttttttgtttgcgcggaggcgatttagaaggtacgttcgttagtaggagggcgggcgtcgtagggttttcgg

SEQ ID NO: 5006 - DNA, 201 bp, Artificial Sequence
  Description of Artificial Sequence: Synthetic polynucleotide
gttttttcgaaacggagatttgttatttttttagagggcggggaagtttatattattttttgttttatagtgttcgtttcgtttcgtttgttggtttttcgtttattcgagatattttaggtacggttcgtattggagagggtcgcgttgttgttgcgatcgtacggcgttcggggtaggaatatgttcgtttttttttgc

SEQ ID NO: 5007 - DNA, 201 bp, Artificial Sequence
  Description of Artificial Sequence: Synthetic polynucleotide
atcgaagttaggtggaagtaaatgagtttggattttgaggcgcgtttggtttggagtcgttaaatttgttagcgggcggcgggggaggtggttcggtagcgtcgggtgttgcgttcgtatatgcgttcgggaaggtagtttcggtcgtttcgtttttagttcgttttttatcgttggcgcggcggcggcggcgtggggttc

SEQ ID NO: 5008 - DNA, 201 bp, Artificial Sequence
  Description of Artificial Sequence: Synthetic polynucleotide
tgcgttttttttttgttatttcgatgttgggagtggcgttttggttttggcgttttttgggtaagtattagtcggcggtatttgcggaggtggttggtacgttgttattttttgaaatgagtgaggagggaggtttagatttaggcggttttacgcgttcgttttggtattagtagattgggaattgtcgtggttatgttc

SEQ ID NO: 5009 - DNA, 230 bp, Artificial Sequence
  Description of Artificial Sequence: Synthetic polynucleotide
tttttcggttgtagaacgtttttcgttgtcggagaaggggtttagtaaaattgatttttttttatttgtttttatttataattgatggggagatgagaacgtaatatattttagtatcgagtttttgtcgtttggcggagattttgtttaagacgttttcgtaaagtatttttagtcggggaataaagtacggaaagttgttgggtagagcggtcgggaggagatatcgg

SEQ ID NO: 5010 - DNA, 201 bp, Artificial Sequence
  Description of Artificial Sequence: Synthetic polynucleotide
gatagtggtagaggcgatcgtttttttttttattatttatattttagttttagatttttttttttttttttcggtgatattaagttttagatcggcggtcgtatttggttttatagtgtaaaatgtgtttggcgaggaagtcgaggcggcgttgtagtagttgagcgtgggggtttgtaagggcggttagttcggggaagc

SEQ ID NO: 5011 - DNA, 201 bp, Artificial Sequence
  Description of Artificial Sequence: Synthetic polynucleotide
cgaaggttatcggttgcgttttgaagcgagattggcgcggtcgtcgtagtcggtttcggtttttgggtagtttggcgggtcgtacgggttgcgggaattcgtcggttaggtatacgaagtgcggtattatcgtttggtaattggagtagatgtttattagttcgtcgggtttggcggttatggcgttttcggcgtttgcgg

SEQ ID NO: 5012 - DNA, 201 bp, Artificial Sequence
  Description of Artificial Sequence: Synthetic polynucleotide
tgttgttgttgttgttgttggcgttggcggcgcgcgcggacggtttggagttcggcggcggtttcgggtagtgggttcgttacgcgcgttgggcgggcgcggcgagtagcggcgagtttagttttagtttgcgtattaacgttacgcgcgcgttgttgttttatttggacgacggcggcgattgcgattttttggagttgt

SEQ ID NO: 5013 - DNA, 201 bp, Artificial Sequence
  Description of Artificial Sequence: Synthetic polynucleotide
agtttcgagtcgttagtttttaggtttgggggtcgtcgttttcggagttgttggcgtttattcgtttcgcgttggagatgtttaatcgcggtcgggttgcggggacgcgggtcgtgttgggttttgtgcgcggtcgcgttcgtcgggtgaggacgcgtcgggggcgggggcgttaggttcgggtttaagggataggagttt

SEQ ID NO: 5014 - DNA, 201 bp, Artificial Sequence
  Description of Artificial Sequence: Synthetic polynucleotide
ttttgacgcggggttggggacgtagatatttttggtttcggtagtttagcgtaatttttgaggtcgggcgtcgtttttcgtttttagaaattcgggtttcgagcgtcgaattttagcgttttcgttcgtgggtatagggcgcgcggtgtagttatagggggttcgagatacgcgtttcggtttggtttaggttggggaatc

SEQ ID NO: 5015 - DNA, 201 bp, Artificial Sequence
  Description of Artificial Sequence: Synthetic polynucleotide
cggcgattatttgttgggtattaagcggttgcggcggttttattgtaacgtgggtatcggtttttatttttaggcgtttttcgacggtcgtatcggcggcgcgtacgcggatattcgcgatagtgagtggcgcggttaggcgcgaaggggcgggggcggggggtaacggtcgtcgggttaattcgtttagttatattttga

SEQ ID NO: 5016 - DNA, 201 bp, Artificial Sequence
  Description of Artificial Sequence: Synthetic polynucleotide
gttgtattaagttataattttatttatatggtgtgagaattttttgggttttttttttttagtaagatttggtattttttgatatttattagtttaatgcgtgggaaatggtgtttttttttaatttgtattttttttgatttatagaaagttgtttttagtttcggtttatcgattatttagttttttattttttgaatg

SEQ ID NO: 5017 - DNA, 201 bp, Artificial Sequence
  Description of Artificial Sequence: Synthetic polynucleotide
gttttttcggtattcgtagtttcgatagtttagttttttttatttgaaagttttatttgaggttttttttaattttgtttttttgtatttttggcgtcgcggggagttaggggttaaatttcgtggttcgcgtggtttttttttttttcgtagttttttcgtttttattcggcgtcgcgtttggagcgttcgtttcggaga

SEQ ID NO: 5018 - DNA, 201 bp, Artificial Sequence
  Description of Artificial Sequence: Synthetic polynucleotide
tttcgggggtgtcgagtcggcggggggtgaggtggttgcgtcggcggtcgggttaggaggtgcgggtattgggggcgcgggaggggacgtggtaggtttcgcgggggttacggcgattttaggggttaggaaggtttcgttgcgggtacgtaatttgttttcgtttttttttacggagtcgtttcgggtaggcggcggcgg

SEQ ID NO: 5019 - DNA, 268 bp, Artificial Sequence
  Description of Artificial Sequence: Synthetic polynucleotide
agttggcgttggataagtcgggtaagtcgaagcggaaggtgaattatcgtaagtatttgtagaagtagattaagcgttgtagcggttttatgggcgtcgcgtttttcggttcgtttttttcgagcgtcgtcgatacgttagttaaacggtcgttggtcgtttttagcgtttcgatagtcgcggtttcggtttacggtaaggttgtttttcggcgggaggcgtcgtaggtcgtcgcggtcgttagtttgtaaagtcgaagtttggtcgc

SEQ ID NO: 5020 - DNA, 614 bp, Artificial Sequence
  Description of Artificial Sequence: Synthetic polynucleotide
atcggtcggggttgttgtcgtcgggggtttgggttttttagttagttgtggattaaacggtttttttttatttaaattaattgcgttacgcgtaggcggcgtacgggttgggtttgggaatggggatcgcgaggttttagtatttcgatgttttgaaagttttttcgtttcggggatttgtttttgtgttgtagttggtaggggtcgtttgaagtgggagtagcgtttggagaaggcgggaggagttcggttcgggggacgggcggcgggatagcgggatttcggcggcgcggtgcgttttagggcgtagcggcggtcgtagatcgagtttcgggcgcggtaagaggcggcgggagtcggtggcggttcggtattatgcgtcgagggcgtttgttggagatcgttttgggatttatcgtgtttttagcgttttatacgagttatggggcggacgttaatttggaggttgggaacgtgaaggaaattagagttagtcgggttaagagaagaggcggtggaggatacgacgcgtttaaagggtaaaggaatcggtttttttttttggtgtgggttttttaagttttaagatttagaataacgggtaggatgatttt

SEQ ID NO: 5021 - DNA, 201 bp, Artificial Sequence
  Description of Artificial Sequence: Synthetic polynucleotide
agatgtattttagtttagcgatttttattggcggaattttcgcgtttatcgcgcgtcgcgttaagatggtttaggttatttttattgttttttcgttagcgttttttagttttttatatttgttttgtatatatattggtttgtagaggggattcgtttcgaatcgttcgggagtggggtttgagttcggagttggtgttt

SEQ ID NO: 5022 - DNA, 201 bp, Artificial Sequence
  Description of Artificial Sequence: Synthetic polynucleotide
gttttgttttttttataagaggttaagtcgatattacgcgagtgtgtacgcgttggggattgagttttcgaagcgaagttttgtcggaggagttttaggcgggagtgggaacggttgggcgtggggttagtaacggcgttattcggtagggtggggggagttaggtttgttagagttagagcgcgttatcgtcgtcgcgag

SEQ ID NO: 5023 - DNA, 201 bp, Artificial Sequence
  Description of Artificial Sequence: Synthetic polynucleotide
gtattgcggagtagcgaggtagcgcgtaagtaagttagggtaggggtcgggggtaggggcgggggttggagttatggttaggggtggttgtttaggtcgcgtgagttgttttttttattcgtatttggtcgttaggttattcggttattagaagtttttatttatattttgttttttatttggatcgtcggttggttgtaa

SEQ ID NO: 5024 - DNA, 201 bp, Artificial Sequence
  Description of Artificial Sequence: Synthetic polynucleotide
ggggatcggtcgtagggcggggttttttttggcggtgagtgagcgagatcgttaggttgaagtatcgggagattgttttggtagtttttggtcgttattcgcgtcgtaataaaagtttttcgcggtttttcgtttagttagtttcgtattgattggtcgtcgtgggagggattcgagttggttggaggcggcggtcgagcg

SEQ ID NO: 5025 - DNA, 201 bp, Artificial Sequence
  Description of Artificial Sequence: Synthetic polynucleotide
aagtttcggcgcgcggcgttcgttgggcggtgcgttttttttcggttttttatttatcgtagtcgagtcgggtattgtggggtgggtgtgcgtgtttgtcggggggtgtgtgtttgtgtcggggaggggtgttgttggggaattgttgtttttcgtattacggcggtagcgatagtatcgttcggtagttcgtagtattcg

SEQ ID NO: 5026 - DNA, 261 bp, Artificial Sequence
  Description of Artificial Sequence: Synthetic polynucleotide
gcgttcggtttaagtacggtgcgagcgtttcggggaggcggcgagcgagtcggtgcggagcgtttcgtgcgttcgggtggtttcgcgggtcggcgggatcgtgcgtattttaagcgcgtgcgggagtgtgcgaggcgttgtgcgagttagcggcgggcgcgttagggtgggaaaggtatttcgaacgtattaggtgtagagatcggtatttatcgagagcggtcgggagcgtacggcgagtttcggtgttatcgtcggttt

SEQ ID NO: 5027 - DNA, 201 bp, Artificial Sequence
  Description of Artificial Sequence: Synthetic polynucleotide
gtttgggttttaggttatcgtagaggacgtgttttcgggcgcgtagatggcgggagatgaggcggtcgaatttcgcgtttttgcgtggtggagtatatacgttttaataagtttagcgttatttgtttagttttttaatttttttttttttcgtttcggggcggtttttttttttttttgttttggttgttgttttggtcg

SEQ ID NO: 5028 - DNA, 201 bp, Artificial Sequence
  Description of Artificial Sequence: Synthetic polynucleotide
ggtttacgtattgttcgtcggtttacgcgggagtttcgaggggcgaggcggaggttgggcgtagtttttgtagttagtagttattttcgcgcgtttcgtcgcggtttagttaattatttgttgcggcggcggtcgtgttttttagggtgtattagtattttcgtcgcgggcgttgttttcgcggcgtcggtatcgatgttc

SEQ ID NO: 5029 - DNA, 201 bp, Artificial Sequence
  Description of Artificial Sequence: Synthetic polynucleotide
taggtagtttcgcgtggcggcggtcgggatagttgggcgcgttggtaggagagtaggtatagcgttttttataggtaggatgacgcgggtttcgtagttcgtttttttacgttgtttcgtattattgtttcggttttgacgtgcgtgcgatagatttatcgtaaatagtttttagcgggagtacgaggtcgggataggagg

SEQ ID NO: 5030 - DNA, 201 bp, Artificial Sequence
  Description of Artificial Sequence: Synthetic polynucleotide
atatagttttaagggattgagcggttcggacgggatttgaaatttttggaggattagttacgttcgtatagttcgtttatgcgcgttggtattaggattcgtaggttgttagcggcgagttttcgtcgcggttttttagggtattttcggagaagggggcggttttgaggaattttttgtatttcggatgttttatttttt

SEQ ID NO: 5031 - DNA, 219 bp, Artificial Sequence
  Description of Artificial Sequence: Synthetic polynucleotide
gtcgtcgttttttcgggagtcggagtcgtcgtttttttagtgggtgtagtcggggtttcgacgggggtcgggcggttatcggggttggagttgcggttacggaggtttttgcgtttgcgtcgcgtcgagggtagggatagggattggggtgaggggttgtttcggaacgtttatagttggcgttggtttttttttgtttgatagttttttggttcgggg

SEQ ID NO: 5032 - DNA, 268 bp, Artificial Sequence
  Description of Artificial Sequence: Synthetic polynucleotide
ttagtcgtcggcgaggttattcgggaggggcgggagtcgtttgttagttattcggtagtttttttggggtttttttcgcgcgttcgtttgtttttttttcgttgcgttttttcgtttgttggcgtttttgttttagcgggattcggtagttaggggttttagggggcggtgtagtaaatttttagcggtttgcgtttagtagattaggttggggagtcggtttggcgttgtagggaggtagagagcgggaggaagaggtagtggtagg

SEQ ID NO: 5033 - DNA, 201 bp, Artificial Sequence
  Description of Artificial Sequence: Synthetic polynucleotide
ggttgttttcgggcgtattttgcggttcgggtatttgtagggcgggtagcggtcggttttttattatgttggtcgtcggtatgggggtcgtcgtttttgcgttttttttgagtttttcgttagcggtttggttcgcgtttttttttggttgttttttattttcggtttcgcggtatattttttaattttggggtcgaagga

SEQ ID NO: 5034 - DNA, 517 bp, Artificial Sequence
  Description of Artificial Sequence: Synthetic polynucleotide
tagcgtttattgtcggggaagattcggacgaaaatcgaggtaaattaattattaaaaagtgtatttaataagaatttttttatttaggtttttcgttgtcgagacgcggtagatttttagagcggtttatttatttatcgaagcggattttgggcggtttcgggttgattcgcgttgttagggcgcggattttatttcgggcgtattgttaggagaaggggtttttcggggcggcgcgtttcgattttgggttttcggtgttcgtagagggcggagattcgcggcgttttaggttatttattcgtattttttcgagttaaatttttagcgtttattcggattcgacggtttaagtattgatttttaggtaagagtcgttttttttggtttttagggaattgatattatcgcgggacgttttttttaggatagttagtaggttttaggagcgtagtacgtaatagcgtagagtagatttagatttttttcggggtgagattcggaggttcgcgttttg

SEQ ID NO: 5035 - DNA, 226 bp, Artificial Sequence
  Description of Artificial Sequence: Synthetic polynucleotide
cgtcggggggttttgtttttcgggaggagaaggaatcggtcgttttcgtttttttttttttttaggcgttttcgggagggggtcgttgggcggcggaatcgcgttttcgttcggggagttattacgcggttttttcgcggaattttgacgttatttatacgtgggggaaggggttgggagagtaagaggaagcggcgggggagggggtcgcggttgggagagcgcg

SEQ ID NO: 5036 - DNA, 201 bp, Artificial Sequence
  Description of Artificial Sequence: Synthetic polynucleotide
atttcggaggtagagatgagagcgttttaaaattttttttttttattttaattttcgaggagtaggtgggtgtatagtgtcggcggcggcggggacgcgcggcgcggagtttggttttgggaggtagtggtcgttttagtagtcgaatttttcgcggttttagttttcgcgtttagtagttcgcggttcgtttttcggaaa

SEQ ID NO: 5037 - DNA, 212 bp, Artificial Sequence
  Description of Artificial Sequence: Synthetic polynucleotide
tgcgtagtggggcggaggaggtggcgatggtcgggggaggcggggggattgttgtttatttgtagttgggttaatttcgcggcgtaggcggcggcggagcgcggggagttcgcggcgggtttagttgtcgtagtattatgttcgagttttttttcgggtagacgtcgcgcgtcgtcggggtttcggtaggggaggatgttagacgttcggga

SEQ ID NO: 5038 - DNA, 388 bp, Artificial Sequence
  Description of Artificial Sequence: Synthetic polynucleotide
ggtagtcgtagttttttcgcgcgttttttttttttttacgtttttcgttttcgttatggggttaacgtggggtttttaagagttgtcggtttttagcggcgtaatttttagttaaagttatcgcgggcggattatggtttagggcgttagaggggttagaggtacgggaagaggaaaagacggttaattgggaaaaaaagagaaaacgaaagaaaagttaaacgatgagtttttataaggaggacggagtgaatagtttgtgttagaaggttttgtatatcgttatcgagttgtgtttcgtcggttaggtggagtgggagaagtgttcgggtattttttttcgggataggggtagttagggcggaagtagtataggtaatcgggaggg

SEQ ID NO: 5039 - DNA, 201 bp, Artificial Sequence
  Description of Artificial Sequence: Synthetic polynucleotide
tttttttttttttgttttttaagatacgcgttcgaaatcgaggggtgagagtaaagatcgtttattaatttagtattttggatttagagtttttaatttcgaaaggaggttggtattgttcgggttatcgagagagggagggagaagagttgaggttgtaacggtttttgggttttttagatcgggtttggtatttaggag

SEQ ID NO: 5040 - DNA, 201 bp, Artificial Sequence
  Description of Artificial Sequence: Synthetic polynucleotide
ttattttttttggaagtttattagttgtttaagtgataattaatatcggagagttagggttcgtttaataggagtacgcggagatattttagacgatagcgcgttttttttatttttatttcgtttttcgggcgttttaggttagcgtttattagattttacgtttgggggattgtttgggttttagcgagagtgttacgg

SEQ ID NO: 5041 - DNA, 212 bp, Artificial Sequence
  Description of Artificial Sequence: Synthetic polynucleotide
aggtgtagagatagtggagatgaggttttgatgttcggttttggttttacgcgggtagcgttagttggtcggtgttacggagttttcgcgtttttcgttcgtttagttttcgcggatttatttattggggttgtttcgtagcgcgatttttttttatttcgggggagggttaagggcggcggtggggggcggggtgggggggaagcggcggg

SEQ ID NO: 5042 - DNA, 250 bp, Artificial Sequence
  Description of Artificial Sequence: Synthetic polynucleotide
tttttcgtgtttttcgtagggtaggttatagttttttagattttcgtttaggtggtaaagaagatggagttgggggtcgcgtttcggcggcgcggggttcgaaggcgaggtcgtttagttcgtattttattttacgtacggtatacgtcgtcgcggtttttgttacgtatattttcgcgttgtttcgtttacgtgggcgtcggggaggaggttcgagagatgggaagaaaggttggtatttatttttttg

SEQ ID NO: 5043 - DNA, 488 bp, Artificial Sequence
  Description of Artificial Sequence: Synthetic polynucleotide
ttgtaaatattggaggaaagttgcgttgttttaattaaatacgtttttttaaaatacggagatgcggggagtgggggttcgggaaagaaatttttaaagcggtagtgtttttttaagaaggggtaaaaaaatttgtttatggttatttttttttcgttttattttttttttttttgatagtttcggttttggttgttcgagtcgggggtgtgttttcggttttttttagatttgggcggggggcgggaggagtgagcgatttgggaagtttcgggggtggagagggggcgtttcggggtttgggggcgacgtggatattttttttggagtacggcggtgcgtttgggatttgaaggaagggtcgaaggaagcggggtgcgggcgggcgagttgttcgttaagttgtttggcgggcgcggcgaggggagatgcgtaagtttgtagatcgggggttcggagttcggcgtttaggttggcggggggcgtgt

SEQ ID NO: 5044 - DNA, 201 bp, Artificial Sequence
  Description of Artificial Sequence: Synthetic polynucleotide
gtagagttgtagtttttgcggttttttttttttcgttgtttagtcgagttttgggtttttagtttaagtttttcgtatcgtcgttgttgttgtcgttatcgtcgtcgtcgtcgcgcgttgttagagtcgttttttcgtttttttttttttttttcggtcgggtttttttttttttttgtttttttttttttttttttagtt

SEQ ID NO: 5045 - DNA, 364 bp, Artificial Sequence
  Description of Artificial Sequence: Synthetic polynucleotide
attgcgtatgtgggtttggggtttgcgcgtatcggaggttgtaggcgttggggagggtgtggggggttgtgcgtggggttgtttttatcggaagttgtacgttttgggaagcgtagaggcgggggtgttgttcgcgttggggagtacgtgaggggatatttagggattgttcgcgcgaatggtttttaacgtatgcgttttattttatattttatagtcgttatgacgatcgggaggttcgtaacggttgcggggataagttcgttgaggttgttaggcgagttaggtttttttggatttcgtttgattcggttgggttgtgtttgaaattgatttagttttattatattttttgattatgaga

SEQ ID NO: 5046 - DNA, 220 bp, Artificial Sequence
  Description of Artificial Sequence: Synthetic polynucleotide
gtgtaattttttggttaaaatgttatagttaagattaaattcgaagaaaagaatgaaattacgggaagttttttagatagtcgtcgtaaggttatgggtcgaagtggtgtaggggcggcgttcggggaagcgattggtagagttgtgcgtattgggggtgttgtaggcgttggggagagtgtggagaggttgcgtggagttgcgcgttcggggtgggggt

SEQ ID NO: 5047 - DNA, 201 bp, Artificial Sequence
  Description of Artificial Sequence: Synthetic polynucleotide
gcggttgagttcgcggagttgggtgagtgtttgcggttgatcggttcgtgggagtagggagcgtatagtcggttggtgttggagggttacggggatttacggggtatcgcgggagtcgtcgagcgtagggaagttagtaggtatttgtagtgcggagtttgtaaggttgaggtaggagatcgttcgaggcggggagggcgg

SEQ ID NO: 5048 - DNA, 201 bp, Artificial Sequence
  Description of Artificial Sequence: Synthetic polynucleotide
tttgagggttcgggtagttattcgtattttttcgttacgcggagaaagtcgagtatataggtcgtagggtgggggttcgcggggagagggtggaagtagcgggtttttcgcgtttggggtggtcgttgttttatttaggttttcgtttgttttttatttttttagattaatcgttttttgtaggtgttaacgcggtgtttc

SEQ ID NO: 5049 - DNA, 201 bp, Artificial Sequence
  Description of Artificial Sequence: Synthetic polynucleotide
gttttagtttttatttgtttaggtgttttcggcgttttggcgaattcggttattttagttttttacgtggtgagtatttagggtagcgggtcgatttttcgaggttttatatttgggtttgaggggcgcggttcgtagcggcgggtgtaggggcgattgttagtttttatttcgtttcggggtgcgttcggaggtcgatat

SEQ ID NO: 5050 - DNA, 358 bp, Artificial Sequence
  Description of Artificial Sequence: Synthetic polynucleotide
atttagggttattgtagtttcggggtatttcggaggttacgattcgcgagtagatgtttcggaagaggttttttatgtaggttgttaggtagatggcggcgtgttcgtggatgcgtagcgttacgcggttgtttattatttagcgatatacgcggtttacggagaaggtgaggtcgtagcgggtcgatttgtcgcggtttaggcggtcgtcgtcggcgttgtttatgttgtagagggatagtgcggttagcgtagtcgtcgtatagtgcgcggttaggttttaggatagtacgatttttatggcgttttggatttcgtatttggtgtatttggcgaagcgtaggtttaggcgttgcgt

SEQ ID NO: 5051 - DNA, 201 bp, Artificial Sequence
  Description of Artificial Sequence: Synthetic polynucleotide
agcgtttttttatggtcgcggtagttaatcgatgattgaatcgaataaagagtagcggcgagattaatttttaatatttatcgatgggtagcgggcggtcgagtttcggcgagtttcggtagtcgtcgttcgtcgttttagggcgttcgtttgttcgttcggggatttttttaatgcgtttagggcgcgttcgggggtttt

SEQ ID NO: 5052 - DNA, 328 bp, Artificial Sequence
  Description of Artificial Sequence: Synthetic polynucleotide
ttttttagtttcgttggtttgggagtcgggagtttcggaggagtttttcgttaagtttttttggttacgagcgcgtttggttttggtttgggagtagatcgtgcgttcgagtggggtatttgttcgaggtcggggattgtgaatcgaaagattttatttagttttgttgtttttttggtattgcgatttgggggcgggttattttatttttttgaatttcgtttttcgttttgtttatggaaggttgtaagtttttttggggttcgggatttttttttatttttatttttcgagtagagaaataggcgatgttttttttttttttgcg

SEQ ID NO: 5053 - DNA, 201 bp, Artificial Sequence
  Description of Artificial Sequence: Synthetic polynucleotide
gaggtgtgtgttggaggtgggtagtcgtcgcggaggttttagcggtaggtgcgttttagtaggtagtagtagtcgttattttgggtaagtagtaaatttcgtataaatttcggagttattatgtttgttttttcgttttatcgtcggtttttttgttaggagtagtagaggatgtggtgaatgtatcggttttatcgaacg

SEQ ID NO: 5054 - DNA, 319 bp, Artificial Sequence
  Description of Artificial Sequence: Synthetic polynucleotide
gggcgtatatatacgtttatttagatatttcgcgcgttttttcgcgtttttgtttgttcgttcgtcgtcgtttgtttttttttttttgttttcgtcggtcgttttttttttttttttttttttttttttttttttttttttttttttttttttttggtattatagagttgttttgaaaatagaagatagagggagtttcggagttcgttatttttagcgatttttatattgggaaaaaatatggagttagtttcggtagttttcgatttcgtcgttagcgagttaggtagtagcggcgcggacgcggtcgtcggtttta

SEQ ID NO: 5055 - DNA, 201 bp, Artificial Sequence
  Description of Artificial Sequence: Synthetic polynucleotide
ttaagtttaattttacgtttttttcggtgttcgattttgcggtcgaatcgtaattgcgagtcgtaggtaatggcggagtttttggtattgttagttgttcgcggttgggggttcgaggttgggagggtttcgttttcggaatatcgtttcggtttggtttttaattttgcgaggagtttttttgcgtttttttttcgcggt

SEQ ID NO: 5056 - DNA, 370 bp, Artificial Sequence
  Description of Artificial Sequence: Synthetic polynucleotide
ttggattttcggggtgcgggtttttttttttgttttgttttttagtatttttggtaattgcgtaaagttgtttgggttgtaatggtggggtgtagggggcgttcggttgttgtatttgttagtgttgggtttaggttgagaggcgatttttagtttttataataatgtttcgggttttttggtttgggttttcgtagcgttcgattgatcgttagcgatacgacgagaacgaggatttgtcggacgtggaggagatcgttagcgttcgcggttttagtttggaggagaagtttcgtagttagttgtattagggggatttcgtgtacgttatggagggtaaaggtgaggcgtttttatttcgggtcgtttt

SEQ ID NO: 5057 - DNA, 201 bp, Artificial Sequence
  Description of Artificial Sequence: Synthetic polynucleotide
ttttttcgttttaggcgtcgttaagttttagtattatgcgtttttttagatgttcgaaagcgtttttttagggtagtttatgtttttttgtgtttttttcgcgacgggtcgggtttattattttatatttttcgggtttttttatgtttattatcgtgtgtttttttagtatttttttttttttttaagttttaatatagt

SEQ ID NO: 5058 - DNA, 201 bp, Artificial Sequence
  Description of Artificial Sequence: Synthetic polynucleotide
gttgggcgtaggggtcgtcgttcgaggattatgggtgggttagcgtttcgtcgggttgttagttggcggggatcgtcggcgtttgtgtcgggtcgcgttcgaggttgcgtcgttcgtgtcgtagcggttaatgcggtagtattcgcgaacgttatcgcggcgggtttcgttggttcgggttgcggcgtgggggcgggggat

SEQ ID NO: 5059 - DNA, 201 bp, Artificial Sequence
  Description of Artificial Sequence: Synthetic polynucleotide
gtgtagcgacgtttagttttcgtgcggttagcgcgtcgcgtcggcggattttgtagtttagagagtttagggagtttagggaggggagcggggcgcgggcggggtagtgtcgtataatcgtaggcgcgtttcgcgtcgttttcgtttcgggtttattttttttcgtcgcgttttttttagtttatttacggacgagcggat

SEQ ID NO: 5060 - DNA, 263 bp, Artificial Sequence
  Description of Artificial Sequence: Synthetic polynucleotide
gcgcggtttcgcggggattttgcgggcgggcgggcggtcgggcgcgcgcggggcgggggcggcgcgcgcgcggggagcgtgtgggtcgggcgggcgcggcggggaaagttgggcgcgcgagtcgaggttgttgtttatttgtagtcgcgtcgtttatttgtcgcggagtgcgcgtttcgcgttttttcggttcgtttcggagttcggtcgttttttttttgttatagcgggtaattgcgtcgatatgcgatacgagtagttta

SEQ ID NO: 5061 - DNA, 201 bp, Artificial Sequence
  Description of Artificial Sequence: Synthetic polynucleotide
ggcgggagaggagtttcggtcgcgtggattttagtttgcgcggtaattatcgcgttttgattttaggttcggttgtttagggaaggatagtttagggcgcgtttagcgagttttagggggtacggaagtggttagggtagattttagggtgaataattaatattttatttattaattcgttaaaaataaagaaaataaaat

SEQ ID NO: 5062 - DNA, 201 bp, Artificial Sequence
  Description of Artificial Sequence: Synthetic polynucleotide
tgtcggggtcgcgttttcgggttcgcgtcgttagtatttttttacgcgcgttcggtttcgggttattcgttttcgtcggttttcgttttttttcgtagtcgtagggaagcgagtttgggaggaagaagagggtaggtggggaggcggatgaggggtgggggattttttgacgttattagaaggaggtgtcggggtaggaag

SEQ ID NO: 5063 - DNA, 201 bp, Artificial Sequence
  Description of Artificial Sequence: Synthetic polynucleotide
aggggttaggagcggcgggatagcgcgggaagagtaggtaaggggagatagtcggattgcgttttagtttttcgtgttaagaatatcgtcgcggaggcgcggttagttttttttggatcggatttttcgtttttagggttaggcggcggagttttagttttgttttttttttagtttcgggcggtttttagagttgagtaa

SEQ ID NO: 5064 - DNA, 201 bp, Artificial Sequence
  Description of Artificial Sequence: Synthetic polynucleotide
cgggcgtcggcgtgaattcgcgtttttcggagtttagcgtcgtgtttttaggtttcggttttgattttagggcgtttaggtggaatggtttcgtagttgcgcgttgttttcgcgttttcgttttgtttcgcggaaatcgttttcgatagttaattcgatcgggcgcgcggcgttttcggtcggttttcgttcgatttcgcg

SEQ ID NO: 5065 - DNA, 215 bp, Artificial Sequence
  Description of Artificial Sequence: Synthetic polynucleotide
gattttttcgcgtatacgtatatgtatacgttgcgcgtttttacgcgtatatatacgttttttttgtcgcgttcgtcgtcgcggttattatcgcggagtcgagttttgcggagcgggaatcgaggtcggagcggggatcggaggtagtcgagtcgggggatgtcggttcggagcggagtcgcgcgcggacggcgcgttcgggacggtgagtgtgg

SEQ ID NO: 5066 - DNA, 201 bp, Artificial Sequence
  Description of Artificial Sequence: Synthetic polynucleotide
tcgcgtaatttttgaagtggtcggttagggcgcggttggtttagtcgtcgtaggcgttttgtaggcgttggggtaggttttagtggtatagggtgattacgggttgtacgtttagttttcgtagtcgttttagtaggcgtcggtagtagcgtagtttttcgcggttggggacgttcgcgttgttattggggagtattcgcg

SEQ ID NO: 5067 - DNA, 201 bp, Artificial Sequence
  Description of Artificial Sequence: Synthetic polynucleotide
ggacgggagttgcggggagggcggtcgggggatttcgtagagttcgtttcgttcgtagtcgcggggcgtcgagggtagggcgggcgtttagtttggtttcgtcgtttcgttcgtagtttttcgaaaggcggtcgttttgttttggttagtttggttcgattcgggggcgttgcgtgcgggcggtttcggggttgttggtat

SEQ ID NO: 5068 - DNA, 201 bp, Artificial Sequence
  Description of Artificial Sequence: Synthetic polynucleotide
aatttaatatttttttttttttttttggagttattttttttttcggaatatgtaagttttgggtggtttagttttgtcgttagatttagtttttaagtgcgggggaaggagatgggcgtttttagtcgcgattttttgggaaggtggttatttatttgcgttttgaaatagaagaatagggcgacgttgtagataatttgg

SEQ ID NO: 5069 - DNA, 217 bp, Artificial Sequence
  Description of Artificial Sequence: Synthetic polynucleotide
attggttgaagtttttttagcgatttgtatgaatcgagagggagtgttttttgtcgttttttttttaagagcgttttgattgtagttttttagggaatgcgcggtcgagggaatgcgcgtagtttataggttttgggagtgagttggtgttcggcgatttggtattcgcgtttggatatggggcgtttatatcgttttaggagtagtattagttata

SEQ ID NO: 5070 - DNA, 317 bp, Artificial Sequence
  Description of Artificial Sequence: Synthetic polynucleotide
agtaaaagtttttatttgtagtatcgggtatgttgttcgtttaacgcgtttcggggatttgttggttcgtgtttttaatttaggggtggttatacgtttcgcgtttttgtttttgggtagatttttttatttgtgtattttggtttttttatttagtaaagagatgtgcgaagtgtgcgtttggagacgagtcgtttcggtgatttttattcgttcgtagcggtggttttggtttttcggattcgcgttcgcgttttgcgggtttttcgcgtcgtttttgttcgtcggattattcgggtttagagggtcgttcgttt

SEQ ID NO: 5071 - DNA, 201 bp, Artificial Sequence
  Description of Artificial Sequence: Synthetic polynucleotide
gaggggaggtacggagcgggaggagggggacgcggagaagattgtttggtttcgtcggtttcgttaacgtgacggttagtttcgtcgagcgttcgtattcgtttatatttatgattattcgtatattcgttttaatacgtgttaaggcgcgatcgcggggtttttggtagttttcgttgtatttttttttttataggggta

SEQ ID NO: 5072 - DNA, 201 bp, Artificial Sequence
  Description of Artificial Sequence: Synthetic polynucleotide
tcgtttaatacggagacgcggagttttatagcggtggtagaaagtgagtattaatttagtaatagggggaaggaaggggacgtcgggcggttagtgggacgtgcggtagtcgagggttgtagtttgtttttgtagcgcgttcgcgtttatttgcgattttttggtaggggatgttcgttaggttgaattttttggtatcgt

SEQ ID NO: 5073 - DNA, 201 bp, Artificial Sequence
  Description of Artificial Sequence: Synthetic polynucleotide
tagtcgggtcgagcgcgttgtttgagttgagtcgtcgtaggtgaggggttcgcgttttcgttcgttttgggcgtcgcgtttggtattgattttgtcggtcgtttattgtcgtcgtcgtcgtcgttcgcgggtattatgatagttttgagcgttggggttataggttggttatcgtcgtcggtgttcgggaggttgcggcgc

SEQ ID NO: 5074 - DNA, 201 bp, Artificial Sequence
  Description of Artificial Sequence: Synthetic polynucleotide
agtgtgattgatgtatttattatttaataatttcggggtgaaatttgaggtgaacggttttatttttttatatttaggaatggaattagttttcggtatcgtgtatagtttgattttacgttcgtacgttgggttttcggttttttggtagtgtatttaagtgtatttcgcgtgtgttcggcggattttcgtgtatatcgt

SEQ ID NO: 5075 - DNA, 201 bp, Artificial Sequence
  Description of Artificial Sequence: Synthetic polynucleotide
gcgtagttttatttcggatggtttttgttttttcgcgggttcgagggcgttggaaatttagcggcggcgaagcggagaggagtttcgcgcgttttcgttcgtacggttttaggtttggggtttgcgttggagtcgcgcggggagaggtcgtttttgcgatcgtcgcgttcgttttcgatcgttcgggttcgcggttagttc

SEQ ID NO: 5076 - DNA, 221 bp, Artificial Sequence
  Description of Artificial Sequence: Synthetic polynucleotide
agtttaggtttgcgtttatacgcgcggcgtttatacgcgcggcgtttatttggttgtagtttcggttagggttagcgcgtcgcggttgaagggggcgttcggatttttttggggcggcgcgtagtcgggatagtttcgtatgacgttcgcgttttagcggtttcgggacgcggttttatttttaatttttggcggttttagtttcggtttttgtgtttcgg

SEQ ID NO: 5077 - DNA, 311 bp, Artificial Sequence
  Description of Artificial Sequence: Synthetic polynucleotide
gtttcgtttcgtattcgtatatatttttttcgtcgttgttttgagcgtagcgataagggtttttatattttcgcggttcgtaatgtttcggggttaagtcgaggtagggaggcgttttcgtagtttttgattttataattcgcgcgcgtgtgtatcgagtcgcgggtatatcgcgaatatatatatatatatatatattcgtgcgttttcgtttttcgttcggttcgggtttttcgaatttattttcgaggcgtttcgggcgtagggttcgtttttttttgcgggtttttagcggttgttcggtagtggtt

SEQ ID NO: 5078 - DNA, 308 bp, Artificial Sequence
  Description of Artificial Sequence: Synthetic polynucleotide
ggtggcgggtagtgtggtgatggtttttgaggaggtttgttcggagcgtatcgatttgatttataaaaattatcggaaattttgtaatttgttgatcgacgtggaggagtggggttaggtggttattattagtatgtttattcgttacgttcgtacgtagtttttgagttttatttagaacgtaagtgggtttagtttaggtagagcgggtcgaagtgtgtttcggggaggcgtttatagattcgtcggttttttcgtttaggaatttttattagaggagaacgcggaaaaagttttttacggtttag

SEQ ID NO: 5079 - DNA, 201 bp, Artificial Sequence
  Description of Artificial Sequence: Synthetic polynucleotide
cgagaattttgcgggtttagaacgttcgcgcggacgttttttttacggcgtcggaagtcggcgtcgagtttgttatcgggtatttttttgttgttttgacgacggcgggcgttgtaagagtggagaagttgtaggtgttgaggcgcggtgaaagaaattttgggagttaagagtacgaggagttggtgtttgtgttatatt

SEQ ID NO: 5080 - DNA, 201 bp, Artificial Sequence
  Description of Artificial Sequence: Synthetic polynucleotide
aggtgatttcggttttggcgaggcgcgattcggttatgcgtgtgtgtgttttttttcggagaggatttcggtcgtcgagggtacgcggggtttagttatcgttcgttttttaattagttgttggttcgtttcgatggtgtaaattgtttttttttgttttttattaaatagtaatagtttggttacgtttaagtggaataa

SEQ ID NO: 5081 - DNA, 201 bp, Artificial Sequence
  Description of Artificial Sequence: Synthetic polynucleotide
gggatttggtgattttagtattattttttttttttttttttttttttttgtttttttatcgtttgttgtaattttgtaaagtttcggagtcggagagcgcgtttcgtttttagagttttcggattcggcgagttagcgatcgtcgagtcggttattatgttcggtagatcgcgttattaggcgtttttcgcggtttttatt

SEQ ID NO: 5082 - DNA, 630 bp, Artificial Sequence
  Description of Artificial Sequence: Synthetic polynucleotide
agtttttttttgttattcggagtagagcgcgttagcgcgaggtcgggtcggtcgtttgcgtagcgtcgggttaattttaattgttgattatatttttagcgtgtttttttataggttttatttgtaattgagacgaatgattatagtggggcgggaaggagtagttgtttattaattaatttttaattaaaagtgtttttcgttttcgggtgattaaagagaaatatcgttcgttgggcgatattgattcggatggaatttatttgttaacgttcggaggaatggttttttcgtttatcgcgcggtcgggattgttttggtttttttcggtttgagtcgtcggcgagtgatcggcgagtttgcggttaggtcgggttgcgcgaggtggggttgacgttagagtttttttcgttttaagtcgcgtatatttgatttgacgggttcgcgcgattcgtttttttttttttttttttcgtaaaatatgtatttttgtcgtcgttgcgaggtcgttcggttttagagttttttcgagttttcggaatgcgaagttaaaggaatcgcggcggttatcgttgtttattttgttattcggttagaaaagtttgcggagcgcggggatggattaatcgg

SEQ ID NO: 5083 - DNA, 201 bp, Artificial Sequence
  Description of Artificial Sequence: Synthetic polynucleotide
gagggcggggcgggcggcggtcgcgtttttaatttcggcgttgcgtgtgggagcggtcggattagggaattagcgttgtaatttcggattagtaacgttcgttaaatgagtgtttaatttcgattttttatgttttttagcgtcgcggttgagttttaggaggttttttggttaggtttttttcgcgttttggttttattt

SEQ ID NO: 5084 - DNA, 239 bp, Artificial Sequence
  Description of Artificial Sequence: Synthetic polynucleotide
ttcgtgaatttcgttcggggatattttatagtagtcgcgtttttatttttttttttttaaatcgtttcgggtttttgtcgtcgttattttttgttaaatcgtttttatttttttagcggagttatagcggggcgcggcgtatataaagggggtcggagggtggagagtatagaaggagggagagatttcgttagggttcgtggtacgggtttgggagtagttatttattcgattttttt

SEQ ID NO: 5085 - DNA, 201 bp, Artificial Sequence
  Description of Artificial Sequence: Synthetic polynucleotide
gacgttagtcgcgcgggtttttcgagttcgcgtcgcgtttagggatttggttcgttttttgcgtttttatttttttattttttttagaaatatagtacgcgggttttttttatgtaggttattttttacggagttttaggttagttttggggcggtgaaacgaaggtgttaaggtatagtattttttcgggaggttggata

SEQ ID NO: 5086 - DNA, 221 bp, Artificial Sequence
  Description of Artificial Sequence: Synthetic polynucleotide
tagttgttaatttcgcgcgcggagtttttcggcggtgtagtttcgtttcggcggcgcgggcggtatgaagattagtcgtcgcggtcgagcgtttttggtcgtggttttgaatttgttggcgttgttgttcgttattatcgttttttttattacgtattggtgttagggtacgtagcgggtttttaagtcgggttgcggttagggcgggcgcgttaattgtt

SEQ ID NO: 5087 - DNA, 201 bp, Artificial Sequence
  Description of Artificial Sequence: Synthetic polynucleotide
gcggggaggggatggggtggcgggagaattgtttttttttttagttataaatttattaggtttttaaattttttttggattttttttttcgcgttttcgcgagttcgggatttaggggatggagaattcggggcggaggagcgtcgagttaggcgggagggaggtcgagtcgtgggcgggaggcggatcggcgtggggttg

SEQ ID NO: 5088 - DNA, 246 bp, Artificial Sequence
  Description of Artificial Sequence: Synthetic polynucleotide
gtttcgggggtttttagttaagtatcgtttggtgttttcggtttagggtcgtgtgagtcggaggttgagtttacgtaaggtttttatttgtatagattacgagttggagaattatagtatgtattgcgtgtaatgtaagatgttcgtgtgttattagtgtttggaggagggtaaatattttagttacgaagttaaggttttgggggttatgtggaaattatataaggtgagttttaagaaaattta

SEQ ID NO: 5089 - DNA, 223 bp, Artificial Sequence
  Description of Artificial Sequence: Synthetic polynucleotide
tcgattatgattatttggatttggataagatgagtttatatagcgaggcggatagcggttatggtttttacggggggttcgttagcgtttttattatttcgtgttagaagttttttaacggcgttcgcgtgtttttttcggttatgtcgttatcggttatttatttgttatcggttttggtttcggtgtttcgtaatttttgtattatttgtttttagtgtta

SEQ ID NO: 5090 - DNA, 201 bp, Artificial Sequence
  Description of Artificial Sequence: Synthetic polynucleotide
ttagggtacggcgttagcggatttacggagaaggagaaaagttttattgtcgtgtagaagtttaggttcgggtgagacgtttgcgaaggttgttagtagcggaagagaaggggcgtttttcgtgttgcgtagtattcgttcgcggtaggtgggcgcggagtttagagttgggagttaaacgtaaacgttggcgagaagttt

SEQ ID NO: 5091 - DNA, 244 bp, Artificial Sequence
  Description of Artificial Sequence: Synthetic polynucleotide
gtttcgttgttttagcggtcgttgttttagaaaagttaacgagaattagatgtggtggttattgtcgaatttttttagagtcggtgattggtttttagtcgagggttttagttaattagtttgttgggtgggtttggagtttcgtttcgtttaggcgttcgcggagatttaggttcgaggttggcgcggcgcggagagtgggttggaggtcggggcgggacgcgttgtgtagcgggtaagcgta

SEQ ID NO: 5092 - DNA, 201 bp, Artificial Sequence
  Description of Artificial Sequence: Synthetic polynucleotide
tttgttcggttcgttgaaggttggttttgggtttgggggtagtgttcgcgaagggttgcgatggtaggtttcgttgttatacggtatcgagggttttttcgtttcggcgttaggcgtacgtttttttgttatatttttcgcggggcgcgtcgttagggttatttgtttttttaagtttcgttaggtagttaagggtgagga

SEQ ID NO: 5093 - DNA, 457 bp, Artificial Sequence
  Description of Artificial Sequence: Synthetic polynucleotide
ttgagggaggggtcgggttttcgggtttgtagattcgttatcgcgcgtgcgtatgcgtcggtcgcgagttttcgggtgtaggtttgggcggtttcggttcgcgtatttgtttaggcgttgcggtttagcgcgttttaatttttagttcgggcggagagcgggggcgggattgaagtatcgtgttttttaaagtattttttcgtcgtcggtagttttggtttcgtaaatgttttagcgcgtttaggcgtacgtagagattggcgcggtagttttcgggttaacggtacgcgagtaaagttggttggcgatttgggatacgtagtagaagttgaggttgtatcgattttcgtcgtttcgggggaggtatgggttcgggtaggtttaggaggaagttgtatagttcgaggttcgggcgggagtggcgggtcgcgggtaagggaacgtatatttggaaggg

SEQ ID NO: 5094 - DNA, 244 bp, Artificial Sequence
  Description of Artificial Sequence: Synthetic polynucleotide
gcgttttttttgcgcgcggcgaggtcgagacgtttttcgcggtgatagcgtgtaaggcggagattcggcgcgtttttagtttagggaaagtttaggcgacgcgatcgtaagttcgagtttaggtttttcggagtcgttagggcgcgtcgggttgtttgtttttttgtttttttttgtaggaatttttcgtcgttcgcggtcgggatttcgggtttttttcgggcgtagattttagttatcgttt

SEQ ID NO: 5095 - DNA, 206 bp, Artificial Sequence
  Description of Artificial Sequence: Synthetic polynucleotide
gagcgtagcggcggggtatggaagaagagggttgggggcgcgcgttatttgtaaaggttttcgaggtttttttttagttttggtggtaatttcgtttagcgtcgcgtttttttttagatttaaatttttgttgggtttttcgggtggcggcggcggcgacggcggcggttgttggagttaagttttgtcgttcgtagcgtcggggc

SEQ ID NO: 5096 - DNA, 203 bp, Artificial Sequence
  Description of Artificial Sequence: Synthetic polynucleotide
agagagatagtatgagaacgcgtagagttgtatttcgcgggggtcgggcgttagtagtatcgcgttgttttatttacggcgcgtttgtttttcgcgttgcgcgtttagcggggcgtcgagttttagaaattttagtatatggtcggttcggcggttacggtggtcgtagttgttttgtttttcgagcgttttttattgttttt

SEQ ID NO: 5097 - DNA, 266 bp, Artificial Sequence
  Description of Artificial Sequence: Synthetic polynucleotide
cgtgattatttttcgttttattttcggggcggggttcgttagaaattttaagcgttcgtaatcgttttttttcgtgggcgggatggggaaattgaggttcgaggtcgtttcgttggttggtgtaagaattagtttgtaatttaagttttgagttgttggcgtttcgtttcgtgtagttgaatttaatttattcggggttgtgggtagcgtttttttggggttgatacgttatttcgagtttgaggattaagatcggagtgatttgg

SEQ ID NO: 5098 - DNA, 242 bp, Artificial Sequence
  Description of Artificial Sequence: Synthetic polynucleotide
ttcgaatttttttaaatttggcggttcggggcgcgtgggggggacgtttcgttatttgcgcggttataaaggagagatttatggtgtcgttgtagttagcgttcgagttttcgttgttgtcgttgtcgttgcgggttagtcgtttgtatagttggcggggatcgggttgagtagcgagcgttcggagatcgtacggcgtattcggttgtttttgggtttttggttttagatttttattaggc

SEQ ID NO: 5099 - DNA, 201 bp, Artificial Sequence
  Description of Artificial Sequence: Synthetic polynucleotide
taaagtaaaataggataaacgatcgcggcgcgtcgacgtttggcgggttacggttataaagcgggttttagagttttttttaggcggcggtaaagggggcgttcgaggttatcggtaagagatagattattggcgtttcgggaaaatagagtggggaagggcgagattgtgtgtttatttacgttcgcgcgggtttgagtt

SEQ ID NO: 5100 - DNA, 201 bp, Artificial Sequence
  Description of Artificial Sequence: Synthetic polynucleotide
acgttggcgaatgattatggaaataatatttaatagtagtgttttttatgttaggtatataatcgttttggcgtgggttgataattatgtttattttatcgcgtggtattgagtcgatcgtatatttagggtttcggtttttagggttcgtttattcgtttattgcgtgaagtatttattttcgtaggagtcggagtagga

SEQ ID NO: 5101 - DNA, 312 bp, Artificial Sequence
  Description of Artificial Sequence: Synthetic polynucleotide
tggtcgtttttttcgcggttaggcgtattttgtagcgtttagatcgtcgcgtttttattcgcgtttttaatcgcgagcgttcgtttgggtcgggtcgggcgttcgagattcgggagagattaggggttcgtaaagtagaagagtagatttagaaagaaaaaaaaaaaagcgagaagtgcgagaaaaatatattgaatttagttaaatatacggtagatgaaaaaaatattttgtttagaagttaaaaacgagttttcgagtcgtgagatattgttgcgttttcgttaggcgtgtaggtcggatgttaggggg

SEQ ID NO: 5102 - DNA, 203 bp, Artificial Sequence
  Description of Artificial Sequence: Synthetic polynucleotide
gcgttggtagggggaggtttcggtaacgtttgggggttttaggttagtttttttcgggttggaaggtatcgtataggggttttcgttaatttcggttttcgcgcggtcgggatacggttatatttgttcgcgggggtttgttttttaggtcgtcgtaggtttttcggagtttaagaggattttataagtagttaaagttagcg

SEQ ID NO: 5103 - DNA, 201 bp, Artificial Sequence
  Description of Artificial Sequence: Synthetic polynucleotide
tttcggggcgggcggcgaggggcgggagtttagagagtgtttcgtttttgtttagtgttgggcggcgcgtggggggggtagggttttcgtttttttacgcggtttcgcgtattttaaggattttaatttgttaggtgagtttttgtttcggggaggggcgttgggggcggcggcgaggatttagttgcgcgcgcgtatgcg

SEQ ID NO: 5104 - DNA, 283 bp, Artificial Sequence
  Description of Artificial Sequence: Synthetic polynucleotide
gtggtaaggtttggggattgagaggttcggtgagtgttagtttcgtaggttgcgtcggtgttcggtttttattttagttcgggggttttaggtttttcgcgggttttggggcgttggtgttcgcgtagttttagtcgttttcgtagttatcgtcgttcggtttcgcggaggcggcgcgtagcgggggcgttcgggcgttgtttttttgaggtttcgggggtttagggtggttcgtagtgttattggttagggtttgcgatttttggggttcgtcgtcgtcgtt

SEQ ID NO: 5105 - DNA, 201 bp, Artificial Sequence
  Description of Artificial Sequence: Synthetic polynucleotide
gaacgttttttagttcggtttggtattggcgtcggtgttttttattttggttattacggtttttagggatttgtgggaggattatagtcgttatcgtttcgattataagattaattatttgggttgtttggtttttagtaggtgagttgggcgggcgggcgagcgagcgcgcggtggcgtagggtagggcgtttcgggaat

SEQ ID NO: 5106 - DNA, 247 bp, Artificial Sequence
  Description of Artificial Sequence: Synthetic polynucleotide
aggcgtagatttacgagttggagcggcgttttcggtagtagcggtatttgtcggcgttcgagcgcgaatatttggttagttttattcgttttacgtttacgtaggttaagatttggttttagaattatcgttataagatgaagcgcgttcgggtcgagaaaggtatggaggtgacgtttttgttttcgtcgcgtcgggtggtcgtgttcgttttggttagggacggtaaattatgttacgcgtttaa

SEQ ID NO: 5107 - DNA, 427 bp, Artificial Sequence
  Description of Artificial Sequence: Synthetic polynucleotide
tagcgcgtttcgggtttcgcgcgtcgttagtttttggttcgttcgtcggtttcgtcgcgttcgttagtttcgtagcggagtttcggttcggtttcgggtcgtcgttattacgtcgcgcgtcgtatttcgcgttaagaatggggcggttaagttgtttaagtcgttcgtcgtcgtcgtcgtcgtcgcggtcgaggcgttcggcgtcggcgcgggtatggagcgttcgtagagtcgttttagtttgttcgtttttttcgaggcgttcgttatttatttttcgtgtatgaattttttcgacgacgaggacgtaggtaagcgcgcggttcgttttttagattttcggggtgtttcgggatttaggttcggtagtttttttttcgattcgtgcgtttttttttttatttttaattttttgggaaggcgtttt

SEQ ID NO: 5108 - DNA, 246 bp, Artificial Sequence
  Description of Artificial Sequence: Synthetic polynucleotide
ttcgggggcggttgtacgtggtcgtggttttgaattttttgcgggggtttcgaaattcgtttgcggggaggttagggcgatagaggattcgggagttatcgttggtgcgtggcggcgtggagcgcgtttgttacggttaaggtgcgggttcggtttcggtttattttaaggggttatcgggatgcgaagttcgggacgttcgtcgtcgcggtgatttcggcgggggcgtatttcggttgtgggtcg

SEQ ID NO: 5109 - DNA, 384 bp, Artificial Sequence
  Description of Artificial Sequence: Synthetic polynucleotide
tggtggcggaattttcggggcggtcggaggcggcggtcggggagtcgagaagtaagtattagcgttttaggatcgcgcgcgtcgtttcgcgtcgtttcgcgtcgtttttcggtttagagtttttattttcggtttgtgagtttgcggcgttggtggagttcggttttaggaagaggagtttattcggttttttttgattggatagtagcgaggttttatcgggcgttttcgcggtttaaaatcgaagcgggggcgagggggaggtagagttcgttttttgcgcgtcgcggttgggagggagaggaggtgggagagaaggaagaggcggaggaggtagcgggcgtcgaggttttgggattcgtaggtaagttagatcgacgcgta

SEQ ID NO: 5110 - DNA, 415 bp, Artificial Sequence
  Description of Artificial Sequence: Synthetic polynucleotide
cggggggggtaggggtttcgggtcgcggggtgcgggggttgcgttaaattttcgcggggcgtttcgggcgtacggagggttcggcgtttattcgttcgacggcgttttatttattggcgtttacggttcgtaggtaaagcgtggaaggagttgaacgcggcggagaagcggtttttcgtggaggaagtcgaacggttgcgcgtgtagtatttgcgcgattattttaattataagtatcggtcgcgtcgtaagaagtaggcgcgtaaggttcggcggttggagttcggttttttgttttcgggattagcgttttcgtagttatcgttcgagttttttttcgcggcgtttggttcggttcgcgtttttcgcgagttgttttcgttgggcgtcgagttcgacggtttggggttgttta

SEQ ID NO: 5111 - DNA, 543 bp, Artificial Sequence
  Description of Artificial Sequence: Synthetic polynucleotide
cgttggaagaaaaatttttcgcgcgtcggtagaattgtagcgtttttttttagtgatttcgggagtttcggttgtagtcggttttgcgcgtttttttaacgaataatagaaattgttaattttaataatttagagtaggttaacgaggttttgttttttcgattcgaattaaaggtttttcgtttcgtgcgttgttacgagcggtgttttttggggttttaatgtagcgagttgtgttcgaggggttcggaaggcgtaagttgggtagcgatatggggaacgcggagcgggtttcggggtttcggagttttgggttagtatttacgttgttgttgttcgtcgcggcgttattggtcgtgtcggacgtattcgggcgttttttcgaggaggacgaggagttagtggtgtcggagttggagcgcgtttcgggatacgggattacgcgttttcgtttgtacgtttttgattagtagttggatttggagttgcggttcgatagtagttttttggcgttcggttttacgttttagaacgtggggcgta

SEQ ID NO: 5112 - DNA, 227 bp, Artificial Sequence
  Description of Artificial Sequence: Synthetic polynucleotide
tttagggcgtagattttttattgtttttcgggtttttttcgggttttttttttgatttttttttttttttttttcgagtttttgtttatatttaggttgcgtttcggtttggttgttaaatagaacgacgtttttgcgtagagttgattaggggtggcggcgggaggtaaggttttcggtatcggaaagtaaagtaaagaaaaaggtattgtagttatcgtttttgg

SEQ ID NO: 5113 - DNA, 323 bp, Artificial Sequence
  Description of Artificial Sequence: Synthetic polynucleotide
ttttgtttcgcgattggcgggagtcggagtttttttgaattcggcgtttatattatgggttgagttcgtcggcgtcgagggagttagtgcgattcggttcggcgcgtacggttaaggtacgcgcgttggtatacgcgggcgcggatacgcgcggatatatacgtgcgggatacgttttttttcgacggcggcgttaatttttcggtaagtttagcgttttacgcgatttgttcggtttttacgttggttatagcggttgcggggacggggaggaaggtagcggggtggttttaggggtttattttgtagggttttttcgacgg

SEQ ID NO: 5114 - DNA, 279 bp, Artificial Sequence
  Description of Artificial Sequence: Synthetic polynucleotide
ggcgtagattatttggaaggggttgtggatgtcgtgcgtggtgtagagtatcgggtatatgtagtgtaaagtgtacgattcggtgttggttttgagtatcgaggtgtaggcggcgcgggcgtttatcgtgagcgtcgtgttgttggcgttcgttgcgtttttcgtgattttggcgggcgcgtagtgtattatttgcgtggtttcgggttcggttaaggcgcgtgtggtttttacgggaggcgtgttttatttgttttgcgggttgttggcgttcgtgtt

SEQ ID NO: 5115 - DNA, 261 bp, Artificial Sequence
  Description of Artificial Sequence: Synthetic polynucleotide
ttttcgtcggtggaggtcgcggttggcggagatcgttaagttagaggaggggattcgaggtttcggttgggcgaaggttttggagggggagaagacggtcgaggcgtggaggggtagtcgcggcggggcgatttttatttgtttattgcggggtttgttcgtggggtcggggtagatttcgtaaaggacgcgtagtttgtaagttcgcggttcgcgcggcgcggggatggggagcgtgtgcgtcgaggagcgcgcgtcgag

SEQ ID NO: 5116 - DNA, 364 bp, Artificial Sequence
  Description of Artificial Sequence: Synthetic polynucleotide
tgtacgcgcgcgtggttcgacgcgaggttcggtcggttcgggttcggggcgagattgggggtttgtcgttgtcgttatcgttcgagcgtaggaaatcgtcgttatttgatttcgttattaagtttaaggtgttttggatttacggtaagtatagcgtcgttgtagttggtcgtgcgtttttattatcgtcgttaggtttcgaggtcgcgtttagttttagtaagaggaaacggacgtttagcgataaatcggcgtatacggtcgaatacggtagttttcggattcgcgatttaacgtcgcgtttttcggggttgttcgaggaggcgatagttttcgttgcgttttcgtcgtttagggttcgagc

SEQ ID NO: 5117 - DNA, 242 bp, Artificial Sequence
  Description of Artificial Sequence: Synthetic polynucleotide
tagggtggaggcggtgtttgattgtttttttgcgtgtgttttgggaggtgggtttgttttggggatagaggtgttggacgtgtaggagtagatatgtcgcgcgtttcgaggaagcgtcggaattattagaagtatagggacgcgggtgtcgagagtttttagtattgaaaacggggatttttttttttgtaagggattttttttttttgttttaatttatttttttagatttaagggacgtt

SEQ ID NO: 5118 - DNA, 285 bp, Artificial Sequence
  Description of Artificial Sequence: Synthetic polynucleotide
tagtttcgggtcggggtggttgttttattttcgtggtttagggaggaggcgttgggtgcgtatgtttaggggtgtgttcgttgttagggttgtagcggtcgttatttttaattagttgtaagtcgagttgtttatttgggatcgggtcggttcggcgggtttggttttcggcgaaggcggcggcgttggtgcgcggcggttggggcgcgggacgtaggtagtgcgtggcgcggttggcgttttcgggcgtcgttatcgagcgagggtgcggtttcgggcggtcgt

SEQ ID NO: 5119 - DNA, 222 bp, Artificial Sequence
  Description of Artificial Sequence: Synthetic polynucleotide
cgttatcgttgtcgtcgttttttcgcggagtgacgcgttttgtagttaatcggggtagtcgggggggaggttcgggaggggttttgggcggagtcgggtcgtttttttattttacgggttcggggttgtttttttcgaaaattttagttttaattgttttgggaatgttcgaggtagagaaagggagcgagggagtaagtaagaagttggaggattagtgtt

SEQ ID NO: 5120 - DNA, 201 bp, Artificial Sequence
  Description of Artificial Sequence: Synthetic polynucleotide
gtagcgttttttggtttcgcgcgtcgttcgggggtcgttggttcggtgcgtgtggtcgtttcgtcgtttggttggagtttgtttcgcggcgtagggttgcgtttcgagggttcgttggttcggtggtttggggtttgttcggtttagcggtttatggttcggttttcgcgttttagttttcgtcgtcgtcgtcgtcgtcgt

SEQ ID NO: 5121 - DNA, 298 bp, Artificial Sequence
  Description of Artificial Sequence: Synthetic polynucleotide
tcggttttgggtggcggcgtcggggtagcgcgttcggtcgagtcggggagaggagcgcgggagattcggagcggagcggtaggagagcgcggagcgaagcggtaggagtagtttatagttaggagcgttttttcgtttttaacgtcgcgtttttttttttaaaacggtttaaaaaaatttattaattgtatggtcgcgtatttttaaaaaggtattcgtcgttatttggtttcggtgaattttaggaggcggaggaagggcgcggggtgggtgcggtgatatcgtgggaggtggtttt

SEQ ID NO: 5122 - DNA, 272 bp, Artificial Sequence
  Description of Artificial Sequence: Synthetic polynucleotide
tatttatttcgattcgaggttgtttattcggtttggtatgtttcggcgtttttggggtttttgtatttcgttggtttttcgttgtggtgtttcgtagttcgattatttttgtgtttttaggagtttattttgggcggtagggaggcgttgcgtggggtttacgagttttacgttgttatttttattagtttttattttttaggcgtttgttttttcgtattgttaggttttgttttcgtagtatttggtagatttgagttcggtttttgtta

SEQ ID NO: 5123 - DNA, 201 bp, Artificial Sequence
  Description of Artificial Sequence: Synthetic polynucleotide
tttagtaatatttgtagggttggtttttcggtcgtttatttcgttagtttgggtttttgtgtggagtgcgtttttgtgtttttggttagtcgtcggttacgtgtattttttgttaggggttggtaggttttttatttgtttaaattagaaatataaggtatagtggtttttagttgagggatggtatttttttttatgttt

SEQ ID NO: 5124 - DNA, 251 bp, Artificial Sequence
  Description of Artificial Sequence: Synthetic polynucleotide
tacgtttttcgcgttcgttcgcgtttgttttaggtttttatcgcggttttttttgttttcggggtcgttttgttttttatagattttattttcgggggtcgtttttaggattttcgttcgtttttttttgattcggtttttgttcgtttcgtttttttttttcgggttttttatttttttttcgtcggtttcgatttcgggggcgtttcggatttgtttttcgaatatttttagtttcgtttttagtttgc

SEQ ID NO: 5125 - DNA, 249 bp, Artificial Sequence
  Description of Artificial Sequence: Synthetic polynucleotide
cggcggtttttatttggagtcgtatttggggcgtcgagtttcggggtcgcggaaagaatgcgcgtcgttcgtgcgtttcgtttgtcgcgtttggttattcgtagtcgtcgcgttcgtatttgattatggagtgcgtttttttgttcgcgtgtgttttttcggttgcgggttcgggttcgtcgaggggtttggcgggattggggcgcgtggttaaggtaggtgtcgtcgagcggagtttcgagagcgggt

SEQ ID NO: 5126 - DNA, 249 bp, Artificial Sequence
  Description of Artificial Sequence: Synthetic polynucleotide
tttttagagttaattttttagatttggaggtttttaaggttttcgtaatttagtgagtttcggggtattaataaattttcgcgggggttatcgcgttcgcgaacgtagagtttatacgtggattttcgcgtttgtgatgtttcgattcgtttcgggttttcgtatagataatgtcgcgcgtttttttcgtagttatttcgggattcgcgtttcgcgtcgttcggacgtttttttgcgtttgtcggggat

SEQ ID NO: 5127 - DNA, 201 bp, Artificial Sequence
  Description of Artificial Sequence: Synthetic polynucleotide
ggtcgcggcggtcggggtcggtgtcggcgtttttttgggcggtagcggcgaggagatgggtttcgtcgtcgtcgtggtgttcgtcgtgatcgtcgcggtcgtcgcgtagagcggcgcgggttcgtattattattattattattattacgtcgtcggttattattattattcgacggtcggcgcgttcggcgtcgcgggtag

SEQ ID NO: 5128 - DNA, 201 bp, Artificial Sequence
  Description of Artificial Sequence: Synthetic polynucleotide
atggtttaggcggtcgtttcgcgcgttttagtttcgtcgcgcgtttgagttcggtgcggcgttagaagatagcgcgtagtcgtttttgagtcgtggaggcggggattaagttggaaggagtagcgattttcggatcgagtcgcgagtgtgcgtcgttcgtcgttcgtcggatttttcggatttttcgatcgtaagtgtcgt

SEQ ID NO: 5129 - DNA, 251 bp, Artificial Sequence
  Description of Artificial Sequence: Synthetic polynucleotide
atcgcgtagttcgcgttttattgtcgatcggattttacgttgttgtttttagcgttgcgcgttttgcgcggattcgcgttgttggacgtcgttatttcgcgtttggggtttacgcgagtcgcgagtttttgtttgtttttgcgttatttcgatttcgcgttttgtattcgtttcgggttcgcgtttcgcgttcgtacgtaacggtattcggttttgtatacgcggttggttttacgcgttgttcggcgtcg

SEQ ID NO: 5130 - DNA, 201 bp, Artificial Sequence
  Description of Artificial Sequence: Synthetic polynucleotide
ggggtttcgttgagttgagttttgcgattcggtttatgtgacgtgagttttattttaatttaagtgtgaggaagcgaatagcgttttgaaacgtagaaacgtgtttattcgaattgttaacgcgagcgtagagtttattgataaagtaaaataagataaatcgggagttagaaaatttagcgatttataggatttatcgtg

SEQ ID NO: 5131 - DNA, 201 bp, Artificial Sequence
  Description of Artificial Sequence: Synthetic polynucleotide
ttttagaattcgcgggttattcgggagtttttttcgtagtattagtcgaaagtttttagtgtcgaggagggcgggtagttgtttttttcgatttcgtttcgttcgcgcggacgttttcggttttacgcggggattatttcgggattttcgtcggatttcgcgcgttcgcggttaatttgcgtgtatttgcgtttcgcgtta

SEQ ID NO: 5132 - DNA, 201 bp, Artificial Sequence
  Description of Artificial Sequence: Synthetic polynucleotide
aggtcgagttcgtacggcgttttcgtgtagttagcggttagtgatcgcgcggttcgggcgtttttcgcgcgttttagttttttagacggggttcggacgcggacgttttttttgtagttttgttttgatcgttagggatgggttttgggtatttagcggttgagggtggggagcggttagcgtttgatgtttagtttttta

SEQ ID NO: 5133 - DNA, 337 bp, Artificial Sequence
  Description of Artificial Sequence: Synthetic polynucleotide
gtggtttcgttttagggtcgcggggaggcgttttcgtgcggggcggagttgttatcgttttttttttaattttcggggattgtggtttttttttaagttcgcggcgtttttagttgttttttattcgtttcgttcgttagtttttttttcgcgcgatggtttcggcgttgagttatgtttttaagtttaagtttttcgtgattttgttcgttatttcgtttttgttgttgttattcgttattttgatgttcgttaaggttagttgtatttttaggtagtttttcggatattcggcgttttgtgtttattaacgggtatcgatttcgggagttttgag

SEQ ID NO: 5134 - DNA, 201 bp, Artificial Sequence
  Description of Artificial Sequence: Synthetic polynucleotide
tgttttcggcgttttacgtgtggcggcggttagcggcggtttaggaggtagtcggtgagcgtttgcgagtagagtggcgggggtcgttgataggtttcgcgtagtttagtttagtttagttacgcggtttataggtggggtttaagagtagtttggagtaattcggcgttacggagaggggtggacggttttgtacgggtt

SEQ ID NO: 5135 - DNA, 201 bp, Artificial Sequence
  Description of Artificial Sequence: Synthetic polynucleotide
ttttttgcggcgaggtcgtttgatgaatttaagggtattagtgtttcgcgagaattttttgtgggttgtgacgagaattaagcggagcgtaatttttatcgtattcggataggatgcgttgcgtaatttgtcgtagtttttttgttttatttcgggtggttcgaagttgtaattttgttaattttttattatacgttatgt

SEQ ID NO: 5136 - DNA, 201 bp, Artificial Sequence
  Description of Artificial Sequence: Synthetic polynucleotide
ttttgtagttttgtttagattcggaagtcgtcgaggaagggaggaaggcgggggtggggagagcgcgattttaagcgttggcgggcggcgaggaggggtcgtagcggttcgaggaagcgtttggaggcgttaggggcgtcgagtttttagggaggtcgcgttttcgggaagttttttatcggttgttcggagtaggatcgg

SEQ ID NO: 5137 - DNA, 2567 bp, Homo sapiens
gcgctgggcgatgagggaccgttgggtaattgggggcataggaccgggcttcgctgggttcggggcagaagcgccgaagctccgacccggaacgcggtgacttcatcaacgcagaagcccgcgcagccgagcagaggagtccctcgtaggcgaccctcggacagacgctcctgcgcggcccgcgtggctcagctccgccccaggaaacttttcgcgcagcccccgctccatgcgcccccacccagtccttcttcggggccgccccctccccaaagtagctctccgggtccactgggcgcccccgtaaccgggtcggaacctcgaacggcttcgcgtgccatccggttaccctggcaacaccatccggcggcgcccggcggtccaatcctagcctgcggcctctctcgagcctttcgcaaggtggggaccgggacgcgaccggggatggggaagggggctgcaggaggccccgcctgcgctgtcgcccctgctgggcacagcgccccccaccacccgcggcgaccccggcccccgcaaggtggggcggcgagcaggagccggggccaggccaggggctcgagctcccgttcgaggggcggggaaggcgggtgacgtgagccgggccgggcgggcggagttgggaccggctccgggaggcgggggcgagcgcgcggagaggcagacgcgaggagggaggcggctgagcagcgcgggcggctctgcggcgggcgcggtgggcgcgggcggcggggccccgggatccccgcgcgcctcctccgcgcggcgccgccgccgcgcgtccccacgccccgcgctccacggcgccctcgccccgcgcgcctctcgtgcccgcctcctgccagtctccgggccgcggccgtctgcagagcgagcgctcagacggagcccccgggcaacttgagtggcgccgatcggcggcggagcctctggcagagccccccgacccggcagcgcggaggggactcgcgtccgtccgcgtcgcgtcaccccaaaccctaagcagcgccgccccatcggcgcggagctccggctggaggcaagagccgcgcgccgggagacacgcaccgtgagcggcagcgccgccggcctccctcctcgccgccccggagggcgaagccgcggctccccagccctttgctgcgccgcgacagcgccggaacacgccccgcctcgctgccgccttcgctgtgccgccggcggagggggccgcgagccccgcgccccggccggaggatgtgcgcccccgcgggccgcccagcctgagccatgcgccccaacggcggcggcgcgccggccggcatggagccccgcgcggccgcgctctgactcgctgtgcgccccgcggccggcgggcggcgggaggcggcggaccgagagccggagaccggcgccgcgggacggaagcgagcgggcgcgggcgccgcgcagatggcctgggcgagccaggtctgaggccccgctccccgaaacgtgaccatgtggattcaacagcttttaggactcaggtgagcgacccggccggcgccgggtgcgtgtgggcgcgtgggtgccaggctgggcggaagcggcgctttcctctatgttgcaaatcaagggacccctcttcgcttcccgcaagcgggcaacggggtgcaccggtagccggaaaggggcgcccgcccggagcctggagcagcaccgcggccctggcggggagcggccgggtctccagggttccgcgcgtccggggtcggggcagcggcgcccgccccagcaacccgggaagtggggccggccaggcgcgcccgcagctctaggagccagcagcgcagtgtcctggccggctgccccggcgcgcctcctccccggggcccggggcgaggcgccggccgctgggcgcggcgggcgcgggggccggggctgccggggaaagctaaagctccgggctcccagcgagagcttcgcaggcggagttggaggaaaccacagccaaacagccactccgctcccccttctcctttctcggggccccggggctgagcaggggcctcccaggctcccagctgccgacccagctgtttgcgggtgacctccgggcccgacgggcgctcacagctggcgggcagctggggcgggagagctggggttcttggggagctccggcggccaccccgctgtaaacacacacgcacatacgcccgccggcgcgcccggggcttgtctgtgtctgggactccagggccagatggaagagggggttcgagcctagagcccgtggtgggggtgtccagaaagacccttctcggcaaactttgccagcccgccggggttctcgggcttctctggcttctgcctggggtggcccagggcccaccagagcacagctgtcgtttttgctgggcaggctgcctctgagccctcgccctcctgccggggcattcaccgagctcgtgcatttgggtcccgggttggaaccgcgagcggggaggacagaggtggaggcggagagcagcgtgcggttctcgagtttgtccactgggatgcactgcgctcccgcgttggggacg

SEQ ID NO: 5138 - DNA, 573 bp, Homo sapiens
gcgcccaagaagtcggggtcctccctggccacgcgcctccgggggcgctcgcgctctccaggccctggctgcctgggcgccgattcccgggacgcgccggccgacagcaggggaggcggcagcagggaccgcagcagcccccgcttccgcacggcccgccgggtcgcggtgagcaaggcgggcaggcgcggcgggaggcgtccgacgcccaccccgggcttggcgtccccttccggccaccacgcggcgccgccccccgggatcctccagtccccggagccccgcgcgcccagagccgctcggagcgcgggcggggtcagcttgggcagccgcgggtcgctgctgcgtcggaagtctccgtcgccagggagccccttgggcgccaggtcctgggcccctgggcgaagtcgacgccagaacatgcttggccccgcactcagctcaccgcaccctcagcgcgcgtgggtggggggcgccggctgaggtggggagggcatagtccagccccaggccatagtgccccgggcggggcagcgcggtgcggggtgaacgccaccggcccggcggacagcg

SEQ ID NO: 5139 - DNA, 383 bp, Homo sapiens
ccggcccccatagcggctccgggccctcggatggcgtgacggcttgtggggcctgcggggtgcgctgcccccggacctgcggggggaggcggctgagctggcggcgctcgcgggcccagtggtgagtgcggcgtcctcacgcccagcccgacgcctccggagcggccgccgcgcaggggtgggcgcgggcttccaggagggagggcggctgtgaacgcgccttgctttccgcgcctccgcagtttcttgcgcagttgatgatctttataatcagcctcgtcagctccatcttctgtggacatctgggcaaggtcgagccggacgctgtcacgctcgccgtcacggtgggtgcctgatttcgcccctgtaggagccgacgggcg

SEQ ID NO: 5140 - DNA, 853 bp, Homo sapiens
ccgccccaggggcactccgtaggcgagatccctgcagatcctagctaggaaacgccagtgaacggcagcgcagggaacggggcggggccgctggcttcgcccaccgccgcggtgttgggggctgggggtggccctcgggactggtgtggagcctgggcctgacccactgacttggctgagtggggagactggagggtcgcatccggagctgggcccggggacgcccgctggtgggaagggtgtgcgcgcgtcggaggccgcggctgaccctgctccggcgctgccaggtacggcatcagcccggacagcatcatcctgtaccggcagagcatcggcacggtgcccaccgtggacctggcctcgcgctacgagtgtgccgcggtggtgctgcactcgccgctcacctcgggcatgcgcgtcgccttccctgacaccaagacgacctactgcttcgacgccttccctaagtgagcggcccgggcggggacggaggcggggcggggacggaggcggggcggggcccgggccgggcgctaagtctcacccgctccacgcccctcccgcagcatcgagaaggtgtcctagatcacgtcgcccgtgctcatcatccacggcacggaggacgaggtgatcgacttctcgcacgggctggcgctctacgagcgctgccccaaggcggtggagccgctgtgggtggagggcgccgggcacaacgacatcgagctctacagccagtacctggagcgcctgcgtcgcttcatctcccaggagctgcccagccagcgcgcctagcggcggccccaaccggccggacctcagcaataaggcggcccccggacctcaccccgcgccg

SEQ ID NO: 5141 - DNA, 1062 bp, Homo sapiens
ccgggatgaatgcagtcacggaacgcgccaatgcaggaggcccccaggacatcctgagcgctcgggagacgccaggcgcggcagcgggcacggatagcggaaaggggcgcgaccccgcggaatcctccggcagggcagggcctttgggtggctccgggtgtccagaggaaggggtgggctcggggacgcggagggaaactggggacgcggagggaaactgaggtcgcggaggacgcggccgttggcagctcgctgcgcctgccggccccgcgtgggccgccccactcgggaggacgcgggctccttttgtctgcagcgtccccgccgccgccgcccccgccgcctccccctctccctcccattttcgccgcggcccccgcccctcccctccccgccccctattgcccctcctccttcccctccccactcttctccttccctcccctcccctcccttcccctccggagcggctggggctgcggcgccgctgctgacacggatcggccgcggccgccaccgggcggaggctgcgcggcgcagacccagacgggcggccccggagggcgcgcggcgatggcggcggcgggcaggcggcgggcgcggcgggcgaggggtccgggctgagctgcgggccggcccggatggcgggcggcgcgggctggtcgggcgcccccgcggctctgctgcgctccgtgcgccgcctgcgcgaggtgttcgaggtgtgcggccgcgaccccgacggcttcctgcgcgtggagcgcgtcgcggcgctcggactgcgcttcggccagggcgaggaggtaagctggcccgaccccagtcccggcccggggaccccagcccagccccgccgcccctcccccagctcccccgccgggtcacccgcgtggcccgaggcggtggcctccctcccaatcccctccctccgccggagcccaggacctcggccccccccgggtatccctggcccagccgggccctcgctttccgccccccggcgcccgtgccccgagcgtcacgcgtcacgcctagggtggcttctgcgcccaccttccttcctcg

SEQ ID NO: 5142 - DNA, 918 bp, Homo sapiens
ccgccgcctccacagcgcgcctccaacaccgctgtctctgccccgcgccccagagcgctcccagctttctttcctacccttcccatgagtggagccgggcctggggcgccttaggcggtgacgatctgcagaagtctttgagaatgcaagatcttttggagccttcggtccgccagggccgggtccagtcaggacgccccgctcagaccccttcccagcctggggtgggcccaggcccgtctgcccccactgccttgtgttccaggagcccccgctcggagcccagacccggtgcccgaagatgagagtgccgcttctctccgtcgggtgagaagccagcccacgtcccgccggccaggcacggtgtctctcggggcgccccacgggaacccctgtgcctccatcggcgccctcggcggcggggcagtcttggcgctctcccctcgcccctggcccaggcccggctcgcgggtgtagctcttcctagggccccctcccctttccgggccgcgcgtccgccccgcatcgcggcggctcctcggcagtgtttgtttttattggacgcacagtgaccgtgacgggcacggggcgcgagctctcatcaccacaatgggtgtgcatggcgcggggcggggggcgctgccggcctcgagcgagggaggggagaggagggggtgcgcccgtgccctgcccgccccgagttcccgagtccgcgccccaccaccgcagcgagccgcccttctgggccgctcctctgttttcctttcccatccgttccctttgcctcggctgctcggagacatgtctggtggcgatcggggacccagagcccggcagccgctcctgtccctgtccctgcgatccctgtcccttccctttgtctccccgcgcagcgctctccgccgcggaaacttcgcg

SEQ ID NO: 5143 - DNA, 865 bp, Homo sapiens
acgtgcgcgcccgccggagaccagggatgaggtcactaaatgactgccccggccaacccccaccccgtctttatccgcaccgccccccccttaattgacctaactttctaaccctagctcttcgcttctggcaccggtcccctcccaagtctccagaccctaaccctggctcccgacccgccccgctacagcttgggaagcgggagaagcagcgcgcgcccttctgcggaccccctcccagggaagattgtggtgttagctgcctagggggaccagggggccaccgggacccagcgcaacctctgtctcgctccccaacccccggaagcgctaacagcacggttcttacgtaatgccgggcttctaagtacccccaacccgcacagcccccggggaggccgcgcagataccggggcccctcacagctcaccaccttggtgcctgaagccactttggagcccctaccgcaggggcggggaccagtgtcaatgggcagcggggcttggttctcccaaccagcaccccagaaagagggcccaggggcgggggcgggtggacagggagggaacgggcctgggtgaaaggggcctgtggagtttaaacccagtgaatagggtcctaagtgccgtgtcaggacgaaaagaaggcggaggtcttgggataggagctggcccgggggccgggggacgcctacctgcgccccgggaagcccctagctccgggcggctccagcgcagccgggcgctcagcgtttattgcttgtcaatcgctagcccggctcttaaagcggcaaggcctctccgcgagggggcggaggtccggaggagaggggaggtgaggagaacgcggaggccggcacaactcg

SEQ ID NO: 5144 - DNA, 408 bp, Homo sapiens
gcgctcggctgtcaggcaatccggtccccggttccccacggcggtctcctcggtgtgccccaccaagagcgacagggctggtgacccgaggggcgcgtgcgcggtcgtcagcctgggatttgcacggacccccttctccctagtacgctcgctcgggggcccctcctctgctacgccgctggggctcgcccgccacccacagccctcgcagagccctccgggcacaccgcggctggccgcccggggccaaggatggggcgggagcgcccacccacccccgcgccggccggggcatccaagaggcgcgctcgcagccacacggcgccccgcctcccgctccgaaaaagctcctgctcccctggcgcggtgtggcgtctccgtcagcccagccggattctccccgcttcg

SEQ ID NO: 5145 - DNA, 2245 bp, Homo sapiens
acggccccggggtctggcggggaggcccaccgctgcccagagggctcggccggccgggagggggcgctgtgtcctccccacgccctgcccgcgggctcctagcagcgttcgccgcgctgcaacgcaatgcgcgcccggctttcccctgggcagcgttcagtgcccgcttgtcctgcagggcaccgccgtctccctttcatcctggggctcccaggtccaaagggttcccagatccagcctcttgcctgaaccaaagtggccaggcactcagtttgtaagatgaacaaatgaaggaaagaaggaacgaatgaataagggctcatcttgcagagcgttcgcgtctcagcgcgcaccaggcacatcagtgccaaaggtgctgggggtcgggcccagcgcccggcgcggctggaatgggggcggcgaggagctcctcctagccagccgcagggcgggaactgcccaaacgcaggtcgcagcctcactgggttccgcggcggctccgctcagtagggaccgccctgttccctagcccccaatagcctcgccctcataaattcacctgagcaccctggcccaagtcaccccagatccctgggacttcccaggccccgacctcggccgggcgggaggctgatcctttaccgcggcccccttcccccattcccggcttctccccgggctgcggcggccgccactgctgccagcgcgccccgaggactgccgcaaaccccgggcgcagggaaaggggatcctggcggcgggacacagagagcgggccgggggaaggggagggaacggaggaggcgaggaggagctgggagggagccgaggggcgaggcgcggaggagggaccgaaggggagcggaggggagagggagggggaggaaggggaggggacgagctgggcgagggggcggggagccgaggcgaggagcggcgcggaccgtgggggaggtggcgggggcgaggccggcaagaggcggccgcgggccgggctgcgtcgggaaacggcggccagacttccccgggaaggggcgagcgagagccgggccgggccgggccgggccgcggggccgggaagcgccgagccgggcatctcctcaccaggcagcgaccgaggagcccggccgcccaccccgtgccgcccgagcccgcagccgcccgccggtccctctgggatgtccgtaggacccgggcattcaggacggtagccgagcgagcccgaggatgggagggcacccgcagctccgtctcgtcaaggtaacagcccgccggccatccctcgagcgctggcgcccccggcccctggcggacgcgggacggggctgggctgtgggtgtgatgggggcgggggcgctgggagagccgtgcttaggtcggggaaggctgggctccggggcagcctaactctctggacctttggagccagggttgggtaggcagggggagactcaggtgagaaaagaaatcgtggcgaagccgccgggatgttggcggaggagggggtccgcccacccgggtagccggctccgcgccaagaatcgctctaggctctcgggcagacgcctaggggaggggaggttccacctcccacgcccttcctgcagacctcggccccgggactggagactctgaagcggggttcccacctcgccccagcgcccccaaacagctccccgactccgcacgcccccgccctagtcttgggagcgcgtcctgccccttcccctccgcggcgagctgcgagtccggagagatgaatgccgcccgcgcctgcgagcccttgatcaatatcgcagtctcgggggaggagacggtgcctctggcggcagttcctgttccccgaccgcggctgggagcgcgacgctcgttctccgagcctgggcacccgcgatccccgcgctgcgcggccgaccctgcgacgcggatcgggcgctggagtttaggaaagtagccagaccgcacgtccagcgtctgcccgctgaagttcgtgggcggtgggggcggcccgcgggttgtgtgagccagggaagggccgggaggccggcagtccggcccgccgctcgtgtcaggcgtcacttgcagccccaagcgctttccagagcgttttggttttgcagggtataggcgcgcccgctgcagccggccggagaggcgggtgggcctctgcgctgctgccgggacaccccgcttcgcgccagtctgggcatcgcctcacccggggctcgggactccgcagggtccg

SEQ ID NO: 5146 - DNA, 2972 bp, Homo sapiens
gcgggccgcagccggagaggaacaggaaccgcagtggggacgccctggtccccgggcccacagcatccgggacggacgcgcagtagcgcgggccgggaactgggtaccagggcgggatgggtgagaggctctaagggacaaggcagggagaagcgcagcggggtgcggggaaccgcacgccctccctttgcctctgcttcccaccccgaggcggcagggcgggcgggcgcggttccgggggtgggcgggctgggcggggcggaggcggggccgcagcactggcttcacccagcctctcccgcccgcagccagagcgagccgagccgcggccagctccggcgggcagggggggcgctggagcgcagcgcagcgcagccccatcagtccgcaaagcggaccgagctggaagtcgagcgctgccgcgggaggcgggcgatgggggcaggtgccaccggccgcgccatggacgggccgcgcctgctgctgttgctgcttctgggggtgagtgttagccggagggggcccgctccctttcccgggatcagaactccgagaagagccgggcgccgccaccaaggaaacagaacagagcattggggtcccagatactgagggtgggtggtgggaaaggacctctgatgccgggaccacgaaggagggtctagggttcccggagcgcagaggcgactctccagggtggagatgagggcaagaccggagcacggatgccggtcctcaggtaccgcagggggcggtgggggagctgggaggggtctttcaagagggggcatggggctctccgatgcccaggttcttcggaagaggacactcgaatgccgggatcccgaagggactttcccctcagcatctcggtctctggagagtcgtgggacagaaccaaggcgagagaaggagggggaactggacggggactagagatgagaggggcgagctgggctggggcggggagcccgggacgacgggatggaacaatggaggaggtcggagggactggaggcagaggggacccggcaaggacaatggggaccggccagacaatgggggggaggggcgtcggagggagaggttggggagcgggagagaggttgagaagtgggttagggagggcagaagaggggcgacggcgagggcggcagagagatggaagcagaaggaaaggagacagagcggggcgcggaccctgaagtggtcggggtcccgcctgcccgctgagggacagtgagacgagaagagagagcagaggcttggacatttccagcgcctgtccccgcgctcctgctcgcggcctctcccagtcccggaattggggctgcggatctaaggctgggaggggagtgcccacttcgccggggcgaacccgctcccggggttcccccacggccggcgggctcctccgacgcgcgtgttctcacggcttgaagcagcgcagcggatcgcgagggacggagcgggtgtgcccctacccgggctggcggtggctacgtctcggggtgcagagcgccggggcgcactaggcggggacccttcctggccgcgcgcagctctggctacgcaggcgggaggcggcaggcagggggcgctgcggggcgaggcaagtgcagtccgccgctgcctgcctgcgagtctggggctgcgcgccgctccccacctagctgcgcgacccgagcgccgcgcccaccgcgctccgtgggctcccgcgcctcgaagggtcgggatccggtctgagcctctcctggctctcggtgcaagccgctgggcacctaacgagacgggggcgcccggacgcctcggattctgtagcgcggtatcccgggccaccgactcggcaaaggtcggcgggtcctccgggtggtccgacgagattgtcagatgtggcctgctttatggccatgaaccgaatgccctggaaggtctggcaacggaggaggcgtcttcactctccccgccagcatctttcatcagagcactgcgccccaaattccggctttacagatacggagactgaggctctgagagtttaaacgacttggccaagatctcacagcaagttgggccagagtcgtggctagactccccgacctgattcccagctcggtactcccccaccttttcagggggcagccgctgtcccagctcggggtcacggctgcgtttcccagcagggcggggggggttgacactgtccccagagtccgtcggcggtagagcctgcgggtgaggtgggcagagattctgtccgggtgcgggccccagcccgaaagctcagccccagttccctggagctgtcaggacctgtggctgcgtccggggatttgggagcgaccgcgggcacgtctgctgactaacgccgctggttagagacgctgctcagacgcgggtgggcgagcgtagaccaggagagcggggaggagggaccggatcccagaggggcaacgacttgggctccgggtctgggcaagagcgagggtccccgcgcgaagacccaaggaaggaggggagctgggcgtggaggacctgggcgcttgggaaggtgtaccccgacaggaacctgccgtctgcagcccctgcggctcccgcctccgcctcggcgcgcggctgctcggtctgggatggctgtgcgcggtccgagtttcttcctgggccgcggtgagagagagagggctgaaaccagagcgcgtcccggcgggtcggctggcgggccgcgccggtaatggaggcactttgtcattcagacgtctgtaaccagagccgccgggctggctaatgcgcctaatagggatggaacgagggcagcaaatgggcgtgcgtgagcggccgggctgagctgggtggatggtggatggggaggcagctccgcgggggacgggcccctaccgcactgttccagcccagtctggctcaagcgcctcgcttcttccctgggggaccgcgtggggaggcgggaataatcg

SEQ ID NO: 5147 - DNA, 1026 bp, Homo sapiens
gcgggcgagtggagtgtcctttagactccgcggactcgacgggagggaccctgcaatgcttaattagaaccggttgccatggcgacagtctctaggcagcgtgggctgagctctccgtaggaataaagggtgggccgccgctggaccctgcgcgcgcccgccaccaactttccctccagatccgagaggggcggcgcgctccgcccccgggccgcgcacgtcggtgctcggcggcgcgcacgcctgcgggagccctctccaggcaacctagtgctgatcgctcgtgccggtgcggccgttaaccgcccttgccggagccctaggctcaaaagcagccccttacccttcctgggcttcccccaacccctttcccggtctgccctggggcatgagcagcgatggccggctgcatccctgaggagaaaacttaccggcgcttcctggagctattcctgggcgagtttcgcggaccgtgcggcggcggcgagccggagccggaacccgaacccgaacccgaacccgaacccgagtccgagcccgagcccgaacctgaactggtagaagctgaggcggccgaggcttcggtagaggaacccggggaggaggcggccacggtagccgcgacggaggagggggaccaggagcaagacccggagcccgaggaggaggcggcggttgagggtgaggaggaggaggagggcgcggcgacggcggcggcagccccggggcactcggccgtgccgccgccgccgccccagctgccgcctttgcccccgctcccgcgaccgctgtcagagcgcatcacccgcgaggaggtggagggcgaaagcctggacctgtgcctgcagcagctctacaaatagttaagtagctgggcttggctggtggtgggcccgcggtccccaccgcgccggcctcggacgcggctccctcggcccctcaaactgctctcttttctgctcctctcccccgcacccgcgcctgccgccgctgaaagcgcccccgctgctcggacccgggcggtcg

SEQ ID NO: 5148 - DNA, 10207 bp, Homo sapiens
gcggaggcggcacagctggagcccggattgtggcacgccgtcaccgtgctgctccggggaatcccgacccgctccctgcgaaagcgtttccgaacgcgaacccagagcctgtgaacgcgccggcaagccccccactcccccaccgccgcccgtcgcaggtgggcccgtcctaggggtccttcctgcgctctaccccgtctctcaagtcactcagtcgatcgccccgttcacgctcccgtgatcccagacatccataaccacgatctcgcctccatgcacatccaacgcacgacggtgcacagacgtgcacctgacttctgcggaccaggtgtctcaagcgtacagcggccacccgcggaaccgcggcccggggccagtgagtcgtctgcagctccccgggttaggggattccccagaactccgggaaagtcacccgaagtccatccgggatgcggccttggttctcggccgcgtgatctcgcccttaggtgcagaacgacgcccttccagggcccacagctgccaggctgggccttgccctcgcatcccccgggaagaccagggacggggccacacaggccgtggctgcggagacgcttccccgggccaccccgcgaccaggagggagtcgagccgcccgctctccccgcgtcccccgccccatcccagccagttggccccaccctgcgcgggataattgggacgggagggaggcgacgggagggcggcggctccagagagactgcgcgcctgtcagcggcaatttgtttaagtggacgggacgggccgggccgctgcgggctggggtcaccgaggccgcggcccccaccccaaccagacctgggaccgcgggggagcccggtccggccgctaaaccgggctggctggcgccagggctccgggaggtgcggtccggcggggaagccgtgatgggaagcgactctgtccagggagtgtccttcaccaccacactcctcacgtccaggcagtgatcgacggcctggcggcaccctcacagcgggcccatagcacggggccacacacgtcccctgagcttagcctgggcacattcgtctgccaccgagggcttaagccagtctgcagcccgcgccccgtcactcggacgcaagtccgtcgtccgctctgccacgcggccgcacagcccgagcttcctgctgcccactgcccgcggggtcacgcaaccccggccctgcacacagaggaggaagcggcggggaccccctgccacctggaggctcaacccggggaaggtcccagcagtgccccttaaccctgcgagaggtgacggggccggaggacggaagggcagccacgccaggctcaggaccgcggccccacccggcccaggccgtccccgctcccgccccatttcactgttgcgggaagcgcggggcgcacagaccgcgcgccaccagcccaagcccgcccgacgccctggccggagaccgcctgcgagagggaggggcggccgagcgcgcgtcccccgcctgtctgcgggacctggccgatgcgaagtgacaggggccggagctttgttgtggagcctcggccgcctggcgccagccgcccccgcccgcgccctccccctccagccccgggcggcccgcgaggcgccccccggggcctcttaaaggaacacgcacactcggcccccggggctccgccaggggagggggttcctgggaagggggagggggccggcctaggtgggggaggggcccagcggaggcctcacggcgccgctccagggcctcccaggcctccccagcgccagctttcggtgagcctcgggcattcctagctggagagtttggctgggggtcgctacagactcttcagagcggctgcagcaggacctcagggtgatcgcgggaccgcggggcggggcgagtggtgggatcctggcccggacagagccccggaaagccagagggaaggtcggtgccactgtaggtggggtcgccgtccccagatgcagccgctgcactgtcgccgccaggtttctcggtcaaataacccaggcctgagtgtttcaaactcttcaggcctcggacccctggaccagctatggatggactaatgaaatggactaatgtctaaaacgcacacatttagatgtacacatactcttacaaggacaaaagtatgtgtctacacacacacacacacacacacacacacacacgcgcgcgcgcgcgcgcgcgactttgcgaatgtattcacggattcctaggccggtacctgggttcccggctaaggaaagctgccctggttattatctggtcacctcaccggctgcgcaaacgtgtccacaacgggtccctccccgagaggccacatctcgcctaaggtggagccagcaggtatttgcctgtggaaaactgcagtggatcctgccccgtctgcgtagactgcgcagctcggagtcaaagattcgttctggccagagaggaggtactaagagaggtgcgacctagccaagaacgaggtcgtggagaaaaccctgtgggggcggcgctcacatatgcggtgatgaggagttgtgagggccctggggtcggccccgaaaagtagggataacggtcgcagaggccatactgcttccgccggtcccgaatccgcactgccaggagagatccggccttcaaacgctgctcccaacgttcaacaacgaagtgccctgcgaccggtgtgcgcagtgggcgggcgcctgcatgggtcaatgttggatgtacgcgcccaccacgcggttgtacgggtgggaatgtcacccgtggctagtgcatgctctgtcttttccttcagaaaacgaccttcaggaatcagcctgagtgttcgcgcccgagcccgattggaagcaggtgcgtggtcgcttcactctccccgtgcacaccttgagttatagctctcgctgcgcacagagggcaccacacggggcccgacacacacacacacacacacacacacacacacacacacacacacaccatcacttcatgggggggaaactgaggctgccggaagacagaaaacgaagactgatcacagaagagggggcttcaatcacaggtgctcgcagacaccccaactccctcacgcgttactcagcactccttaacttaggagacgtgcgcttccgagagatgagaagaaactaaaaaagtggttggcagggcgaagagaggaagccggtatttcggaagaaggagactttcgtctccggtaccggatagggcgaaaattcgttgggtcgcgggtggagaatccggggtccgcccgcgcggtgccgccctgtgctcagcgaaaggtgcgctcaccttcctggccccgaggatccgctcctcccggccgctggaaagctcagggcggggcccgggcctgcggagaactccaggttccttccgagtcttccggtgaaggcgggcgcgggtagggggtccccgcgtttccccagcgcaaggccgcgtcccgctcccgcccgcgccggccccagcagggctcggccatggctccactcaccagctcccgccacctgggatccgctcccggacctcggccgcccgagcctcccgactcgcccgcccaccggcctcgctttccagtgcctgctgtctctttccggggcgcagggacccccaggcggcgccacgacccggagctgggtcggaggccaggctggggctcgggccagagcggccgggcctctgggcgcgggagaaggagggcgccccctctccgctcggggtcgtgtcaatgctttgcacttggggccggcgtgcggctgcgggtccttccccaaggccccgggacccgggctcccctcgcctcaggccctttcggcgggtcaggtcggccctccgcgctctccagtccggcgcaggcagccgcaggcgcgggcgggcggtgggggccggggcaggaggaggggtctcggggcccggcggcccgtcattggttaatattttattctgttgacatgttttcttactgctgaggcttccgacaccttctcccaggccccccctcccggccggagcttggcctgagctgtcaaaaccccgcccccggagacccacaattggtccaaaaagcgtaaaatcagcaatcaaggggggcctggctcgttagcgcaggggatccgagctgggcaggacatgtgagatagtcacagttttccagagatcacgacaagatctaaccagtcgcgcgtggtccccggcgccggagcgggccagctcagcccggcccagcccggccccgcgcagagcccccgccgcccccgcgcacagagccgggtgccccttgcggtgcgccggacgggaagccccgaggagcagctgctgcgcccgccacccgggtcgtccgtccaccgcgcgcgccgccgcccgggccgggggtccgagccgcgcgcccccggccccggccccggcccccgggcgcctgggccggatgtcccgatgagagagccggcgctggcggccagcgccatggcttaccacccgttccacgcgccacggcccgccgacttccccatgtccgcctttctggcggcggcgcagccctccttcttcccggcactcgcgctgccgcccggcgcgctggccaagccgctgcccgacccgggcctggcgggggcggcggccgcggcggcggcggcggcagcagcggccgaggcggggctgcacgtctcggcactgggcccgcacccgcccgccgcgcatctgcgctccctcaagagcctggagcccgaggacgaggtggaggacgaccccaaggtgacgctggaggccaaggagctgtgggaccagttccacaagctaggcacggagatggtcatcaccaagtccgggaggtagggctgccggccggctggaaggcgcgcgggcgggcgggcgggctggggcacgggactgcacggatcagagcagagctggggactcccggctcccggctcccggctccaggttctggccctgacgccacgcttcgctcccacggacaaccaagttgacttttctcgtttggcaccggagcgatttttttttaaaacaaaaacgctaaaatcctccgaatgaaataaaacgaaaacatactgctaaagaatagccccaaccgttctgagtcccagcgcagaggaggccccgcggcttggccctggcggtctcctccgccccgcgctctcgctcttctgcgtccgggtccgtctccgagctcgggggaaattcagcctctctcagactctgctccgaccccgaagcccctagtgggacctgggcccagctaaccccacgctggttgctcggttcctggcagcgagccccgggtcagccgagccctccgcctcaccgggctgggagccctttctccaccgcgggcatccgagccctggacgcatccgccgccccaggccttaaagcctgaagaaagccacagccccggcccctccacccttcgactcagccaccgagaatccaggcctcgggttcaccctcttcccccgaactgcacggccaggatgtcttatcaggctctgtagcccagttcccaatacaaacaccctccagatttatttctgggagcttccgtcccaagtgggtatttcccctgaacgaatttcggggagattaaggagaagcgagaatatttctagagggcctagacttctctcctgggcatcagctttcatctcagatcagggagaaagagggtccccagatctgagcacaaggcctaaaggaggctgtttaggagagggtctgacaggcagaaatgggatctcctgggagcaacaaccacaggtggggtcgtccgggcagtgatgagagggcagagcagccgaccacaggggaaacagccaggcggcagcggtgtgcgcaacgaggagggataaataaaggaggagtggggtcctggaacctagaacagccggttccaatgggatctcctcccttccctccctcccaggcggatgttcccccccttcaaggtgcgagtcagcggcctggacaagaaggccaagtatatcctgctgatggacattgtagccgctgacgattgccgctataagttccacaactcgcgctggatggtggcgggcaaggccgaccctgagatgcccaaacgcatgtacatccacccagacagcccagccacgggggagcagtggatggctaagcctgtggccttccacaagctgaagctgaccaacaacatctctgacaagcacggcttcgtgagtgttggggcagggtggggacggtgcaggagcttgttgacccagcactgcagctgagcaggagagcagggcggcaggatctcccagggggaagcgctgggcaaacccccagagtgcccctgcccgggtcactgccctgtggtctacgtgggctgggcctgggcctgggccccagcgctctcctttgcaagcctgggaaatggtggggtcagtggctggcagctcacaatctcagttcctcaggccgtggagggtcccttgtaccgtcaatagggaggcaggtgctgccaggactgggtctgcagtgctggaccacggaggtcaccctgctcttggcctgtaggtgccgagcttggaagacctgcccatgacctcaacttgtccatcacccttctgccaagacccgcgtccctggccctcccccaagactaggggatttaaaagttaaaccaccctccccacccacccccccagcctccctaagacctttccctcctcccacaggcagatgcccaactaggaggagagggtttgggggttctctccatttatgcctgagcaaggccccagcgaacgggggtggtgtttcatagggtaaaaggaactgcccattctgaggtagggcagttggtgagcccccgaaggttggaatctcctctttgtggggttagggggtttaccagtgccagaaaggaagagagtgttaagagtggaattgtagggctctgttttgttttattttgtttgggtttcttttgtggggaggggttgttttttggttggtttttttgttttgttttttgttttgttttgtttttgctctgtctcatttctgtttccaactgggaaattttttttaatggcaagagaaaaagaagctgtgaaaagagaaaagcgagaggaaaagtagaagaaaaagaaataagggtgagaaaagagcagagacaggagaaaatggggaagaggaagaaccgatagagagagagagagagagagagagagagagagagagagagaaagtggagaggaagaggtcaggtacccaaagaatagaaaagctcgggccggggctggtggctgccggctgacccccaccctccccgcagaccatcctaaactccatgcacaagtaccagccgcgcttccacatagtgcgagccaacgacatcctgaagctgccttacagcaccttccgcacctacgtgttcccggagaccgacttcatcgccgtcactgcctaccagaatgacaaggtgcgcgcggcgggcggtgggctaagcccctgcactgacgcccctcaacacgtgcaggcccaaccgtccgttcatcgcccctcgaagccccctgcacgggatccgcgctcttgcggcccgcccccgagcaccgagcctcgcatccatacgcgcagcactcacggaagtcctcaaggcgccctctcaatcccaccgcgcgcacacacaggctcccctggggcgagcgaacagctgggccgtcgttctgatggagatgtttacttaacaattagctgagactccgggcccgcgctgacatttttacattttattcgtttatttcttggctcaggaatgagaatgtaagtgaagagagggcgcccgaggcaatctgcccaggctctaccgatgctcagaacccggggcccagttttcactctctcggggggagccagagggtgggacaggtgacacagccccccaaagcactcctggctactgctctgggtcagtctaggccccagaccccttgggaggcgcttagagaattaccttccaatcaaagggctttttctgcttgcggcttctccacccttgttctagtggggcagagcatcacccctctaggcctgtgcccttgtgcgccactgtcgagtgaaagagagggtacgagtgtccgtgccggtcgttgtggctttgtgaaccaaggtgtacgctgggctgtgcgtgccccgtttggggtgtgttggatacctgtggaggcatgtgaattcgtttggttccgtaggcgtttgttatgtctgtgcacacttgcgtgtgtgcgagcccgtgagtgtgatttggctttgtgtgtacctgcagccttgcgtgtgaactgcagtctctgttcgcgcctgctcgggtgcggagtcgtttaacttgcgcaagcccgcgggcgggtgtgcatgcttgggctggttccgacactgtggcactgctttaggcctgtgtggggctgtctaggcctgtctagggataattcctcgaatgaagcttttggaggacagaccccgtcgctttccgcgaggccctcccaccggcctcagctcggggcgtcccatcccaggcgggtgggtaccaagtggacgctccccgggtcttccctctgcggccagcacccgctgacctcggggtgccaccgaccacgctggaagagccacggcctgacttagcgccgcccccttggtccccgcagatcacacagctgaagatcgacaacaacccgtttgccaagggcttccgggacaccgggaacggccggcgggagaaaaggtgagaggccgaggacagcagccctgtggcgggtgcccgcgggagcagcgagcaggagggatggagggatgggctccccgctgacctggttcatccgctcatccccaggaagcagctgacgctgccgtctctacgcttgtacgaggagcactgcaaacccgagcgcgatggcgcggagtcagacgcctcgtcgtgcgaccctccccccgcgcgggaaccacccacctccccgggcgcagcgcccagtccgctgcgcctgcaccgggcccgaggtgagggtcggaccggaggagggacagggaggtggcggcggggggtcctcaggtcgctgggctggtcttttgctgagccacccgctaacctgaaaggccaggaaggaaacgtcggcgagtgtctgggatggggtttccgtcccgggactcccctacgagggcggtccccggtagccagaagatccggccggactccgagcctggccccttgggcgccgtgtaattctatagctgtagggtttcctctccagggctgggttccttccactgtaaatctggggtcttggattaggtgacctgcagctgccctttgcccgactccagcagctcctccgactcggcctccccgagagcagcccttcccgagtgtccctgatcctgctcgtcggcctccgcccaggcccctgtaatccgcgcgccctctccccgcagctgaggagaagtcgtgcgccgcggacagcgacccggagcctgagcggttgagcgaggagcgtgcgggggcgccgctaggccgcagcccggctccagacagcgccagccccactcgcttgaccgaacccgagcgcgcccgggagcggcgtagtcccgagaggggcaaggagccggccgagagcggcggggacggcccgttcggcctgaggagcctggagaaggagcgcgccgaagctcggaggaaggacgaggggcgcaaggaggcggccgagggcaaggagcagggcctggcgccgctggtggtgcagacagacagtgcgtcccccctgggcgccggacacctgcccggcctggccttttccagccacttgcacgggcagcagttctttgggccgctgggagccggccagccgctcttcctgcaccctggacagttcaccatgggccctggcgccttctccgccatgggcatgggtcacctactggcctcggtggcaggcggcggcaacggcggaggtggcgggcctgggaccgccgcggggctggacgcaggcgggctgggtcccgcggccagcgcagcaagcaccgccgcgcccttcccgttccacctctcccagcacatgctggcatctcaggtaaggcctgtgaccccgcggcagcgccagcgagggagaaggcccagggagctggcggcgaggccagcg

SEQ ID NO: 5149 - DNA, 2392 bp, Homo sapiens
ccggaccccctgcccttccggtgagccgcccctcctttgccgtcgggtttccctccctcccttttgcccagccaaaacccgaacccaggcgccaggggagaggaccgccgttctagcttgccccactgctgggggcacggagttcttgctcctccaaggctacggcccccgtctccgcggaccccgcccggactccccctggccaccgggacgccccgccccctcccctccgcagcaatctcttacactcgggctgtgaagttcggggtatttttaggccggcgataaataattcatagggaacgtggcatcaggctccccccgcgggaggagggggcgcgagcagcgagagccaccgtcacccgcggctcaaggacactcgcgatgcggcggcggcggcggcggcggcggctccgggcggggacccgcgccacgcctcctggcggccaagctgagcaccacgcacccggcgccccccgccccacgctgccccccgccggcgtccgcggctccggggcccccacccccactcccccaagctgggtcgtgaccccgagtcccgcagtggggggaccaagccagcctggcaggcggccccagtaccatcccaggcccgcccgggggccctgggcgaacccaggtgtcccggacctgcctacctgcccctggcacgctcttattcttcgggagtttagaaacaggctcaaagtcactagcaccgccaagacctggacgggctctgaaatacagccagcggaatggtaccctccccaaataagtgtctttcctcgattttcctgtggcccggggtcagggactgaactaagataacgccaccatccgagggctgggggaccgagccagaagtccccttggacgaccagggctgggaaaccgagtggacgaatggggtgggcatcagggcctggcgggaattcccgtcttgctcacccagcagctccttgcagggtcgcgggacgcacctgggggttcaggttgccgggtgcctttgctccgcgtgtccccgccctgcccgcgtaggcaggaaacaggagactcggggcttcccctccccgccgtcggggatcctgggcgaagcccccagagaccggcgcaggcggctggtgcgcagccagggcccagcgccaggtcttgctcgcccagtgccctctctgcctacccttccctttgcgctctggaagcccgggagccgggcacgggccagcatctgcaagatgccactactctggaagcccactccgattctcccaggtcgcaggaaggagagagctaggctggggcaaaggagatggggcagagctggaaggggaagaagcgggactcgcggcgggggaaggggtctgggcgccgaggcgagtgcgcagcaggtgcccagcagacctagggaaactggggcactgggctggggagccgcacagccccctttcaccttctcgactcctttccaacccctcgctctggtggatcccagccccggcccccactcccggccctgttccccgctctccgccccggcggcttccagcagcaacagtttgggtccgcggcagcccagactcccctggtcccgcggtgctgccgcgccaagcgaaggaggaggagggctcggcgaccctggggacgaacgtcttggacgcttcgcccgcgtccttctctcgcgtccgccgcgcgcctgtctgctcggcctcttcttcgccttctctccggccgcccgggtcaaaacccaaggccaggttcttgagggtccgggtcctccagccgccccctccttgagccccgagagtcctgcgtgggtccaaccccccgggtgtcccgcctctgtctccgccgtccttgctcgcgcgccgcgggaacccagccccaagttggcggcgaagttggtgcccctcgcccgccgctcgccacttaccgaggggaaggggcgctgcgcccgcgacgagagcccgcgccggccgcctccctcgcggtgtctgtcccagagcctcggccccggagggctggcgcgctcagtctcagctccgcgggcgccggagcccgggcgcggcggggcgggggcgggggcgggtggcgcggcctggtccgctggccccgacccgcccctgcgccccgcgaccctcccgaggctcgcacggcgcccggctccgtcccgggctgggctgcgcaccgcgcctcctgctcccagagctcgcagccgactgtgcgggagctctcaccgccgcccgcgagggcccgccccgccggggcccgccacctccgccccggcccggcccggcccgctgcccctcgaggcccctcccgccgcattcccgggcccctctcccctctccggaaccgcgtccccagacctgacactcggggcaagtgcgcctcg

SEQ ID NO: 5150 - DNA, 564 bp, Homo sapiens
ccgaccccctctcgtggtcgccagggtaggggtgggaggaatctggaagccacgtgcgatgctcggagctgcgtcctctgtcctggggcgtgggtccgcgagcgccgcgcagcctcccggaccgccctgagctgctgcgcccggcgctgctcctccttccccagctccgcgccttcccctcgcgatccccctcctgcctcttcggtcctggaagcgtcccaagatggggtgggggcatggagggagagaggggaggagggagctgcccgggggcagtgccgccaggaagtgggacggggactctggcgcccctccaggctgctgcgcgcgggctggggaccgtgcaccgctttgcgcgccagacgatgcatcttctggaacggcagctgaggcaatgcggggtgtgaagtggcggcgggcagaggggctcgcaggggctgggatccgcgtgcccctctctgcctcggtgcggagcacgatgtgcccgggcgggggcgaggacgtccgggaggggctgggctgcgcacgctcgcggggccgtcgcagatgggcggtttggaggcg

SEQ ID NO: 5151 - DNA, 3277 bp, Homo sapiens
gcggctgtactgctgcggggtgcaagggcgggggaaaccacaccgttaggcgaggcgcggggaccgtgctggaaggcccgcggcgcggtcccctctgggcgactgcgggggcggcctggcagggagctggggcgagtggccgccgcggggcctcgcaggcgcggggaggcaccggccgggcacccgcgcggctgaggcgagggcgggggatgcctggccgggtagggaacggggtgggggagggcagaggggcgagcgagccggagggggaaccggagccgagggcgcgcgcggacctcgaggttctccaggcgggttttgagcgattgcaaagtttgcccgagttggctgagcgtctcggcggccggtgtccgggacaggtcgcccatggtgttcttgcccgagccgggctgcttgcggccgccgcccgcccgggcctcgccggctccggggtccagcgtgctctggctctcgcagcggcccagcttggcggtcagctcgcggatggtctccttctggctcaggatggtctccttctgctgcagcaccgtctcgcggagctgcagcacgctgctccggagctcctcggcgccgccggcggccacggacgcggcgcacatgtcggcgtccacgggcaccgaggtgcagatgaagcgcgtcggcccgaaatcctgggccccggcgcccaggaggcagagggcgagcagcgcacaggtgcgcgcggcgcggccggccggcatggctgcgggcaccgggcgctccgggcccggctcggctcggctggggctcggctccggctgggacccggctcgggctgtggctccgcgagcggcccgcgctctgggcgccgcgctcttcggccgcgcggtccacaccgccgcgctatcaggcccccactgccgcctgcgctgcggagcccgcgccttttatgccgccgcgggaggggcctcgagccgccgacgtcagcgggggaggaatcccgctttaattgtccgcggcccgggcccgcggcgcggcgggggtctcacgagcgcgccaccggggctgcctccgctcgcgtcccccccgcccttctgggagctgccgcggccccctcctcccccgcccccgcctgggccggcgctgctgccccgaaggctccgagagctcagggggaaggaagtcgggctccggccccggactcgaggatggaccacctgcgtggtgtccccgaacctccgacggggctccaggcgggcgggaaaccaccgcgtccgggagatagaattcggttcggccctcctggctgcactgaacacccttgggccggggtcgtttggagccgggctgggtgcccaaggacccaggtcgtcaacacccgagtgcccggtggtcaacggctcggagtggggcctcgcggcgccactaagtccagagcgggggtcaccgggccgccccgcgtttcttagatgtccgtgtgctattgagaagccgccgggcagcctgggtacagggacttcccacgggtcggggcccccggcgcctcccctcccccagctcccgggctctgtggacccggccccgtccccgggggactgtcagtccccaccccgtgcgggcggggcgctggggacttctcggaggcagacctagctgatcgagcctttcctgtccgcggcgccggcccgatcgcgggcaggcggcgtcgccggggctggacgttcgcagcggcgcttcggaagggggccccgcgggagcagccgcccgcgtctccagcagcttccccttgccaggcgccgcgcgcgcccggtatccccgggtgtccacctgtgcgtggggggctgtttcccgtctgtccagccgcgcccacttctcaggcccaaaggccagcaggaagggtcccggaggtggctgggggcgtccacctgagaagctccgctctcgctcagacaccccacccggcacccgcgcactcgcgccttcatctggaccgcggggctcggctcccgagatcgcggtccgggttccggcgccgggctgggggctcaggaccagggctggcgcagccgccccgccccgccccgccccggggctatcagagcggtcaaagcctcggaaatccctccgtccacgctcccgtggtacagagaaggaaactgaggctccgagactgcggggccgggctacagccgtggccccccgacccctccccgccgcccccggcttctctggtctctgcgttctgcagcctttccctgcgcgcagccgggggctgggggtccccagccagcagggacccacgggcagtcccgggtgccgggatcgggcgtccgcccctcgggcgggagcagaggccggctcgatggagacctttttgagaaatggcggcctctacccgccccccagcccccgagcgcccgccgtctgcgttcagcatctcagcttttaagcctccctgagccggggctgcgttctcgttgtctccttcggccgccgcttcctggcgccagagggaccccgcggcccgcacgggcctgtcctcggctccgctcggagggtgtgcgggttcccgctccgctggccccgcttgcccaccacggcgcgcccaaacccacgcggcccgcggccccttgcgtgctctgccgaccccgggccgcaggaggggttagcctcgccggtccccacgcggggtctgcgccggcagcgccacgggctggaacgcgcctcgggagaaattacccgcgcggggtcgcggcgtcttctgccccaactcccgtagggagccgctaggcgggtgccctcctggccccagcgctttggcctcgccgccctcccgcacgcgtccagtggggaggccgcgcccgtcaggcctggagccggaccgtgcccagccgagagcgcgcgggcgcgggagaggagccctgccctgcccagggcaggctgtttagacggggcgggaacccttagcctggccccgcgtctctatccccagcagccgtggagccttcctagccgcccaaggccagggaccctgcctggcttttcctccagggcagcagatctcagcggcctggcacctcggcacagaggagcgtgtcccccttccgcagaggaagggagtggacggcgtcagaaagggaggggagcctggggcggtgtctggggctagcgggacctctgggcactgtggggccccaggagaggagaccctcgggtccagcctgcaactgttgtgcaggaggcgctgggcgggacacctgcaggcgctgcacacacacgcgagggccaccatgccgcg

SEQ ID NO: 5152 - DNA, 5692 bp, Homo sapiens
gcgcgtccccgcagcccgccggccacgcaccgcacgcacgcgtcctccccgcgcggggtggcggccggcgggagccacgtggagcagccgcggtgcctccggccacgcctggctcccgatgccgcgaagggggtcttggggcaggccccgctccccgaagctgtcgctgcggctcctgccagccgggagacgacgaggggaaggggtgggccgcgctgggccttccgtccatccgtccttccccagctctgcgggggctaaatccgtcttcaacaaacctcgcgaaaaagccgagggggggacgcgccgttgctggagaataggtcagaagtgacagcagaatgggccgctgagacccccgtccccgccccggtcctccgtcggcctggcgggcggcgacgtggggaggggccgctcagaagccggggtcgcccgggccggggaacttcctcgcgccgacgcccactccccacgggccgcactcgccgaggggccgaaaggggctccagtggaggacgcggtgggagctgggtcccgctctagctgccgacgccggcggtgcccgggtctccgggagcgcagtttttggcacaaagtagcgccgaagaccctgccgggtgtcccgccgcggctgccgctgtgcccgcgcagggccggctcgtgaatgcgtgcgggggctttcgagggcgcttcctctaccctgcgcgcccgggggagctgtccggtcgccgccggcaggcagaggcttcgggccccatgggtgcccccgagaccccggatcgtgcgctgagaatgtcgacgtttcaaacgagccagcagagcgggccggagccttggtcgggaaccggcgccgcgtgcgcactggccggcgaggcctctggcccgccggggaaggagcccagagcgcctgtctccccggtagaaaccaacacacacaaataattatccgtatttcccacactgggggattgggagtaaggagcaaggataggggaggggacaggatccaacccgctggttttttactttaaaaattatatattttatgtcacgatcgcttttcgttaagaccacaaacatccaatttggcttggcgtaataaaatcagccggagctcccttaaacggagccattccggtgaattaagttgtgaaatctaatctattatatccataaaggagaatgctttcattgtaaattcaggttacaaagaaactatacctgggccgccggcctccctttcggatttactacttgaaggcttatcaaattacttcaaaatgctgggctaccccctccatatctcatggcaacaaaaattaaacgtggcaacatttcttttaatagtaggaaaggtcaaaaacaaccgccacaacaaggggatataatttttaaaagacatccttccccaccccgggatgtcttctccgcgtttggaagcgcccttcctattttcccaattaattcgagtttttaaaatatctaaacgcgccacgacttccttcaggttctcccccgctccacgaggcgtctgaggcgcagctcccggatggatcgcacgtggggccgcagaccctgggcgcccggacgtcagccggaggcgcggggatctcgtggctccgctgcgaacctgcgccccaccgcggcccgcacacctgggccgagccggggccgcctcgggagcccctcgctggctcctgggcgccccactcggctcagcaatgtccgggccagacaaaggagtcgccagggaggggttaatccgcccctcacccttctccgtccttccttccgcccccttctcaggcggcgcggaggagagaagatgcggcccctaataatgtgtttggtttaacctgcggggtgtgggtatttgctgcgctttcttgggtgagggttgggccccttcccttccaccttcctccactcctgtgcatgataccctggctggggcctggggcgtcctgcgctggccagaagtcagggtcaccagggactctccgttctcgctcccgaagaggggacttgcgcggacggcgaggaggatcgatgcgttcctgagttcccagggaaacgaggccgcggctgttgtcacgtcgcgaggaagatttatgaggcgcgggccgagcatggcccggcccggcggaggccgcccgcgcacccaggctaatctttgatttccatctgattattttttttttcctgccatctccaagtcggcgtccggaaaggcgaacaaagggaggaggatgggggatgggggcgccaagcggtggcgagggctcggtccggcaaccttcctcctcagtgggggcccttgggcgccccaggctcgcgcccaatgcggggcccaggagggcgcagtttgaaaggtgaccgggctggggctgtcggagacccgctctgcggggtggcccttctagccgctaggcccacgacaggacttctagggaggggtccctgcaaatgcccttgggcgaagagaggacggaaagaatattctcccttaaattgcaattaagggtgtgcggggcgggggtgcttggggggtgctgcggcaggccgggttcgctcaaccggaggcagcagctcagccctgggccgataaggccgagggaaacgggatttctttgcttcccgcacggaaaagatccatccaagcgggtaagagggaagcgaagcttgcattttttatgttgaaaaaaaaattcaaaatggaaaatcattttattggtcaccacccataagtaaactaaaaacagggataattagagtgtggggatttggagggaccataaatctgcggcgccttttccactggaatcaggagcctttatggcttgttgttttattttgagagaaatgagatccctggctttggtgcaggcgggtgtgcgctccgagcgtctttcggcgggggggaggggggagcaggaggggcgaggagacttgcgcagtcagggagccgcgaaccccgagtctcggtcctcgaaggcggcaggagaaaccgcgcgctgtgccccgacctctctcgccctggccaaccgcgacttgggacgagctggaggagcttcccccgggctccggacgcccgcgccgaaaaccgggccatgggtaccaaacccgactctaggcggtcattcactttgtccccacccaaactctgatgagctatttgggagtgcgcggggactgggaagtgagggacttttataacattcttctttcgactccggcttccgagcccaccacccatcttgcctccttcgcctccgccctttgttctaaactggggaggggggaggggggagagaaaaggacacaaaatcaccgcccccccgtcaaatccttaaatttccaatcttccgcaaaatggcctggaatccatttcactccataggggttctatcccccaccgggtggaggccagctttccaatctcccacacaagcaggatcctttcccacttctgaaagtcttcaaacccagtcaccccaaatgcaaacatcgtgtgaaaccccattaatcaggtaagaaagtagggagagctctgactcagctgcctctaattttgggaggagaaagagaaagtgagtttctctttcatcaagtaccccaaaataacagcgctccttcccttcagcccgctccaaccgcagccttgcctttgttgaaagacccctgtccttcctaggaaggggggcggggaggacaggctcacattccgaagagttctgtccccaaaactgttcgaagattcttttgtttgacgtgcacatgggggaggggaaggagcccgctcaggccacccggcctcctcggaccccgctcaggccacccggcctcctcggaccccgctcaggccacccggcctcctcggaccccgcccaggccacccggcctcctcggaccccgcagaatacccccaaagcccatgggcgtctcctaaccgtgtaagtccggggctccgggggctaggaggggctgctccaagacaagggaagctgcccgccagattggggccaatatcgggctttcccaacccaagcttcctccgaaaacaaccccctcaaaactgagcatccctactagaaaaaatccgcattttccaggaggacggggtgggagagcttcggggaacaaagcccggtcctcccagctctgaggccgaggcagggcgcacctcctcctgggcgaattcaatcggagctgcagaagagacaagcatttccaaactggcacccgctccgagcccaaggtgagggtggagaagggtccctggtggaagctgcaggaacactttgggccggggtctaccccgcgttcggcggctccccgaatcccgcagaaagacacgtttgcagcgaaaggctcttacacaccagccgggattttattcgttccctaccgagagtgcgctctgggagcgcgggaaacaaggaaaacgcacgtacctggcggcgctccgagggcggcctcgcgggccctccgctggcgaaggcccccagaagccactccccgcccggctgctcgccccacggccagtccctccctccccggcgacgcaccccgccgagccagctcacaggaagcgccaggagccggagacctggctcgcctttccgggcgctgcgtccgtcttcgaccgccagggcccgcgtcctctccccggccacggcccaccagagggaccccgcggcgggtcctggctcgggcgcgtccttctgcgtccgagttcccaggttcccggccgagctgcggagacggacgcggagccctcggggaagacgaggcggcggcggccgccgtccgggcaggagccccggggcgggaggggtgcagggcggaggagcgggcgggatcccagcgccccgcgccccgcggccgccgccctccggggcgcccagccccacccacgtggaaccgccccgcccccgccgccccgcccccacgagggaaggcacccgagcctcgccgcacacccgcgcctcccggtcccgggcccgaaacaccgcgcccctcccccagcgccgtgctccccgcctctccagcgcgcggctcccgcccgacccgcgcgcccgcccgacccgcccccaaccccgcccaatcaccgccctccgcggctgctccctttgtctgagcccccggcgcaggccaatggaatcacgcggaggcgcgggcggcttggccaatggaaggcccagggggcgtggctggcgggaggggctgcgggcggccgggttctatgcgctgagacccgagactgcgtcgccggcgggtgcgcccaggtcgcccagctagagccggcaggatcccgccgccgggttgtgggtttttgactctccctccgctgtcgggagaagcgcctgagtggggagggaggtgggaggaggtggccccgcgtcgggggtgcggggagcgggacggcggcttggatggacacggtcagccccgggccggagagggttcggctcagagcagcctgggttctgttcagagccctactgtgcacgtttccgcgaggatctgcggagagacgtgcaggcgacgcaggccccgggaaggaaggagggtacctgggctcggacgagcgataacgctgtgttctgtgactccgtacaaacggatcctggagtccagggaaagcgtcccaggcccccagcccgggcagggttcgtgggattggcgtccg

SEQ ID NO: 5153 - DNA, 7937 bp, Homo sapiens
gcgccgtctgcgaggggcgccctgcgtggacccggggcctcggggcgcgtccacttacccgagccaggagagactgggccccacggtgttagccccgcgctcgggctcgcgcgccgcttccagctcgcgcctcctccatccccggagggctccgcgggtccccggcgacgggtccctgcccagggtccgggaaccttcccctcccctcctttctcaagcgccatttctccggagccgggccggccgtcctcggtgtacgcgggaagcgggcagcctccgcctgcacccgcggggccgggacccggaggcacccgcttccccgacacactcgctggggccgctgctcgctgctccagcctcccgaggccacggcaagagcccgggggtcggcgccacacacccccagccggcgaccgcgcccagggacctaattcaatcgcccccagcctaatgaatagccgcgcgctaatcggatctccgcgcgcttcggggatttacgcttcccggctctccccctcgtgccccgcggcccgccagacgtcgcttccgaaggcgccggcctggggcctggccaggggctcggccgcggggggtcccggccgccggagccgggagacgccggagacgggagccgggcccgcgcgaccgccactcccgagccagccggggtgggccccgcgccttgtcctgcgtccccggcccggcccgcggagcgccggtgcttacctgcgagccccgggctctccggagctcccctccgggccgagccgcccgaagcgggcgccggcgtaggccccgactcaggcaggcgggaaatcccggagtccccgcccgcggcccgcagccccccaccccaggtcggcgtggcctgcgggggggaaggccggccggggccggccgcccgcttcccctttctctccagattcctttgatccgcgggctctccgccgcacctcggctcccgggctgccccggtcggcccgcggggatcctggaaacggtccccagcttatctcctttcatcaagcggccttgggccgccttgaaaccgcggagccagtaattgcttttttcaggaggcccagtgcggactggacaacagccaatcagcgccttgtttacactcggtgatggacagtccactggcggagtgccaaccaatcccagcggtcccgcgggagcgggagtgggggcggggaaacagagagacaacaggctttgagtttaactctttcgtgtccctgccggaatgagacggtggagaatttcgaatgcgtgtgaatctgtcagttggctcctagtttaaatatccttttttcccccagagggggaggcagagattcacatggagaaagaggagcaaaaataaatgtatccatcgccactaagacatcacctcgactccctgagaataaatagcatttgggtgggaaaccaaattctaacagaaatatttgtttgcggaatattttagaagtggtttgcatctgattacgataaaaattgttcagtggcttgctttagttggagtgaggatttagcagataggcagacagggagcagcattgagaaatactatacatggtttaccacaccatacccgcttcccccattaccaaactgaaaatattttctaaatctaggtgtagatgaagaaagggcaatccttgtcttctcaataaatccctgattttcattttagtagctgctctgttgcaaagtgtggcagagggagataaaattgagagccagtaatgtagacggctggagactcagaactcacttcccagggtctgatccccaggtcatggggaggagagagccggacgggctattcaaagcttttgctgcccaagcagcgggcgtgcgtgcgtgcatccgcgagctcgggtccgggcaggcagcagcttcagagcggtagatgggccaggcaacctggggaggcctctgggcttggaggtctggcctacctgccacctgccagacagattccagggagaaaaagcagctacttttaaggggtggtggtgtttcttcccttggccttctgtgcggcagaagccaaacgttagacctgctggattaaacatatatgtgtgtgtgtgtgtctgtgtctgtgtctacgcctccccctccgccgggacacgcgcactcgctcgctccagctccctctcccgccctgcgccaccacattcccattcagcagcaatgatctgcgcagaggagctgcgcagtcgccgggcttgaattaggcgccatcgggcttggtagtagccccgctgcttcctgattggcagttccctggcccggcgccagcctattgggaggcctgtttacgccgaatgagtggcacgagctcccggccgtggagggctgcgcggccaatcagcgcgctggctgttccgggctgagtggcacgagcttattagtatgcagggcccgtggctcgccgcgccaggctgcaggtttgagagccgctctggatgggctcgctagagtcgttgttgtggaagcggtgcatttacagtgcaacagtcagcacattgaaaataccaataggaatacaaaacaaagtcacatttactgatttaattgtattgcattcagttgtatccaggaaacagcctccagtaagtaactgaaattgctttcattttttttttgtttttgtatttttattattattttattttttattctggctttggggttttacattttttttagcaaaagaaattcaggattgtgatgttaagaagtatatatcttcccttttaacaaaatccgttaaaatgttgaggcttttttttttcttaaaaaatatggactatgagcgatttttttttctctgaaaaatcttatcgatcggtttaaaattacccccgtaatgcatccttgctttgctctgagcgcttgttgtctcgatcgacacccagcattaaaaacaaatactcgaagacaggacagggaccgccaggctgcgtctggcgcgagccgcgcgggtggcaccgggcggacagtaggcgaagtccgggcgccgccagcgtgcgcccagttctgggtgacccacgaacgaaccccaacattcgctcccctaccctgctcccctccccggaacagtcctgggttggccctgcccggtcggtccgcggcgaggggaactggccgggtcgtggtacccacggccgctgccctgaggggccttccgggccgaagctaggggccggggaggggaatggtcatggcgagtttttcgggtcttcgttcccaattcagaattttttttttccggagaagtgggggtggaggagggggaccgagcaaggccggcgcagcggggcgttttcaccgcgcgcgttcgggacggcgcgcggggctcgggtcacggcccgtgtggcggggtccgcgggctggttttcttcgggcgcgggggtcaggcgcgaccccagttctcatgactctcccagggagcgggtgcggctgtttcgcagggagcgggttctgcggcgacggccgagccactcgcgccccaaggcgcgcctggtcccagcccggcctgcaggccccaccgcgcccgcgctcccggagacgacgccggagggaggcagacgggccagagtcctggtctccggcaggcgggcgaggagagagcgggtttttagatgcaaaagcaggaaacaaagcaaacttgtagaagctccagatcctggagcgcgccagccacgcctggggccgcggcaagagggaccggcggctccagggtcacgccctgccttcccgggagggagccctgtgctcctaggttcagttccttccgaaatgccctcgtcagcgattctccgcccgcccggggccctctgcccgccgccacttttcgctccatttcctcccttacctcagcccgacctggcgctgcggcgccgtcctcgcggtcctccggcgcggcctctcctggagctgggctgggagtgggccccgggcctcggcactcggcgggtggcggcgtcgccgctgcgggactgtgggactcccagctcgggccgtgtggccgcccttcctcgccccacttcctggccgcctcaggctccccaggcccccgaagcccggcgcgggcagacgcggaggcgcggcgcggcctctccccgggaggagagaacacaaagaaaagctctctccaatccggtcagagccgtggcggcgcaggcaggcgacagtaatccacctcctgtttgcttaaaaagtcgagcaggctggtgagaaaggaacaatcgggcctgcgatccgcccgcagggggtgggagattaaaattgttgcttcgtagccgagcccgcgtcccgagaatcgccggcagctcgcgctttctcaactttgaaatttcttattggagagaaaaaaaaaaaaaaaaacaaccacaaaacaaaagcacagcacacacgactccctggaggccgccaggaagcctggcacccccgcgtgcgcagcccccggcccctctccggccttcggcgcctttgaagctgcaggtttctgacctccctccctttccttctttccctttgtcccgcccggcgccctccggggctcgggaggcgccggccggggctgggggcccccacgtccctagtccagcccgggcagcccctcccctgacccctgcgctcgcagccccctcgccagagcactctccgggccctggcggccgggcgctcgctttgcaggccgggatcggggcttgggagccgagctatttgttagacccggggagagagctggcgatccccagagggaagggagccccaaacgcctttgtatgtagttgccagacaaagagaactctttgtgtagacccatttatttacaatgcaaaagctctccgaataaatattaaaaaagcttatcagctgagcaaatatgtattcacttaatacattatgttttcggttatagattaaatcaaacacaaaatagtctgcaaataagacgttttagaacccggaccataaaatatcgcaatttaaaaaggtattcagtagatggaaaacatcttaatcgctttgttgtcatggtggaatggctacaaaaacacaaggttttccgcaaagttcctaattaggaatatcaagcctatccatctcccttttgttggaggtgataaacattaaaacaatacgtatttagaagatgaggagtaatatgtgaagtgcgtccagggagcgccttcggagggacgcctgggagcacggtggtgcacgcagcttctatcactggctccgaccctccgcacccagagtctaaaattgtccccaatttcgcctgagtggatgctccgcgttgggtgggggtggaagaaaatggaggtgagggttattttaggtggccgaggtccgggcagggtctgctggcagaaggttgtgctgggccgggcccaccttccccggctagagggccgagctgggcgccgcagaccccgcgtacccaggccgcccggtactgcccggagcggagaccggcctctgctcgcggtccccggcaggcgctgaaggaagaaatcccagggccgatttgggccgttgagagagagcattctgactctgaaagcaccccccccacacacacccccaagcccccaatccgcagaggaagatcctgggcgaatttgattggggggcggggtgattgttacagcctcaacaggaagctcccggctccgggacagcaggccgggcactgcggcgtggcggcccaggtgatgccggtggcggttgcgggcctccggggctctgaggagccggcctggggtcctagcgcgatgctggggacaggagctggtcccgctggggctggggaggggggaccacggtggattcagaagaatgggccgaaagatgcatgagggggatgggagtggggagaaaaggaaggttattaaaaaaaaaaaaaactcttgagttacaatcaataaaattactcgcttaattagcatggttattcggttaagcggaatgcagtaaaagctggacctcggcatgaggtggggagagggggagagctagtgtggaccccaggccttttcctccgagacacctttgggcagcgggggaggggagagggtgtgcgtgtgagtgtgtgtgtgtgtgtgtgtgtgtgcgagtgtgcgtgatggcttcgcagatttgggtttttatcacccagcagagccagcagcctcttcgccgcggcgccctagctgcagggacccgcggggacgagaacgggaggcggcgagcagtgcggctgggttcccccggctgccccgggccaagcgtggccgggacggtgcgtgcgcgcgcggggccccgggtgctgggctgcgcgcgcgtgcggcggggagacaccgagcgccccggccccgccacccggcctggccgccgctcgctcgggccggcgggggtggggggtggggggagtgggtgagcgggcggggcggggacccccgggcgagccgagccccccagtcacccgtgtctcctctgcttttgcctccacagaccatggacccgcacagcggccgctggctcggtgcgcggccgcccgccgagaagcccagtcctcccgcgtgctgaccggccccgccgccaccaccgcctgtgaccccggacgccgccgcctctgcgccgcccgcgcgccgagccgcccccgggccccggccgcgctgctccgaggaagcggcggcggaccggggccggggcccggcatggatggccgcgactttgcgccgccgccgcatctgctgtcggagcgcgggagcctgggccaccgcagcgccgctgccgccgcgcgtctcgccccggctgggcccgccgcgcagccccccgcacacttccagccgggaaagtacttcccgtcgccgttgcccatggcttcgcacacaggtcagtgctcggccggggcgggcgcgggacgggagcgttcgagagcggaacagggcgcccacccctccgctcccgggagcagagaagctttggtttcatttcccggccccggccgcggtggctgcctgggcgctgagcggggccgcgcgtcccgccagccccccaagctgcgtcgccgcggcttagagaggcccttccctggccaccctcccccgggggtctcggaggggcagccccggagccggctgaaattaaagcctttccgcgcctcgccaccctcccccgccccctcctgcagatctaaattccacggaaacctcttttctgcattctgcattcacctccctaagacgttccggggctgggacaacgaggcgctttctgcggaaacaaaacggctgttgtggcggggggaggggaccagggtacgccgcggcctcgcggattagagtggtgtgtgcgccgggcgagcgttaatagggactgctggtgtaagacgagcaaatcctgtttctatataaagccttaaagtgtcagggcgagaatgggtttgcagggatgcatttgccttaacgagtgcctctggtatcccgctaaagccggacaaagcgtggccagagtgcggcccagcctctcagcctgcggcccggggaggagggcagcgcgggcgcgggctgggggtggcgcggggcggcgctcaggatttcggtgcaggcgagagtgcggcggatttgctccaagaggagagcgaggcggatttgctccaagaggagagcgtggggcgccgtgctgggcctcgcagggacggatcctctcgggcggtcccctctgactccctgcccgagaggatcagtccttggcagagcgggcccaggcctccagggcagccctcttcccggtggctttgatatgagtgtcgagggaggtcagggtaggggcagctaccacgcctgaagccctagaggtcaccaggcggcgcgggtagattcgggggaagcgcgcagggctgcgctagggacccgccg

SEQ ID NO: 5154 - DNA, 1408 bp, Homo sapiens
ccgaggtctcccgacgtggacacctaacgcccttggaaagggagtgaattggtaggatatcatcgctccggttagttccgcgggagctgcccttcagaaaaaaaactttccagagccaaaagttactttccaagcgccttggggcttcccgggcgcctccctcggacggcaaccctagaagtcaaagcgattgcatcgccaggtctgtggcggctggaagcggggtgaccgcggtcagatggcatttcgcacccacgcagggctgtgttatcctagcacagaaccagcaactctcacacgaagccttgtgtaaacaccacgcgggcccattcctgaacgactctttgatgcctccgctgcggttacttatctcatacataaatcaggattccgctgacaaatctccgtgtttccactaaacagaaggctgccctgcagtccttctcgtgcttctttctaaagtacgataacatctgacacttccataaaccggcctgcagaggacaccgcgcagggggcgactaaccagctgaggtgtgtcaccccaaaacaccagtgggcacaccccaaggcgggcacgtggaagggacgcggaaccgagggcaactattttccagtcggtgaatctgatggagaaagatgccaaatgcacttcccgagccagctgaactcctcgggcacctaatcattgccagatgtggcgagggcgcacggagaacatccccagtcccggagaaaacacccggccgccagcgcggggaccgctcgggccgggaaacggctagaggcgggaggagagaggactgggcgagcgtggggagcgctgcggcgtggaaaagcgaccgggagggatggcgatgcctccactctcctcggcaggttttttcaattaaaaagttggaaacgggaatccgtaaacaacgacttagggcttcaaactacttgcaaagacgcgatggggaggggaatacttgcgcgcttcaaaaccccaacctcgaggtctccagccgcgcctgacccgggagccgggtgcgcccccagtgtccgcgcacgaacccggcgccctggcagccccgactccccgggcccgcagcccaagggaaggttcgcgcgggaggcacctccgtggcctcccgcgcgccccgaagcccgttccccccgcccagagccccgcggagctgccgccgccctacctttcatggtgaccgtggggacgcaccgccggccggggagctccgcgcgagcgccgcgcagccgaggaagtcgtcccgagcggctgctcaccgcacgcccatggtagccgcgccgcgcgccggccgtctgcgcccccgtcctccctcgccgccgccggcccgcgctccccgcgctcccggctccgcgctctgctgcctcggggctgccgcgcgcg

SEQ ID NO: 5155 - DNA, 208 bp, Homo sapiens
gcgggcgtgggggggaaggggaagaagtccggcgagattagaggggaaatccgaaaaagcaagcccctgcggcagcagccaggaaacactcgccaggaactggctgcgaccccaactccagcggtccgaagccctagcctccccacccccaccgcggcagagccgccttcgcagacacctcccgaggagaatcgcggccccgagggcg

SEQ ID NO: 5156 - DNA, 805 bp, Homo sapiens
tcgccccctgtcccccgcacctccccgggggaggggccggcccgcgctcgcccccagcccgaggggcaacttaaaacatggcgccccgggcgggggatttgtgcaaattggcggagaagggacgcggggaccgagtcgccccttcggccagggatcccagggaggcccccaggccggaggccggggctcaggctctgcgcgccggcccagccactactgcgccgcggcgggcggagcgggcggggggcgcggcgcgcaggctcggcccggtgggggtcccggcgagcgggagggcggttggggaccccggccgcgccgggcgcggggctcgggattcgggagaccgcgcggcgccgaagccacgcgtcagccccactgtcccgcgcgcctcgccccaggcctcgggctcttcctccgcacctcgtaaagccgagaccccctcgcagtcccccactccgagaggcggaaaagttacctgggatcagcagggagcccgggcgcgccgcggcgtggggactaggctcgggcgcgcgtcctcggcggcggtgcgcaggagactcgggcgtggggaggaagccgcagcccagggctgctcgccgctgttccccccgccccctgttgcaggagacaccgaggctccgcggagctgcggcgggggcccacgcccagagaccgtgcgaggaaagccaacctcgtcctgcctgccctcccagccgcgggggagggggccaccgcagtacttcaggacagttacatgggcacagcctcctccgtcctggcgcagggtcaggctccgcggacgacg

SEQ ID NO: 5157 - DNA, 2462 bp, Homo sapiens
tcgcggcccagtcttaatccatcgcacttcagagggaattacgagggagttgcggactggcgggggcgggggtctgtaactaacaccaggtgcctgtgagagagccccaagggcgggggcagcacctcctggctgggttgggtccgcctggcctcgcctcgcctccgggatccttggcgctcagcgccgccctcccgctactgcgctacccgccagagcccggcgtcttccctttccttgtcttgtggacgccgcccttcgctcccgggaggatttcgcctccagcacctcaggcttttctggcgcaaaggtcgccagcccgagcgagcccaggcggcggcttcacttctgcagagggaaagcgaaagacgcggccggcgggccgagggggcggccgaacgcgccgcgtggttgctgctcccgaatccgcagcggcggcgccagggcggtcaccgagccctgcggaccccggctcaacttccagcgccactcgggtgccccgagcccgccgcagctcccggcgcgccctccagccgcggcacgcagcccctgacgcgcccggggcgccctcccgcagcaccagccaggccaccccacctcccgcgccgcgcttccccgccagccgccggccaggagctccccggcttctgagcaggacgcgccaaagggagttgggaggctcagcagcccccagcgtcgccttctcgggtgacgtgacgctctctctggagcgcgggcccgcctccgccaagcctccaccgcaggtccttacagccgagccacgggaagatgcaacgccgggcgaggggcgcctcccggattttgaaaaacagcctcattcgcctcgggaacgcctcgatcccccacccgcaccctttggccagatgattttaatcctgggattccgcgttggtcgtgggggtaccgggagctggagctggaggagaggagccggcagcgcggagttgccggggtgcagctgcgcgcagctggcggcgaggggaggcggtccctgcggctccgccgggctgggggaactggctcctgcgcctctgcctcccggaggatcgcactcgctcatccttacacaccacacacacacacacacacacacacacacacacactgccgctagcgccccccacgccacaagccggaatgcggaggtcagagccactgtccacttgaaagcaggaaagcaggggctgaaacgctgagatggaggcggaggctctggcctcatctgcgaggttcgcaccttcccggaaggcccccccctcccccgcgtttccccagggcgagcaaggtctagcttctgagactccgctctctgggctagcggttcgagctgcaggggggcggggacggattcggagggagcactagagagagagcccgcgctcactcctgccctcctcgcaaagaactggccagccccactcgcgtccagcccacaactaggctgccgggaccggggagccagaccccaggtcgctccaactccggcgagggcggggaggggagtgacagcagcaactagcgcgcgctggcaaaagcacagagtctcggaataggctaaacggccggcgcggaggggtggaggcaagagggggcggaggaggagttgcccgagcggagagggatgacgtcctccagggccttgggctccgaggaaccgaagactggtgcgctcgccgggccccgcgcactagctctggggttcgcagaggcgccgcgcccggcttccgcggcagctccaacacagcgcgcaggcggtcgatcccggtcagcttaaaccgggcgcaagccctctgtccccctcaaagcacctctctgctcgtccctagtctccaggtgcccgtctgagagtccctgtcgcctccgggcggacccggccaggcagcccccggtcgggccagcctcgccccttcctcgctttctcccccatcgacctcgagccaagggcaggcggcccgcacccgcgcccctgcccacggggctaggcggcgctcccggcctacgcccggctgccaagaagagaaaggcgctcacctgagtcaccgaagccttcctttggggcccctcccggagcttgttcgcagcccgcaggcacaaccttccttggagaaaaaaagtagcgcaagggcagagagaggtagggctgctcacaggtccctccgcaggggctctttccttcgaattctccggggtccagtctcgggctcggcggcgggaaagagctcctggaggctggaaggggccgccagacccgggctcctcccgcagctgcggtggcggcacctccaagttgccacctgcagcgcgcttcgggcgcctgtgacagcccgcgccgctcagccctcgcgggcccgccctccccgtccgctcgttggctgcgcccggtgcccgggcggtccccgcgctctgccccgccctgagcccgcctcccagccgcgcgctcg

SEQ ID NO: 5158 - DNA, 990 bp, Homo sapiens
acgtggtgtgtgtgtgcgcgcgcgagtgtgtgagcgccaggggccgcccgcccgccgcggctccccgtgggctggccgggccaatgagcgcgcggctgtaggggcggcgggcggggagggggcgccgagccctgcggatggaggcgcgggcagcgcggcgcgctcattccgcgcgggcgttgctggcggggggcggcgcagccactggacccggaccggggccgcgacccggggtggcgggtggcgtgggcggcgcccggggctgggatgcgccgggggctcagtggcggcggcggcgttggcggtggcgtcggcggctgcagggggacgagctagcgccgcggcgctgggagccagttgagcccggccggcgagcggaggcggcagcgcaggcagagcggcggcggcagcgggagcccgagcgctgcgcgcccaccatggccgcccagggagagcccggctacctggcggcgcagtcggaccccggctccaacagcgagcgcagcaccgactccccagtgcccggctccgaggacgacttggtcgccggggcgaccctgcacagcccggagtggagcgaggagcgcttccgcgtggacaggaagaaacttgaggccatgttacaaggtaggcatccctcgtgttctcggactctccgactgagcctctaactccttttcggacatccccaccgcgcgctccggcgcccgctactccagcctacggccggccggtttagctccaggcccgctcccccgcggagccggaggacacccagggactggagacttcgcgggactccccacccttccacgcctctcagatttccaggcgctgggggccctgtgcgaacttgactggcttcagaaaagccgaaggccgagtttgtactggcgcgcccaagttgcgttctggactttggagatgccaactttagcccggacacctgggctgtgccatccggaccactcgggccgcacagagtatgcg

SEQ ID NO: 5159 - DNA, 2274 bp, Homo sapiens
ccgccttccgtgtactgcctgcggctcgcttcgggcccacacgggacaccgaggcatgatgaggacgcagaacagcagaagcgcgccctgcttcccgggcgccagtgctcggggccagcggcgtgtacccggcgggcccggccgggagcgggctggcgatcgcggggctcggcgctcccggctcccgcgccatctcccggcgcccgccaacttcgctccgcccgcggcgtagagaagctcgcagccctccggagcctcagcgatctcctggctcgcttttcccgcagccgccgagcagcgcaggcccggcgactccgggtgcagctggccctgtgcggtgacatcgccgtccggcgccaggctcgaagccgcctggccgcgcccgcggggtcgcaggccgctggtcccgcccggccgcgctcacaaactactcgcggctcgtgacccgggacaaacttctggcggcggcgcagcctcttccacagtcaccctccccagagccagctaccaaaatagaagacgcggccggggcgaggaggtgggcggggggagcccggtggccgctcctccccgcgcggctgacgcccgcttcggcggcggtagtggctgtggccgcggggccgcccccagccgagctcccggaggcgctcgggcgcgggccggcggggcacgggcgctcacgccctctagcgggccgcggcggcgccgggcggccgtgacgtgagcgctcccttcagccggcctgcggggcaccgccagtcagtcggggagcaagagccccgcgcgcagccggcgcgggctcggtcatcggcgcgccgccgcccggggctgggcttggggctgcctgtggagaggcggcgggcggaacgcgcgcggccacggccacggccaccgccacggccacggccggcagctcgggtcccgggtcccgggcaggggaaggggagaggcggcgagctcagcaaccggaaccgagggaagattttggctccgcgggctcgccctccgctccctctgccagcggcgccagacgccgagtggggccagggacaggggaggaggacccaggaccctgtgcccgcgcccctggagccgctggagttcggacttctgcaactgttggcactttgggggcttggcttagcgctctgctgtttacccgtctctcctcgctgcctcggaaccaaagctcccggccccctccgccctcgcgcgcccacccaccgccgccggggagcggcccggcccgcactcagcaccatgaggggacttgggacttgcctggcgactttggccggacttttgctaactgcggcgggcgagacgttctcaggtaagcgggaccgcctctgccgcccccgaggcgcgcgggccggcgcgggacgcccgggacgccgacagctccctggtggtagagccctaaggctggcgtcggggccgggcggggggcgcggcgggccggacaccgcttctgcctgtgagccgggcgctgggcgaggggccgtggggctggcaggcacccagtcctcgggcgggcggagcggacggaccccgagggcgagctccccagccgggactgccagctcggccgccgtccttccgcggcctgggctagtgctcaaggttgggcggcttgcactcttgagtccctggccggctgcaaaaggaacagcagaaaactttgcttgaagttcccagttgcagccgccgggccgcctggcgtaggcgctgcgcggtccccgccgaccccgagcagcggccgggcccaggccgctggtgttcggctgcgcccgcagcgatcgccgggaactggcggccgctccggcggcggcgatctcccggtgccctgccctccctgtcgccccctgcccggcgcggctggcgaccccgggaggtccccgcggtcgtgcagcgtctgcggagaggctggggggagttcctcgccggtcccagcggtagggcttggcggccgcggagggaagcgggcaggtccccaggccctggccacggccctgcgccccgctgggctccccctccccaccctcgtccccctagcggagcgccgcggccagctgcaacttgttcatccagcccggctgcccgggggtcccaggtgggaaggagaggcactggcggtgtgcgagcaagcgtgtgagtgtgtgcgcgtgtgtgcctgcacgcgcgcgcgggggcgttctaagcccagaggaacccctcacggagaggatctgtggatcggagtcgggggtccggcgtgggggcgaacccggcacg

SEQ ID NO: 5160 - DNA, 882 bp, Homo sapiens
gcgaagtgaccccctacgcctggacaaagcgctcgaaagcccaggcccgcgggttagctccagccgctgggcttgacaggggtcagggaggcgggccggccccacagccaagtcacagctccagggcctggtcgcacctgagcagcgcggcctcgggctgctgctggcgctgcaggctccgcgcctgaccctccagcctgcgcagcgggcactcggccgggaagaacctctccagcaggcggctcagcactacgttcacgcgcccgcgcccgcgcccgcgcccgtggccgcgcgggccccagctccacgcagcgctcacagaccgtgagcccgcagggcagtgtcaccggcttgtgcagcagccccgggcagccaagcaggtcgcggggcgcgccgggcgccagggccggccctccctagccttgagctcgccgcccggcttcctcgccaacagtggccgttcgcgcaggccgggacacaccaggccgcccgccagctcccccagctcctccggccgcagcgcctccagcctcccggctacacggaacgcgcccagggccaccgggaggcggccggcgcgggtcagagcgtcccccagcctcaggcaccggccgcggtcgggctgcgccagccgggccagcatggagcggaagagcccgactgctttctggtactcgctcgcgcggaaggcctcgtcgccctcctccaagcgctgggcgattggcttcccgcagcagcagcccgtcactggggcggcggcgggaccggctcagtgctgatccccgcggggctgagaccgtgcgggcctggagcgaaggcgcggagcaggggcgatgagctgctgctgggaactggccggcgggagcgcggccacagccttcg

SEQ ID NO: 5161 - DNA, 4359 bp, Homo sapiens
tcgtgtttcacggaaaccaccaccaccgcatccacaggctccgaggggcggatacaaagtcttttgggggaagtggggccgcagatttcccccgacccgaacacagactcgtacagggcgcgcttgggcgcagcctcggatttcacgtcgggcccgacctggctgtctttggggaggatgtaagtgttccccagcgagggcggctgggggcggtggtggtgggagggatgggtgggggggtggtgggagtggtgccgtgccgccccgttcagagcctcggcgtagcagccctgcggggcgggcgagcccagcttggtgccaatgcccgcgatgctgttgagcgtggcgatggagacggcgccgatgcagtggttggtgtaggtcttggagagcttggccgccttggagagcatctgcatccgagtgcctagcaagttcttgccgatggctttgttctcgtaccaggtcacatcgccctcgctgcagtggtcccggggccgctggaagaacgccttgcagagagggttgcgtttcgacaggtacttgacgaagctggcgtaggggcagaactcggtgcccgtctcatacatgcggggcaagttctcctcgtcgctgctctcggcgcgcttcttgctccacgacgacgagcgcgacttgtggtagggcccgagggacttgaagtagacgaacttgcgaccgtcctcgtccatggccagcccaaaagagtcctcctccaactcacgctggttctcgcggccgcgggtacagaagtacatgcacgtctcgaaccagaccttgttgagcagcccgaagggcgtgttggtgctgaagacgctggaggtgtacagcttgcgcaggtcggcgcgcgtgatggcttgcttctgcaccaccggcccggcgccctgctcctcgagcttgcggatgaccgcggccagcgtcaggttggcgctgcgcagctcggggtccttggtgaggtcgagcgtgcggcagtacgggggctcattgaggtagcggttgagggagctgcggatgctgatgagcgacgacttgctgtagagctggccgcttttggagcgggcctcggcatagaaggagcgcagcacgcggcacagcgcccccttgtccatggtctcgaagtccgggctctgcgccttctcgctcaggtactcccggaagatgcgcacggcgtagcgggtggccagccgggtgttctcgctcagccgggcccgctcggggcgctgcagcacgtcggggtccagctcggagccgtccccgggcggcccaccgcgggcccggggcgccagcagtcgcggcggcgcctcgggctccagcgcggcgctctggtccatattgatcatatggaccggctcgggctccagctcctccccggccgagtcctcgggctccaggggctcgtcccagtccagccccatctcctcctcttcctcctcctcctcgtcctcctccagccccccacctccgtcctcctcctcctcctcgtcccccgttatctgcacctcctggatctcgtcctcctcctcctcttcctcctcctcctcgcccgcgctgcagtagtgcggacggctgtggcggcggccgcggccccccgcgccgcgctcgccctcgccccgctccccattgttctcggcggcggcggcggcagcgctggcgctgccgcccgcgctggtgttacagtccccgctgccaggcattctcgccatattgccgtctctctgccagtcctcgggcagggcgcatgcgctatattggaccgcagcgctgagagcttttgtgtttaatgaccttcagctaccgggaggcaaagccgggctcttaaaggagccgcgctccaattgtcattcccgagcgcagctccggaggggcagcggcgcgcaggggatggaggggaggggggagggggggacaagttagaccggagagatagggtaaaggacggaggctgaccagaccttcttcctcccccacccggctcccacttctaagaaaactttgaaggaaaaaaaaaaggaaagggagggagagctgtcggtgggggcgaaacactcccaacttaccctctggcggagaattgcgcgggcccgggcgggagagagggagggccggcgagagggcgggacggtctcgtttctctaagtaatgcccgaggagcagtgccccttccactgccccctcattgccccccggagccggggggtcggggcggcggctgcgccgggcgggccgcgggtgctgccgcgggaaacccgtgtctggggccgcccggagcggagcggagcaggcaggttaatgagcagggtggaggaggcacggcgaggccccgcaccctctcggcgcccgcggccagggcgcagcgggcgaggcttgggagcgggatggggctggcggcggcggcggctcccccacctacttgctggcggcgaggcgcgggggcctggggccagccgcgcggctcccaactccctttccgactcttgcaaaggagcgaaacacgccccacgtcagccacatccctttcgacttttccaacagccacatttaagctgtcattaaagacctggggcgctccccgtaggtctggggcaagtccgcgccggtccagccagccccgggaaggagcgaggcagagaagactgggaggggccggtgggaggggagacgagggaagaggcgcttgggaccccaggggccacagggacccttccccacccgcccagggcgccgccctccctgcccctgagcaaagtgacacaactccctcgggcgaggcgctccaccaagctggagctgaagtctccctaaggcccatcgggcaggcggaaaaagcgaacttgtgtctcggccgaccctgccgcagccacaattcggcaattcggatccggagcgcactctcactcaaagtttgccaaccgccattcgttcgccctccgggctgcgctgcctcaggcgcgcgggggcgggcacctcggaaactggaaaagcagccaaagagctcgccgggtctcgctttcccataggagacactgccccacttccagccaaacgcccgcccccggcgcgcccaggctccgggcgcgtccttgcgtcgccgcctcccgctctcccggcccaggggcagcttcccagagccgccggggacctcggctgttctcttaggaggcacagcccaggccactctcggagctcgtgctgcatcctaactttcaccttctcccgcagcccgtgtgtaccctggcgcgcgggccagctgcgagtccctggggtgaggggacacgagggagtcaggtccccagcagtgcgccccggtgccaggccgtcctgctgggaggcagcctcgcctgctcctcgggtgcgtcctcgaatttacctccaagtccgaattctcggcagttaggctgtgagagttatgtcaactgcctgtttcccccttccctggccctcctgtcttgctctcaagggaagcattttacgcatcaattgaaacccatccatcaatttgcattttttttttttaagaaagaatgaaagaccaggtctcagggcagtgtgggcttctgagtgggagttgacgatgtctttttctgcagcgaacgctgctggtcctccgcgtgcctgcccggccctggacgccacccgagcttcggggaaaccgcgccaggtgtgaaacaagttagagcaagtccctgcctcgcgggccgcctccggctccttagggaaacacaagacacacagacacacacacacacacacacacacacacacacacacacaccacgctctcatccgcccggctctccgcggagaaccgtccgggaatcgtccccgaggtgcggcgcgggaggtggccggctttgttcacaatgcactgcccgccgcacccgccctggacacgtgcagaaaggcgtgctcgtttctccgaggctgcggtgagcagctaagttagttgcacactgggacccccacatacgagctggcacacactagtcacacacggctaattccagagggctggccctttgtcctgggacgctcccaggttttcgggccgcggtgcggagaactcaggtgggtgcccggcaagttacctaccaggggctgttcccccgcgaccctcgccataagcgcagggacccgggggccgcgctggctccgggctgcgctcctggcttggcaggggaccaggcccacgctgcagcctgggagcggagccgccccccaggtctccccacctctgcgggcggcggggtccacccccctcccaccagctcccctccctactgggcgagctgctttgaattgctcgcagtttgccggaggcggtgtgctgggttggacgctccg

SEQ ID NO: 5162 - DNA, 2762 bp, Homo sapiens
acgacccgggaggagagcgtggagccgggcagggacaggcgtgccgcaccatggcgcaccatggacagggctccgcgcggcggcggcccacgaccgtctaggggttgcgggagaaagcgcgagagactgcggaggccagccccgtccagcccctgcccccgccccagcagcactcaccccccggcgggccggagcgcgccaggccctgacccgtgaagaccacggagcggggtaatccacaccacctgtctccacccccggagcaggcacttccgagctgcgtccgcacttttcggggctgccagctggcagtagagcacctctccccttgccccgagggcgacaggcagggggaccctccgtggattttcctgccccgcggcgagggtgggcacgcccctttcccgcaaccttcgagggaccccacggcaggcggagaccgacttgggaccagggcactgcacccgcccagctagagggtcccggccgaggctgtgtgaagtggcctccaggcctgggctggctggtcgggaggagcctgggggcatcctcgggttggaggcggcggaaagttgggctgcccccgggctgggaacccgcagcgtgcagtggcgagggaacctgcgcccggactggagcaggtgcttcctgccgcggaggagcctcttagtagagattaaatgaaaaggctcgctggctctctcccgagggtatgaaaagtacggaaggctccaggcaaaggcgcccccggggcgcatatagggcacaggcagccggacagagaaaggagcagccgcgtaacggaacttctcgcccgggggagatactaggcgtgagaggccagactcgttctacaggcaggcgctgaccggcagagactcctccgggcaagagggccagattttctttccaggtgggacgaacacagaatattgtgagggcaagagaagaagaaaaggaggcaactccagactgggataaagacaataggacagtagagcccttgagcaccgggaggcgcacgggtgcagggtggggtaaggtggaggcaagtcccgtaactaagacaccagagtgagaattcctactgtaaactcgcgacccatccctgcagaaataaacaaaaaaattggagcaaagtactatgcgaggggcgaaaggcacagaaaactgcaaaacctgggagttatcctgcctcaccctcctgctgcctggggacaccccccgcgagcttgctcggccccgaagaaggagcagaggggacccgcaatccagcccctagagccccgccaggaaaggcgcgagagacctactggccccggcaaccctgccccggcgcccggacggagcccgatgcctgcgcagctaccggccgcgcggcgcggcgcggcgcggcgtggcacctcccttcccgggtgcgcagcccggccccgcagcggcgcggggaacaaagggacccggcgccgcccgccccaccccgcccgtggcccggcccgcggggaccgccgcgtacctgaagcagggccgccagcagcggcagcagggtccgcagcgctcccgctatccggcacatggaggcggagaggggccgagcgaagagccggaggaggcggcggcggcggcggcggcggcggaggaggaggaggcagcggcagcaccaacagcggcgcggagaaacggctccaggcagtttccacccccttcccttcccctcccctccccacccccttcttcgctgctctccgctccccgccaatggagagcgagctgatgacaaatagcgggccgcggagtccgcgggactcgcaccaggagtaataaaacagacccagagatcaaggagctggggagggggcgggggaacagggagggagagcgtgtgagcgtctgcgagtgtgtggaggcggctgctgtggcagcgcaggcggctcggctccggcccggagcgcagcggaagccgcgagggatgcagcggcggggaccttggccggtggaggatgtggaggtggaagtggagcggatggcgctccccaagagctccgccacgcgaggtttcgggctcgtggttttgcttcctccgggtccccgctccagggccgctcggcgcgacgaagacgccggggacagcgccgcggggagggcgctccgggtcgtgcgtgctgcacccacaaagagcagcagtcccgccactccgcgcctccgctgcgtgggggccgaggggcgcttctcggctcctctttccggtcccccggcgagttggagactgttctccggcctcggccgcaagggggtgaggcgaggggccggcgcggtctctcccgccgcggctccgtcccgcgcagctgctgccgcagccgcccctgctgcccgcgcaccggcacccgcccgccggtcctcgccctgcgccgctcactcgcgcgcgccgccctccgtcgccgaccgcgcaccccgctcggcctccgctgcgcgacctgggcgagccgccgccgctctccccgcgctcgccccacgcgctgcctggctgcgcggcccgctcccctctcctattcctcccgccgccgccgccgccctcgcccccgcctccctcctccgccgagcctccccgcccgcgtcgtggccaatcggaggccaccaagctgcggctgtagccggccggatccgcggcagccgcccgcccccgccccgccgaagcgccccgtattttgctgcagcccgcggggggtcgccggagggaagcctagagtgcgccgagcaccgccccg

SEQ ID NO: 5163 - DNA, 338 bp, Homo sapiens
ccgcgggagtcgcgcaggcgggcggccagggggagtgggcgccgcccggcagcgccccgcgccgaggcacaagcgcccgcgccgaggcacaagcgcccccgactcaccggctccgcgcgtttccccgcgcgtctcccggacccgcgcctgcccacccctccggctctgctgcggtcgaggccccaagtcggttatcccgtgtccaggcaaccgcgggggcggcggcggcggcgtgaggagcgggcggctgctgctccggggcctcctggctcgagcccttagcccccgactcccggcgtttcggcgcccgatcagcgctccaggccgcccccgctccg

SEQ ID NO: 5164 - DNA, 1435 bp, Homo sapiens
tcgcggcaacgatctctgggagtgatcgaggcattcgggctgccccgtgcctcccgggcagcgatctaacgataaaacctgacagtgtcctggggaaaaccccacatccaccgctagcgctacattcgggctttatgccaataaggagacactgtagactatcgatcagactcgtctgctctcagagcgtgcggccgggcttccagcctggcctttaggcgcggtggcggcggtgggacacgcgccaggcgcccagagaaggacatgggacaatggcccagcccgaggacgccagacgccgccgcccgacccggggaaggaagctcctgcagccggtccgggaacccgaggcggggagggaggccagctctggaggtgcgctgccgctttaaaataaaggaccacaaagactgtacagtggggaaaacgcgcctggctaatgcgagtggggacgacttggggagggggttgaggaaggtagggggcacacgagccaacggcggctcacggctccccctctctcccgcctctctccttcctccctccccgccgggctgctccggcagacaaataacagaggaaggcgagtcactcaccgtggtcttgacaggcacgtagagcacttgcttggcgccgccgcctcccccgcggacctcgtccggctggcccagctggaagcccttcgatttgacccagaatttaaatttggcgttgtccgtggagctcgactcggagccattgaggagctggacgatccgttcgtattttttacgggtcaccgtcttggtcttgcctgagtccccgtaagtcctgaggcaccagtcctggaactggcggtacatgtcgcgctcgctctccatgttccccgcgctcggccgctggccggatgctcccagcgcacttcgcacctgttcaccctaggctcatgaaaaatgcagccccggccacgttgcagggatgcgaggtcccggccgcagcgggagcctgctttgggtgggggaagggatgggaagaggggaggagggtccggttgggcaccagcaatcaatgccccgtgctaccaagtctggtccattcgtaattgcaacggctgtctcggacgtttttcctgttcccttagcggtcggtctctttaatattttgtgaccaggaccatcccaacaccattctggcccagaggagctgggttttcaataattaaaatcccattccttggtttattaaaaatcccaatattgaattggggtggtccctagacgcctcgcccccgggctgcgtccggggctgggcaggtggagcgcagcgccgcctccccgcgcgcgccccagaagcttccccagccactggccccgtggtccaggagtgagggctgcgcctctcccgaaagcagccgcccgcccagcgcctttgagccccgaagggcacacgggtcccg

SEQ ID NO: 5165 - DNA, 510 bp, Homo sapiens
ccgaggcgcgatagtttatcaaagacgagggctggctccttaaataaaccgcggtgatctcacttgcggcgccccctcccacgccggccccctcctcccccactagagcggcccgcgtcgactcgatgggcggactcgatcgcgcacgcggcccgcgggcccggcggaggcagctcccgctccggggacccgggacgcgccgctcccccgccccaggctgcccgcgcaggaacttcacggccacggccaagtggggcccctgtcccggatcccgttgggcccggacggccgagagcccagggatttgggggggcgcgcgggctcccgagctcaggcggggcggcgggcgccctgccgtcctctccccgcgcgccgcgccgccgcccggcctcccgaagtcgccccctgtcggcgcgtcggccgcttgcgccacggcgggcgccacttaccccgggcagagtcttctgctcgtgcagcgcgctctgggccttcagcgctgactcacgctcg

SEQ ID NO: 5166 - DNA, 2722 bp, Homo sapiens
acggcgatggacagcaccctcggtcctcggccggccaggagcccgcgagtccgtccgctcagcgtcctgggctcgaccggtgcagccttccccatccccatctttcaggtcgctgtacccaaaaatccaagccccgtctcctcgatcccctctctctttctcttcatcggcgcccgctgctctctccatggcatcgttcctatcagcacctcgcccaaaacccagtcttgccccagcgaacagctccccacgcaccccagctctggtctccgctgcccgagcgcctccctccaccgcgcccgcccgaggcttcctctcgcttagtccgccgctcgtcagtcgccggccggccggtcggcccgccagcccgctcctgctccccggcaaagttgggagggaaaggtgtactcacctttgtgcatgcctgtgaacctgtccttcagaaccgtaagctcgtagattttgccaaactcctcgaagaggggcttgaggtccttctcatccaggttgcgggggatctgcccaatgaacagcttgatggcatcgtggtccttcatgggaatggtcgacgggttccccgggctgtggcttaatccgttcatgtgcccggcactgcccgggctgctgccgagcccgttggtactgaggcttgcgttgtcagcctgtccgtttgctaacgtggccatctttatatacatagagaaaatcttctttccttttattctttctcgctcacactctctcgctcctctctctcgctcgctcgcgctcacacacgcacacgcatacacacactcgggttctctccccctcggtttctctacacctcgctctccgctcgctctctgctctctctctttctcctcttctctcgctcgctcgcgctcgcgctctctctctgctctcccccctctctctctccctccctccctctcctctctctctccctctctctctccctctctctctccctctctcctctctctctcggtctgatctgattttttttttctttttttcttttttttttttttttttttttttttacattgaacagacaggatctctgtcctttccgtttaaacaggctggaccggttcaagttcccagccagaccaggggtgggggtggcgagtgtgcgcgcgcggaggagggcgcggggggccgggaatgggcgcgctgtgggggcccgcgccacggcgggcggcggccgggggcagggcggcgtggggcggcggccaccgcgcctcccccgtcggcggccccgcgccgtggcgatggtacagtccgagacggcccccggctataaatagcgccaggcgcatggctcttcgggaggcgctgagattccgggcccggcggccgcggggagcgggtgtccgtgaggagccgggcagccggcctcctctctttgccttttgggggttctttttgtaatagcagcaggtgcaactttttgtattttaaaaatagtgatttttattttcgtgtgggtatgtaggggggctttatccaccaagctatgctctattagggcgccaggcgggcgaagcaaaggcagggatggcgggcggggcggcggcggaggtggaatgggcgcttttttcttccatctggctttatttatttatttagactagaaaagcgagccggcttggagggagtccgcccggggatccgagcgcgcattcatcagtgtcgagagaaaaaaagctacataaatatatattatgtggataaatctatagacaagagctctctcgcgcgcgctctctccctgtctctctgtgtgtgtctttctctgtttttttttcctcctcgcacccccaacctgccagagcagccccacatcttcctcccgcccggcatctaccgccacccaagccacctgccaggatggggctgggagctgtcgggccgcgccggggggcagagggacggggagtagagactcggggtccgacccccgccccaacccgcttccgaaggcggaaggtgggggtccccgtcccgggcggcctcccccgccccggagagcgcggctggtcccccggtggctggcgggaggaaggtaggagtcgggcgcccctgcccgctcgcccgccggagggggaggaaggcgctgggcgcggtggccggtgagccagcgcgggggatggcttgatttgccctcgtctgctttacgggttcaaatagaatatatttttttaatcaccatcaaaagaataaagcccctgaatcgctatctgggttgccgccggaccgagactcgcgcggcgtgcgctgcccccgcgggtttcgttttcggcacctacagctcccgaggtgcgaggctgagtcgttcctgccgtggggaccgggggtcgagccgcccggtccggaccccgccggactccccgccaggcccactggggctggcatctcggctgcgcgggaaagggagtggcaggcgcggagccgggagcagggtccgagcggccccgcctgtaggggtgaatactggtggtgaacttggctggggtagcagattttcacgttaatgatatttacctgcaccccgtcctctctcatgtttgctttttcagggcagcctcttcgcttcagaagcctggcaaattgaaataacgcgcccgctcccccgcgggctgcggggctggggagctggggcggcggggctgagcggctggcctaacccccgccggccctcggctagccactttcg

SEQ ID NO: 5167 - DNA, 1133 bp, Homo sapiens
acgacgcggtgcgccaggcagagagcctggggagtgtgcgtgtcttacctgtgtctgcatcgtgtgttccctctgtgtgtctctgagaatgcgttcttggcacgcgtcctgcgttaacaaggcgtttggtgtgtgcatgtctgtgtgacagtgcctgggtcctgtttgcggctgcttgttcgcattccagcttcccttgtgcccgcagtcaggctctacacgtgcgccagcctccgagcgcacgtccccgagtgacccgtgcgcggtgtgcagggacctcagggtcgtgtgcactaagggcgctcgtgcccgtctctctgcactaaggaacgcacctccacatgtctgagtgcacgtccctctccatgtgtgcacgttccgtgttcacgccgcccatgtctgtgcaggggcgcttcacgcgcgccctctccggcccgcgggcggccagggacccgcgctgggctccacgcttcccgtggggctgacccctccctcgcgccccgcagcgggccgcagcgattggccgccggcccccttccagccgtcacccctccctccctccgccacccgcgcgcccgcggtccccgctgtcccccgcggttccggcgaggccgcgccgcgctgcgctccgctcccattggctgcgcgcgcctttgtgtggcggcagctgcggccccagcgcctttgaatgtcgagaggggccgggaagggagcctttccatgggccatctgtctccccgccagccgccgccccaccgccgcccgcgccccgcgctccgcctcccgccccggcggctcccgcagccccgccgccgcccgcgcccgcgccccggagccgcgccacaaagggcccgcgcgcagccgccgccgccgccgccgcgcgaggagccaggatggtcctggtccacgtcggctatctcgtgcttccagtgtttggctctgtgcgaaacagaggtatcgctttttcctttcggggtctgcttcggagcgtggatcgccgcaggcaccggggcgggggcgggcgccgcgggcggccgggggctcagggcacacccgcgaggacgcagggcgagcggtggcttccccccaccccattttagggggacccccgagggtgggggcggccgccctcg

SEQ ID NO: 5168 - DNA, 2401 bp, Homo sapiens
tcgaaggtgtcgccagcctcagtgccggtgggcgtctgcaccaggaatagctaaagccgacgacatctagccacctcgagcgccagggaagacgctccgcgtaaaaccgcggcctcaggcggactcccgctccagctccgcgctgctggtggcatttccggggacccaaagtgggtggcctgggggcaaaggaacagaggccgaagaacttggggtatgttccactagagcacctaagggacggagtgggaggttacatcagatatgcgacctcgacacattccaaaagtggcagccccgtgggctacccccaatagtgggatggatctccccaacttctctcgcccctcgaagtccccctgttatctcgggccatgctcctcccccgggattcccttgtgcaaaattattctctcccttgcccaaaggatttttcccttctttctgaccccacgaactcatctccccaacaggttcctaaagtatgggcggatgtgctccctctcgcccaccgccaggagccgagccccggcaggtgagcggtgcaaaacacgcacccagctgcccccagcttcctccgtccccgctgagttggctgtccccaccccgcaccacggcacccgagcctgtgagtccccgaccccggccccagccgcagccgccaacaaccctacaataaacaagaggacaggattgagcgtccgcgtcccggagcgcactggctgggggcaactcctcacccccggcgcgccgcccgctgccccgatccgagagcaccgggagagccgagggaagggaaggcggcgaggggaaggcaggcggggatggagggaggcacggcgcggcgcggagcgaggaggtgggctgcaggggacgccgagaagcggtggggctggcgcagagggcgggcgcccggggcgcgcgttaccttcgtcttgcccccgcagtggcagcacacggtccacaggtacttgagcgtccgccagagcaagatgatgaagaggcccccgaagaaagtcaccatggaggaggccaggaaagcccaccacatgcgttggccccggctgtcgcacggcacctccatggtcaccgggatgatgagcgcatccatcttgggctcgtggaccgaggacgaggaggaagaggaggaggaagaagaagaagaggaagaggaggaggaggaggaggaggacgcgtctaggctgagatggttcgcgtggatattgctactcattctaagactgctgcctccgccgccgccgccgccgccgctgctgccgccgccgccgccgccaccatttgccatagctagcaacgggcagccggcgcaggggctcgggggagctcctcccgccgccagcgccaccccaaacacccatcaacagccatattgctgctactgctgccgccgccgccgccgccgcggagcgcgggaggggggcggggaggcgcctgggctcggggcgctgtgcgcgacctggcggggtgcgccgagatatatacagcgagccgccgccgcccgcccgggggggagggggatggagtgcgcgggcagctccccctccccggcccgcgccccgctcgccccgggctgcgctggccccgagcgccgagagccagggggcgccgcgggccgcccgcgcccggggtctgcgccgcccccgggcccgccccggctccgcgcgcggtcccgggtgtcctcggcgccgcgccgcccgccgtgcgccacgggtgtgcgctgcgctcggccggtgacccccttccccgagcgcctcccgcgcggctaacgagccgctctccgcttattaggtggtaactcgttaataatggataatcggccccctccgcccgggcgcccctgcgccagccctcctcccccggctgcgctcggctccggctcgccgcgccagtgcgcgcccggccgcggcaggttcaccgcgtccggccgccggcccgtggccgcctgctagcccatgttctcgggaccccctagtcctgtcgccacgccgctgagcccctcggcctccgctcgctcttcctccttgccgcctccgactcctcctcgtccccgtcctcgccgcccaagcctcttcggcgcgcgccccgcgctccccgcagccgccagcagcagcagctgcagcaactggagcgggcgcggactcaggacgacccaggcgggaggggaggaggctcgccgcgctggctcgcctgggctccgggctgggcaggggtgggcagggcccctcggcagcggcccggcaagcgcccctgacccccagggcgcaaggtagagcgcccccagcccaggcgcggggccaggcgcctctctccaaggtgctgcgcccccagccgagagcggtggggtacactgggaggacggcggggcgccccggtcaggccg

SEQ ID NO: 5169 - DNA, 769 bp, Homo sapiens
ccgggaacgaacgtgcgtggggcagttcaaattcctgagctcagatttcgtttcccgcggtcagatggtgcggtcggtggggcccgagggatgcgcacagctgtgcctgagaggtgctgctctcccgccaccgaagtcgctgggaaattctgctgcactgagacattttaatgtcggatgttctaatcctgcgggcaaaaaaaaaaaaaaagtttgaaccaggtactgggcttttgtcacggtgaaccccacccgcgccccgcgccgtcccttcattcactcaggcgaggtggcttggatttgcacctcgttgaagaagcctcccatgcgacatctccgccagcaccccgcgcggacttggctgggcggcggcggggagtcagcttgtcaccgcacggcggccgggaccgcagcccctgggtgcgcagtgcgcctctcgctgcgccctcctagagcgcgggtcccgtgcctgtgcccggcgcgacgcgatctccctgctagtcgggctccgcgtgctccccgcgcttcccgcagcctccgcgcagcccgcagcgccctccagccccgcctcgcggccgcgggaacccggcgcctgcagccccgcccggaaccgaccgccaggcgctgttgccgccggccacgcaacgcggggcctctgcctggcaccagccccaggtgccttgtctcgggtcgtgctgtcgcgcgacactggggacccaacaggccgccggctactcagctggccccgcagcttccctgcggctcagcg

SEQ ID NO: 5170 - DNA, 1169 bp, Homo sapiens
ccgtgctccctccgagtggacttggccccggctccaaacccagccgagggtcggctcgctcctggggacccgcggatgtcgcgagggggcgccgcgccactgaaggctgggacgggggcggtgcgcggggcggcgccggagtccgggatgccggctccagagacgccgcgctccgccccgaggaggccgccggccgggtaagcggagcccggagctcgcggagtctggaccgcaggtaaagttgagcgcgccgtggggccgggggtggggggtccgcggcgaaggagccggggccgcagtgggcggtggggcggggggcgcgggctcctgtctgatggttccgcgcgcagcttcttctccgggtgcgcggtgcgcgcgggcgcgggagggtcgaaggggaccttggaatccccctgttcgggccaagggggcgggggcggctcggggccgggcggggctggtgcctccccctcccgctcagcgcccagagtccgggagtcgaggggggcgtcgggccggaggcgctcgccggtctggccgcgccgcgcgcgtggatggaggtctcggccgcggatcgccccgtctattcgcgctggtcctgcgggagcccgggtgagccgaaggcgaggaaggggcgcgggtctcgggaaaacccgactctcccggcgcccgccccggttcggttgggggcgcacccggctcgcgcggagagcgggcggggtgtgggcgaatgctcggcgcgctgcgcctttcccggtcccccttctccccggagatgaacgccccactcccgctcggacacacggccgcacccctactctgcctcctccgaccagccggggcgcggcccgaattgggggagagaagacccagctcccgcagccgcgaattctgcaaacccggagcccatgcgccccgtcctccggcccggggagctcccagccttgcccgccgagcgcagcccgggtccggactgtggtcactggggacgagaagggtccctcctgcggggctcccgggttcggatggacggagggggcgtccggcaggtgaactgggcccgctccgcgtcccgaacgttcccctaaacccacaagtcccggagaccctggggcattctgcgatttcggagtgaccggtggagcccccgcccgcgcgcctggctcccg

SEQ ID NO: 5171 - DNA, 6036 bp, Homo sapiens
tcgcacagcctgaccatcgtgagcaacgcgtgcggcacgctctggaacctgtcggcccgcagcgcccgtgaccaggagctgctgtgggacctgggcgccgtgggcatgctgcgtaatctggtgcactccaagcacaagatgatcgccatgggcagcgccgccgccctgcgcaacctgctggcccatcggcccgccaagcaccaggcggccgccaccgccgtgtccccaggcagctgcgtgcccagcctgtacgtgcgcaagcagcgggcgctggaggccgagctggacgcacggcacctcgcgcaggcgctggagcacctggagaagcagggcccgccggcagccgaggccgccactaagaagccgctgccgcccctgcgacacctggacggcctggcccaagactatgcttccgattcgggctgctttgacgacgacgatgcaccgtcatccctggctgcggccgcggccaccggggagccagccagccctgccgcgctgtccctcttcctgggcagccccttcctgcaggggcaggcgctggctcgcaccccgcccacccgccgaggcggcaaggaggcagagaaggacaccagtggggaggcagccgtggcggccaaggccaaggccaagctggcgcttgcagtggcgcgcatcgaccagctggtggaggacatctccgccctgcacacctcgtccgacgatagcttcagcctcagctctggagacccgggacaggaggcgccacgggagggccgcgcccagtcctgctcgccatgccgcggcccggagggcgggcggcgagaggcaggaagccgggcgcacccgctgctgcggctcaaggcggcccacgccagcctctccaacgacagcctcaacagcggcagtgccagcgacgggtactgcccacgcgaacatatgctgccctgcccgctggccgcactggcttcgcgccgcgaggaccccaggtgtgggcagcctcggcccagccggcttgaccttgacctgcccggctgccaggccgagcccccggcccgcgaggccacctccgccgacgcccgcgtgcgcaccatcaagctgtcgcctacctatcagcacgtgccactgcttgagggtgcctcaagggcgggtgcagagcccctcgcggggcctggaatctctccaggggcccggaagcaggcctggctgccggcagaccacctgagcaaggttcccgagaagctggcggctgccccgctgtctgtggccagcaaggcactgcagaaactggcggcgcaagaggggccactctcgctgtcccgatgcagctccctttcctcgctgtcctcggccggccgcccaggccccagcgagggtggtgacctggatgacagtgactcctccctggaggggctggaggaggccggccccagcgaggctgagctggacagcacgtggcgggcgcccggggccacctcgctgcccgtagccattccggctccccggcgtaaccgaggccggggcctgggggtggaagacgccacgccgtccagctcgtcggagaactacgtgcaggagacaccgcttgtgctgagccgctgcagctctgtgagctcgctgggcagcttcgagagcccgtccatcgccagctccatccccagtgaaccttgcagcgggcagggcagcggcaccatcagccctagcgagctgcccgacagccccggacagaccatgcctcccagccggagcaagacgccaccgctggcgcccgcgccacagggtccccccgaggccacccagttcagcctgcagtgggagagctacgtgaagcgcttcctggacatcgccgactgccgggagcgctgccggctgccatctgagctggacgcaggcagcgtgcgctttaccgtggagaagccagacgagaacttctcgtgcgcctccagcctcagcgcgctggccttgcacgagcactacgtgcagcaggacgtggagctgcggctgctgccctcggcctgccccgagcgcggcgggggcgccgggggcgccggcctccactttgcagggcaccggcggcgggaggaggggccggcgcccacgggttctcgccctcgcggcgccgcggaccaggagctggaactgctgcgggagtgcctgggagccgccgtgcctgcccggctgcgcaaggtggcctccgcgctggtgccaggtcgccgcgcactccccgtgcccgtctacatgttggtgcccgccccggccccggcccaggaggacgactcctgcactgactccgcggagggcacgccggtcaacttctctagcgccgcctcgctcagcgacgagacgctgcagggaccccccagggaccagcccgggggaccagcgggcaggcaaagacccaccggccgccccacctctgccagacaggccatggggcaccggcacaaggcgggaggcgccggccgcagcgcggagcagtctcggggcgcgggcaagaacagagcagggctggagctgcccctgggccggcccccgagcgcccccgcagacaaggacggctcaaagcccggccggacccgcggggacggggcgctccagtcgctgtgcctcacgacgcccactgaggaggccgtgtactgcttctacggcaacgactcggacgaggagcccccggcggccgcgcccacgccaacccaccggcgcacatcggccatccctcgcgcttttacgcgggagcgtccgcagggccggaaggaggcccctgccccgtccaaggctgcaccagctgccccgccgcccgcccggacccagcccagcctcattgctgacgagaccccgccctgctactccctgagctcctccgccagctccctcagcgagcccgagccctcggagccgccggccgtccatccacgaggccgggagcccgcggtcaccaaggacccgggcccaggaggcggacgcgacagctcgcccagcccgcgggccgcggaggagcttctgcagcggtgcatcagctcggccctgcccaggcgccggccccccgtgtctggcctgcggcgccgcaagccccgagccacccggctggatgagcggcccgcagaggggtcccgggaacgcggcgaggaggcagcgggctcggaccgggcctccgacctggatagcgtggagtggcgcgccatccaggagggcgccaattcaattgtcacgtggctgcaccaggcagcagctgccacgcgggaggcctcgtccgagtccgactccatcctgtccttcgtatccgggctgtcagtgggatccaccctacagccccccaagcacaggaagggacgacaggcggagggagaaatgggcagtgcccggcggccagagaaaaggggcgcagcctcagtcaagaccagcgggagcccccgttcccctgcaggccccgagaagccacgtggcacacagaagaccacgcccggggtgccagctgtgctccggggacgaacagtgatctacgtccccagcccggcaccccgtgcccagcccaaagggacccccggcccccgcgccacaccgcggaaggtggcgcccccttgcctggcacagcccgcggctccagccaaagtcccgagccccgggcagcagcggtcgcggagcctacaccggcctgccaagacctcggagctggcgacgctgagccagccccccagaagcgccacaccgcccgcccgcctcgccaagaccccctcctccagctcctcccagacctcgcccgcctcccagcccctgcccagaaagcgccccccggtcacccaggctgctggggccctgcccggccccggagcctccccggtgcccaaaacgccggcgcgcacccttctggcgaagcagcacaagacgcagagatcgcccgtgcggatcccgttcatgcagaggccggcccggcgtgggccgccaccgctggctcgggcagtcccggagccgggccccaggggccgggcggggaccgaggcgggcccgggggcgcgcgggggccgcctgggcctggtgcgtgtggcctcagccctctccagcggcagcgagtcctccgaccgctcgggcttccggcgacagctaaccttcatcaaggagtcgccgggcttgcggcgccgccgctccgagctgtcctcggccgagtccgcggcctctgccccccagggcgcctcgccccgccgcggccggcccgcgctgcccgccgtcttcctctgctcctcgcgctgcgaagagctccgagcggcaccccggcagggcccggccccggcccggcagcggccccccgcggcccgacccagccctggcgagcgccctgcccggcgcaccacctccgagagcccgtcccgcctgcctgtgcgcgcgcccgccgcccggccggagactgtcaagcgctacgcgtcgctgccgcacatcagcgtggcccgcaggcccgacggcgccgtccccgcggcccctgcctcagccgacgccgcgcgccgcagcagcgacggggagccccggccgctccccagggtggccgcgccgggcacgacctggcggcgcatccgagatgaggacgtgccccacatcctgcgcagcacgcttcccgccacggccctgccactgcggggctccacgcccgaggacgccccggccgggcccccgccgcgcaagaccagcgacgccgtggtccagaccgaggaggtcgccgcccccaagaccaactccagcacgtccccgagcctggagaccagggagccccccggggcccccgccggcggccagctctccctcctcggcagcgacgtggacggtcccagcctcgccaaggctcccatctccgcacccttcgtgcacgagggcctgggggtcgccgtggggggcttccccgccagccggcacggctcccccagccgctcggcccgagtaccccccttcaactatgtgcccagccccatggtggtcgcagccaccaccgactcggccgcggagaaagccccggccactgcctccgccaccctcctggaatagtggcctaggccggccttctggaacgttctctcccggccctgcggcgcggtctggctgccccatgggcctgcgctgtagacgtcccccataggtcgccccagggcctctgcccacccgagccccaccactctcagaacccccgcccagcgcacggcgacctcgcgcctcaccggaagaccttgcctctgtgccgcggaggtccaggaggaaacggggcggccgctaggcctcaagtcccgaccgtggagcgctggcaagggcgtcctggcccagccctgagcgcgcggcccttcccctgtcggaagccgttgcttgaccccgggcgagggaggcggtagcctccgggtccgggtctgggtctgggtccgctgcttcgcagggacagcgctggggaggtgacggcgcccgccgcaggtggggcgaggctgggggagggcggcgccgcggcgggcctgccagctgggggcctttgcggcgcgcaggggcgaagcctgtaatcactgcagccgccggtaattcgctaatgagggctttgcagggattgttttcattctcagccccagctgtgggagtgcgggtgggggtgtggccgagccccggcaggaagccccgcccagacggtgttcagggaacccggagcccaagcgctccggcggagcccaaaagggtgggggtgggaggggcagaggccaacggatccccctgcctgtcgcaccccttggcgggagacgggaaggcagcgggctgcgtacgatgggaccctggtgcagacgccgggccggctgacatttggaccccatcccagaggagatgctggctaccagctggggcgaccccaagggtcgctggagtcagtatcggcccggcgcagccgcggcgggcgaggccaatggaaaggagactgaggggagtcccggcagtgagcccgaggccctgggacctggagcccgcgctggcctctccccagcggagcctgcacgttacggagaccatcacatgtgggcgtggtcagtgcccaggaccgcaccg

SEQ ID NO: 5172 - DNA, 3400 bp, Homo sapiens
gcgtagaaccagtggcgatgggaggaaggggaccggtagagcggggctgggtaagcctccatccagccgggctgagccctggtctccgcagagcctctgcccctcccgagacacccgctacctggtgttagcggtggaccgccctgcgggggcctggcgcggctccgggctggccttgaccctgcagccccgcggagagggtaggtccgcgtggagagggacggggagccgggtcgactgcccccgggcccccagcccctgagccagccgcgtgcccacccaccgcagactcccggctgagtaccgcccggctgcaggcactgctgttcggcgacgaccaccgctgcttcacacggatgaccccggccctgctcctgctgccgcggtccgagcccgcgccgctgcctgcgcacggccagctggacaccgtgcccttcccgccgcccaggtgcgcgcaggcaccgggacacggggcaggagcgggcgggggcggcgtggcctcgtggccgctctcaactcctccaattgcgggttccaggccatccgcggaactcgaggagtcgccacccagcgcagaccccttcctggagacgctcacgcgcctggtgcgggcgctgcgggtccccccggcccgggcctccgcgccgcgcctggccctggatccggacgcgctggccggcttcccgcagggcctagtcaacctgtcggaccccgcggcgctggagcgcctactcgacggcgaggagccgctgctgctgctgctgaggcccactgcggccaccaccggggatcctgcgcccctgcacgaccccacgtcggcgccgtgggccacggccctggcgcgccgcgtggctgctgaactgcaagcggcggctgccgagctgcgaagcctcccgggtctgcctccggccacagccccgctgctggcgcgcctgctcgcgctctgcccaggtggccccggcggcctcggcgatcccctgcgagcgctgctgctcctgaaggcgctgcagggcctgcgcgtggagtggcgcgggcgggatccgcgcgggccgggtcgggcacagcgcagcgcgggggccaccgccgccgacgggccgtgcgcgctgcgcgagctcagcgtagacctccgcgccgagcgctccgtactcatccccgagacctaccaggccaacaattgccagggcgtgtgcggctggcctcagtccgaccgcaacccgcgctacggcaaccacgtggtgctgctgctgaagatgcaggtccgtggggccgccctggcgcgcccaccctgctgcgtgcccaccgcctacgcgggcaagctgctcatcagcctgtcggaggagcgcatcagcgcgcaccacgtgcccaacatggtggccaccgagtgtggctgccggtgacccctgcgccgcgcggactcctgccccgagggtccggacgcgccccagctcgcgccccttcccatatttattcggaccccaagcatcgccccaataaagaccagcaagcaaccggctggggtgtccgtgcgtgttagggggcccgtgggacctcccttgccgtctctcctcgcgcacggcccgggtccgccctgtagcgctcgctgtctctcccctgcctgaagcgccccaccaccgtctttcaggccccggacttggtgccgggtccaggcgtaaaggagcaggtgactctgcggccgcagcactcgctttatttcgccagagtcgcggggcgtccagaaggggcccctggactccggcgcggggccggctcagtcccgccccttgcctgcgcggagcttctggcgactcccaggccgctgctcctcgtcgggacgcctcggggacacccaggcctgcttcttcctgggctcggcgtccctggagtcccgtgcccacggccggtggcccccttcgcgtgactcccagcgctggggtagggcttcccggggctccctggcggcccgtggcctctcctctttccgcggcctctctttcttaggtctctcctccttccgcggcttctccttccgcggcttcccctctctccgaggcctctccttgggtccccggtctgcgagggtcacacggtcctcccggacggcctctccggtggcctcgccgggctcctcttcgtcgttctctgcagcctcccgactcccgggaatcttgggtctgacctctgcctcggcccggggcgcaggcggcgctgatggaggcgcctgggcctcgaacttaggctgcaagacagagtggggtcctggggtaagcgcccaccttccccccggcccgggctccttctttccttggggatgaaggtcccaatgcccgcggtcagtggaaggaagctcttaccaggggcgacgatggctccctcggggctgagcttggcgggacccagggctcgggcacacgtgcttggagtgctgcctccccagggacggcgtctgcagcgacagggtcgggacccgagtcagctgggccgaggcacggtccacactgtccatccctccctcacccctagagcccccctccctggacagttggagtggggctcccccggtacggctgagactaaggatgcccccgagccgtgggaagggactccgggactccgctgccgcggcgccccttctccgaacctcgctctttcaattggtcattcttccccccgaccacgggctgtaggaggcccctagcaagggaggggtcgcaggagtgcccccggggggcgctcacgagctgagcggtccccagagagggcgcaggggaaaggcggcagaacgctacgaggcaggaggggttgcacaaggttcatccggaagccagaacctactcgcggcgaggggaatgggccccgcaaaaggtccacaccgggtgagaggggcgcgcaaggcccgtcacttaaggggagatgcacaaaccaactttgggggcgtgcaagacccagccctggagaggaggctcccagaccccaccctggcggcacagcgcctttccttggaggaataggcgcacaggtggaccccagcctcgccccacctctggggagcctgcgctcaccgcggcacagctggaaagccgagcccagcagcgccaccagcgaggcgagcaccaggcacttgttgagcgacaggtctccccagggcagctcctcgctcagggccgggggcggcggcggcggctgcaggggcggcgcggtctgcgccttcttgcgcgcggggacgctccgagggcctgcgggggcaagtgcgcgctgcgctgtggtcactggctctgtgccgcccccttccccgggcgcaggggacaagagacaggcctgtgccctgaacccggctctctctgcctgcctgtgcggccccgggcgcaggtgaacccagccccgggtgccccgcagctgcacg

SEQ ID NO: 5173 - DNA, 1143 bp, Homo sapiens
ccgaccgctagtggctgggaagtgggcggtgctggggggtgagtctcggcccctccaagatgcgcctcccatgaaatcctccagtcccacgtgtactcacacgcatacggatgcatgcacacgcacagaaacacacagggctcggacacagctgcgcgcagacaagcaaaggaccacgtccacgtggaaacaggtgtgcgcacacgtccccgcgcatccgcgcgcacaagcgctccacacctgggaacgtgcgcacctgtcccccgcccccggcacacacacagccgccccacactggaacacctgggcgccagcgccgggccactcgggcacgcagggcgctacgcagggccgcgcacacgcttttcggccacacgcgcacagccctccacgtggacgcgcgggtacacacgcccggggctcgtagccgcgcacacccgcacccaggaaaccccagccaccaccacgcggggtccgatcgcctctgagcaccctccgccccagccgcgcacccgctgcgcgcccgggacgcgcacactcgcgcacacaccggcccttcctgcgcacgtcccgggcccacccccgcctagagccctcggggtttccccccaccccggcctcggggtctctccacgtctccccgccgacgtgctcacctgctcagggggcgcccccgagccgcgccccgcgcccgcccccaggagggcctccgcgagccggctgcacaccccgaggcggtcccggctgcacaacttggagcgagttgctccgtttcctcattttgggggcgaagaagggtcggggagtgggggaaagcgggaggcgccgcggcctgggaggcccccgcgggtcctagcgccggccgcactgcggtctcctccgcgcgccgccgccgccgccggcccctccccgccccgcctccgcggcccccggcgcctcccgcgcgccccgggcggggtcccggggcgcacgcgggctccacgcctggccctgacctggccctgtcgggcgtgcaccccccacccaccctgggaagcggggttcttggagcgtggaacgggcgccgccagtgcgcgcggcggggaccgggggtgagggagagtgagctgcccgtccggggagataagcaaggcgccaagcccg

SEQ ID NO: 5174 - DNA, 220 bp, Homo sapiens
acgtgccggtgacgcttcgtggagctggcgagcctcgcctgtcccgcgactgagcttgcggtcgccccgattctctagtagaccctggcgtggggcacctgagatctccgccactgaaaaggcgctatagaaatgcaaggaattatgattttaataaaattgtctcatttaggagcgagcttctgcgctgcctctgtcgtcggagcccgggtttgccacg

SEQ ID NO: 5175 - DNA, 1860 bp, Homo sapiens
ccgcgatgtcagccacggcccgcggcggtcacggagccacttcagcacctcgcgatggacagtgacccccggcgtggcgcgagttccctgcggtccccacgcgggcctgggcggcgggtccctccacggctccgtccagacacccggaggcacctgccaaagctgcggaggtggacgaccgggcgtccaagcacgaactttctcgccgaggcacggctgccgggctccgtcctgagggtttggggcggcgaggaccgccggggaggagggcgcgcgagccggaggccagagccgggccgggcagggcgcgcccaggagcaggggagacggcgacccgggccgaggcgggacggggacacgttacctgcccgtggagcgcggggaaggggtgcgcggcggcggcggcggcggagtctggcgcagagggcagcggcagcagcgggagcaccggctcgctcggggccggccagccggggagaccggggagcagcggggccgcgggcggcggggccgaggcgagcagcaccgggggaaccacgacccccgcgctgagccggagcagcccggccgagcccggcaccatccagacccagggcggcggcggcggcggctctgcgtccatcggccagaggagaggctgccgccgccggggctgctgctgctgcagctgccgccgccgccgctggaacctggcgcccgcctgcatcctacatccccgcgctgacggcggcggcgggggcggcgggcgcccgagatgctgggccggcggcggcgcggctccggagcgaactcacttggctccgcggcgcggccgctcgctccgcccctgccccgcgcgggaagctcctcctcctcccgcccgcgccgccgccgcccccggacccggcccccgccccggtccccgcccgcccgcgcccctccccgccggaccccgccccgccctcgcgctccccggccctggccggggtctcctccccgctgcgcccctggacccgggcggccgcggaggacgtgggtgggagagggccgagggcgcgcccggctgggctcccgccgatgccggccccctggtggcctctggccctctgggacccagcgcaccgcgagggaggctccgggctccgcactcaagggcaagcggaagccgaggtggcggcgccggagccaggcatgtcccgctgcccagcgcggggctgagggcgcagacggggaccgcgcgagccgctctctacctggcctcctcggagtccagggcgcggagggtactgggctgcggatccggcgcaggcggccccggacgctgctaggcgcgggcggatttctgttgcacaaatgggccaaacaggttcgtaaggcccccgcgggtcccctggcccggaagttgagccgcgggtgcctggtctgaagttccgcgccccacagtggcccgcgggcctcggcggctcctgccctacgccctccaaggcaccaggcaggtggccccagggcctttgcccacgacaccccctgggtggggcaggaccacccctctgtgaattcgtcctggatgcccccaggcacagtctgtactcctccctcccccagcacacgcggcctctgacgctgcacgccgagcttcctgggacccaggacgaaccgggctccaaggaccctcgctccgcccggaccacacgcaggcagcgccggccgagccgagcctgggtccgcactggccacgcgcagccaccgccagacggcgctagccctcccccgctgtagaccctgcttcggaggccgccagcctcctccccatcccgggtccacagcttcagtgcagcccctggcgacgcgcgctgacagctgggcagagacttccgtgcg

SEQ ID NO: 5176 - DNA, 441 bp, Homo sapiens
gcggggccttaaacgttatccaatcggggacactgggcggggggccgtccaatcaggcccgcagctggagcagacagggcggcttccgggatttggcgcggcctttgtttctcgctgccgccgaagctccaattttcgtctgtctgctttgtgtcctctgcacgtagaagcccagcctgtgtggccctgcgacctgcgggtattgggagatccacagctaagacgccagggccccctggaagcctagaaatggtgagagtgccggtccgacatcccgagagagggaacggggctggttggaaccggtgggaagcggctgtggcgggacccaggcctccccgcagtcagcttcacaatctgcgcccagagttcttgcccagctcggcctcagtccccttcagccatacgatggcggccgcgctgacagccggggccccggcg

SEQ ID NO: 5177 - DNA, 5587 bp, Homo sapiens
gcggtgcctccgggaggctggtagccggggaagcaggcacgtgaatccaccgggctgccccaccccaacctgaggtcagagctgaggcgtaggggccggggtaggggcagaggtgccgaaacgcactagctggggactcccgggggaaggagataggagagacccaaggcgagccttaggactcgcccctatgactatgactacgcgctgcgtccgaaccacatgtccaccccgcatttgccttcggggaccagaccgcgctccctcagatggctggggagggagcagactccgggtgaaggctgggggaggtaccgggatgccgagtacgccagagcaggcgggggatgggttccggcttcctgccgcctcggcatctcgctttgcaccgggcaaagaaggggccacgaccggcgaagagcgcgtggagacacagggacccgcgatccaggggcaggaaccccgccccctcccggaaacctcccgggccctgagtcgtgcccggcgctccccaccccaccccacccccgccgcccctgccgtcactcacggccgctgcgggctggctagcgtgtgcgctctccgcgccgcaggcacctgctcgctgggcgctgtgcgctcacttctccctcgcgcactgcagactcccggcgctgccgccgccacccagcgtagtctccggctgggcacagcgttccgcccttctcgcggccccgggcgcccacccatccgtcatggcccaggcctgggccaaacagcggggcagctggttgcccaaactggggtaaggagttgagggctgggagctgcagagaggaccgagggacacacggggagcagggatgagcggccgtctcgagccgtgcagactgggaagaagccagggagagtttgggtgggaggactcccaacccaagcgggtgcggggcggggctgtactccaaccagaaagacggtggtccctccgagcgacccccgaggagagagggggagcgctctggggcgggggcggggcgggctgtggcaggagaggggagggcgggggcgatgcagcggtggaggcggcttggcgcccagccactgaccgccccctcccttcccctcccctccccctctccccgcctctctccggctccgggtccgccacgccggacccgctctccccgcgctgcgctgggtcggacgccaggtctgcgcgccgcggctgagcgcccactcgccctgcggaaagagccgcggaggaaccggcgggggcggctgcgggagccgaaggaggtggcaatcgggagcagaaccagaaggagacagggaggcagaagctcgcggctccgtggcacgcactccctcggccagggatgggtcccggcgcggcccagcccctgcccggcccgccgggcagagactgaaccgcggatccccaccgtcctgtggacgaccggacagagagaggcactgaccgatcgccagcagcctcccggtgggaccgcgtctcctgcacaccccgcgcagcgccccccgccggagccgcaccgggcaagccggcgagggagcggggctgattggcggccgccggcggccaggggagggggcgccgcgcggggccatggcaggctcggaggcgtcctagcccgagccggagccgatccgagcccacgcggccgccgcctctccgctcccgggcccccgccgccaccgcgccccccgcgggagatggaacagcggaaccggctcggtgccctcggatacctgccgcctctgctgctgcatgccctgctgctcttcgtggccgacggtgagcgcgggaactttgctgccgctgtggactcgggggggtctttgctggggccgccaccgagaagaagaagaaagagaacgaaccgggaagcttcgcggtctccagcaatcccgctgtgcagcctgggcccggaggggtagggagaggcgagcggcgaagggtcgccgcagcagcagcgccgcgcccgagtcgttcccagtcccgccggggccccggctgcggaaaggatgcctgcggggagcgggagtaggcgcgccccagccaggctctggcggtgcggccaggggcgggggagaagcacgagtcgcccctgccgccccgccccatccggagggaagcagtaggcagccgatggccggtccctgcctcggccctgcagccgcttccccgaactttgctagcccctccggccgtgcgccagggagcagctgcggggtggggggcacaaggccagccagccagagaccgactgcctcgctttaggttgccccaggcccccgacctacagctggtcacgcctctctctctctccccacccccagctgcattcacagaagtccccaaagatgtgacagtacgggagggagacgacatcgaaatgccctgcgcgttccgggccagcggagccacctcgtattcgctggagattcagtggtggtacctcaaggagccaccccgggagctgctgcacgagctggcgctcagcgtgccgggcgcccggagcaaggtaacccgccgcccacgcggtaccggcgcgcgcccggctcgcgcccggggcggcgaaggctaacccagggagggaagcagcgggcttcactcgcgcagggcgccgccctgtggcgcagcccatcttccaccttcgcatcccaaagcatcttcaaagtcagcagtggttacccccaaacctgtcaattattttgacagcatcgctgttcccaccacctcccagaactccattcacgcccagcccctaaagagccacacctcagcctggtcgcttgctcgtgctcgctggctgcggccctctgatgggtgctgggtagtgaaggaagcccccttggtcccatcaggctctccccgccctctgccactttgaggaccccagggctcccacggctgcgttccagaggccaccagaaaaccgagtaccggaaagccggcaggacctccagccctcaggggcacagaggggccacttctctgtggccgaaaacaggcccacgctgcctgtctgcctcaaaacccacactctcttacacactctagtgtgctcgcgtgcacacacacctacacacacacctacacctacacacacctacattctcccagggtcccacccagagttactcccactgagcctcccgctgggtgctgtccagacacagcggccctccctccagttcttcacggctcccagtgagctgggggaggattttgagccacgcggcagggcctaaggatgcccagagggaaggagaggggctttccttcccaccctggtgtccatccagtctccccagttcagccggcaggtgtgcaccagggcagccacccgttggtcaggcaccatgctagctccaaagcccgcttcctcctgggaaactcttggaaagccggacgtcctttgtgccctcaacccccatcccccgggcggtttcggtcctagcctgccggaggagggtgcccttgcctaaaggcggatccgagttcccctagccagaaggccgcgagcctcacgtctctctctccctctttgcattttaggtaacaaataaggatgcaactaaaatcagcgtaagtgtggagcccagcgcgggccgcgggagaccccttctggccgcctcgggtcccgcagctccctcccttagcaagccgcggcggccgcgcatgtggggccgcgcaagtagggcagcgatcgcagccttgcatcggtggctgctcggcgtgtccgggcgccatctgtcgccggttgcagggtcgggttctcttttgtgtaaatcaagggtccaaggcttgagtcccctaattcggctcggcgctgacctgtaaaactccccttggtcggactgcgcgcttagggcctctcgcgcctgccagcctccgctctgcgggcattcctcctagcaccgggagcgcgcggctgctcgccctcgccgcgaccgtggcgccagcttcccgccccctctgccccgccctgagcatctgctctgcgccctccgctgcaaccctttatcctccgcctggattgcgggtctgggtgcggggtgttgcaggcttgcaggggacggggtagggggtggttgtgccaggctgcgaggggcccgggtcatggggttgctaactctgggaggagatgcgcccaagcttcccacctggagcgtagaaaggcctggagatgacgaagcctcctcgtgggctcggttcagaggtgagggctccctgggtgtttgttgagagccgtagagcagtacttcccgaagtccccaccggggcgcaggggaggagcacttcgctggggggcttctggagatcccgcggaaaggcgggttggtagcaggtggccagggagccaggcagcagcctcagcgttgcttgccttcttaagaaagcacagtgttagctgtaaagggcggggtccggtgacagggtggctttccttaggaagcgattcgggcaggccctccgtgctccgggaggtgaggagggccggctggggcgggactgtcggttggagcgcgtcggggcgggaaagacgtggggaagttaaggaacaaggaatccagcctggggtttcctgaaggtgcaggagggaggaaggagaggtggactctgcccttctgaagcgccagctacgggaagacaagcagtgttggtttgtatgggcggggcagatgcaaggtgggcgtttggttaacgtgatggggacgtggggacacagtccaaagagctggctgcctggcgtccacgcagagttggaagccctatgccactgggtagacgcgggtgaaagggaagccggatcgtgatggtgggcaaaccaggatccgggaagtgttggggtgcgcggatgagggggcgcgacggccagggtggccagaagagtaggtttgggagctgcccagcccggcctctaaccctgctctcttgcagaccgtacgcgtccagggcaatgacatctcacaccggcttcggctgtctgccgtgcggctgcaggacgagggcgtgtacgagtgccgcgtgtcggactacagcgacgacgacacgcaggagcacaaggcccaggcgatgctgcgcgtgctctcgcgcttcgcgccgcccaacatgcaggccgccgaggccgtgtcccacatccagagcagcggcccgcgtcgccacggcccagccagcgccgccaacgccaacaacgcgggcgccgcgagccgtaccacctccgagcccggccgcggcgacaagagcccgccgcccgggagccctcccgccgccatcgatcccgcagtccccgaggccgcggcagcctcggcggcccacacgcccaccaccacagtcgcggcagctgctgctgcctcgtcagcgtcgccgccatcgggacaggcggtcctgctgcgccagaggcacggctcgggtaagggatcgcggagagggggcgcacgcgcggggatggcgcagggctagggctgcgccgggacgccccggggggctccggacccaggacccgccccctgggcgcatttgcatatgcatactccttcctagttaggtcgggagcgccccccccagggccttcttcccgcg

SEQ ID NO: 5178 - DNA, 3643 bp, Homo sapiens
acggggcgattctgaaaagaggctgatgaaaatcgagcccgccctgccccggctgggctgggaacagttcgcagggctctgccgagtgggcgagtgaggcgcgcgagcagggcgcccgtcccccctcagccccggaaaatgatcaagtcaatcgtgtgggcatgtttcattattcattgaacacaatcttttacaacgctccgtttacgtgcccgagtttgctcctgacgcccgcgtttcaatgtttaaggtaaggaaaacaaaggtgggggggggatcgcggggcgcggcgcggtgcggggggcgcggcgcgggggggcggcggcgggtgggggggcagcttcggcgtccgggaggtggcaaagtgagtttggactcttggcgcggcccccccgtcccctccccctccccatctcggcgaggcctgccgcccggttccttctcgccccatcgcgattaaaaaatacggtctaattaaatatccgtggctgtgacgttggcgagagaagctgtcagcgggtggggggtggggggaaagaagaggaaaaccgagccggcggctgcggccgggcatcgtatggcgctagagaacttcggcggcgagcgggacctgcgcctgggccgccgcctccccgcccgcggtcccgggaccgttactttgaaaaggagtcccgaggcctggcgcccggcgcgcgatcgggaccccgcgtccagctccggggacccggccggcgccccccacccgcgagcggcccgcgagccactctcaggccccgggaaactttcaagagggtctggggggtggggggagtaaaaaggggagggggtaggctggggccgcggaaacttctgctcaagtgactttccccattttctcctctgcctgggacgggggttcgccttgcgctctttctctggtccgcgctcactgcggggttccggcccctccgcccgtggagagagggtaatttgcaaccttttttttttttcaattaaagttagctgatgcttacaatgtgtcaaacttgcgggcgccgagagccgctgagatctgccattttgtgattgcatcggcctcctgtgccccgggagcctggccaggctgaggccggagagttggtttcagggctgaggtgccagggtccgaacccgcgaccccaggaaaggccgtggcgcctgcaagcgcaggcggcgcccgcagcacctgccccagccgggcctcggcctgggggcccagccgggggccaaagaggaaataaataaataaataagtaacaggttatggagggaaaagagccggccagtcccaggctggagaaatgaggccaatcagagcgaggaagtgcgggcgtgggggctctggaaggcagaggagaggcagggcttgcgcggcgtctgggaagagtgcaatctggggggacgcctcccgtccccccagcgcagatgcatgactggggtaggaatgatctttgctgataagcctttttctgtttgcttcaagacattatttttcgaagatgaattgaggaaaacagtcgtaggcgagactcggggtgtattttaggcaaaaaaaaaaaagttagggttgggggagagctttcctttgatgagtaggaaagtgtccagatctcgacgcgcccatctgttgcagttttgcaaataatttaaaatatagatatctccatatagacggatgtatgtgaagtggaggaaggtcgaaacgcggggaagttagggaaaaagaaagaaaaagggctgggcagagagagacctgtgttgctcactcttcactctgcggagtgaactccggcagggctttctttggggacaggtggaaagttaagtcccccccttttcacttctgtattgtgagtggttcctactgtgtgcctgttggagaacatgtccaccgttcccgagttaggtggaggattggaatgttggggggcggggagcgttggagttgaggacgcagtggccaggggctgggggccgagaaagagcagggcggggtctcagccccgcgtgcgggtggcagcggcggccgggttttgtttgccagatattgttatgtctaacgggtgcctcgccggagacgtgatttgtcagccgccttcgttttcactttagcagaaaatacggcagctgcgaggtgtcccggcctgcggggctcgggcacccggtgcgtcctgggggctgggtcgtgtgcgcgggtgggagccggcggccggcggggccggggcgaggggcgagcgggaggggcggagtgagcgagcgcgcggtacggccctccggttcctcctgcgccttctcccggcagccgccgccgccgccgccgccgctgtgcaatttagcagaaatccgacaggggccgcgtttgctgagcgcatccggcggccgggcagcccgagcgggccgccgggcctggtcggccggtgtagaggcgcggagggggccggcggaggggaccggcggggatgggcgcgggaagcacgcctgaccagagcacgcgccgttccccaaccctggtgtccccggcgagttgggcagccccgcgcgccctgaccttgacgccccagtctccagccagggcttaggtgaacttggggtggggtgtgcgtgcgtgcgtgtgtatgtgcgtgcgtgtgtgtgtgtggaaggggtggtgagactgggaacgcgctgttttctttcccagtttgatactagcaactggatttttactttaagaccggctttgctctctgctggggttgggagggggggcgatcttttcccatcactcacatctttgttcattgttcactgagtggaaggcaggcgacttaaagagacgaaagagaggaaaaaggggtgagagacggagagaggaaaaagaggggggcggccagaagagggaaggagaggcgtggggacagggcccccgcccccgccggggtcgggtttgatggtgaaatagtaaacccacgcacggagggtcgccaggaaagtggacattaccgctttaattaacttcgagatgctccggcggcgggacctggcgtagccgtgacgcgcccccataaatctgcccggcccggggctgctccgagaactcgtacagtagcggcgtcagatccatcccgcgcctcccagtccggagtccatttgcataattggattttttttttttgcctccttctttctccctgaaacttgtttgaaaacccaagtgaaaaccgcgacgatctgcacactcaaaagcaagtgccaagtaagtgccctgcggtggcctcggcgcgccccggggtgagcgcgcaaagccgggagcgaggtgccgcgagctgcgcgccgccccgggccggcctcgcgtgtgggcggctgggcggctgggcggcgggaggacggcctccgcgggctccgggactgcccggctggctgctcgcacaactttttttttttcccccgtctgctgacttttcgggccaggtgaagtgtttgggccacgcgtgtacctgtggcgagactcgggaggcgatcttggggggcgcgcggtcgcagttgggcatcttgcctgggtcgggggcgggcagtcggtcccagtggccgccgctgagggcagagctgcgagcgagcggggccggctgctggtcgcgccgcgccg

SEQ ID NO: 5179 - DNA, 808 bp, Homo sapiens
ccgggggagctgcgaggccacccccagccggcgcccgggcggattgcgagcccccgcgggtccggccgggggagcggagactggccccccgcccgggctggggcgcctgccgcccgcgagccggaagagcgccccattcacgagcaggcagccctggcagagggttaattgaggatcattgttgttggttccaggaggagcgaagcgcctggagatcgggcgcgcgggcgcggctctgggagcgggggaaggtgaggggaaatgggacatgatggcattaataatcgttaccaaagacggtgggagtaacaaaggaatgcgtctccgagacgccgcccagccccggggtgttttctggcgcggtcgcggtgcaggaacgcgagccccgccgccgagcctcccgccgcctgcgttcgttggcgcggcgcccggcggtagtgccaccccgaggccgagcgctgcccccgccggcccgcggctgccagccggccctgcccgcgcccgggccccgcgagcggccgcacttcaccttacggaggggagataatgagatcaattagaggcgccgtcaccgcgccggagacagctgccgccgcatagtaatcacccgcgggctgggtgcgcgggggctccccgctacctgcgcgcctgctgctcccaccacgcggcaccgacccgggcgcgcccccggcccctgtccgcagcccacagccacaccgcgcaccctacaccctccttgcgcctctgctggggagctcaccccctccactcgcacagtgcgctgcggcccggggtgtgggaggtcccg

SEQ ID NO: 5180 - DNA, 3415 bp, Homo sapiens
ccgaggggaccggctcgctcactcgttcgcgctccctggctcggcggacaccaggcagtcccccggcggtcggccgctcggaggacgcggaagatgtcccggggaactcaggtgaccccgcccgccacccacagaaagagccaggccggggttgcttcccattccctctgcagccggagagctgaggaggtagggacctggcgcggctcagcgcgctccgcgagcggctccccaaatgggtgcgagagggaagagggcagagcgcggcggggcgtccggggggcgcccggtacccgaggcgggcgcacgcacccaaacaggagagcggcgcccggagttactcagtgcgggcagaagagcggggcgaggagcggggtcgcgcccgctggaggcgcggggcgagcggaggaagaggaggaggagagcagaaggaaggggaagcggctcgtacctgctgcgcgccggggcgcctgctgcttcctcctcggcatgatgcttctccggcgactgccactgccgccgccgccgccgctgccgggctgaggacagggagggagggggcggcgggcccgcgggggggcgaggcgggcctgctctcagcctcccccccggagagcggccgcccgcaggatgctgctgcgcccaggctctccgcgtcccccccgcgccgcgctccgccgcgaaccccgaacgtgcggagggaagaaggagggcgggcgagggaggctcggggagggaggagcacgggggggaggaggaggcagaggaggaggaggtggaggaggaggaggaggaccgcgctgccggcggaatgggaagtttgacaaatcgctccagaggccagaggaggagggggcggggaggagcggcggccctgcccccccccgccccgtccccagacgaggtgcgcggggttcggggctggggggcggggagagggcgggcagagcggtgggaggaggagcgcgggagcggcccggaccggtactgccccggcccccgcccctaggccgggggtcacggcatccggggggacgcgcagccgccgccgcggcccggggctcggcggtccagtcttctgcccgtggcgcggctggagcggcggcgtcggcaacaggcaagcttaaaggaaaaggagatgatcgtgtcaatcgcccgcccgcgggggcgccgcgcccccgcccccggccccaggcccgcgtgggacccccgccccgccagcgaaaggggtgccgcccctccgcctccgccccgtgcgcacacgcgggggcgcggcgccagccccgccgagcccgtcccggggcgctcgttaccccccacccctattcccacccagcgttcgtccccagccaccccccagctgccccacccggctcgcactcctctccacccgccgactccggagcccccagcgtggtccccgggccggggctggcgtcccccggggaagccagagcccacgggcaggccccctccagggaggaggcgggcgcgggccggggcgggtgggggcagccctcagaccccgcgccacccagctcctcccccaggacccgccgtagccacttcccccaattttttttccccggacaaactttcctgggcccgtcccgggggtcggtgtgggagggggttccttcaagtttcctctcctgactttgggatgatcagggtccctccaccccgcccctcgcccccgggagccgggccgcgccccccatccacggcgcgggccgatcctagggcgggacgggggcgggagaaggaaaccgggctcccctgcccatcccccgccaggggctccccccgagagcctagggggccgccgcgccgtgtcccgcgcccggcctgccggggctgctggactagagggattgattattgattggtgatcggggtcgctgaggctccgggccggcccggccgactggccgcggcaagaaggagctggctgggcggcgtgggcggcggggcgacgcgggctcacttacgggcggcggtgagggcgcgggtgggccggagctcatgcgggcgacccccgggcggcggcggctgagcgggagccggagcccgagcggcgcgggcggcggcgcatcgatgcgctgcgggctcgattgcgtctccctgggccagctctcaggccgggaatggggcggccgcgccggggccggctccgggcgctgccgggcggcggctgctggagcgcgggggcggcctccgggcccactatccccgaggcggccctgcgcccgggcgcgccggctggggctctggcgctctcgcaggccccgaggccgacagtcccggcgagggcgggcgccccgcgctccagcaccggctgcctgagcgctcctggagcagcaaaccccagacttcttcctccttctctccttccttccttccccctccccttatctttttctttttttagtctctttctccctctttttctgccctgtgtcctttttattttttctctacgactgtttttgcaagtttgtttcaaaagttcacagcatgctttcttttcttttagaccgggagacagtgatctcacccacacggtaagatcaaaagtctccgctcgcccagcctgcgggcttgggctgggtccagacgtctcccaggatgcagatgcgccgccgctggcctccccggctataaagccgcctccagcgcctttccgcgcgcaggagcgctcggagttgtggggtacggaccccaggcggggcagggagtccgaggcgggctgcggcggggctctcgggctggcggactcgggggctgaggcgccgtgcgcgttgggtgcccgcggccgcagaggccagaaccgctactcctccaggccggggagacgcggccgtggagcgtgaaacgcttcttgcaagcgaggaaacggtgagttggccgacaccgccggcggcctcaccattctggtggccgcgctgagctcctgtcgcctggaggcgggttgcgccgcacggggtcagctcccgccggctcccagctcaccttcgaagctcccacttaggcgcgcccggtgcggcgtgtgcacagcgcggggcgccgcacacggaagcgtgtagttctccctggtcgcgcttttctcctcctttccatcccctcgctgttcttgcaaacctctgttccttcggccccctcccactgcgggccgcggcctgaactcgggtctccgcgtagccggccgccgccgctgggtcgctgcctggccctcccccgctcaggcgccgagcgctgtgcgatccgccctaacatctgtccgtccaaccattggcgcatccatcagtgtcaatgggctgcacattgcagcgacagcccgccacgcacaacacgggctatgcggagtgcacgcagcaaccatactgccatgtcgggacacgcaaaaaggcccccg

SEQ ID NO: 5181 - DNA, 3415 bp, Homo sapiens; identical to SEQ ID NO: 5180

SEQ ID NO: 5182 - DNA, 1592 bp, Homo sapiens
gcgaagcgacccagcgcgaggaccagtccccaaccaacccgctcctagttctgggcgccttccccagcagtcagatgggggcttcagaggccggtgcgcggccacatggccccgggccaggcagggggtcgtggggacgcatctgcgctaggcgcacagtattcctgggcgcgggacgggcgaagcgccgtgggttccaagctgagctgggtcggccctgcagcgccggagagcaaggcggcgcagggaagggagatggggcgggatgtggggaaagctgtcgactgcttggatctctccggcccggatggcgccagctgcctccagctcagcctgcggaaatccgagctcttcccagcggcccgacggcccgggcgccccgcagaccctgggctctccccgcggtgcctccgccgcccgcccctgcgtcctggcccggcctccacgcccctccgaggtcccggcgcagcgcggccgccgccactccccccacattccagaggccgcagcgccgtctccttcctcgcattcctgcccccgcaaaggagtccctccgccccgcgcgaggccgcggcgaggagggggcgcggcccggcgcctgggagcttacattcctccgccgcgcgcgccgccgagcagggcgccgcgtcccccggcccgcgcgtggccgccggaacgaccccggcccggcgccggccccgccccgccccgcgcccaggggtcccggggcgggctccgggcttcgggcggacgatgcggcggcccggccggagcggcggcgggaagcggaggcggaggtgacgcgccagggccggcgggccgggccatgcagcgctccagggcgggcgcggacgaggcggccctactcctggccgggctggccctgcgggagctggagcccgggtgcggctctcccggtcgggggcggcgggggccgcggcctgggcctggagacgaggcggcgcccgcgctgggccgcagagggaagggcagcggcggccccgaggccggggcggacggactgagccgcggggagcggggtccccggcgcgcggcggttccggagctcagcgcgcagcctgcgggcagcccacgggccagcctggcggggtccgacggcggcggcggtggcggcagcgcccgatccagcggcatcagcctgggctacgaccagcgccacggcagcccgcgctccggtcgctcggacccgcgtcccggtcccgggccgccttcggtgggcagcgcccgctccagcgtttccagcctcggctcccggggctcggccggcgcctacgctgacttcctcccgcccggcgcctgccccgcgcccgctcgctccccggagcctgcggggccggctcccttcccgctgcctgcactcccgctgccccctggccgggagggcggcccaagcgcggccgagcggcggctggaggcgctcacccgggagctggagcgggcgctcgaggcgcgcacggcgcgggactacttcggtgagctcgctcggcccggcagttccctgcgcgcatggctggggtccggggttccgagactgcctcgggtaggcggccggatcagcggaggagagcacg

SEQ ID NO: 5183 - DNA, 903 bp, Homo sapiens
gcgatcccagaactcgttccccaccccgagcccgtttcccgccgcctcctcgcccctgggagggcggccccattaaccctcgcgacccgggccgctcctggcggtcctgaccccgccaccccgtcccgcggcgggggtttgggggtgaggggcgcgccctggggcagaggattgcgcggcagggtctgccacagggcagaggccagggctctccgggaaaaaggcaggcgcatatatgcccccctttctgggaaaagacggggaggggggcttctcctgggagactccaggcttcgaaattcctcgttccctatcctccggcccccgcacccctcctcctccccgccacgcaccctctcccctccccagccatctgttccactccgcagcgccgcgacaaacacggctccagctcgcttccgcccctgcccagccccctccccaagccccggggagtgggggagtgagcagacgcccttctcctaggaggccggaatttctgcctccatctcccaccggggtccggctggccagaggcaagcttcgagaccccccaccaaccaccaccaccgttgcgagggccggtgaggctgcagataacgcttgcaaggacgggagtcggggagggtgtagggcgagtttaaaggacgggcagagcaagccccgggaagaggcaggggttttccctcccgggtcgccgccccccgcaccctcggagccagccgcagccacgcagcgccgcctgccgggcacaccaaggacctggcgcgcacgtggcgcttacccccacccccgggtccgctcctggctcgcgctcagcctccccagactattcgcaaattgaggatcccggacacagagtgcagagaccccggcaagcctactgaaagccagccgaacccg

SEQ ID NO: 5184 - DNA, 1592 bp, Homo sapiens; identical to SEQ ID NO: 5182

SEQ ID NO: 5185 - DNA, 382 bp, Homo sapiens
acggactgttcgcctagtaacatctgatcacgtttcccattggtcaccgtttccggaagcccgctctcccgtttccggaatccccgcaggcgctgggtctgcagatggcgtccaggtacacagtggcgagtgtgattccgcagtcttgggctgtttggccaagcgcccgccggacatggtacgccgaagggtcatcggcgtggagtcctcgctttcagcgtccgcggctgggaaatcggccatcgctacggcgggaactgggactcgggctgcgtcccggcccttccacatcggtccaccgcactcgtgggcgcccgcattggtgctgacataatttcctgacctctgacccgtattgtctcgcgattaaaggtaaaaaacg

SEQ ID NO: 5186 - DNA, 665 bp, Homo sapiens
gcgcctccacgaaatccgcttacggacacgatcccggggccacactcagccagacgaatgtctggcaaatgacagtcacttcacgccagactctcacagtccttcacacgccactcccactgcctcagggaaccacaagcacaggcatcgccccgcccggcgtcctcctccaaagattggggcaccaggaccgcgggcccccactcccacccagcacaaagagtccggcgctcagagctagcggtttcccgaggactcaccaccaagcccgcggacacaggccccgattccacacttaacgctgccaaagtggcagagccggcgcgggctgggacagaggcggcactgaggccggcgctgtcggtggctgagagcgccacaagtctcggtccgttacaccaggggcgacgcttcccagaggcccccgcggctcacccgggcgggactggcttcactgtttgcgcgtcctgagaagcagaccacggtgttccagggctcacagctccgcgcaggggagctcagcctaggttttgcacgagcggcctcccgcgagcccagctctgagagattgggagcgcaacttggtgctgagaagaatcgaatcgttccgctgcttcctgcgccgaactacatttcccagaggccttcgcggccctacttccccg

SEQ ID NO: 5187 - DNA, 764 bp, Homo sapiens
acgcgccactagcgcgttcccacgcacaaaccttttccctgcggccaacctgcgattctcaactccccgccctggttgctaagggaggcgcgcagagcgcttgtgcctgcgcacttccacaccagcccgtgtagtgtgacgctgggccccgtccctgtgaccgggccaggctcggagctgcagggaatccggactttcgggctctctggaaggccggggagaggccagtgtgggaggacctggtggggaggaggccgtgttacaaaccctgcgcggagctgcaccgctgctgccagacactgcgacgccgcgaccttttctactccggactacgtttcccagcggaccccgcgggagttgggccggcggcccctttgtgtcctccgggggcggaggcagctgaggcgcttctttccgggcccgtaagggctgggttccatccaactaagggtagcggtgagacccgagtgcagattccccgagccttcggggcaggaaggagatcttccaccagttctgttctgcaggtcgggagtgggctgaggagtggcgtgtgggtctccggaagctcgtcgcaggccatctgtgtgactccggtgcgagtggaggttggtaccgttcagtgcgaggctgtcaccccgtgtgcctgtccacgtcctgtgtgactgggtgcgaggaagtcaatggcaccgtggaatgtgaggctgtgagttgaggcgggagcgggcgactgttcgctgcaccttgttgggccgatacccgcg

SEQ ID NO: 5188 - DNA, 1394 bp, Homo sapiens
ccgcgtctgggttcgcagctccgggtacgctgtagttccgcacccggttgcccacgcccgggaccacccactgtgtcttttcggaactgtccagcgtgtcctcctagaccccagacacccaccccaaatctaggtcccagcgttttgcaggggaccttcatcctggggcgttcacctctgacttccctcttgggccttttcgctacggccgagcctaagtggctgaagcgcggacgaggatgcgcggggcctcggtctccaactgcaccacaggccgcacccacgaacctggtccggcacagttactaccgcccgggcctccaggcctcagggctgcagaagctcagtcccgggaaaaaaagcacaccggcctgaggctccacaggaaccttttctccaccttggcccggcctgcaaaacctggcccactccgcgctcttttccctcagaaaagcagcggccacagtggcgcccggctcccagccccagcctcacccgactcagaggatagcccagccctgggagtcagcggcgccagaatacgggagagcgcctgtctccgtcgcgaatgcgctagcgcgcgggggggcggaggcaagtcccgcagctgctccgggccgggaggggcgcgtggggccgggtctcggcggggatagtcgggccggggagacggagccagaggggccgcagtgtccctcgcctcaggcctctacctgtaatggccgccccgtgactgaccagtgccattaaagataatccaggcctgctcccctgtggacactgcggtccaaaatttaaaaaaacaatattccgcctttttatttttcatttggttctcggctcggagacaggcggaggctgcgagccccgccccgcccccagcgacgcctcaccggaacctttggaaatcggcttctgcctcgagtgcgcaagcgcgcggggggcgaacgctggggcccttcagggagcaagggagaagtgtggggccgcacctgccgaggggtcgggaggtttggaggagggtggaggttggctacaggatcccgatggggatggagtgttcaaatctaggcctgtagccgtgaccctggcgtgagttggatggaggaaaccccagtatcgcgagcctggaccaaggcgcggcgcgtgctgcctgtggtgtttgctgagtgacggccgccgcgcccccgcgtacctggaccgagtgcctggccgctggcggagtagtgtttccgtgcacggggctgctgcgtgcgcgtgtgccgttctctagcgggggattaggatggtgccgcagagaaggctgcgcggtggtgcctgactctgacgctggctgtagcgggtctctggggtctttgcggtttgtgtctgcgtttgtgacgtacctgacatcg

SEQ ID NO: 5189 - DNA, 949 bp, Homo sapiens
acgtcgtgtttcgttactttaaaaaagaaaagtcacttccgtcaggcccccctttctcctcaccctcgtgtgtgcttcgaggccgagatgcagagagcaagaaaaaggagcgaaggggatccctgcgcgtcccaagcacccaccagcgcctacggtgtgagatgaaggcgcaccccctgggcgcgaagcttttaaagcacctgcccagggagacatttttgaagttgtcagggcccctcctctgtcccctcccagacccgggtcctgcacaaatcctggagggttagcgggcgaggcggccaccgcagcggccgccaacgagcagctgcacggaggtgcagaagaaggaggccactgccattctcctgacaagctgggggcgtgggaggcctcgggagctcgaagtcgcctcgagcgggggtgggcggtgagcggacccccgggtgttgaccaggtgtttggtggtagagcagggaaggggggaacggacgtcgaccctagggatccctcacccgctcacgctccttggcgttggccacacgccgccgctccagcaccaactggaggttttcagtggacgagtagccgcccgagggcagccgcttgagccggcagacagcggccagctggggcagcggcccgaactgctcccgcaacacgtcctccagcacctcggcttgcggggtgcccaggagcgcgggcggcgcggcgcggggatctaggacgccgggcgcggggtccatggcagggccgaggccgctgaggccgggctttcacctgcgcacccggggccgcacgaggcccgggcgggggcggggcgggggcgggagctggaccacctgcaaccattccccggctgcgtattccaatcccggcctcctctctggaggctgcgtccaggcatcgcgttgaataagccgcacaggtgtgactcgggagcgctggagcg

SEQ ID NO: 5190 - DNA, 1365 bp, Homo sapiens
ccgcgcggtcctaggtgaatctggccgaggcttctgcgtcaaggacggcgcgggtcagctgaggccaagaccgcaggcactgccctaccgctctccagatcacagctccgcctctgcaaggccccggggaaacgggcatcccttcttcagtgagcaaaggagaaagacggagcccggtggctgggtgtttcgcccaggatcaccagcgagctcagagtcctccccacgaccgccccagggtgggcatttttaaaagcggaggaagggagggaacacactctttggtgctgtgcccaccttgcctcgcacagagcgggcgctcacaggctttgggggccccgcccggaccgcagtggggagaggccgccccatgccccgccccgccaaatttaagagccttcgccgagcgccaggaggttcccagacaaccggtcttgctcgctgccttttgcagaatcttctcacttctcccgagctcccttccttgcgtccgtccgggcaacggccgcgtcatgcctagccccaggccgcgaggcagcccgccacccgctccctcgggctctcgggtccgacctccgcgctctggccgctctccggcgcccaggtcccctactggcccgaacacgccccgcgctcccggacgcttcgagtcccctttctcggtcgaggccatcctggcgaggcccgacccctgcgcgccggcggcctcccagccgtcgggctccgcctgcgtccacccggccttctggaccgctgcttccctgtgcgccaccgggggtctgccctgggcttgcccgacatcgtggctgcccgcctacctgagcgtaggtttttaccctgtgccagggccgcgcgtggctcccgtctgcggcctgctgggcttcggcgtcacaggtactgcggtcccggcgcccgcacgcgggggactgggcgggggctggagagcctaggtcgccactgccggcgccccagtgcaggagagggcactgagtgtgagaatcacacacggctggagtgggaaggggctctgccaccgtttaccttgcagttgaagccgaggaccgcgacagtcttgctgaaaaagaccccggcgcgaggcttcccccgcacgctgctgaggtgggagagggtgggtgtgagggcggcgcagcgcctgaatgcggtgggcaggaggccagcgctggggctgcaaggggacccagccctgctcccggtctccgcgtcccttgactccctcgcacaccccggggtagcgcttagtgacagagacgcttcccaaagcggctctcgacccgaaccaatggccctgttttttttttttacggggtagggggaagtggacgctccgggcggtgctgttgagcg

SEQ ID NO: 5191 - DNA, 2638 bp, Homo sapiens
ccgggggtcgcgttggaaccccacaggaaaaaggcgcggaaagccgccgggcattttccggggttccatagatgtccccagtgtcctagtccgtgcatcagctcgcgcactcggagggactctaggcagggggagggccccgcggccagtatgtgcgtccgaggctttcccgcagggggcagtgccgcccgcccgcgcgccgatacggtgggagggggtgggaacctgcgcggagttctggaggttctttgggagaaagttaggggatgcggaggggtgggcgcaagacttccaggactccagggaggccgtggggagggccgccgagggtgcagtgtgaggcgcaggagggggttgggggcggtgcacgttgcagggagacgcagcccctggaagatgcgagtgtgaacgtgtgagtgtgagtgcgtgtgtatgtgtgtgtgtgcgcgcgcaccgcagctctccgggttccgcgaggcgcgcgggtgtcagcttgcagccggggctcctccctccggcccccctgcccagcccggcggtccctcctccctccctccccgctcgcccctccccggcgggccaggggctgggacgccccggcggagcaggcggcggcggtggcgagttggggagccctaggctcggcgctgccggaggggcccgagccgagccgcctgcgccccggccgggcagcgccgggcccgcttcccgcggggccacgccctgtcaaactttgttgcggcggctagcgcagcgggcccgcaagcgggcgggaggggcgccgggccgggccgggcagggcgcgggcggctaggggctccgagagcggcggccccggcccgcggccccaccatgccccagctcggcggcgggggcggcggcggcggcggcggcagcgggggaggcggcggctccagcgccggggcggccggcggaggggacgacctcggggcgaacgacgagctgatccccttccaggacgaggggggcgaggagcaggagccgagcagcgatagcgcctcggcgcagcgggacctagacgaggtcaagtcgtccctggtcaacgagtcggagaaccagagcagcagctcggactcggaggtaaggaagcaccgcggccacccccgggggatcccggccctgcgtccgctcacccgctcttgcctttgtgtctcctccgcaggcggagaggcgcccgcagcccgtccgggacactttccagaagccgcgggactatttcgccgaaggtatgtgcccgctgggacagccccccactctcgattcccgctgcgctccgctgctcagcccgggcggcccaccgtcccccttgcttgggtggacgcacccttgccctccgcctttattggcggcagcccccgtggggcgcgcgtggggggcgctggggtccccagctcccgcctcgagccccctgccgcggcgctgtcagtcccgggggcctgggcctcacctcgccttggtcttgttcgcagtgagaaggcctcaggacagcgcgttctttaaaggacccccgtaccctgggtaccccttcctgatgatcccggacctgagcagcccgtacctctccaacggacccctgtctcccggaggagcgcgcaccgtgagtgcccgtcgggcgcgccggggagggtgggaggccgcggcccgcaggatgcgcccccgggcttggccatggagtgggggatggggccttctgcgccgatcccaagcagaacttgtttgcggagttgaactactctctggcggccgagcgcgaggctgcgctggccagtgcctggatgaaagtaaagttactttaacttttcccctcttgcgggttgaggttttggagtccacctctgggatcttccttggcctccagaattcttcgcctgcaccgaaggaaacttggatttgtgcccgctttgggggggtctcgctttccttcttggaaatcggtcagctttctctggcagtggggcaaggggcctagggagctgggttggcgacgttgtcctccgactccgggttcactgggcggctgcaggctggttcctaagaaacccagttttcgtggcgggttattcacagcccccgttcccacccccagccctcgcaccggggcctcagcttttctgcggagctagctccgaattttaaactcgcgtagatgatttcgaggcgacccaaggcattcttcaagttgaggaacttggctttttcccccttttgtcgcctgcttttctcatttaaagcgagcgctgcgacactttaaacctgttaatgggcgcgtattgtgtgctgcccgctggcatttagagcggtgattaagcaaattgaccgggccccagacgacgtgcaaatgagggcggattccttcgccccctctctctggctctaaactcccgccccccgcgttgcgaggggcgcagctgggggctggcgaggcctttgtgtcccccaagccgccactccacccctaggctccctgcccaggtgctgggtccgatgacagatgttgggtgaacgcctacctactgtgtgccaggttcccgcgtgctgctgcttgggcgcgatgtgaatcgtagtagttctttgcttcccgcccagattcccattgcctgccacttcgctgtcgacg

SEQ ID NO: 5192 - DNA, 1531 bp, Homo sapiens
ccgcacaccgacccctgcgccggcccttgcgacccgcgtccgccctccccggctgggaagcacctgccagcggccctcacctgggtcgtcctcgtcgcggggcaccttcttgaagcagtcgttgagcgacaggttgtggcggatggagttctgccagccggccttgctgcgctggtagaaggggaagctatcggcgacgaactggtagatgtggctgagagtgagtttgcgctcgggcgcgctctgaatggccatggcgatgagcgccgaatacgagtagggcggccgcaccatcttcatcaggtcctcgcggctggccatggacagccagcccagctccccgggccccgcgggcgcggcgggcgaggcgggcgcggcgggcgcgggctgcgcgaagggccgctgagagcagccgaagtgccggcggcaggcggtggctgcagaaagggcccggccgcggccccggggggcggcggcggcggcggagcgcccaggtacgcggcggcggctgcggcggcggcggagggcgggcctcccacgccgggcccgttgagccacaggtaggggttggcggcggcggccggcggcgcggcgtagtcggccagcccgtaaggcgccctggctgccgggggggcgcccggggcggcggcggtggcggcgggcgggggcaggccgggctgcgaatacactccgaagttgtcgccgcagtagagggccatgtcggcggccgtgggcggctgcggcgcggccgcggcgaggggcgagcggggctggtctcgccgctcgggcgagagcatccctttgggggccaaccctgcggctccgccttcacccgcgctgggcgcccggtgctccgggccggggtcgggcgggtgctagcggagcgcctgctagccggcctcttataaccgagcccggcgcggctcctcctgggccggcccggagcggggcggtggccgcgggcctgggctctccacgcccccgccacgccccacctgcccgcgcgcccaaacccggagcccgcccgccccgcccctaccgcccctctgcccgggcccgggagcgtctgggaggccggcgcctccaggtttcgggcaaaaagcagcaccccattcctagcccacgtttcttaacatcataataagtaaagccacgaatattaaagagaagataacccgaacagtacgaatgatttctaaaaagttaacttggggtggccgctcgggccacctgcctagtcatccttttggcttttctacctctttcctcctaaccttttgtgatcgagtcgcggaattcacgtccagtctcaaccgatcggcttccagtcgaaaataatcgatgtgatttacaacgctttggggtatacggtagaggttattaacaggcccgcttggcgtgtccccttctcctcggggattctgtgattggaggaacggaaatcagtgttgagtttttctaaccaaactgtaggttcgctcacattcgggaagcatttattcgttttctgtgcggtttgtacgggctttcg

SEQ ID NO: 5193 - DNA, 2045 bp, Homo sapiens
gcgaaacggcagaggccggcagcccgcggcccacgtgcacttgctcagggaaccgttccagcgaaacctgacccggatcggaatcctcccgcagcacagcggccgtgtttatcggaatggaacgctacaagttgtcacctgcatccctctcccagctttgacagggaacacgcgctgcccccacgcccacaccgacacccggatccctatccagcccggccagagtcccaggggccagggaccagtgcagggagaaggtcccccacctcagccctcaggacccccaaccacagcccacccgcccccaccctgctcggttctaggcccagccgaacctacatgtccccgtagtgtcgagcgttatcatccacagtcgcccctcaaactgtgacccccacctgggagacccggaatcatccaggaccctggtgtggggggcagtactccccatatctgccccccgaaaactgctatggagcagccgcgcctcggcgggcaggtgagggggccgagcccaccagcgccgcagccccgctgcctaccttcttcagcgccggctgccgctcccgggcagacatcgccggccctgactttggggctgacaccgccaaagggcagtcagtgctcgcccaggccacttcgggaggcccaggggcacggcgaggggtcggggaaaggcgatcgcccactacagcccgcgcgcctagactgagggaggagccgggctgcagaaccggcggcggatggagacgggagggaggctgcgaggtcgctcgaggagagactaaggctctagaaacggagaagcgggcgctctgcgggaggcggcggcgctgccgctggccgtcaagggcgggaagtgttctgggactctcattaggggccgcgagcctcgagcgtcaaattcccgcggcgtccgcctagcgcgctgctgtggcgggcgcggagggcgcgcgccggcagtgggggctgcggcggcggagggcacgggcccccgctcagcgtcctcaccttcttggtgcagctgcctcccgcgagccgagacactcctgtcagggaagaggagcgccccggctgtccccctagagtctcctgctggggggacatcgcttccatgaagaaaatcttcaaacaaatcccagcccaggaggaggctacacgatcatgtccgcgggctgccggccggaggggcgaggacgcgcgggcggaggcgcggctgccgtgctcaggcagggagccgagctccgggtgctcgccgcgcgcctcccgtcggggccatgtacctccgcctgcgctcgacaccgcgggctggaggcgagtgcagcggcgacagcccgtcagcgccgcggcccgccccgcctcgggcccgccccctccgctccgggcgccctgcgccggggcccgcccccgcagccctcctcagccctcctccagcctgggccctcctagcctcgtcccagcctgcggcgcgcctggcgggcgtctctctatatatgttagcacaccggccaccggctgaccttttcggtctgtgactccgcgtgggtgcagcccgcaggagctcatcggcctgtgtcacgcacgggggcctctagtgcacggacacgcgcctctcccgccacctgcccactcccaccagaccccatcccttcccgcgccgtgcccgcggcggaaggcgcccctgcagcgcgtgcatccgcggagcggtggcgacctcagcctgagcagaggagttgcagtgattcctgcctcgctttcagcggactgcggagggaatcccccaccccaccccactggggatagggtggcacgtcgcagagtgtcgcagctgtacaaatttggaagcccacagcatcgcctgacctcttgtgcaatcccgaacgctagcctgttcgggtaaccctgagtgggcttctgcagccggtcatgtcagcggcccctgcacatttgcacccgcggtttccgctgtctgcaggctgcagagacgggggcattccaaacgtgaaagagcaatgaaggaaaatgcagacagagcgaggacgccg

SEQ ID NO: 5194 - DNA, 476 bp, Homo sapiens
tcggcccgcgcgggaggagtgtgacccaggtgccgcttcctctcgccgccgagggtcaggagcccgggagcgcgaccctcccccggcccggcctggcccggcctggccagtccccgcggtctctgcccgggctgacgcccaggaatgtggtcgacgagaagccccaacagcacggcgtggcctctcagcctcggtgagtacccgccgtggggaagggtcctggggacccactggaggccgcggcccgcagcagccaggggccgagccacggccacggacgccctggtgtcccggtccgtgccgggcctccaggcggaggaggcgtccgctgggctcagatccccgactccagccccggttccccggcgcctgggctgcgcggagtccctgtcccgcgtcccggacccctacgcgcagcctccacgcgctccgagctggagaagccgccagcccgccctcccagggcgtgtcgcccg

SEQ ID NO: 5195 - DNA, 455 bp, Homo sapiens
acgcgggcggcgcccggggtctgcgggtaggcaggcggcctggccgcggaggcttccccgagtcctgcgccttcctagagagggaggggctcatatcggctggcacagccaccacgggtaccgaaacttggggacgtgcccgaccatgcctcctccggtggcccgggggccaccccgcattgcttagaagtctcgcttcccgttcctcctctctggttcagctcattactcttccggtgaccctgggtatgccacgcttattctccaggcctcagtttccccatctgtgctgtgaggagtggaaggaacgggatgactaggagccttttaagaccgagtattcgaggttctttccggccccgcggagccaggaggtgccagccgagatgcgcgtgccgcgcgcgccctccagtgcccggttcccgcttctgcacggtcctcgctgggcaagggcg

SEQ ID NO: 5196 - DNA, 749 bp, Homo sapiens
tcgggcggcgcgcccaggtgcaggctcgctctgcggaggagggcgggggccgggcaagcagagggcgcccagtccgggggcgccggtctgggctgggcgcccagagcttacctcggcgcgcgggccgcgggcgcgtggggcagtggctcctccagccgggaagctgttgctcacgctccggtggttgctgcggtcccgccagggctgcaccggggcttcgcgcagacgttctcccgcgatctgctgcagcccaggcggtggcggtggcggtagcagcggcggcggtggaggtggcgcgggcgacagctcggcccggcgcggcccctgaactgtccaactcttgcccgcgccgggcttaagcgcccggccgctgcccccgcgctgagcgcctgcgcaccgggcctcgcccaggtgaggggcgtgtgcccggagcccgctgggcgcgcccggcccggcccggccccgccgcacgcccgcccccctggcctggccgaggaccccggggtttggacgtgccaacgccactctcgcgcgccgaagctgtgacggtttactaagcagagacttgcgaggcacacagagagggaatgaggcggaaccgttcgggggctcgttgacactgcagagcctcccgcagcatcgctgccttaaatcccgcctttccaggcgtgcgcgcacagcgagccagaggaggctccgtcccgacctggggtcccccgcggtcctcagcccgggggctcgggtccccg

SEQ ID NO: 5197 - DNA, 1134 bp, Homo sapiens
ccgaaaaacacgttctaggcgccgggattccagatacctgggaaatagagtgcacgcagctgttgagaggcctcgcgcttggcttctcctatcactgaggcgcagaggtgctgtggacagcccagacccacacggcgcccgaggtgaaacagaaccctcagtctccctatgaggccactggcactctcggctgtccccagagctctccgacttagagctgaatgcaaagtaagcgctcgaaatgcagaagtagccggggccgcccacggcacctgcctcgctcggggcgagagaagacgccaggctgaggtcccagcgacctcaggcaccagctccgaaggagggcggggagaccgcaaaggggaagtgcccggagggccaacggcccccgcgcaccctgcgcccctctgaagcgcgccgcctccccgcgccggggactgggacctgcctctggggaatccgcctagaagacggcggcggactggggtcgggcactctccagggctgtcaggccctccccagccctgcacctgccgcgccgccccacctcgccaggaagtctcagagaccccggggatggggtgggagcgccttcccatcgcgggctcaaaaagaaggaaggacgcccccaggggtcgtagaaggaggactagctccaagccacaactttcttcggacccaaggcaggccggctggggctccgcgcctacacggcccctggcgggggtccgcgcgccccgggagccccgcggctcggggaggaaagaggagacaagagacaggcgaggattacggggctgacccagccggggtagggaccatcgtggaaaaactttggcgaggtggggggacgcggaaagagagcggcccgcgccctgcaccttgcgccgggcatcccgcgccagtgcctcgctcccagtgccccgcgccccgcgccccgcgccttgccttcaccccgggccagctgcatcgcgcccgcgccgcaggaaccgtggagttggaaagtgggggcgccgcggctggggggctgcttcagctgcgcctcggccagcgatcggcgggccgggctcaaatccagccaggctgggcaggcggtggccgcgcgactggggaccgggcgccccgccctcctcg

SEQ ID NO: 5198 - DNA, 1645 bp, Homo sapiens
tcgcgcaccgaacccgagccaggtctggctccagggcagatctaaccacctactccgaccgagcttccgaggccggcgctctagccttcatgcccacctcccggagacgccccgtggagaccctggcgcctaaaactgcgggagcccatctactgcgctcaggtggccagctcttgagccttccctatccgtggctccttgccggcatgcaggcatgcacaagcataccgccgagcaggaggatctaacgaatccagcttgtggacatgccctaatttccatttccgcctcctccaggtctgttcaggtgaggatgatgggagggaaaagcggtgtacagccgtaacattggcaccctgcaagagccgccggggcactgacacagagggacaccgcattggagatgcggtgtctacggagatttattgcgcgcggtgaaacactctaagcaccgcgcggaacaactgggttcagctccctcatcccggaccttccccaggaccacacgtcaccctttatccccgaacccaggggcccctccacgctgcgctcacctgccctgtttcgtaatgatcatctcagtttggtggcggtggaatttgagccacagaggccggttgcacaggtagacgtgggcacggaagccagaacctggaacccccaggccccccagtcctccgcaagatcccgccgctgcggctccagggtacggcccgtagagcggagccccctggctgtactgataggtgcccgggccgccgcccccgccgctgctaccgcccgcgccactgcccgcaccggctcctgggccgaactgcgccctcccgggtgggcacacagccgcggggaagccgccggggggcagcatggagccgtaggggtagcgcgccccgttaggagccgggtacacaggtccgtggggcgccccagccgccgcctggtacgggaagagtgagcagggcgcagccagctccgacccctgaggaccgggggactggaggtagtaccgctcggagctcaggctgtccatggagtagcgcgcagtggccgcagccgcggcggcggcggcggcggcggctgcagcggcggagggcagctcctcctccccgcagggggagcccttgcggccgtccgggggccccggcttggccactgccgcagcgctggcaaatgcgtccccggcgtcggtgtcactaagcatggccgcgggggcccctgcgctggcggctgcgggctccccgctcaccgcctcgcaggagagactgccggaaaacttcttggacgctttgtctaagtccaacttctgaggagagggggccgcgctggggaggtggccagcgctcccgccgctgccgcctcgcgcactctccagcgggtagaagtgcgcgccaggcaggttcactgagctcaccaagagctgctcccctaactgcatgctttgcaaagcgcagacggcagctggctgcttcctctcctccggtggccttattataaaggcaggatgggggagccagcgccctcttccgaggggaaggtaacttccccttcctcccgcgccggggctacccacctgccgactcgcgggccgctactgcgcgtactggcgcgccctgaatccagcgtcctttccggaaggaaagcgccg

SEQ ID NO: 5199 - DNA, 4698 bp, Homo sapiens
gcgcctcgggaacgccctcccgctgcaccctacaggaggtcgtgggcggtggcttaacagccccagtgcagagcttgaaccccaccgtccagaaggaaaggtgagtgggggacccgggcgggaggtgaggcctgccggcagcggccctcaggcgtgctgggcagcacggctagcagaggcggcgcctggtcttggatgctgcagcggagacgccaaggagactgaatgcagggagcgaggcgtagcggccgcggagggtggggccgcccggaaatccaggcggcgccagccttgtagcatctgcaggccgggggcgcgcacacgaggggcacgtgggtgtggaggaaccggcgcggcggggcctccttcctgcagcgccgcggcggtcgagtgcccgtgctggaggaacggcgagtggggtgcctgccccgcgcaggcggtacccgccgccccagctccgcacacagcaggcacggccagggaccgggaccgtggcccagcgcctggaggcgctctccacgcgcatctttcccgatgccggggcgggaagccgagtggctttgtccggagatgccaggggatgtgggcaggggacgaagaggtttcccaactggccaaaccctggcttgaggaaagactgaggtggtcattgacccgtgggagcgccctggggcttcgagggaacggcagccgagcccgggagactggtgttgggtacccgcgggggccggcgggttccacgtgggtggaccccgagctgagggcagggtagggtcgcggatcgctgacctatgagctcccctactcccgcacaaggacacctgcacatggacccgggcttccacccgcttctggctgggttggcgccgggagcgcgcaggggagggacggcggcggagtgcggggtttggcgggtgaggtgggtgaggtgtggccgcgggggagggggcgaaggcactagaaggctgcggtcgcgctgtcgctgctgttcccaccgtcggcgcggggcgcggagggggcgaagaggtgcctgccagtcgcactgcggtctaggggtgaaaggaaaagggtccatgtaaaggagaaagggcaggcagagactcttgctggtgccagcaggcacggaaggatgtggccgcggggacttggagtttagagggcaacgctgggtgtcataatgccggagatgaccccgggtgcagaggcgattccagttgggtagagctacagagaacgtggcccgagaaggggagcttccttaaattagacatatcctgtgttgtcctaaacctagcatttaccctctcccaccccgctcccacaacctccagggtcctagcggagtcatttaagcgctcagtactaccagcttcattttaggtaaaaatcaagactaattctgcactttattaacctcctcgtacccaagtcaccacggggcagcttttcacagccctaaggcgtggtcacttcaagcccacagcgagttgctcgtgtcctcggcttctgctccgcaaatctcggacgatgccaccggaggacgctgaaggcaaaggctggtggggccaggcgccggcgagactgccgcgctagcacagcttccgcgggagccgagtgctgacgggcctcgcgaccccctcccgagggcaaacggctcggccctccagggacacttggtcagtgtcactctctccctaccgggtgtcgcgcattttctcaacagaacgtgaccccgtagacggatgaactcggaatcggcaaaacccgcctgcccttgtctagtctctctgccccaccacaccactgcccttcactgcggactgcgccgtgtgcgctccgggaccgcccctgcacctttgcccacagcttcccattaccaaggcagccggaggaagacctttccgagttacctgtctcacgtcagcagccacaccgaggcggtccccctcgcaccactccccaagtgcagagcccctgaaagtccgaggctcctgtgccacgcaccctcccccctgcggggcgaccccgcgtatgcgtgtgtgtgtcacgcgtttaatcgcacagagtaattcccagacgtgcaagacaaagcatttcaagcaaagatggtccagagttcaaattggaaagcacatctcgaggcgctgaatctgttctcgccgtctgcctcggtctctggggcgtcgcatccaggagaagggttttaactccctgccagatccgctcggaattagctcttctggcggtgcagcaacaagtggccccgccgcctcccttgtgcactcggagggactacatcctcctcctctcccagcccctagtccaaacgggagtaggtaatggcggggaaagggggaggtgacgagagcggggagaaggaagtacatattttttaattgtgaaattgtctgtctgcgtgctgtgctctgggattctcttgtctcaatcaacttcaattttaacgtggccgtaacgttaagattaagacctagaaatgaaaacgtacccacctttcttattacaaaggtcgtttgttgttgttgtttttttaaaacaccaagtaaccccccccccccccccccacggacttatactttgtttatgagatttctccaaccttggtggtttggagaaatgaggtgggggaggggaggaccaagggcagcaagacgtccactacgaaaataagatacttactaatttaatagggccgttcctttttacataagatgctcccccaccccccaccaatttacaataggtaaactttgagcttcctcaaagtttcgctatctagcgtttatgcccgaagctttacgaataaactccctttccaggtaaacctgcccaacccttgtcctatgcccagcgaagcccaggtacgatgggtcaaggacccctggcttccacattgtctgagtcacgttccagttggaaaggccatcttgggcgagggacgtgttgcccgactggtctaaataaggaaagaaagtggagtaccaaagaatcaagggcctctgttcctccccatcccgccaccaccaccaccggtccccgggctctgctgagcgctgcggcggtcttggctgaaaactgcgtccccgcccaaatcgagcgcaaaactcccttggacagaagtttgaaagaatccagtgtagaaacagacttctccgtccaatttggttttaatcagtaatcatataagtatacccacataaccacctaagtggagagcagacgcccagattcacggtccccacgtgttgctggagttggcgcagacgcgtgtgcgggcatagcggcggacgtgacaccgcattttctccgaattcctgccatctagggtggtgccgccccaagagggggccgtggggaggtggggtaataggctgcgcaatccacttgctctgggggagcttagggttcagagcagagcgcaactccggggggctgtcgcacagccccattctcccacaccagaagagcaatgctccttatggatgattaatagccgggcttctcctgaccatgcggcgcgtccctgccggcaccacttagttgttttaatttgacctttattagcaacgtgctcccagaggctgcgagttggattcgcaccacgataacggccctctccccttccacccggccggcttcctgggaaggatcggggactgcagctcccgcgacgcctcctcctcctgcgcagggagcaggcctgagttcctccacgtaatgacctgggagacctcaggcatcccggggcctggtcggagggtcttcgggccctggagctgggcggtgtctgcagtgcaccgccgtgagtttctctcgggtacaatgtgctggtgtgcagagaggaggaaaggaaaaaaaaaaaacccaacaccactcttaagtggcactggcatctatgaagtggcagtggtctacactgagcgtgcccttgcctggaggtgtagggggcggttactgcagccgaggggagggtactgcggccaagggcagggcgagaggacagtcaaggccggctggccgcgtgggagcctttcctctccgggttcagcggccggaatcaccagcactgcggctaaaggggctggtaggctctcctgcaccccgcgtgctcctccgccttctctgtgtcccccggcttttccaggaggaagatggggtgcccatcgcgaatggggcgcgccgggccgcctggccgggcggtcacgtgtcccccctcccccgccactgcggcgggagttccaatcagagcgcgccagggggctcctcccgggcaggaaccacccggctcggcggcggagggtgggccgccgtcacctgaccgcccgcccccgccccccgcgagtaaggggcggtggtagcgtctgctcggttacaaatggcccctcccgcccggctcgcccgctcgctcgggctcggcgcggacccgcctgggcgtgctcctcccgccggctccaggcgtcccaccgccctgcccggcgccagcccgcggtcccagccactcctgagggcgcgccgggcacccagcgcgtaggctcgcccacggaggtcgacacggaagtctggaccgccgaggcgtgtggctcgtctaccggcaggtgagcgtgcaccgcgggcgtgggatgctgtggggacagtgcgggggacgtgtggggtcttcggatgcgaacgcgagtccgtgcg

SEQ ID NO: 5200 - DNA, 462 bp, Homo sapiens
tcgctgggatcctgtgcgcggggcacgccagcgattacaaacgtgtctcaattctgttgagtcaaagccctggtgccaggcgctgcctccttcctgctcgctcgagtcccgcaccccctggcccccctctagttggtgctgtgctcagtccctcctgggtaattcactcaggaacccgctgcggccaccctccgtcctctccccaacctgggccgagcaacaagtggagccagaattaattccatgggcgagaggagcacggaggcgagtggagcgcgctgccgccagaggctgccaaggaggcggggtggccagcgcggggggtggaggatgggggcaggacgcgggagggaagggcagggggtggggggcgaggccccggggaccagcgcgcgagagtgcccagctgggaaatgcagctccgaattaacatcgtatgtttcataatcagtttacgagccg

SEQ ID NO: 5201 - DNA, 300 bp, Homo sapiens
tcgaactggcttgcccgtggcgggcttgtccaaagcacaggggcctccgccttcggtgcgcgttgttctcaggattagtgctgttgggagacaaagagccccagatacccgaggctgggagcgccggagagctcccaggtttcgggtaccctcccggagcacgcaagcacagtcccaggcctttagggacagatgggccagagccgtctgcatctgcccgcatcctttgggaggctgcgatgatcgcagccagggtggccgagcgcccggcccactgcacccggcggctgttttgcagcg

SEQ ID NO: 5202 - DNA, 554 bp, Homo sapiens
ccgagacaccccgggcgcgagcggcagtgctgcttgcttgctcctcctctcccccagcccttcccctccgtgacctacccactccttgcagccctcgcccgcaccttctccaacaccccggcatccctgcaccacctgctcgggcagccccggcgggctctgggacttgctgtgcgcgccgagaggaaggcaagctccaaacccctgcctggaagacgggctgtcgcggctgcaccaccagcaggaggaggaggagaagaaactatttcgcgataccccattctgcgggtgctttgccgctgccgcttctgctgccgccgatccgagtccgcgggttcgaacaccgcagcggtggggacggtgggtccggcgggcgccgggaggaggacaccagcggagccctgcactctcgtgccccgctcaccagcatctacttgccccctcgttccttccccagccctttagagaagggaccatgatttggaaacgcagcgccgttctccgcttctacagtgtctgcgggctcctgctacaaggtaatccccgccccggcg

SEQ ID NO: 5203 - DNA, 1153 bp, Homo sapiens
ccgccccctccgtagagaccgctagctgaggctgcaacacctgccccggcaaagcgtctccgcagccttcccggcttgcccgactcggcttcctccgcctctgccccggctgcggcaccacttcttggagccacgtctcggcgagcgggggccgcggagcgagggggccgctgtgccgctactcacccgagccgctcgggctggccgcgagccgggatccgcgagggctggcgggctctggcccccgaggacgcagacatgtggcttgaacctccgctcccctagccgttgcctctgtgcatctttctgggcgcccccagcgaatgcgagcggcgaggcgagggcgagcgcgccgaggaagggcgggagaggcgcggagcttggccgcgccgcgctgcgccgagcgccgggctctccccgcgagctccccgggcccgcgcgcgcgccccccactgcccccgccccccgcgcggcgcgtgccccccaccccccgccgcgcgccctcgcacccgcccggctccacgcggcgcgcgcctgccctggcggcagcggcggcggcggcggcgcgtcctcccccgaacgccgtctccagggctgctggctgcgctctccattgttccgcggctgctgcccggggtgggcggcgaggcgggggggaggtgtcggcttggccgccggggagggcttaccgctcgggcggaccctcactgcgagagcgatgcgggcccaggcgcggcgcgcgggggctgcagggcgcctagcactgggggttgccggcgcgcgggggcctcctcctggctcccaggcactcgctgctgctgggcgcccctcgcatcctcggttactatggatatctcgctcctccgccgccccctccgcgcactccgggaggccgccggggcggtagcagcggcgcggctccgcgggtgcccaggtgaccggctcggcagcggcagagcagtggcagcagccgccactgccgctgttactgcggtcgccgccgctggagagaggaggacgaggagggcaaggggcagaagcaggtcctgctctgtctgccccagaggccacctcgggtttcttctcactaaccaagcgacttcgtgtttacctcgcaggagacgcctcggcagtcctcaacttgtgtgcgccg

SEQ ID NO: 5204 - DNA, 1603 bp, Homo sapiens
gcgatacggtttccttgacgcgcccttaaccaaggcgttaagtttagcctgacagcatccctccctcctttcggttcctggcctgatgagccgcctccacctgcgagcggtgcaggcatttttgttgtcgactaaccccctctagcgccgaactggcggcatccgagccgcggctgccaggccgggagaaggctgggcttggccgggctctgcagcgctccgggctccgtccctgccctgggcgcccgcctccgccgcggggcgaggtggtggagaccgcggacgccgagggtcctcccagtcagcacgccgcgttgccccggccctggggcgggggccgcggagtcccaccaagtggcccgcgcctcggcttccgggagacccgagcgcggggagggagtgggtgccgcgagggggcggctcgcgcggggagagccgtcagcccacggcgcccctgcgctgctgtggatgtggccacgcgccactcggcccttggactgctaggagagcgcggcccgacgccaccacgccgtggacgctcggggacccctgaatcccagcgtcaaggctgcgacgatgctcgtgacctccaccgcgaagtcacctccgcaaggcgacgcaaggacctcggcgatcccgggcgccgtacacccgccactttccagcctcatgtaaccccccctctgctgcttcctcccggcgctttgcttttctacaactggaagccgcgaaggcggctactgcgctgagccgctcgctctgctggtcaagtttgggcgacccgcgcggaggagggtcgggctgactgccgccgctgagctgtccccggacgggagcgcctgtccacggcactcaccccctccagcggtggaaatgtggagaagtaagtgggaggcggtgtcgggaactgactcctcttaaaacggtcggcgccgctgctctgaaatgggcggctaagtgcttgtgggactaagggcggcctcagagatgcccggaaaatcgctgccacggccagagtgcggcgcagacgcggcagagttggaggtgtccgcggtgcaggctgctgcccacgccgctcaggccaggtgctgagggctcagcccgcgcctcggccgaaccactctcagccccgttgagccacctcgtccgcccggctttcatcgcaccggccagaggaaagttcccgcggcccccacgcctcttcacagctgcagcgcctcccctgcttttggctccgcaagtgcccacttgagtcgggagaggtcctcgggccgccccaactgcccgccccacctggcagtccgtccccgcccccgtcctcgcggtgaggcgctccccgccccctcgctcccctcccccaaaccacagcccgagctcgctcttgcgcgcgcgcgctctctccggcccaagtgaatagtcctcgcgcaagcgggacactgtggtggatgcaattcccctcgcctccagccgcgaggagctccccggcgccgcaggcagcgtcctcctccgaagcagctgcacctgcaactgggcagcctggaccctcgtgccctgttcccgggacctcgcgcagggggcgccccgggacaccccctgcgggccg

SEQ ID NO: 5205 - DNA, 1411 bp, Homo sapiens
acgatcagcgctttcggtgcgaggatggaaagaaacttcagaaaaactctcgccagacaacccggcagcacttggccccggaacagagaggagagaaagacctgaccgccgcactcagggccacccgccgcactaagtttgagggttccctctgcctccaggcctctgtcgcccgagctcaggctctcctaggtgcttcagggccgggctgcactcgagccccgaggaggccctgctagcgctagcgcggcggtgataaccgagggaggtgggtgagaggtgcggctgtcgaggcaaacgcagagcacccgcccagtcctccaagggccgagagccgggagtcccgaacgccgcttaagcagctccttgcttcccgcagcccgtccacatccctgcgggatttctggacgccccgcccggggacctagggaggagggagagaggagggagggagtgggcagcctgggcgcacgccaccggtccccgtacgcccggcaccccccgtggcgcggcgagtcaatgggatttgcacactcgaggtgtaacagcattactgcattaattaccatttccatttcacgtccagattgtttacttatctgcgggaaacatatgtcgggagaagttcacattccggattctgctccgctgcccaaggtgcaattccggggaggcggcgaggggggaggggagggcttcagattttttattacaccctctagccttatctgccgctgtaaattatgaggatcctccattgagcggcatatggagattatatacttttttgaatatcgtttcccaaagcctgcagattttcactttgaaatgaaacaatcctccgctggttcccccggggacaggcgtctcctgcgttcccccgcgcggcctgggggacccttctcgcagagcaggcgcgcaccccaatgccgtggccggcgcccagtggagacttctttcacagggtctagaataatcttccgcggaacacccatccatatgcagtgtttgagaactaaggcagctcccttgctctgttttcctgcgcctagcccccggacttttgtgccgtttgcagctctttttcatttcgaatacccgcatagacgcgagcccacttctgccctcttcctacgctgggcggctccaaacccgccgcgagggctgaggtgttcacacctgcccacggcagcctgcctcgccctcaagcgcctcaaagcttcctaagcgcttacattggtcttgggacagccgactttggcttctttgtttgtttgagggaccgcggaagtggcggggaatgtgcccccgcttgagaccgcttattgtgagccctcaacggaaatcctgcacggaaggcaaccgcctccccgctcgcggtaagcaggatccacccgagtagcggggaccg

SEQ ID NO: 5206 - DNA, 2629 bp, Homo sapiens
ccgccggggcccggaggtgcccgaagcgacgggactgatagcggaggaaacgcagcctccctccgcgcccgcccgcggtgtaaaccgagtacaggccgtggagccaggctgccccggctcccgctgggtcccaacccccgccccgcctagtgggccccgcggcaagcggcttctgaacagcttcaagagggttcgcggagcaaacacacgtattggtccgtccctttctcgggcagcgcggtcccgccatcagtcctgtccggcgcgtctagccatggactgcacggcagtcgggcggggaacgcggagagcgagcgcaccgacctgtgagagaaggccaagaggtctgcgctgccgacgcccggtcgcacctccgccccgggccctttccgcggtgaatttgggcaggagacgctggggctccggaaagagacgagcccagtagaaagcgcgcagagaggcagcttcaggccaggggagtgcaaggtcacagaggtcagggaggtgagcacaggaggacataaactgaggggacaaagaggagcgacaggagcttaggaaagcgaaaaagcacagagggaccctgggcgctggctccagaggcgggcccagagggtgtgaggtcaggctggcggcggcgtcgtcggctgcgaccggggccggcgtcgcgcgtccctgcatcctcgcatccgtctgcaccggcatgcggtgggctctcagagatcgaggcgcgaatgcagcgcgccggtcttgctgtcgtggtcccagtaagagcaatgcatcatggcgagctcgggctgccgggcacaagcgaactgcaggcccggcgcactggtgggcgcgggcgccgggggcgcggcggtggctgggctggcagggctgagctggcccggcggcggcgcggcggccccgtggtgcggtggggcaggcggcggtgcggcggccgcgtgcagatggtgtgcgtgcggatgcgggtgggggtgcggcggaggcgggggtgcggccggcgggcctcccaggccattgtacgagttcactacgccggggggcagcgccatgctctgcacgcgtgtgtacggcccgtacgaggcggccgggcccgccagccccttgaccacagcggccgcgccagggctaccggggcccgcggctgcagccgcagctgctgcagccgctgcggctgccgccatctggcaggaggcatagggcatgggtgagggaggctgcggtagcggccacgagttgttgaggaagccagactgcaggtacttggggggcgccaggtagccgtagccgtcggccccggcgcccgccacgccgcacccgcctgcggcgcctccggccccgaagagccccttgccgggctggaagtgcgcgggcggcggccggaagggcctcttcatgcggcggcggcgccggtagttgcccttctcgaacatgtcttcgcaggccgggtccagcgtccagtagttgcccttgcgctcgccgccgccctcgcgcggcaccttgatgaagcactcgttgaggctgaggttgtggcggatgctattttgccagcccttcttattcttctcgtagaacgggaacttcgcgatgatgtactggtagatgccggacagcgtgagcctcttctccgcgctctcgcggatcgccatggcgatgagcgccacgtacgagtacgggggcttctgcgccgggtccggcttctccggggctgtcccgccgccacccccaccgcccttgcctgggctcggcggcggcccttctggctccttgactgtgcgaccggtctctggggccagcagggcccccgccgcgtcctcgggctcggggtagctggccatcatgacaaagccggcgcgccgcggccgggccgcctctgctctccgctccaggcgctggcgcggcaaagagttggggcgcacgagtccgcttacggccaagtctcaaacttctggagactgcggatgccgcccgcgcttgcttgctggaggcctgtcgctgctctcccctctccttccccttcccctagggagcggccggcgggagtggagctcagcctctggccatggggagtccgcccaacagagaggggctccggcctcgccgcccctccccgctcaggccagtccccgccttggtgggttttcttttctgcgctcttcccctccccccgccccccggtttcccgaagcacgacccgcgtctctggcggagctgcctcctggagtccctagtgcgccaggagcctcgctctgttctgattcgtatgggctccaccgagttccgcttgcgtcaggcgccttcgcccctatagcggggcggccagccgcgcacgggcgagttcatctccaagtcactttttgtaaacgccccgcacagcctggaccggcctgcccccgcccagcgagcctcaggggcccagccgacagccaggctcacgcgcccttgaaatctgccggtactcgctctgcgggctgggctgggagatgacgaggaccccggtggggtctgcccgcacccggccaaagcccaggaagctcgggccccagcgaggaaaggcgctccaagcctcctcgcggctttcaggtgaaagaaaacgactcctttgctctgccgtttgctgccg

SEQ ID NO: 5207 - DNA, 1686 bp, Homo sapiens
ccgcggctgcccctgcttctcggagatgacgcggagccctgccattgccatccaggtccaaggctatctactctgcccgacaacccctagcaccactaggcgctgctctagtgtgcgcctggcgccctccccagaccagtcgacgcagaacgcccagagacccagccaagggcaagacccttagcgacgcccgtcagtcctctccgcccagatatcagttcaaagggcatggcaggtcagggtccctcgcgccaccccagatgaccctcaggcctcgggtggccactttctgggggagccctccatcccttgcggcagcttttccgagagtcggagtggaggcgcggggctggagggctctccggagccgcccaccagggtcctctgggggcccggtcccgactgggcagggggacctggacagggccccggagcgtggagacggctgaggaaagttgggggtcggggccttggggcggggagcgcggaacccggcgccgatgcccgcgttcatgaatatgcacgagccacctccctccctccgtgacgtcacgggccgtcccggggtgagcgcctgagccgctccgggtccgcgccagtgagcgcggctgctgccggcgagctagcggcgcagcggcgggaacccgaggccgagcgccgcggcggcagcgctagaagcgcacccatcgggcacggcgaggcggcccacggtgcggcaggcaccgggaggcgagagccggcgcggacagtaggcggcggctgcagctcgttggcggctgctgcgaggatgctgcctgggcggctgtgctgggtgccgctcctgctggcgctgggcgtggggagcggcagcggcggtggcggggacagccggcagcgccgcctcctcgcggctaaaggtgggtgctggggaagtttgctcttctcccaggagggaggcagggcaggcttgagggtgaaagcggcaaggacctaggctcaagctggatttgcccaccctcccttgccgcagcttctttggcctctgtgcgccctggattcccgaagtcagttccctgcgcagcggaccagagaggtccacccgcggacgtcaactcaacccctgggcggggtccgggggctgagcagaaggcgaggtctggggagtacggacaactttgagggctgtctgtgccggggtgggagcgcagtgggtgagtttcgagctctggcccagggacggctagagcagggcgctggcgcgccgtggggacaagcaggtgtctgctcctgcctgggggaaggatcagcggcggtgctttcaaggagggagccgagctgtgacttgtctcccagctcggggatggagtggaaacttgtaggctccagggaaggccccgctgacactcctcaagctcccccagggcgtctctgactccccggggaacgtgtaccctccgggtaggcggcggggtccggaagaagcgcgggatgtgaggctccccgctgcctttcctactccgctctgactaccgaggaccgaggagcctaacctggcaccactcccctgcccaccctgttcctttgaagagcttgacctccccgcgcctcccgcccggaaggaagctagatccaagcgaacgcctggctctgtcaggcgagcctggaagccggcgaaccccggactttgacagctgcctgggagcgtcg

SEQ ID NO: 5208 - DNA, 1686 bp, Homo sapiens; identical to SEQ ID NO: 5207

SEQ ID NO: 5209 - DNA, 2132 bp, Homo sapiens
ccgagaaagtgggtgcggcaggcggcgcctggaggaactggcgcaggccctcttctacgtagtacacctggtcgtagatgctgaggaaggtgaagatgtggaagagctggtggctgtggccgataatgtcgaaaagacccggctggatgcgctcggggatcttgctcacgttgaagaaggcggccaccaccagccagaagtagcggcggtagaagtgcacgaagagtgtggggttctccccacgcaggtcgaagagccagctctcgagcataatggggcaggccatgctgagcggcatgacgaagacgaaggtgcgcagcgcgaacgggtaggtacaccagtcggtacggctcttgcagcaggccacagtgcaagccaccgccagcacgaaggccacaggcagcaccagggcgcggtaggcggcgataaggcgcgtgcagtccacgtgccagcccaggcgctgctgcaagtatggagtcatgactctggcatccagcaagctgaggcctggcaacaggtagtagtagtaggccaccgtgctgccgaagccgtagtagctgatggacgcgtagtccaggtagaagaaggcggcgcgcagacgcagcgacaggcagctgaacacgtgcgccgtgcagctcatggcgaaggtcagcagcactcccgacgcgtagcaccacaacggtagcagccacgggtggtggaagggcacgtcgccgccgctcaggaagaacagacggcagaacttgctcaggaacagcagcagcgggatgaagtgcgtccagaagttgagcgtctcgttggtaggcttcagcaccgaggctaggcactcctgggccgtgcacggcagacgccggtagcccgacaggatgaagcactccacgaagtcgtcgggcacctcgtcccagcgcagcagcggcttggcagacgctggggggtcccgggaggcggcagagtgggagttccgggcggcccccgaagctgccggggccggggccggagggccttttgtgcccgcgccccggggctgcaggcgccgcggcatggtgcccggggctcggctagggcgcgcgcaggcgacctctggcgccggctcccgggcgctgggcagcccccgccggccgccgtcggagcctttgtgcccacgccgggggcgtcgctgcaggtttaggagaagacccgtgcctccgagcagccgctcctaaaaattaaataaatcaataagagaatcaattaataggcagcgctgcgaccgccaggagcgcggagcgcgcgaggctcagcggcttcctcgccaagcccctgctaccggcgcgcggccgcccgcgctgcggcagcggcggcggcgcggctgactgcggcggcagcgcggcagcggtgactgggcatcgcgcggtgcgggtgcctccgccgccgccgcccccggagcgggaggtggggatgtgcgagccgaggcgcggagggagggacgggcgcaccgaggaagggcgggggcctcccaggctagggtttcgcggccgcttcgggggatagagttgtcccctgtctcgagttccgtaccatccccctcctcgggccgccgcagcccgggccgccccgttaatgattgatgcgggggccgcaggctggtcggcgacgcggcggcgcgcgcgccgagtactagagtcggccctggggttcgaaacccgacagccacgcgggcgttctggaggacactggggagccgcgttcgcggggggcggggagctgcggctgcggggggaggggagggcgccggagccgggcagggcggagagatgcgccagcggtaatctccggaggtcgccggggaggggggcactccggaagtcggggggctttaagcccgcgtccggatcggggccgtgtcattgtcagctacctggggatgcgcctctcgctccctcactgtctttgcgtgtgtgttagtgtgtgtgtgtgtgtgtgtgtgtgtgtgtcggcctgtctacgcactacacgaaggcttagttggtcttctttcgtctagtgggcgcactcaggtgcgtcaccattctgccgtttccctcgcccttgtcctgtccgaaagaaccgtccgcaagctgccctgtggtcgcgctcaccagctcttcgagccg

SEQ ID NO: 5210 - DNA, 2954 bp, Homo sapiens
acgtcaatcacagtggacgcagcaccgcgagcggaaatgcggagagcatcggggctccgcatgtggggcacaatgaaacaagagcagccccggccagaggtccagtaaagcggaaagacggtcccgcccgcacacccctccggaaaactgaagcgtctcctctgacccccaaggtcagaaagatttattacttccttcgagagggcgcagccacagacccactagagagggcgggcagggtgtcggaagccagagaacggcgctccgcgtcctcccaccgctccagggcgcagaggtgtcctcagtgcccggagaggttggcagtgtcggccccgagggaagcgtggagcggacggccgacaggggatttctgcccaaacttcatcaccaactctttctgagagcaaaaacatggggccgagtccggcagctgcacgcagaatccaactctctggcagctctcggcaccgacgagctccagatcccgcgttcgcatcccggcgctttgcgcgcagagctaagccttcggacccgtggactgcagcccccgcgcgtcgcggtaaagcgggtcgcgtctccagcccccgaggcgcagcgacggtgggagccggctcggcgttgggggcgggggcggggccggcgaagggggagggctgcgcggcggaggggaggagccgcggcgacagacggcggcgcgcaccaaccgggcgccggctggcaggagccgcgcagaggctggtccgagcgcgttgcgggcgcccggcgtaaggggagtcgggtagcagcatcctcctgggcgccgctttcgcgcggcggcggcggctgcggcggggtctttctttgcttaaatacctcgttggccagaagcgctggtaccgggggcgggttgggtcgggtcgggcagtgctgcacacctgggtttccttgcctagagctgtgtgttcggggtcctttggtccagtcggaggctgcggagcggcgggggttgcctgcgctgtccgcccgggcatcctcccggtgatggaagcagccgccgccgccgctgcggggtcgcgctgtgccccatccaccgctgccagagaggtgggaaaattcgccgcacggaggccgaaagcgagaggggctgcgccgctatgccgggagctgagtcccatataagccgcccccagccatcgcccccagccggcttcgttcccctgagcgagacaggaagctgcggtcccgagaaagcggaggagacgtcgctggagccgggaggcgccgggttcggcggagcgcggagcggggctctgggccgcgtgaaagtttttcttcccgagccgcagggcgcccgctgcccggaaactgcccagggataagtcggccgactccccagacccctcgaaggtgcggggacccccagcggaagcgagagggagcgaaatcgaggaacgagtgacagccggacagtccgccgggcggtgatccggggccgctcccgggcgcgccctcggctccaggtgagcggaggaaccgggcagaaccgagggtgggcgttacttaggaggaggaggctgggagggagattggggcgcatccgctcactccgcttcccctcgcaggtcctacccggagccgctgccatgggagagccagccttgggcgctggggaccagccgccgcgcccgcctcggagtcgcggcccgagtcccggcgccagcagccagcccgctgcgtccccttcccgggctgcagggctgcctccgccgcgccgccggcccggattgtgcctgtgatgagccgcagcccgcagcgagctctgcccccgggcgcgctccctcggctgctccaggctgcgcctgcagccgcgccgcgtgccctgctcccgcagtggccccggcgcccaggacgccgctggcccgcgtcccctctcggaatgaaggtgttccgtaggaaggcgctggtgttgtgcgcgggctatgcactgctgctggtgctcactatgctcaacctcctggactacaagtggcacaaggagccgctgcagcagtgcaaccccgatgggccgctgggtgccgcagcgggggcagccggaggcagctgggggcgcccagggccgcctccggccgggccgccccgtgctcatgcccgtttggacctccgcactccttaccgccctcccgctgccgccgtcggggcggctcctgcagccgcggcagggatggcgggggttgcggcccctccaggcaatggcactcggggcaccgggggcgtcggggacaagcggcagctggtgtacgtgttcaccacgtggcgctctggctcgtcgttcttcggcgagctattcaaccagaatcccgaggtgttctttctctacgagccagtgtggcatgtatggcaaaaactgtatccgggggacgccgtttccctgcagggggcagcgcgggacatgctgagcgctctttaccgctgcgacctctctgtcttccagttgtatagccccgcgggcagcggggggcgcaacctcaccacgctgggcatcttcggcgcagccaccaacaaggtggtgtgctcgtcaccactctgccccgcctaccgcaaggaggtcgtggggttggtggacgaccgcgtgtgcaagaagtgcccgccacagcgcctggcgcgtttcgaggaggagtgccgcaagtaccgcacactagtcataaagggtgtgcgcgtcttcgacgtggcggtcttggcgccactgctgcgagacccggccctggacctcaaggtcatccacttggtgcgtgatccccgcgcggtggcgagttcacggatccgctcgcgccacggcctcatccgtgagagcctacaggtggtgcgcagccgagacccgcgagctcaccgcatgcccttcttggaggccgcgggccacaagcttggcgccaagaaggagggcgtgggcggccccgcagactaccacgctctgggcg

SEQ ID NO: 5211 - DNA, 2954 bp, Homo sapiens; identical to SEQ ID NO: 5210

SEQ ID NO: 5212 - DNA, 885 bp, Homo sapiens
gcgcacgcctgcgtgcccattctccagagttcctggcctcgcgatcgtgcactgatttccttcagaaccccaggcccgctctggacgtggaaggcagccgtgccgtctgggaaagtggagccgagcccgggacgctgtcggcctaaatggaacgccggccccggggcccgctccccggcgggttcccgagctaaatcctccaactgttccatgacgtcatcgggccccctccccctgctccggcccgcgcggccccagcgtggcgctaaggagtgtggcggtccccgcgcgcaccgtgggccatccctaacccaggacctggctagcaggctgccctccgagccgaggctgcgctgggcggaaccagggatttatagcccggagtggggctgaaacagagctcctggcccgagcagagagcgtgcacacgcatgaaatcgtgctcctgggtgcgccggcggccaggtgcccgatgtcggtcttggaagcagcgccggagtccgtctgaacccaggcccgggaggccagaggctgccggccacgttcaactgtgtcccccttgggaagacaatccccccagttctggtttcttcctgagccacgggtggttggttggtttggtggaaggcaggtgcacaggtaacagagacaaggttaggaggcaaagcacatttatgtgcaaatgagacgcgctagggaacttgtaatcctctgcacccccgcccttgatgtctcgatccctacaatcacagaattctaggcagaggccgccgacttctccgccctcgccaagagggacccggagcaccgaagcttcccagccggtgccggcgtttccgcgccctccttctctcctgcgccgtgacctcaaaagggcggcgggcg

SEQ ID NO: 5213 - DNA, 2174 bp, Homo sapiens
ccgcctcaccggcctcttgcggccgctgcagaagcgcactttgctgaacaccccgaggacgtgcctctcgcacagggagcgcccgtctttgctggggctggagcggcgcttggaggccgacactcggtcgctgttggactccctcgcctgccgcttctgccggatcaaggagctggctatcgccgcagccatagctgctcagcgagggcctcaggccccagcctctactgcgccctccggcttgcgctccgccggggcgagggcaggacctgggcggccagggaaagggcagtcgcggggaggcagtgctaaaatttgaggaggctgcagtatcgaaaacccggcgctcacaaggttagtcaaagtctgggcagtggcgacaaaatgtgtgaaaatccagatgtaaacttccccaacctctggcggccggggggcggggcggggcggtcccaggccctcttgcgaagtagacgtttgcaccccaaacttgcaccccaaggcgatcggcgtccaaggggcagtggggagtttagtcacactgcgttcggggtaccaagtggaaggggaagaacgatgcccaaaataacaagacgtgcctctgttggagaggcgcaagcgttgtaaggtgtccaaagtatacctacacatacatacatagaaaacccgtttacaaagcagagtctggacccaggcgggtagcgcgcccccggtagaaaatactaaaaagtgaataaaacgttcctttagaaaacaagccaccaaccgcacgagagaaggagaggaaggcagcaatttaactccctgcggcccgcggttctgaagattaggaggtccgtcccagcagggtgaggtctacagaatgcatcgcgccggctgcggctttccaggggccggccacccgagttctggaattccgagaggcgcgaagtgggagcggttacccggagtctgggtaggggcgcggggcgggggcagctgtttccagctgcggtgagagcaactcccggccagcagcactgcaaagagagcgggaggcgagggaggggggagggcgcgagggagggagggagatcctcgagggccaagcacccctcggggagaaaccagcgagaggcgatctgcggggtcccaagagtgggcgctctttctctttccgcttgctttccggcacgagacgggcacagttggtgattatttagggaatcctaaatctggaatgactcagtagtttaaataagccccctcaaaaggcagcgatgccgaaggtgtcctctccagctcggcgcccacacgcctttaactggagctccccgccatggtccacccggggccgccgcaccgagctggtctccgcacaggctcagagggagcgagggaagggagggaaggaaggggcgccctggcgggctcgggatcaggtcatcgccgcgctgctgcccgtgccccctaggctcgcgcgccccggcagtcagcagctcacaggcagcagatcagatggggattacccgccggacgcaaggccgatcactcagtcccgcgccgcccatcccggccgaggaaggaagtgacccgcgcgctgcgaatacccgcgcgtccgctcgggtggggcgggggctggctgcaggcgatgttggctcgcggcggctgaggctcctggccggagctgcccaccatggtctggcgccaggggcgcaggcggggcccctaggcctcctggggctacctcgcgaggcagccgagggcgcaacccgggcgcttggggccggaggcggaatcaggggccggggccaggaggcaggtgcaggcggctgccaactcgcccaacttgctgcgcgggtggccgctcagagccgcgggcttgcggggcgccccccgccgccgcgccgccgcctccccaggcccgggagggggcgctcagggtggagtcccattcatgggctgaggctctgggcgcgcggagccgccgccgcccctccggctggctcagctggagtgctagctccgcaggaaactcggggcccgggcgagagccaccgagatggcaggtgggacgcagagcccgcggcagccagagttcctcccgcacggcccgccgacccacggaagagcgaaagagcgcccaggtggggccgagctgggggccgggcccctggagcgctgggaagcacagcgcg

SEQ ID NO: 5214 - DNA, 873 bp, Homo sapiens
ccggagagctgccaccgaccccctcaacgtcccaagccccagctctgtcgcccgcgttccttcctcttcctgggccacaatcttggctttcccgggccggcttcacgcagttgcgcaggagcccgcgggggaagacctctcgtggggacctcgagcacgacgtgcgaccctaaatccccacatctcctctgccgcctcgcaggccacatgcaccgggagccgggcggggcaggcgcggcccgcaaggacccccgcgatggagacgcaacactgccgcgactgcacttggggcagccccgccgcgtcccagccgcctcccggcaggaagcgtaggtgtgtgagccgacccggagcgagccgcgccctcgggccagcgtgggcagggcgccgcagcctgcgcagccccgaggaccccgcgtcgctctcccgagccagggttctcaggagcgggccgcgcaggagacgttagagggggttgttagcggctgttgggagaacgggtcacggaaacagtcccttccaaagccggggccatcgtggggtgggcgagtccgccctcccaggccgggggcgcggaccagaggggacgtgtgcagacggccgcggtcagccccacctcgcccgggcggagacgcacagctggagctggagggccgtcgcccgttgggccctcaggggcctgaacgcccaggggtcgcggcgagtccacccggagcgagtcaggtgagcaggtcgccatggcgatgcggccccggagagcgcacgcctgccgcggtcggcatggaaacgctcccgctaggtccgggggcgccgctgattggccgattcaacagacgcgggtgggcagctcagccgcatcgctaagcccggccg

SEQ ID NO: 5215 - DNA, 2174 bp, Homo sapiens; identical to SEQ ID NO: 5213

SEQ ID NO: 5216 - DNA, 510 bp, Homo sapiens
gcgggcacctcgcacgccacgcaggcgttttcccgatgagctcctcctcaccccacagcccagggaaggtgcggggctgcgggcgcagagctgcacaagtagggctgcaggctgggccaaagccgccttgcggggaccgacatgaacccgggtccctcaccggaagggaccaaggactgagggctgagcggcggcagcggagactccgttcgcagactccgtcccgccgccgccatttcccgccggttcggatgaggcctccccagccttgggacgccctgcccccacactcaccatttccccacttcaggggtgtagcggagtctcagctacgaatcatccaatacccgcaggtcacagagcgacggaggctgaggctgtgaccgaatcaccgacgcctccctgaggggtgaaagcacggccgtggagaccctaaccgagctcacgctggcgcaaaaggcaaaagccgcgccagatcccggatgccgccccctcctctccggctgcgcg

SEQ ID NO: 5217 - DNA, 511 bp, Homo sapiens
ccggagcctggggtcgggccctccttacctgcgtgctgctctcgggccccgccccgctccgccccggagggatcctcaggccgggcccagacctaggagccacctggggatcccggggtggctgcgcgccgagggggcgccagcggggacgtgagctggcgccgagacagcctcggccccccagcgccagggccactgccaggagacccccggccagcacccacgtggggcgcccccgggagcccgaggggtccatcgcctgtcgggacccgctacctcaaagcggcgggtgccgccgagtcgctggagcttccggaccccaggcccgccccgccgccgagcatgctcagtgcgagccgccgccgaaagttttctggaacaaacacccgcatctggggcttggcgggccaggaggtgccggacgggcgtgggagggggagagcgagttggcgcggcccaggcgcccggcggccaggcctgggtttgcttgcgcccaaaccgaatcagagcg

SEQ ID NO: 5218 - DNA, 417 bp, Homo sapiens
ccgcgtcgccgccctggcggggacggtgcagcaggcggcgggatgcggcggggcggcagcctgagcgccccggatggcccgcggcggggcggcctgcaagagcgacgcgcggctgctgctggggcgggacgcgctgcggccggcgcccgccctgctggcccccgccgtgctgctgggcgccgcgctcggcctcggcctcggcctttggcttggctgccgcgcgggccgccagcgcacgcgacaccaggtgggtcggccgagcagacagcggcggggcggggagcgcggggcgcgtggcttctgggtcctgcgggcccggagccccggctctgcgactccttgagcctggttgggaacttcgcacgcaaccgcttaggcgtcgggttccccttctgctccaggagggaggtggcggcg

SEQ ID NO: 5219 - DNA, 1748 bp, Homo sapiens
acggaaatatccgaatcggtgaaatgtaaatcgtgtctactgcataagggaatcgtgcagggagagccgctctctataaggagttaaccagcgcctgccccggacacccccgcggggcctccagcggggctcaaactggcggcggctcagcagggggcgaggggtgctgggaaacgccggggctgcgaacttacggaagaaaatgtactcggtgtagctgctccagatcttgtcgtcgcggtactggttgacgaaggcggcggtgcccgaggagttacacgccaccatgtggaagccggcctcggacaggcgatcaaaggcctgctccaagtaggtgaacttgaggtagaagcgggacgtgtacttctccggctgccggtcggggtcgcggctctcgttgagcgtgtccccgaagacctccttggccagcgcgatgcgcccgcacaccatgatgcgcgccacacgccggaatttggcgtcggcctggttgtcgcgcacggtggtgtaggagccccggtagcccagcgtgaggaagcccgagcgcttgtcctgcgcgccgccgccgccgccaccaccgtgcgctcccgggcccgagggcacggcggccgccgccccgcgcagcagcagcgcgtcgctgctaccctgcgagacgttgtcctccaggtcgctctggcagccctcgtcgttgagagagttctgcttggtgaccttgggcgacagcagcttgaccaagtcggtgagctggaaatactcggcctcgcgcagcagccgctccttctcggggaagtgctccggcagcgcgagttgcttgtcccgcagataatccagcacgtacctgaaaaggaagccgtcccggtcgatgaagaagcgcgcccggctgtccctgggcagctcgccccggcgccgggcgccgccacggggactagagggcgagaacatgctggccaaagtactgtccgggacgctgagcagcgtcgagtgcttggtcacataaacctggccgcctacgttcagctccactacttcagggaagggcgagggtgcgcagggccccggggcggcggcggccgacgcgccgggcgagctggacgaggaaaccatctcgctaatgggcaggatggtgctgccgccgctgcccgtgtccttcagagccatagtccccccgccgccggcccagtgacccgagagagctgcactttctcgttcccggagcccgcgccccagccctccgcgtgctcctggcgctctgcgccctcggactgggcggcgcgttcctccgaccggggcggccccgctcagggttcggggcagcggcggcgtcggcggcgcccgagctccatcggaggagagacgcgcgagagaggagctccgccggtgcggcggcggcaatggagaggcaagaaggagctgctgctcctttggggcgagggcggggaagtgtgagagagacttgcgagaggctctagggctgctgctcggctctccgtggggagggcgggaggaggggccgaagcaaagaaaactcgccgccccggcagcttgcaagcgtgccgcgaggccggagcgccgacggtggcgctaactactcctggcagcacgggaggaggcactgacgtcaagccccggactgggacccgagcctcagctgtcatttaaagagataggctgcagccgcggctcccgggctccgacgctagggggcggggccgagagccgagcctgcaagaggtgcagctccccgacccgcg

SEQ ID NO: 5220 - DNA, 1748 bp, Homo sapiens; identical to SEQ ID NO: 5219

SEQ ID NO: 5221 - DNA, 648 bp, Homo sapiens
acgaaacgctgccacaccgagcgaatgcaacgcgtacacacgtccacactcgaacagcacaagcaagagaccggctgggtgtggaatagaggcgcacatcgcgcaacgcattcacagcatgcacacgcgcgcaccccgaccccgtccctccccgcgcgccctcacaccccggcgcccaagacccccggcccacgaacctcaccagacagccgggtaactttccaggtgcgcagcttgtcacctcggcgcggccgcccctgcgtctcagcgtcctctcccacgccgccctccccagccgcctgcggcgccggagcccagcgcaggtcagctcagccagccccgccgtgcacacggtgcgcagcgtgggcccggggctgccggctcagtcgctccggctacgtgtgagccgggggcgcgggttagcgcgatgcgggcaggagctgcggcggcgtcggtgctgccgcctggctccgcggcgggggccggtgcagaggagacacgcagggagggagggaagagaggagggaaggaggagggagggggtcagccggggctactgcctggatagttgggcgccggcttccctaaaggtggggtcacccgcgcccgcacgcacactagcccgaacctttactcccgacacagccg

SEQ ID NO: 5222 - DNA, 863 bp, Homo sapiens
gcgcacaggaagggcggaggcggcacccgggggggactgtccccagaggaggccgctgtgagccggcgacgcgaggctgggggagtgggaggcaaacccgctaacctgtcgtcgaatggccactcccagttctccgctcacgagggtggaaaggcagaaggcttgaaggcaaggcgtgagggagcgcccaggacgctctcggaggggccgggccggggtctgcgctgcagcccgcacgcacctcacttccgcgtcgcggcgctcggtcgctcgccccctctcttgggccccttctggtcgtcgccgtcctcctcctcctagtcctcctccttctccttctcctcggctctccgcccccaccgctgatttgtcagcgcttctgcccgcccctctcccggcgctcgctgctttccctgcagcgtgctcctcgtccctatctcggatggggatggggcagggggcgcggggtgagccatcaactccagccgcctgcctggccgcgcaaggcgggaaagtgggggcgcttttgcgcctcacgttaagtttagggtcacgagcactcttgtggagatcgggagcggttgggctagggatgatgcctcttcctctttccccttcccctcccttcttgtccccgcctttcctctgggtcctcccggggaccaccccctacccctcgtcagagtcgccctgggagagccgagggcctgagggtcgaccaccaagggcagagcctatcccttggggagctgctggaggagacaggcagcgccgggaggtggctcacaccgcaccgccgagagcgctttgccctcgcatcgctgaaatttaatcacggtcacaggttacaacgttaggggtcg

SEQ ID NO: 5223 - DNA, 1288 bp, Homo sapiens
gcggattcgagagcggcgatcctcgcctggaggtcgttggttttcacacccaggtacaggcaagacaccacggccaccactgacaggagggccgccaggacggcacacgggggcatggtccgggcacaatgctgttcggcaggggtcgggtcctcggatctgggctcccggccccctcctttccctgcgtgcttcttcagcagcatcgtggcggggtcggccgtctcggcttcgcttcccaccctctacacctcaaataatcctaaaaggaaagaaaaaggtcgattcctccaaagttcagtccctgtggctgcacaactagttggtggagtcaagcccacgagcggatacggacccctgccttgctcagcgtccagacccgcaggcgtgcaccatccccgctttcttctctcctcccagctggaagtgaaaagcaccctccgtccggggactgggtggcggtggggtaaaaagcaagacgaaacccacccagacagctcttccgactcccagaggaccgacacctctttcgagggccccaacagtggccgctcagggtccgagggcaacggccgaggcgccacgcggggccgcggctcgccctggccacggaggaccggacctgttgcgcctctgtgagtttgccttatttctacctactcggtgtctttcggcacgccgacctgtttcccacctgcattcagttcaaggcaaaaaggctgtgagagcacgctacagcgcagcgcgaaaggggcgactaaggtggagaagagagaggaaaacgaaataaacccaaggaaccaatgctactcgcgaagccgaagtcgcggctgcccgaaggatctccgcagccccgcgtgcgcgatccttaaatacccttcgcgatgctcgcgtgagtgtgtgtgtgagtgtgtgagtgcgcgcgcgctccgagcacgacgtccctcccccgaccccctcccggcgcccggcgtccggcctgccgctcccgctgctgcgcgccccccttccgaaggcaaagcaggagcccgccttattatcataatgtattcaccttggcccagcccgcgggccggcccggggaacccccaagggaggcgggaagcttgggtgggagcggggcaggaggtctgttattagcataatgtatgcaaatagctggagcggccaccgtgattggagaggagcctggcgacccctccccctgcgcggagtaacttcagcatctccgagggccacctctctggcctgggccggggccgaagcggggtcggctgcgcaagaggcg

SEQ ID NO: 5224 - DNA, 1275 bp, Homo sapiens
acgcggagcaaaacttaatcggtccagggaacccagacacgtcttccgcgccgcacggacttcccagaaggagcctggaggcaggcgctggatccctctaggcacctccgtccccgccggctcccctcccccgcgcccgctgggccactcacccgcgtggggcatggtgatggtctcgttggtgttggagcccacgttgaagatgaccacggctgaggcgttctgcaggaacgcgttccggatcttatccctgtacgtgcagttgcccttggggatgagggctatccagttcttgccgcgggtcggggcggcgaacttggtgttggggtcgcaggccaggcggtcgtgggccgagctggccatgaccacctccccgcgggcgtcctgcttgggcgagtgctctccgtagcgcccgcactccgtcttctccgtgtgcagctccgcgccgccgccgcccgccgccccggccccggggtccggcgcgggctcggcgtaggtgatgttcacgaaggcggtgtaccattcctccttctcggccacggtaaagtccaggcagagcagatgcacgaaacaaaaggaaagcagccatgttgagagagccagactgcagcacgcttggatgagagacattgccatctttatccgccggggccccctccccgcccccgcgccctccctccgtcccgtccctcctccccagccccggccaaccccgggccgctgcctctcctcctgctgctgctcactcccgggccggaggggccgcggccgggacgcgcagccgccgcggggaccggattccgggcgagcggatggcgctggccccttcccctctcagctgtagcgcggtggttgcattttgcttcttgggcgcccggggggcgcgggaacagagggcccgcggggcttgcggaggagtcctgctgccgagcgtcctgctccttcgcccggcttcgccttctctcataagggtggccgggggcccacgaacttgcagggtggcggccctgcgccctccagccccggcggggacgggcacgattgctcgtagtctggggtgctgcggtgcggggtgctgcccagggtgtcccggccgccgccactgagcgctggggcgcgcgaatccagctgcagccgctgctgccctgcgccggttccctcaggctgcgggcgctgcgctcctgatctcgccggtggctgcgcctgggcacgcacttgccgcgggcggggcgggcttggggacagtgggagcgagcaggcagagcggagtaagcg

SEQ ID NO: 5225 - DNA, 1071 bp, Homo sapiens
gcgagcggtggctcgaccccgggtgtggcaggaaggggtgccccgcgttccagagccagtgccagtccctatcctcccgggaagccgagactcagggggaacaggtttcccagagcccagcctgcagggacgcggagggcaggagccgccggcgaggagcagccaacttgccatctctggcggctgcacttctcggcggctacaggttgcccgacagcggactccagggtccccgcgacggcacccagagtgctcagaagggaggccggggccggggtgggccgggaaaaccgagggagggaaggagcctggagaagctccgtttaggcggggagggggcgacccggggcgcatctcccgaccatgacccccacagaccttggcgccgcaacctgcgcttcttgaggccgaagatgcgcactttggagaagatatccaccaggttgccgttgcagagcccgcggttcttgctggggctgctccgcctcctgctggcagacggccggtcccagtgctgctcccgcgcctgccgcttctggcggatcaagccgctagcgatggccgcggccatggtggccccgggaacgggtccggggagggagggcgcgggaggacggcgagccgggggcaccggaggggaaggcggcggcgcagaccgtggctcgccctcggggcagaggagggggtgccaggcgggactggggagaggggaaggggggctcagtcctgaccgggacccatcgccctctccgcggggcgcggggccaggcgcgcagatgcgcccagggcgcagccggacgatcccgggaagccggacgtcgtggccgccgccgcttggccacgtccgagtggagagcgggaccgcggctgcgggcgctgctggtcaccgctcgtcgcaggaaccccggcgggggtcgccaccgccactcgcgctgccttctcgccctgcccggctcccgggcgggaggtagagccggccggcggctccccgggcgccggctggagggcgggtcccggcagggtctctgcgcgtccgtcggtccgggtcgcgctgggcaggactcagcgccg

SEQ ID NO: 5226 - DNA, 694 bp, Homo sapiens
acgttcccgaaccccggaccttagctgtcatttcacctgcgtcgtcccggacgccatttggctgttgacgtggttccgagccagcaaataacgccagcagccctcccagatccacgccggcccgtctctccgccggccccctcctcgcagtggtttctcctgcagctcccctgggctccgcggccagtagtgcagcccgtggagccgcggctttgcccgtctcctctgggtggccccagtgcgcgggctgacactcattcagccggggaaggtgaggcgagtagaggctggtgcggaacttgccgcccccagcagcgccggcgggctaagcccagggccgggcagacaaaagaggccgcccgcgtaggaaggcacggccggcggcggcggagcgcagcgatggccgggcgagggggcagcgcgctgctggctctgtgcggggcactggctgcctgcgggtggctcctgggcgccgaagcccaggagcccggggcgcccgcggcgggcatgaggcggcgccggcggctgcagcaagaggacggcatctccttcgagtaccaccgctaccccgagctgcgcgaggcgctcgtgtccgtgtggctgcagtgcaccgccatcagcaggatttacacggtggggcgcagcttcgagggccgggagctcctggtcatcgagctgtccgacaaccctggcg

SEQ ID NO: 5227 - DNA, 694 bp, Homo sapiens; identical to SEQ ID NO: 5226

SEQ ID NO: 5228 - DNA, 1424 bp, Homo sapiens
tcggcgggtacgttggggatgcactcgcgcagttcggcgaaggcgctgttgatgctctgagtcctgcgccgctccttgcggttggcggtgcctcggcgcttcaccgggcgcggcccccccaggcccgggggcccggcgcccggcggcacccccccgtaatgggagtggtccaggccggcggcgccgctggcatactcggggctgtaggacagggccatgctgtagtcggggggcgacatctcggggtggccgatgagccagccatggaagtaggggttctcctcatggctgcagcggctggcggcggcggcggcagctgcggcggcggcggcggcaaacgggtagccctcgtggtgcaccaccgggtggtggggaaaaccacctaccagactcatttcgccctccgcgcccctccacgcgccccagcgtgcgcgcagccccgccgcgccctcggcccgggcccctgcctcagcgctcggcgtcctcccccaccccccaccccccagcccccgggcgcccgggcccgcccggcagccgcagagggggctgctgcagcccgggccccgtccccccgcctggccagccgggcccgcctcagcagcgctgcggccgccggctccccatggggcgcggcgagctggtcctggcaccgtgcgcccctggccgccgccgccgccgcctccggttcccgccttgctccacggcccgcgcttcggctcctgcttcccgggctgctgcgcggaggcagaatcctctcgtgctcatacaaaggtgccggggctcccgcgaggctggtacgcggagtctcgggaatccaagcccgggccgcggtcctggcaccgaagctaacccggaatccaggggcgagtctgagccgcggctggaggagccggtccagctgtgccggggggcggcggggtcgactgctcactgcaaagctacctccgtgcgaccctccccttcccgcctcttcccctccccccaccagcccgatctgggttcttgggcgcttattgttttaatgaaatttttggttgttgttgttttggtccttaaatgtgattttagctgcgagtaacgtgtcctcgctcctctcgcgctctctcggagggttttcagagaggtctcagtgcatccattttctcagatcctctcctttcggggcaaggatctggggccctgaatgagccttggagctcgaagaccgcggctcgggctctcggagggctctgcgcggtggccgaggaagctccggggtgacggcggtggttctcctgggctggacgacgtgaggggagcaagcggattttcccagcaagatctccatgtacagctacatctttagggccgctcgggttaatatatgtcgtcagaggctcctcacgccaatcccggggcggcaggggcggcgcctcgagctctcg

SEQ ID NO: 5229 - DNA, 1215 bp, Homo sapiens
ccgcgcaggttctcgggtccgccgcagaccctaacgcaaactctcgggttctccgcaaaccctaacgcagacctaccgtggcctcgcccgcgtcgggctccgcgtccgagaggtcgagtccggactcgaaggcggcggcggcggcgggcgcctcgcgaggacccgggagcagcgcagcggcgagcagagaacacgccacagagaagaagcccagcaagtgcatggtggaaggaccgggggtgggggaccggtccgctggcgggggcaggggtgggggcgcgggcgcccctgcgaggccgcgggcccctcctggtccctctcccccgggctcctcccggcgaccccccctgggcgagccggaggcggcgggagcgggtccggggctccgcgttcccaactttgcagggcgccctcccagccagtgccggggaaaggcggcgggtgtcaggtaaaagcctcacaggaaaccggacatccgagctccccgcattcggagcccgcgaggtgaagcgagggcgagggaggacgccgccgcggtccgcgtcggtgtagctttttggagaggcggggcgggggacaccagaacaccccgcgatgttcagcccctccaaacccgccagagccctcgtccccctcctccctccccttccccgaagtgagaggagccgggccgcgggcgctgcggcgggggcgctggcggcggtgccgggggcgggaggagggcggcggggcggctggcggcggcggggcccgggagcgccgcggcgcaggatcctccagagcgcgccgggctgagcggcggcggcggcggcggcgggcgcaggggcagggcatgactgacgcgccctctgcctgcgcttatgtgagagaaagcggccgagggagggagcgtgccgagcccgggctgccctcccctctcactctccctcggaagccgtctccctggagctccccgtttccctcgcctcctccccggcggccccacctcccccggcccccctctggatctctccctccccgcccctgtcccctgcggggagcgggcggccggaggggcaagttcagtcccggggctggcggttggcgggaccggctttagaggtgatgcgaccaccctggaccacgtgcagcggggagaaactgggcaccgtggggtggagggagcccccgctttatcctcggccactcccgagttcttgtcctccctcccgcacg

SEQ ID NO: 5230 - DNA, 1184 bp, Homo sapiens
ccgtcttctctccccgggtcgcgacactgactcgtcaacgttaatgggggtccgcgactgctgcggggacgagggcgcagagcagcccccgccacgggccggtccacgcaggggccgagaaagtggcggagaggcggtggccgaggcccaggggcgagcgcgggctgagctggtccctgctgcgttcacgagcgacacccaccccttcgctgcggacgccccgcgggcgccaggctgggggccctgcgaccgacccctcccgcccccgaggtaccgccgggcccgcctggcaggcagcgcgtcccgcgagctggagggccgagtttcgcggggccgtggggcgtgtgggtgaaggcgacacctcggatgcgggacgcatgaatggtggcagagcaggggtcgggatccgttcatgggttgggagagagatgcttttgtgagcacgggaaagtagcgctgccggagaacagctctgaggcgggatcaaaagccgccggcgaagccccgccgaggaacacggccgctgcccggggcggctcgcgagcgtgcgtgtgtggaggggaggatgccgccccgcggggtcttcggagggtgccgggagcgggttctcagtgcagttcccccgtcttcgctgggggcacggctgctcacaggccccggcccgcgtgtgtggagcggggcgagggggtgaggcgagggggtgaggcggcggccgagccggggcgctgggcgcggggctggcgggaggcggcggtggcggcccggcgcgaaggggttaagcggcgcaccgccccctcggcggccgggtgtaaacagaggagcctcagcctatcatgtctggccgccgcgcgcagcccgagcccggagccaggcgctgtaacacgatacgctccagacccaggcaacttggcagcgctgggctcggttcctcacggccacagcgagggcgcgccgcggcaaggtgggtgagcggcggcggcggcggcggcctggggcgggctggcggagcgcggctcccggtgaggctccccgcgcggcagggtcgctcgctcgctccggggaccgcggcggtggcggtggcggtggtggcggcggcggcggcggcggctccgctcttctcccttgtggtgtcggaatgggaggaggctcggcgcgggtttgaatcggtgcggaggcaacattcg

SEQ ID NO: 5231 - DNA, 5820 bp, Homo sapiens
gcgagtagaaggcggacgcctccgagccgtaggtcacgtagttgccatagccctgcgatccgccatagggacccccatagacgcccagcgccgcggccgagttgagctcgtggcgcgcggtggccagcagccggctctcgtagaccgggcagtagaccggcgcctgggccgaggcggcgggcccggagtccgccagcgtgcggcctccggactcgcagcacgtgctcagggagttggtggccatcaagaactgcagagagaggccgcgaggactggcgggaagccgggctggaggctggggccctgggccttgccaatcccgcgcgccgcccacgagggcgtgccccgagtacccccgggcctcccgccgtccacaccaggatgctcgcccctttccactagcttgtgcgcgtctggcctcctccgccacgtggggcccagccgagcacctacacccttccccggagggtttccaaggcctctgacgccatttgcgcgccaagcctccttccccaggggttccttggggtcctaggactcccctggggcacagcctgagccttgtggttcaaacatcagggaacccgggcccggcccgtcggattttcttagcgcctcggcctttccccgggggtttggggagcaggggttgggcgtgaggggcgcgcgacccaggccttgctagctcggaagccgcaggcagtcgtaggtcggacactccccaccccccgtccccgccccatccgccctaccggcacctgcggtggcctgggcggggcggggctccgcttacctggggagccgaggagtaggggtatccaaactgcgggtaggacatggcgggcgcggcccggggcggacgggcggggcctgcagggttctgcgcgctggggccggcgtggcgcggccactgctccggagctgcaggcttctaggcgctgggagggcgaagcaggagagccggttagtccatccccgcgctccgcaaacttttctaaccgggtaacaaagtgagcagcggtggccgccgcgattcctttaacttcgcattccggaggctcgagggggctctgggaccgagcggcctcgcagcggcgacagaaatacatattttacgaaaaagaaaaaaaaaaaaacgagtcgcgcgaacccgtcaagtcagatgtgcgcggcttgaagcggaggaggctctgacgtcagccccacctcgcgcagcccggcctggccgcagactcgccggtcactcgccggcggctcaggccgggaggggccaggacagtcccggccgcgcggtggacggaggggccattcctccgggcgttagcaaataaattccatccgagtcaatatcgcccagcgaacggtgtttctctttagtcacccgagaacgagaggcacttttaattagaaattaattaatgagcagctgctccttcccgccccactgtaatcattcgtctcaattacaaatgagacctatgaaaggacacgctgaagatgtaatcaacagttaaaattagcccggcgctgcgcaggcggccggcccggcctcgcgctggcgcgctctgctccgagtggcaggaaggggctcgcaggcgccccgcacgcgtctcgtcactattgtttaatcgagaatcagcaacgcctcccgccggtttccaccctacgccggaatggactttcagaacccactgcggccgcaagacagcccgcaagagctggtcaaaatgccctcaggtgcgtgggggcttcggggccttagttggagcccgacaccctgagactggcggcccgagggctgtagggccgccccgggcgtgcgcccaccggctttgcacctctgggcagccgagtgtcgcggagaacgccccatcttctccaccgcggtcttttaagttcccgctcagcccaccgcccccacctcgcctccccgactttcctccccgatcccctttccgccggccgtgctccgccggcttccccctgcccctcgcggctaagccggggactgccgggcggccctgcgcgctcggaagagcaggttcctcaacccaggccccggcccctcccgctaagctcgtccctcccggcgccccgcagggctggctgcgagggagggggcgttgggtgcctggcggaggcgccctcccctgtccattttgcccagctttctgtctggggcgcacggagcaatcggaagaggggaccgagcgcccaccccaggactccctcggccagtaccctccctgggaccttgcccaagttcaaagcggaggccagtgagcaggcggcaagggggcggcaagggggcgcccgggccatcccgaacccgttccccgccttctgcgccatcgccctccgggaccgggactcgccccggttgccctcgccccctgggccggcctcccgtggtaagttgggaaggaagccgtgcaaggcagcgttgtgcagacttgctcagaaagattcctgggttcagacctgtgaatcgccccagggtcaccctctaattaatgatgacgtcctcgccctctccccagctgcaagcctgcctcccagaaacgaaatctgcctgctcttttgacagctcggttgaaggtgattgatgactatctggagaccacagtacacatcatataatatctgctgcgtaattgctttaatttacagatgaaaatacgagttctccgatcgcgttggaccggagcgggccacgtccgagctgcttgcagagggaaaccatcggaaataatgaatagccgctccatgcaaattattcagacagtttagcgtcggtagccgcgagaaatatataaagaacacgagtcaaatgacattaataattgtttctgaattctgtattgatttcgcggcaggccgcgtttctttctttctcacctgaatcgctaatatcaccttcctgtaaataataagaaactagccaccggggtttctcgctagaaatgaatctctcaacccctttccctctcctcctgctcctcccctcccccaccctccttcctcccctctcccaccctccctcctccccactccttgcagttttctggtttttcccgagcatccttctacttcccattatttattgtttacaaactactcgctctctccaggtaatgaggcccggctgaaggaggggtgtgagcccagccgggccaagggctgggatggggagtagagacccccagaggggaggcattcagctgtggcttgtcctttcctcacctatactcggggacctggcctcggcgactgtgagcactccgccggctgagggggagagccagggcccaggggcccagccacctatgccctgcacctctgggctctagtgcaacagctcagcccacccagacctgaggctggtgcatttccttccttccagacccggcggggcttaactggagccgaagccccagaacaggcggccattcatcttctgagcagagtctgggagaagcagcctccacttcccagggcagccagtacgtgggggccctttcgggggcttcctttgaccaccaccgccaccttctcctgttctcttttgcctttccagcctgtgtgcataaatcgacgctccagtccccaccagcgggcgaccctttctccgtgacccagaaacctggcctctgaatcggctttcccaggccgccgcacacacacgctccacttcctgcccgccagcaggccccagcgcctggggtccgggcccagtcacagtcaccctgcctcgggaagctcgcaactgcccaggaggcctcctgacccgcccggcctcacccaggccccactactcattccaggacacagggtcaatccagcctgtggattggcgaccaccgggacatctcactgaaaccctgtagcctggcctaggcccgcctgcccaaaccggggattctcactgggccacccttctcccatagataatactggaatattttccaagtgccttcaccaaaaggccaagcctggagcggaggcacccagtgtccctttcaccaacgataggacgctcagcatctcaggtatcagctgaacgcgtctgcatagactcggagtgctgagccttcctccctctagggacccccggtactaaatacacccgtgagcaggtgggccagaagtcagccggctcccggagtacacagcaccggctcagcttcggggagatgaggtgctcccgctggcctggagcgctccgaagagcggaggaccagggccggagcaggccgcaggggaggcaggggatggtcagcccctaacgcgaagcgcaggcgggtcgcctattttgacggggttaccgttggccgtcggaaccatggaaggcctccggggagacaggccgggccctgacccttcttcggccagcctagccctggtgcttcaggagttaccctgggggccaccagttccccgcaccaagagctcgtccggagggagctccttccagcccagagaagttaactccagccaaaggcgaagccgggagcccggggcaccaggcaagggcctttctttctgagacctggggccagagaccttgggggcgcctgtgcccgcccaccgctcgggacacccggctggggtgtgggtttgagaggcctcacggtcgctgacgccgcactggcgaacctcgaggttggcaggtcatttcctcacagccccgaggccccctcggagccagtggtaggagaaggagccacagggacaagcggtgaatctctggattcccaaccgccctccatgggggcccgcggccctctccctcctctctcccgctgcgcccccgccgcttgctccctgggtacggcctgaggctggacggagcgccgtccgggcgtccaggactcaggcctggccactccgagccccccaccccccgccccgcgccggcccgcgcaccctgcttcccgcaacttgcagcaaacgcagcggcctctggagagcctagcgacgggtagcaaactttgtccccttaagcgcaagagcaatcctcgcaaagtttgtgcggcggagcccactccctacctgagctggggaagctcccgcccgcgccgtgtggctgccggggccgcggggagcagctcgcagcccgggacgcaccggggagtcgccgcagccgccgccgcccgctcccctcggcggccgcgcggagcctccgcctcctcggaaggggggaggggtctcggaaccccggggcgggggcgggagcgggggacctcacctacctgcggtggcgctgggccgctcccggcagcccgcgagggctccgcgcggaagctcggcgcgcgcgctccagcggggagccggcgacaactaatggagacatttccaggcggagcacctggcgagcggagcgcgccggcgtccccaggcgccgcggtcgtcagccgagcccgcaccggcgtgacgtgggcgagcgagcgcgctgctcccacccggccgcccattaacgctttctcccgcgggcgccgcgctcttgccaactttcccctccgtccggtctgcgcgcggcgcgccgggtgcaggagctggggtgagggcgccccgggtgccagcaggggcgctgggagctgtttgggcggggacgtagggctccgggaggtcacacagccctaacaggacagtgggaaggcgcgcgagccagatttggccaaacgctaagctcgctgcggcctcgggccctcggcccacggggcccctctccccgtttgggctgccccacccagggacgcttgggccgggcgcgaagagcccggaaatagccacccttgtcgtcggcccggtttccctccg

SEQ ID NO: 5232 - DNA, 1233 bp, Homo sapiens
tcgcgctgggctgcgtttctgcaggagccaggcctcttcatgctctgcggcgacagccgctggggtggggctacggggaagtcgcgctgcccctcgtctgagcgtgggccagggcccaggtggtgaccaaggcccggcgcagtggccccggagcgtggaggggcagctgctgggcggcctcccgggggagggtgacggcttcacccgccaacgctgcctccctcctgggattaggccggaggaatcttggatcgcccgaggctggtgctcagcctccttcccccatcccacctccaccacccggcgacccccgtagacttgattggcaggccctgccccgacccctacccctccaggtccccgcctcggtgcctcggtgcccggctccgggccactcctgcaggccctgcctagggcagccggcggtgcctggaggcgggctcgccccggctgctccacgcccaggccggtccctggcatttcagccagtgggagggcgtccccgccgcccccgtgcctctccgcaggggctgcgccgcgtccccgggcctctccctccgccgtggcctggtctgcctgctccagggcgcagctgcgcccgcttcagcgcctcccgggtctgcgtggcctgctcggctcagaggcctccaccacggtccgctccctgccggacgccgcgctgctgtggccgcggtggttctgtggctgtgagggccgtttctgtccgtccacaccgccttccctctgcaggtgaggaatggggtctgcttcgtttggaatgtgcctttgccgggtcctgcctgacctccaccttccagccgggacgcgcgagcttttccgtttggctgagtcaaaaagggatcgcgcgcatcccgccgcccctcaccacgaagcgcagacacaggaggttgcagggtcagtgctgcggagaatcccagacggccccacagccgccgccacccgcggggcactcgcccgggctctgccgaggatgtgggggctttggtctccgcagagctgggactcccgaaggccttaccagaaactcaggagcagccccagccctgcagagcccgcgagggtggagacgggagacccgctgtggggcctgaggctgagatgccggcctgcggtgaagccggcgggacgttccaacccgctcagacccgcccactccgcagggcccgggcccaccccccggcctgtggcctgtgctgggctgcgcagccggcg

SEQ ID NO: 5233 - DNA, 2865 bp, Homo sapiens
gcgagtctcagttcgctgctcgctcagagccgcccaggtgcgagggcgtcttcaccagaaatcggtgctcccgcgcgccccaccctccggggccctgcagatgccgggtcgggggccgccagcaggccctttggctcctgctggagacactggaagaccaggcgaccaggacagcgggtcgggccagtgcggtgtgacacgagggctcgagcggcttcgcagtttaaacgtgtcctcatcctacacctcccacggctgtttcggattcggtgccctcgtgcccctcagcttgcccagcggcacgtgggcctcaagcctggtccccagcggctgcgccagcctagctgtgttcaccttggggccgcgagggcctcccaccggctggcagctggtggacacgctgtcaagatcgggggaaaaaaaggaaggaaggaggctagggggacacagggctggtggcctccgcagtctttgacctgcgacgggcgcgagcgcacctccgcgcctttgcgcagagaccttcccccaagattggctcacgacgcctcctaccccgaagtcaagggctccctgtggcaaatcctcacacgccctcctcctccccgcccatccccggcgccaggactgacggggagagggcaaggccgggccagaggggctgtgggcctggactgcggctgtcgcccgcggccctgctcttttgggcagccagacgtggggtcagcgcccagtcgcagcctccgggggtgagtccgcagatccccgcacgtgacacaggccaggcatggggacggggagttcctcgtcgtccgttcccactcagatgctccctgaggttccggaacaccccgccccccatcccaggatctgaccaaccctcaagccacggccggccccggttccgcgagacgggggactctgaggattgtcctcccttccgggctgggactcccccacagcagccgaccgcccccagttcagagtggcccggcccgcagcgctccccgggcacaggtcccaggtggacggctccgctcccgcgcccggctcctctgcccgccaagcgccccggggattccccggcctccaagcggccgcggccgggtggagtcagccccgaagcccgggatcccccgaagggagaaaacccgctctgctcctctgaagcggcgggagaaaccggccccacccaggtccgggggcccgacgccctcggcggaggccggctccaggggtccgaggttcccgaagctggaggccggctccgccccggcgtccccccgccgccacctccgcccccatcccgcgggccggcggagggaggggcggggccgcttgccgcccgcgactcgggttcggcttctttagtgattgcttctgcttctcccgcgccagctgtccccagctctggggcaacgctgccaggtgcccagtccccgcgctcgagagagcgcctgcctggctctgaactctggccaggaaggggcgcgaggggaaggccccgggggaaggcgtgtccccgcgccccgccccgccccgcctcggaaagcccccgcggtcccgcccaccccaggggctcgctcagcctccggagacttttttctttgagcgcagccgcctggtgccggtttccgccgagctggagcgcgcgggccacggcttctctggggacgcagaagcgagaagcggggacctcggcgcgcgccccgcgtcccgctcttcctgcccgcgccccggcccccggcccgcgccccggccgccggcatggtgctgctggccgggaccgggccggagggcggcggggcgcgctgcatgaccccaccaccgccgtccccaccccggggcgcgcaggtcgaggaggaccccgctgactacgaagagtttgaggacttctcgagtctgccagacacccgcagcatcgcctcggacgactctttctaccctttcgaggacgaggaggagcacggcgtcgagagcgcggagagcgtcccggagggcgtcccggaaagcgtcccggagacggcgaccctcctgcgcgccgcctgcgccaacaacgtggggctgctgcggacgctggtgcggcgcggggtgagcgtcgaggaggcgcaggagactgaccgcaacggcagggtaagcgggcgtccccgcaggatttgagccccctcactgcccccactcccctcctccccaccacatccccgcgcctcccagctcctggctccggaccggtccctcggtcactcagccgccgcccagagcgccttttccccgctgtttgggagcgcggtgccctgggtggcttccccgtctcaggctgggggacgcggtgcggggagggagcagtcgaggtgtcagcgcggcagaaacgccagtccggcgtcctcaccgcatccccttctcgtttaccggtccccgtggacctcctgactgaattcgcgctggctgcccgtgctgcaatccaggatgggcttcttgcggcccggtcccctcctgactattacctttccccaggtccctggcaggggaccattcctcctcccctgcaggagacagcccctcctgcccagcgccccatttggcccctgggcccctcgcgccgcccttgtcctaacacgctggggcgcagatcggctcctccagccgcaatgatttggaagcaacagtttcttccctcgccgggacagcttggtcccctaccccacctccgctgagctttgtggcccgcgccgcgaccagccaacgtgatctctgactggtctgtccgcaggtcaccttcgcgagccaatgccagccggggctccccagagtcagggcatagggagagccccagagccgcgggcatccacccgggtagggcaggaggcg

SEQ ID NO: 5234 - DNA, 1154 bp, Homo sapiens
ccgtctcctcccgtatattagggacgtcatgaatgcaccgagtatgttctcagggtggcggggagcagcattgtcggtgttgccctaaatacgcttcctcccggggagatgggtggcagggagggggagcacgcagggcagccacttggtaaccgctccaagaaaggcactaaccccggacccccttccaggcacagcggcttccgagggggacctggcgcgatcgcggtcctccccgaggcaggcagaaaccccgcagcagccgccgccgccgcctgccggccgggagcccaggaccacccccaccagcggcaagaggaggaggacggcgccgggaggaggctgcgcccggccccggccgcccagccccgcaactcacccaaaggcgcggcgcccggcggcttcctcgcaaacatgcaccctccgccggcgacagctcctcagtccgggaagaggcgtgcgcggcgccgcccggcttcagggcaaggtcctgaccttgcccaactgcagcatcttccgcttttgttgtctgagcgcggccgcgggacaagggatgctggcgggcggcaggggcgagcgccgcgggcgagaggcggctcccgacgcgagtgcgcagcgcccggcccggcggcccctccgagctcggcgagcgcagcgccccctgcccggctccgcgggctccacgggctcctgcgggctcctcggggctccgggcgccgccgccagccggccgggctgagagagcagccgccgcgcccgcagctccgctcagccggctgtcgccgcgggcgcgagcctggggccgccgcggcgcccggcgccgagcgctcccgagctgcgccccgcgcgcggcccgcgccacctgtgccgccgccgcctcagccgccgagggcgaggctcctcccgcggcgcgcggcagcctcagcctccacctaaacctcggcggccggcccgggcgcccggctagtgagggagcgtccgccccgccgccgaaaccggccccgggtgcggagcatgcccagtgccgccgcgagagcggcgcttcgccgcgcgcgttccacttctcctggttttcgcggcagcagcggcagccgcgggagagaggggaggaggccgcgggttgggagagggccgagcatccttgggaacgcacg

SEQ ID NO: 5235 - DNA, 1154 bp, Homo sapiens; identical to SEQ ID NO: 5234

SEQ ID NO: 5236 - DNA, 396 bp, Homo sapiens
ccgctgggaagggaaaaacggcccacatcgaactggatgccggatggaaacctctctgcgctattagactgcgtccagtacagcagatggcacgagcacgtgcggcgctcagcttaggctctcggaggcagctgagttggaaatcccgacggaaagcacccacaagctcccactctgcgctggcccacccgcgtgcacgcccaccccccacgcgcgtccctggctcagaagcgcacagatgtttactgcttagagccggtaccgctggggagatcgagcgacttgcgcggcgcacagtgcggcgctggcagggctctgggctcccggtcgggggttcgagcggccaagggatgggggtgggggcggggagagtggggggagggcgaaagaccgccg

SEQ ID NO: 5237 - DNA, 438 bp, Homo sapiens
tcgcgtggagagaaatgagctggagagttacaccgagtcaacgcgggacacggctcccggcccgggccgggccaggggtgggaggcggttccctaccgcaggcggcgggactcccatgcgccgagggacccaagtctccactccacccacacgcccacccggcgtcggggcgctgcggcctcgcctcacgagcccagagcaggccgcagcctgggctggggatccggcacctgggcagggtgagcttggccggacatcctcctccaggactacccgcaccccacagtcgcgtcaaaagcgccccatccccctgtctctcgccgcgcaggtttcccaccgacgcccgctcggaaggcgagagcccccacgtggcccggcgcggcgcggcccccggggaccgcgagcaacaaaagcccggcccgcagcccctgctcctcg

SEQ ID NO: 5238 - DNA, 438 bp, Homo sapiens; identical to SEQ ID NO: 5237

SEQ ID NO: 5239 - DNA, 411 bp, Homo sapiens
gcggtggtgtcgatccacttgagcagctgccccgcgctcagctcgccgcgcgcagtggcgtgcgccggctggatggcttggctcatgaccacctcgccgggcgccggccgctccatggccagggcgagagcgctacgcctgcggcccccgacaccccaccatgcccgctccgcccgccccgccctccccgcccagctccagagggcactggcgccgcccgcccgggccgcgaacccctggccgccaggtggtgggagctgcgagtgagggggcccgcactgtcatcccaggactatcgcgagtgggggaaaaccagcgctctcgggtctcaggagaagtctgggaagtgcgcggggagggggctcccgggtagacaggtctggaaggcggctccccgagagccggagcgcg

SEQ ID NO: 5240 - DNA, 1137 bp, Homo sapiens
ccgcggccaaaacgcccagcgccgggtctgggtttgcgaacggctcagcccaggccctgcgccagagcaccgcacccgggggcggacggccctgcagctccccagcctcttcccgcatcaactagctgacgcccgggcgcactggcttcccccgctcccgcccgcacgaaagccctgcccgacgtctgcagtcagcatcgcccgcactgcctagggagggtttgcgccgagacccagtggccgagtgagccacagagtcgctggtcctggggacgctgtcttctaccgctccccaccgtcctcctctttcctgtatctcaccccggtaccccgcacccttctccccgctcggccccgcgcactctgctcagactttacaagcactttctcggggcacccaggactcgacgcctcctccgcgccgccagcggcgctcgccacccttggcacgccggagggaccgcctccggccccctgcgcggcgtttctcaggggactcccagcccatccctcacccagctgtccgggtcccgacgccttacctttgccgaactgggggacaccgaggctgagcccgaccaagagccagacggctaccgagcgcttcatgatcccgtctcccggacgtgaccccggctggtcaggggtcgtcgcggagggcagtgtagccgaggtggcagcgcagggcagcagcagactccgcccctactaaagaattcaagaagacgttctctttcctcagcgctttgttaaacaaattcttggagagggcgagagtggtgactaaagagaggagcctttcctccccttttgcctgcgctccggcgcgcggaggtgggtgagctccggggagccgccggcgggctcagccctccgctgcgggtgggtcccggcagaggcgcggcgggcggggcgcgggctcccgcggccgccccgggtctgctgcgcgggcaggcagacccaccggcagacaggcggaccgggcgctcggctgtcgctgttctccgcgcggcggctgcggggcttctgacttggagaacaatgaagcgtgagctggaggggagcgagcgggccgccgggagcgcactgtgtacaaacagaggcggcgtgcgtgtgagtctgagcctggcaggcgcg

SEQ ID NO: 5241 - DNA, 2383 bp, Homo sapiens
ccgacgtgtcaaggaaagcgcgtcgcaaggtggagcgctcgggttgacgatgagaaggtgagctgtgaaccctgcacacgtcctcaaacaaaaggctcacgagcggcggccccgacgtggggagcaagcaggcttctctggcccctgcagcaggcggacccaggcccgcctgccgccggacattcagaacctgttcccgcagcgcgagctctgcacacgctctgcgatcggcacccctggaccccctaaccacccgccgcccaacccccggagagagggctttccgcccgctgagctgcggggttgggaaggaaaagggggacgcgctcctgggggtctttggatattctggcaaagggggctgcagctctaggctccagctaaagggtctgggacggagtgggccagaaagccgccaaactgaggattcccccctcccccaagccggagccctaggtgcggagccgcttgcccacttaccctcggagcacgtcctgctgtcctcgccggcggacgcggctggccactgcggcaccctcctcgcgatactcgggcgctagaaacccgccttcagagcctgctgtagcggaccgaacctgttgcggcggcggctggggccggggcggcttgggcggaggaggctgaggctggccggccgtgccctgcgcccagagcaccacacagcccagccacaggaagtagagctggagacacagcctccgtcttctccccatcgccggcgccgaaagcgcgcggccgtagacccgcggagagggagtgatcaaagacaaaatctgcgcgcctcagaaaagagtcagggtctaataagcccttcgtcggctccggggactccctcgggctcgggctccctgctctagctggagacctcgacagagcgccggccccctgactgcccgcgaagcgagacgcggggcgccgggtctagcgcagtgagcggcgaggcgcggcggaggtgcagccggcagccccgagcggtacacgttgcataaccggcctaaagccccgagcgactccaggaccgtcagcgggcgggggaggaaattacaaaagccctggcgtaaaatttcaaaaaatgtgaacctcaaaagaaaaaagggcctgcacgcagagctcggcggattcccgtgcgctccgaagacggatattggaaagctgcaaaagtcaccagaaagaaacaggcaagcaaacaaaagtcgcccccagaagaagaggagggttccctccgggctcgctcggagtcccacagggcaacgaagcgcgggtagcggctgcggagccgggcggaggtgcgcggggccggggcgtgcggccagcaagagagagggcgggaggctgggcgctggagaagatgcggcggtggagggcgcggcgcgggggttttagaggcccggcggggcgcggggcgggccggcgggcggcggctgtcagtgggggcgcggccgtccacacgtggggctcaacccggactgagaggccggcgcagagtgggcggggacagagtaagggagagatcgggactgaggaacgaggggaaccagggttgggtgaggggaagaggaaggaagggggggagggcgaagggagggaagaggacggagattggggagaaggggggcgaacccgagaggaaggccgggctggaagagggacttggaaagagggattggcgagcccgggtgcgagaggaaatgagcgggggatgggggcgaagttagggcaaagagagaagtgggaaaggagagggagggccaaggtccgggcgccgagaggaggggcccggggggccggctggagggggcgaggcgctaggcggctttgcttcccgtccccgtcaattggccgctagctctgttttgactgcctgtacaaagcgagtagacggcgggggatggggcgattagggaccggatttgggaaaggaggcagcagccccttcccctccccctccgtcctcgcccggccgcggaccagggactagggtgcctaagcgcgccaggcttggccggacccgcagctgaactgacccgcagctgaacttccccgccggacagaggccgcaaggttgaggatgagaacgggtctttctgtagggtcccggcccctgacctgggatggggggattcgcagtcagccaggaatagaggctcacggggctgttggttgcagcctcaatccaagaaggaggagacctcccctttgccctcctacccccaccgccccaccgggagcggcgtcagtctgcgggaccaaattaggggctgggagtttccagattgaaatgcgccctccaccaccaagagggagctcacgcggccgcggggggccgaggcagccagccggcgccgcggtcctggggagtccg

SEQ ID NO: 5242 - DNA, 2367 bp, Homo sapiens
gcgatcccggctttggggccctgcctttgccgcgggagaataggctccaatttacgaagctggtcaatttcagaaatccgagacccggttcttgagaagcgactgcgtgctccgggaccctgcgtcaacaaccaaacctgggagaagccgcgggaatgtctttattggacgttacgaagggaattggggtttctctcctgggaagaaaaagcccgacctgtgccggcgagagcaggctgccttgggctgggggcacctccgagcgctgcggcgggacgtcggggtccggggcgaagagagccagggcgcggaccgacgtctgctgcttttctgcggcattgctgcccgaacgaacgaacgaacgaacgaacgaagcggtttcgtttaggaaaaataccctcttgacgcgaagccacggctgaagtcccgggccacgcagaggggccagcaattccatgggtggtggggccctccatccctggacgcagcggggagcagcgggcggccctctctcctgcccacttctcctgggggtgggggagccctgtgtcacccgacgctgcgaggggctgccacgggcttctcaggttgtgcccttcgcggggccgtggcccgtgcccccgaggctgctaccctcttgaggtgcccggagccaaagcagagggttgatcccgccggttgggtgaggtagcacccggtgacggcggctatgactgtgccctgggcgcaggaacgagctcctcgcgctgcctcgaaggctcctgaccttccgcgccttgcgctgtcccgcgccgccgggtggacccacacacgccaggagcaaactgcgcaggactcggccgccacctccctgcgcccctccaccgcggagaccctgcgcccctagcccagcgtctcttaccccacctgggcagcgctgcgtctgcggctcgtgggctccgggctcgcccgccgcggactctggctcaggtttcggctccggctggggccccggatccagctctggctctggcactgcacggttcttcggcccctgctggttcgctacatcccagcgcgcgaggccggggcttcctcggctcggcccgctcctcccgccgccgccgcccgtcgcccgcggggaaggcggggacactggccgggaggcgggaagggtggggggaggggaagctaggtgttcgccgggacctgcggggagaggggcggcgcgcagtcccgccggctaggggtcctggcctccctcggggcgtaggctggggtccgcgcggctggcggccgggcctcgaggccggggagcgcgccctgggacctccgtggaggggccctgccgcatgcggacgaagccagagcgggtcccagcctggccctggggcactttctctccctgggcccagtttcccacctgactcgtgaggggctggccctacttccgtttagacgggggctggtggtcgagtttggggttttgagattggacctttcttctttctgctcagcctgcgggagggagctggtcttgcgtgttggcagggagagtccgctgcccagagcgtggcagccagggaggtttgaggacagaccccaggttttctgtgtttgggggtagggggtgttagggtggggcaaccgcccgacctgccctggttgggggaattgccttcttccctctcctcaggggctgggctggtgaggaaagggcacaccaacccctcaggacagacacttctggggccccttgtccaacccctatgcctgcacatcccccagcgaccatcctgctgcgggcctgcgaacggtgacgcctccacccctgtggccccgcaggccgttcctggctggctgccgctgggagacgggctggacgcaagggaactgggagcctgtcctttgcccaccctcaggccacagggctccccagcgttgcctcgtggccagataaccctgtgcgcgaagcctcatggtggaaaccagttggccgaacctactcctggtaccccgaagtgcccagcctgagcctgcttgctgttgggattatgggatgggaccacagggcaggtcgggctgtggcctgcctttctcagggactggagcggctaagcctgcccgccgacggccacgggctccagagcgaccgtttccggcgcaaggtgccgggagatggcagcgcggcagccgggcctgaatctttcatgagatgcagtcagcagcggcgcctccctgcctggttctcgccgacagctgctgcgggagaggccgcgacccgcgccacctcggcgtcctgctagtccgtgcctccagggccgcttggcctgggaacgcagagacccacgaccccctccccaacctccgaagcgggaagccggcccg

SEQ ID NO: 5243 - DNA, 1235 bp, Homo sapiens
gcgctagcgcgtgtcctgctcagagagcccggcgctagctcattcttcgtgcagttattggctgggactctgtgtgccgctgtcggccaatgaagacgctggagatcgggcccctgcccgtcccctttctgcgccccgggatgaggcagagactgaacagccggcgagcaaatcaacggcatccagaaagccatgtcggactcggcgcccagcgcccaagcgctaacccgctgaaagtttctcagcgaaatctcagggacgatctggaccccgctgagaggaactgcttttgagtgagatggtcccagaggcctggaggagcggactggtaagcaccgggagggtagtgggagttttgcttctgcttggtgccttgaacaaggcttccacggtcattcactatgagatcccggaggaaagagagaagggtttcgctgtgggcaacgtggtcgcgaaccttggtttggatctcggtagcctctcagcccgcaggttccgggtggtgtctggagctagccgaagattctttgaggtgaaccgggagaccggagagatgtttgtgaacgaccgtctggatcgagaggagctgtgtgggacactgccctcttgcactgtaactctggagttggtagtggagaacccgctggagctgttcagcgtggaagtggtgatccaggacatcaacgacaacaatcctgctttccctacccaggaaatgaaattggagattagcgaggccgtggctccggggacgcgctttccgctcgagagcgcgcacgatcccgatgtgggaagcaactctttacaaacctatgagctgagccgaaatgaatactttgcgcttcgcgtgcagacgcgggaggacagcaccaagtacgcggagctggtgttggagcgcgccctggaccgagaacgggagcctagtctccagttagtgctgacggcgttggacggagggaccccagctctctccgccagcctgcctattcacatcaaggtgctggacgcgaatgacaatgcgcctgtcttcaaccagtccttgtaccgggcgcgcgtcctggaggatgcaccctccggcacgcgcgtggtacaagtccttgcaacggatctggatgaaggccccaacggtgaaattatttactccttcggcagccacaaccgcgccggcgtgcggcaactattcgccttagaccttgtaaccgggatgctgacaatcaagggtcggctggacttcg

SEQ ID NO: 5244 - DNA, 3043 bp, Homo sapiens
gcgagggtctcggggtggtgggggtgccggccccagcatgtggaggcgacaggatccgtaagaccccacgcgccgccggggcaggaccgcacagggccgccattcactcacttggggcgtccctaatgggcactcgtgcattccagctcgtgcggtgagcgcacgcacgccgccgctgccgcgttcacacggccccccaaagtcgggggaggggtcgtggagcgaaggagctgtaggcagattttctttctctttccgagctgggaaaagggccagccccgtgccctgcacgcctggctctgctttgcagcttgccggtgagccaagagccggtagagcagaggaggcgcacggttcgggtcgtgtcaccatttcttggcttgctgacctggccaggagctggggatggcggcagcaccgcggaggtacgctttgcgctgccctcacgctcccttccgaaagcagtgcccccagggggaaagttcgcaatgccatttgtctcgccggcaaagttctgggatgtcgggcatcttttgaggagggggaagacgcggcacccttactgaggccggcaggccaggaagagaagttctccgggcgcagggcgcagcccagctccggggaccctctgggcctcccgcgtgccggccgggatgaagcgcgctttgcaccggacccgggattcgggggcgggggctggcgctggcagcgtcagacgctgcttcatttcccctcgaccctggggaggacagcaacaagtcctgccccagccatttcatcaccctgctagcacgtgcagattccgggccctcggagcccggcgcggacctcgccttgcctcgcgcttccctttgcacgtcccgtgccatcccaagagtttgcgtggccctgggtgggcgcctggctcccggcgaaacgcctggggcgcgccgcgtgggtgcacggtgtcctctcccagtagctcccggctgcgggggcacatgcacttacctgtattctgcagggacaggcggcctttctgctgggagctcctgtcttggggaccctcgggtgggttggtggcgtcggtcccccgcgccgggtcaaaggtggccaacaccaaagccagggtcatgaactggcccagccgctcggcacacatggttcttggtattaacctcccgtcgggagacctggatcctttgtgctcccctcttcctcctcctcctcttcctccttcgccgcttcccctcctcctcccactcttcctttttgctcgccttttccctcctcctcgcggccgcggctcggatagaggttacccagcgccctcccgtagctctccggagagcatgtgaccaggccgttagcagcgccgcgagtgcccggcaatggcagggatggtgcctcaaatatccctggaagctctggtgtcacttgaatgaaggagtcgagcaggtgttgtcccggcggctggaccaatccgagaccccggcccttttgacaacacggccgggaggcggggcctgcgctcaactactacaggaggaagccgagcgccgctgggagcgccggacaaagttgccgacctggcggcggccacgcgtttgcgtgcgtgtgtatgagtgtgtgtgagcgcggccggagatgcgtgcgcgtgtgcgggtgctccagggcaatggtcgaaaggactgtacaatataagagcgaatccaagctccagttgctgttaaagggggacggtgtgctctgggacagtgtccctggggcccctggctcgcgtcacacccacatcgggttgggaaagtttcctctttccgccgtttggaattcagtgagattcccagcccagaggacttgataaattgaagcagtttcctaggcacaatgatgctgtgggccaactgagcacacatgggaattcctggccttgtgacactttgcattaaaaagaaccccacgattgaagataggagcagaagcactagatacagtatttggtctgagcaactgccctatcttcccgctttggtgggccgtgcaacacctggagtgtcgtttctcgtctttcccctaatccagacgcattccaggctgggctgcagggatccaggtgacagtcaggacttgcatcatttccaggagggtggcagggaggcccaaggcagccctgagtcagcccgccgcggagcatcgcgtgcccggaggccagagcttgaaaggcaactttacgcgtctccaaacacactcctgcattttctcaaagcgctgctcgccaccccgctccgggttcccttttactctccagtcatccgatggaagtggtgagaacaaaaacaaagacaaaaaagctaaatccggggaagttatctccatctcctcccttttcttgttcggccccctccccaagaaccgccgggtcgggatagcccccggctactttctcacccggcccgtggagggaaggagaaagttgggcgccgcttggagcgcctcttcccctgctgtgtgtgtacgtgtgcacgctcacgtctcccccgcgccggggccggggacaggaactgctctcggtcccgtcaccccacggcgcagctcggggggctcgcagggctgggggagggcggggacacgagcgccgcgcccaagcgccccagggcacgcacccggcgttggcgcgcactcgcccctccccccgtccccaccctcctcctggagaacaggtgagccccggtaccagctctcgatcccccacccccgccccgcgccccgcccgcgccctctgcggtaatgcgcctgggaagtttcatcacccactgcccaggcgacgcggccctgggtctccgcggcggggcgcactgcccgcctggttggggccgccatgtgacacggctgggggagggggcgaggagacacgcgggcaggtcatcttttggccggcgcttgacttccaaagctttcctttcccgtgtcccggctgcacgcgggagtggggaaggcggaggcggggggccaggatggccacggctggccgcagctatccggcgtgtcgagctctcctgagtcg

SEQ ID NO: 5245 - DNA, 864 bp, Homo sapiens
ccgcaggcgcggagctgcggctgcagccaccagcctagacgtggcgcgcccgcagcaagtggctggacaccgcagaccaggcccgcgtccccagcagcgcggatcccggggccagccgcccaggcagcaaagtcaggcggtcggcttcgccagcagccgatgagtctcatcctgtggattgcccagcgccagggatcaggatccggagaggtgtccaggaggagcagaccctcagaccaggtaggctgtgcactcggtgaccctgacgccatccaagggaagctccgccatcccgcgccagtgcctgagctgcaactgcaaactgcgcgtcctggcacgagcagcggtgggggcgggtgggggaaggagcgagtgactctccaggcgtcttccgctacctgacaccagccaggcagcccccagggccagagcgtcagcgccgaagccaggctcatccgggaagccactccggtggccgcggggtgcccatgccagcaccagatctctcttcggaaggaggagcggggcgggctacacggccaggcgggccctccccttaaggcggggtgggccgcgcgcctgcgattttccgtccgtggtcctggggcagcccgggccagccaggagaacccgcgagcccagcggcgcctgcacctgcggcttccgggagccgggcggctttgcgaggctcactaggtctgagaggtcggaggccgccagtgtcgctgctgaagggtggaccaggcgggatcgcggattctgggctagatcgcagacttggtatcgcggattgggatttggatcggggattttgagttggatcacggattgggggttggatcgcggattgggggttggatcgcg

SEQ ID NO: 5246 - DNA, 2071 bp, Homo sapiens
gcgagagcagcggagagaaaggagctagagaagtgcgtactcaccagcccatcgcagttgctgagcgccacagaggaggcttcggctaggccggccacgtctccgacgtagagacagctcccgagcaggggctccacgcgggtggtgcccttctcgccctgccactccatagtggccccgggcgccacgaggcgggcgttgggccgcagccgcaggtgcaggtctcggccaaagaccgtgacattgtagaagaggtgactgccaggctcctcctcgttgcctccggggaagctcggggtccggaccggggcggccctgcgggctcgtacccctgctctggacgtagctgccgacaccacgtgggacaccaagcggccctgggcgtcagtgcgcacgggcaccgccaggatgcgctccgctccgtgccccaggggcccgcctgcaacgggaaggggcgttagatcggcggagaccacggagccccagtgcctcagagacccgccggcaagccacgcccccccagaccccgccccactgcgaagggaaggggcattccgccaggcgaccccagaagccagcctgcacctccccggctttcctgcaaccgggaaggggcgttaacagggccaccactccggggctccgccactccccagccgttccctcctccggagaccttgcctgccaagagctctgccccctgccccgttcagggttggggctcggtgggaacctccccgtgcccgaagggacgaccccgtcagagagtcccccgacccttgcacctaccgtccttggcaggacgtggagctgctcggaagccattccgggttggcccccttacccgtgtgccacgacccctcggcgggcccctgccgcccgagtgccctcaccgccagcctccggagcggcggagtctcggcttccccgagcacgagcggcctgtcctgcctgtccagctcccgctcagcccgctgccggccccgtctccccgagcgcccgaggactgggaggggtggaacagggtccctccgatctccggggattccctgcggggcgccccaaccaatccttagggcccaaggctacgcgctcggcagccggctcctccggagcgtccccggacgcgagccccggcgccgcctcgccctggctcccccctcggacccgctggggctgactctgcgctcttggccgcggggcttttcccggccctccgtccccaccctccgcgactcaggagccgccagtgctccgaggctcccccggcccaaggcgctcgggggcggtgcggggcgccccctgcgcgaccaacccggccccgaagttggccaacttggccccgggcggggcgcgcggagtttgcccaagtcaggctggacgacgcctggggagggggcggcggggcacgcgggacagggccaggccggcgggggtcccggggagtaggggccgggccgcacctacctggggggtcggcggcggcggcgagcctggcgttcgcgggcggcggcggcggcggcaggagcggcggcggcagcagcagcagcagcagcagcagcgcggggcagagcaggcggcgagcggctcccgccggcggatccatggcagccggactgcagccggggccccgcactcgcagccggcgcgaaagttccccgcgagccgcccagcccacatctgggggcagctggagccgcccgcagctgcagcaccgcagggcgcggggcggaggaggcgaggcgcggaggggcgggcgggggagcgcggagggaaggcggggagagggaaggagcgagcgagcgagggaggcaggcgggagggagggaggcgagcgagggggagggcggggacggcgggcgcctcagcctgcggtgacccggcgcatcttggcgcggccgccgccgccgcccgcttccctcttcgcgccgccgtcgccgcggtgccgggctcgcagcgaagcagagacaccccgaggcggcggcagagaagcgccgcgggccgggccgggggagccccgccgccagccaccccaggggcacaacctccgaggagcggcgccggccgaacg

SEQ ID NO: 5247 - DNA, 1170 bp, Homo sapiens
tcgggctggcgggcactgagctggggccatcacgcctttctagagcgcctgcggaggtggcgaaggcttggagagcatacgaggcggaatccggatcgagtgagttccttgagccgcttgcgtgggacgcagggagagggcgaataacgccctcaggcgctgaatgcaggggcaaggagccagcgagggtggctggagcaggccttgccagctgttaccaagtctctccacaggcttgggggcttggggcctcctggaaagatccctccgccgcgctgaccagtacggggctcgctcccgcactttgaaggctgccgcggtctttcgtcatttataatcaagcccaagatcaaggttgcaagctgaggtcggggtactgacaacgggaatgaagccataggggaagaggataactgggacgggctggacccatacttgatacccgggaaactcctagagcgtgtggtgctcctgccagcggcagttactggtggagctgaggccaccgctactgtcgtcgttggcgctttgcttctggaacctcccagcaagatggcactcactgtctgttcccttccgattagcacccccagccgcgctccctcctccccgggatacgtattagtcacatactgtggggagaagatgggctatgtaaatgtaagtcaacgcgctttcccagccacctttgcataatgcaacaggaacagcgacccgcgcgcacgaaccgggtagtgtgcgcgtgtgtgtgctcgcgtgtgtgagcgcgtgtgccagcgtgcgtctccgcgcgggcgtgcgtctgggtggatccttgcgtggcttgggaggcaaatcgggcgtttctccaagtcgtcttaacatgatttaggctctcaaatacgtgaaagcggtagacacaacagggatgcgaaggaaataaaaaacaattggggaagtggtgccaagtcactcaggctttgaactgaggacgagtagtgcggtcgcgcctggggcgcgtccggaaatcatcctcagcctgtggcggccactgccccacttaaactcttctgcggggagagttgagcggatccctggggggttggtcctgggctagttttaaactctccggttgcatctcgcgtggccccaccgacggcgcgtctcggcgtagctcttggcgcgggctcg

SEQ ID NO: 5248 - DNA, 2168 bp, Homo sapiens
tcgcgctgcagtcaggcagagccccggggcagctcgctcaccgcggaggagccactttggagttttacgccctttccacaccccacccatggactggaaaggatgttcagttactcgcgagcttgtctgatactgggatggaaagtcacagtccgcaggctggagtgaggcgcgggaagatgcctggtccttgcctcgcggacttggcagccgcgtcctgcgggtctgtccactgaactgctgaggactcgcccgtgtgcggggacccgagtgccacttcccggagcgttaccttgcgctccagcctccaggctagataatacctggaaggcagggcagggctgttcccgctctcaccccttgcggaaggatggcaggatccggcgcagcgacgtagcagcgggagggcacagcgacctgcatctccagtttctcctcaggacacaaggctgacttcaccttccggacagctgcaaagcccctgccagaaccaaaccgaactcgcgcctcggagaggggcttctggggccgtttcgctgcagggcgtggggagtggagagagggaaggggaagcctggggctgggtgtgcgcgcgtgggagcgcgcctcggagcgccccgcactcccccactctatccccgggggcagtttgggaaggagggagtggtagtcgcgggaatgagggagcaagagaaaccctctcaaagtgacgccccaaacaggtccggatttagaattcgaagctaaaggctgttagaaattgggactcctcggcctcctctgcagcccctcctttcccgccccgaagcccgggcggtttgctggctgcctgcttccccgcccccggctcagaggtctctggctggcgggcgccccgtcggccgccggcttcctccttgaaacccgccggcgcacatgaggccgctgcccccgccgcaggcgctggcggccccctcgcggtgcccgtggtgatgccatgccccgccaccacgcgggaggagaggagggcggcgccgccgggctctgggtgaagagcggcgcagcggcggcggcggcgggcggggggcgcttgggcagcggcatgaaggatgtggagtccggccggggcagggtgctgctgaactcggcagccgccaggggcgacggcctgctactgctgggcacccgcgcggccacgctcggtggcggcggcggtggcctgagggagagccgccggggcaagcagggggcccggatgagcctgctggggaagccgctctcttacacgagtagccagagctgccggcgcaacgtcaagtaccggcgggtgcagaactacctgtacaacgtgctggagagaccccgcggctgggcgttcatctaccacgctttcgtgtgagtacccgcgccccctgctatgcccgctgcaggggaccactgtccctggccccctggggcgtgctccgcgctcgcgcccttgggcccccgcgcgcgtgcacacgtggtggcttttatttcttcgcacgtgttcgtggtcttccttctggagcctctcccctcccccagccccacttctctcatctctacagcttgaaccttttccccgaggacacccaatgaactgcccggtagcttcaggctcccggggcgagagccaggcagacgcgggacttaggctgcgcggataattgggagcaattaggtcccaagatacgtaaacttcaaccgaacggggcgcccgggagctagggaatgcaaagggaggacaggcgcccgtgtgaggcttgagagtatactggagaggttaggaggtgatggcggggtaggacggggagaagtgagggggcatcgagggctaggtcctcagtcctaggggcggagtaggggaagctgctacttggagagagctgctaggttttaagcgcgcccggaaacacgcctcgccaccacccagccaccaccaacggaaaatctgtcagtgcatgtagcccttcctgccacggagaaggtggccaaggtctagaggaggccagcaggccaggcgaagcaacgctcccgcgctgcagggggcggggaggcagcggggaacctggggcgcaggaacgcgggcggaggtgcgatagcagaagcgcaaatgggtcgcctctgacagagatcgggcagtgggttaagtccccgtttgtggcgcg

SEQ ID NO: 5249 - DNA, 2053 bp, Homo sapiens
ccgacgcacgattcgctcacacggaataagaactccacgaaggacacttggggaccacactggtcgtacccgagggggcgggaggcggaaaaagtatttccaaacgcaactctgccaggtcttacccttcgcatcccctggtcctcgggacagaagctcccttggcacctctcgcccagctcaggggctggttgtccgctagaacgaaatatcccccactgactacggagagctctgcagggagccgaggcccccgcccgggccaagggaaggcgctggcgccgcgggagacaagaagaggcggaggcggaaaagaagtggagaaggaaggggtggcagagggagtagcgtgcgggaggcggcgccggcgccgggctgctggcgaggcggggtggggtggagtggggtgtgcctccggcgggcggtcagcaagtcagtccgtccgagcgccggcgtcccggtctccagcgcccgcccgcgacagcgaccgggactggcgccccgctgctccgaccgccggcgagcctcgccccttcccaggctcttcactgggtcctcccgcgagccccgcctggcccggcgtggggccgcccgtctccgccagcccgggcgcccgtcgcctcgtcccgctcgcgcagtccctgccgctccctccgctcgcgctgtctctggctccctctcgctccagtcccatttatgaagcgcggtcccatcacgtgttaatgagcctttgtcctgccctggcagcggcggcggcacagaccccgccgagggaactgcgcggggagggacctgagcgcagcgcccgtagccccaaactttgcttggggcgggggacccgccgcggcgccagccctggggccagaggggacaagcctcttcggcccgcgtcacctacttctcctcttcctcctcctcctccgccgccgcgctcccggaggcccccgctgccatgacctcgctgtgctcccggataccctcacaccctgaccaggccaagaaggggctggtgcatgcgccgcccacgacctcggggccattaatcacacgctcccgggcagcgcgcatcgccaacaccttccgcgggggtcacgtctggggcagcgggctgagccggaaggggaaggggagcgggagcccagaggccgaggcgcgccgggcccgggggtgcggtctcgcgccccctccctccgcgcaaggccgctcccgtggcaggcggcagcgagctgggcccggggccgggctgagctttgggaccgcgctgcgcagcccccgagccgttcgctacctggctgcggtcgcgcggccacctgtcctccgccctcggggcgccgcccagcttcgcgccaggcgccttctccagcgcccgccgccctttcccggcgagaccactcgggcgcgccccgcccgccggtccccgatgcaaacagttgggctccgtaggcggctggctccgcgcctcccggcccggcgcgccccctccccggccacccggggccccgctcctcgcaccttttcgctggaggaggacgccccactccagggccggactgggggctctgggactcgggggcggcagcggcgggcgcctggggagccgcggtgtgctcagcagccgcggcaggaattaggggacatgctcgttaattgtttccactatcagccgccgtctgcctcctgtgtgcacggatcaaaccttaattggtctttacatttatcatggtgaattgcgaacctccaaacaagcctgggccgccgcttctgccgaggaggcgctcccctcccctccgcccccggggccctgcagggtgtgcggcggcggtcgtggttatttagacatctttatctctcgtgagttggatcgggagaggatcgcacggtttccacctgacggagccacgtcacgtcggccacaagggccccgtgctgggcgctgggttcggttcccggccgtcctcttgtggccgccttggcgttcattttatgacaccttgccggtgttcccagacatcatcccgcaccgctccgttttaccgacctccaggtcttcccg

SEQ ID NO: 5250 - DNA, 1679 bp, Homo sapiens
gcgtttccactgcgtgttcagcggcggtggaggcggcgccttcctgcaccacgaacacgcggctcgccaaggcgccgtcccagcggctgatggcctcggtctctccccaaaacccccggcgcccgatttcgccgcgccttcccaggcaggaactttgcgaccccaccccctgggcccgccaccagttcaggcctgcggtgcgcgggagggcatcaagcgcgaggcctcttccgcgccctcggccacctcgccgaccccaggcaagtgggggcagcccaagaagggcaaggagcagctggaccgtgccctggacatgagcggagccgcccgaggacaagggcacttcctcggcatcgtgggcggctcctcggcgggggtcggcagcctggctttctaccccggcgtgcgctcagctttcaagcccgccggcctagcgagggcggcggcggccgctcacggcgacccctaccgggaggagagcagcagcaagcaaggagccggcctcgctttgggcaggctgctgggcgggggccgggcgtgcgggcgccccgggagcggggagaactcggcggcgggcggcgcgggtcaccaccatcaccaccacgcgcaccaccaccaccatcccaagtgcctgctcgctggggacccgccgccgccgccgccgcctggcctgccctgctctggggccctgcgcggcttccctctgctctccgtccccccggaagaggcgtccgccttcaagcacgtggagcgcgccccgcccgcagccgccgcgctgccaggagcgcgttatgcgcagctgccccctgcgccggggttgcccctcgagcgctgcgcgctgccgcccctcgacccgggcggtctcaaagcctatccgggtggtgagtgcagccacctgcccgccgtcatgccggcctttacagtctacaacggggagctgctctacggctcaccggccaccaccgcttattacccgctcaaattgcacttcggcgggctgctgaagtatccggagtccatctcctacttcagcgggcctgcagcggccgccctaagccccgccgagctggggtcgctggccagcatcgaccgagagatcgccatgcacaatcagcagctgtccgagatggctgccgggaagggtcgcggacgcctggactcggggacgttgccaccggccgtcgcggcggcgggaggcaccgggggcggcggcagcggaggcagcggcgcaggtaagcccaagaccggccacctgtgcctctactgtggcaagctgtactcgcgcaagtatgggctcaagatccacatgcggacgcacacgggctacaagccactcaagtgcaaagtctgtctgcggcccttcggcgaccccagcaatctcaacaagcacatccggctgcacgccgagggcaatacgccctaccgctgcgagttctgcggcaaggtacttgtgcgccgccgggacctggagcgacatgtcaagtcccgccaccctggccagagtctgctcgccaaagcgggcgacggcccgggtgccgagcccggctatcccccggagcctggggatcccaagagcgacgacagtgacgtggacgtctgcttcacagacgaccagagcgaccccgaggttgggggcggcggggagcgcgacttgtaacgagtcttcccgggaaggggcg

SEQ ID NO: 5251 - DNA, 1474 bp, Homo sapiens
ccgttcccaaaggctcggggaaggaggttgcgggtgggtggcgcggacctcgggtccccagccatcggcgctctcccggggccctctgacctcgctccttaaaggaggagggtccgtggcaacggtcctcctcggccaggcgctctcgggacgcgggggtgaggagtgagcgccgtggcccaccctactctccgagcggggacggagtgggcgacaccgcgcgcccggctgcacgcaggctctgcgcggctcgaggcggccctacagggggcgaggaggaaccccggagactcggcggagagagcagagacggagctcaccaaggggcttgccgccgcagagcgcgggagccggcactcggtggggccgagggcccggggacgctggggctgcctgacctgagcggcggccgctgaccgttgagggtctctgtggccgcagcgcccagacccggggagaagggcggcctccaagggccgggagcccctcgagggcgcggccagcgaggagggacagagggcggcgcccccggctgcccgggcgcgtagaacaagcagctgccgccagggccgacaaagttgctccccgaggggctgagatccaactttcgcttcccgatttagccaggggagcgcgaggccgcacacaacccggcgcggggggaaagccggctgcagctgcgcctcccatccttacccggctggtccctggcggggagcctgggcagcgccgaccaaagttcggagcggcagcttcggggcgcgggacgcggggcacacgggctcagctgctcgacgggagcccgacgcgcgctcctcggcgggtcggcgggtccggaagctccgctgcccgggccgggtccccaagcccgcagccgctttgactaaaataggcatcgcgacggcggcggcaggcggcggcagccagggctggggccgcaccgcgcacgcgcatgcgcccgccgccccgcgccccccggcgggcggagcccggcgccgcggccaggatttcccacctcgctcccgcgactccgctgcgggtctgcacacccgaggactcggtttgaaacgcccgcttatttattttcttgtcgcctcgctacaagattctatccttgtttgggcatgagtggggggcggcagtctcgtgggaccggcggcattcgtcgttcctccttacggggataattcgagaagtgcggtccgggtagggagagaaatcaggagagaaaatgagaaagagaatcctcgtttcccctcaaagttggacgacccactcgtatatctcctttttgggagattcgcccataactcagcacaaacagggaatagcccggaaagcgcgcgagttcccgtccgattgtggcgggggaggctgaacgtttggtccacacgggtgcaggacgcgggggtcaggcctcctgctgcggaggaagagggggaagaggccgcgcgggagggacttctgacacgcg

SEQ ID NO: 5252 - DNA, 675 bp, Homo sapiens
tcgcggtgcgaagcctcggatccgctgggaaccgcatagtctccggcacccttggccgcatgcttgtcagaggtgggccccgggaaacacactcgctgcccctccaacaagcgtccctcgctccccattggccccccggtccccgccccccaccgccccctcccgctccgcagcccccgagtggcgtcagcacgcccgccgggcatgggctttaaatgcccactagcgggagctcaggcgcttctgccctggagcgcggtcgggagtaaaatcgcaggagtgggagggtagcgagccagctggattccgagccgcggagcgcgctggctttgctccgcctgatgactccagagcgcgggtccaagcgccgcccatgcagcacccctgagctccggggaaggagagttaatgaaaaaacacttaaccgtctccgctgcggagagtcatgagctgtctggatgttatgtaccaagtctatggtcctccgcagccctacttcgcagccgcctacaccccctaccaccaggtacgtgtctcctctggggactttgggaaggagtgcgcgccccccgtttgcggcggcatggcctgtacgccaaggtctgctgtgcctccgcgcgtctcgggcgtccgaccacgaccggcgcagccgggatgcggggattgccggagccg

SEQ ID NO: 5253 - DNA, 1133 bp, Homo sapiens
tcggctccgtagctctccgcgctccgacccttcagatcctcgggagcccaggggagccaggtgctgggcggtgcgtccggtgccgccgcgccccttctcgccacctctggcctctccgccactcgggctttccggccgctctggatgcctcggttgcacccctgttccatgaccccagcttccttccctaaccctcctcttggtcccttctcccccgagcgcgcgcgcacacacacactcggttcgctcccgcggagtggctctgggagcacgaccgacttcagctcagcaaaccgcggtcatgccgcccagactcctcgccccgaggccccggtccccgccgccgccgctttcgcgccgctcctttccgcctagacaccgccgcctgcggccgcctgggcggcagcccctgcggtcctcaaagttggccccctgggagggggcggcagggagcaggatgaaggatttgttgtaggaggaggattcacacatctgggcgaagggaggggcagcgccgctgctgggacgcggcgcggacccgcatcattgcgcgcagcagccgctgcagcagccgccggggaccgcggagccgggacgcccccgctcggcccgcgccccgctccccgccccacccccgcccgccgggcccagcaacgcagggtgcctaggagccgcgggctgcgcagggaggcgggcagcggccctcgcgcgcttctgccgcccccggagccggcgcgcggcgagcgcagggcgagcgcgcgtcgggcggcggccgcgctggggggcgtgaggcgagcggcgcggagagcggcaggggcgaaacttcgcgggccagatgcccgagggcgcggcggcgctgccaggctgccgctgctgcccctgcgggccccgagcgcgcctccgcaggcggcactgcccgcggcgcggcgtgtgcaccgagcgagtgaaggtatgtgtggcgggcgcggctggagctgccgccgccgccgccgccgcgccagcaggtcctaatgcctgtcacttcccaggacgctggcagcagcagcagcccggagcccccgagccctcggcaggtttgcgtgtccttccccgcgatctgattggataaagtgggggctcgacggtggccgacg

SEQ ID NO: 5254 - DNA, 1808 bp, Homo sapiens
gcgcgccggcgctggggatggggtgggggcgctggggcacaagggcgcaggggcgcacggccaccgacagccgggtgcgcctagcttgaggccgcggagaggagccgaactgggatgggtggggggtcttcggcctcaacactgcctgccagccccagtgcgcccaagtctccccgccagagctgcccttctggaggggctcttcgcacgcactgctttccccattcttctggctggaattctccggccgtcactgcagtgtccagagatgctgcgctgtagacccgggaccccttaggcgcctcttcccgtccctctgccaaagcgcaacgcctgtacttttccagctccctctttccctcttgaaattgaaagttattgaggtcgctcagggttgttgctccagcagtttccttccccgcccccgagctcccccccgccccccacagccatcccccctcctctccccctccctgccctcctctccctcccccctccctgccctcctcctcctcctcccctatgtggtgctcccgggagcccagcccaacactggagcgtctcctgctcgcgcacgccagaagcagctcggggtctctccgccgccccttggccatggccgctgtgccgacggcgcccgctcccctgcgctccaggggcccccgccgctgcagccgcagccgccgcagcttctgagcccaaggggccgccgctgcagccgccgccgccgccgctcgcccgcccggatcccgcctgcggcagttgccgcacaacatgctacctgcggccgccccggcggctcctggaaccccggttcgcggcgatgccagccaccccagcgaagccgccgcagttcagtgcttggataatttgaaagtacaatagttggtttccctgtccacccgccccacttcgcttgccatcacagcacgcctatcggatgtgagaggagaagtcccgctgctcgggcactgtctatatacgcctaacacctacatatattttaaaaacattaaatataattaacaatcaaaagaaagaggagaaaggaagggaagcattactgggttactatgcacttgcgactgatttcttggctttttatcattttgaactttatggaatacatcggcagccaaaacgcctcccggggaaggcgccagcgaagaagtaagtgcagggttttttacgcgtttgctccctcccgccgcgttcacctgtcgggtcgctttgcctgtccggagccggctcccaactgcagcggtcctcccgccctgcgcctcgcagaggagatgcaggttcgggctttgggggtatggacggcgtctttcacccttgcctctcggcgcccctgccttccgcagcatcctagccggtgcgaggggcgggcggacgcggcgctaaggtggctcccgccccatggtaacttcaggttcgcgggaaagttcggtcctgggttagactcgcacccgggatttgtgctttccttttgaggatcggacaggggcacccagccgaaggcacttgggactcccagacgcaggatgcctctgaccgctgagtaaatgacaagggaggcgcggccgcggtacccgctcacctagcgcaaccgcctcgcgcggggagacctcggctgggcccttaggctggactccggtagccgaacgcccgctacccggccaggaagccagggagcgagcgcctgcgcggccgcatccccgacacgcaccagcggagccaaagggcgcgcgaggcgatggggttcgcgtgtctgcgcgtttgcagagctgccggacgtcccccgcccg

SEQ ID NO: 5255 - DNA, 1323 bp, Homo sapiens
tcgaacatccgcactgctcatcgaagacccccgtgcttcagttccctctgtcttccatttcccccgcccatggttctcgcccccccaagccgttctccggaaccccttgccgggccggcgggaagcgtggaccgagcgggccttggccgcgtcttttccggccaggtttggtttagctcgcgcagcgcccgcgcagcccgccagggggaccccggcccgccgggcggcatctgaggagaaagcgtccgaggggcgtggagccagggtcctgcggtgcctgctccgggaatactgcgagtcggctggagctccccagccgctccggagaactgggggagccgggtccctggctcggtaaccggtggtcccgcggtagctagaggcgggccccacgggtgggtgtgtccgtttccgcacgccagccttccagcccgggaagagcgcctgcaagcgggtactttgttcccaaagatgggttttgtctgcgggtgatttgggctctcgaagtgcaactttgtggccgggacgcggatcggccggcctgggctcctgcagagcagatcctgtctgcgtcctccaggaggagtgggtggcaggactggggtttcccacaggttttggggcggcggcgagattggcacggtccggggtcgcaggcgcgcagccacgcccctggaagtccgccccggcccccgcccccaacccgcctcttcggggctttatggcgtgaggtttggggctgggatccatctggagccgagcagaaaacttttcccctcccgttcccggtcccttttgtctttcttggacgcggtggcggcgccgcctgagcggcgactccctctcccctgcccggcttgctgcgcccggtgccctccgagggcaggcgcgcctggactctgcgcccggatggcggcggccctctgtgagcaccggcagcggcgcatcccctgccccgaggcctccggtgcccccccggcgcgggcataggggcgcccccaccctccgtccgcttgcaccccttgccacccgccccctcgcctgactcatccgcccgcggtggccgcccgagccctgggatggggagggagaccgcggctgcccgcggcggccgagattcccgctgacgcccccgaccctgccgccttcttcgtccgcctccagaggcgcccgacgtcccgacagctcctggagtgagaccaggactgagaacagggagaggcgacccgacccccagggcccggtgctcaggacaggtgaggggaaggaaagggtgctgacgggagtggggaggtgggtgggcggccaccgcagccgaaaccg

SEQ ID NO: 5256 - DNA, 1501 bp, Homo sapiens
tcgacagtggctctccggcccagggaggagagcgcggtcgcgggtccctcccctcagcctggaggctgcagccgctcgagtcggcccgggtgggggcggggtgggggcggcgcggagggcacggagattacggcggcgccacccgggacatccagggccccgaggccctgggcggtccccacgcgagatcgcaaaccatgacaataggcagtcacccgaggtcaaataaaaacggagtgggtcccccgcgcgccgccgccccccgcgtccctggcggcctcccccgaggcccccggcggcctcacgagcccgcagtagccggtggcgacgtcgcccccgccccacctccctgcgcaagtgcgaggctgccggcagcgcggcgcacgctccggccgttcccggcttccgcgcaaaacttccatcctgtccacgtgaagttgtcgctgccttagagagggggaaagagctgcgggaaaagccggggagtgacgactgcggcggctgggcgcgctctctcattttcttttcttctcctttcccccctgtcgcagtccggagttttggctcctctcctttcctcctccccctcggagccggcttctccctccgccccgcttctcccccgcttgtgtacgctatttgttgtggggtggccgaaggggatgtcctgttttcaccagaggcacagcgcgaaggggaaacttcgacactggaaggaacgagaataaatacttaattacggacgcactgaaccgcggctgggacagacacttcgggaacccgaggcggaccgggcgacgaggtgagtgaccccttcttccaacccccgccccagggctcccgggggagcctgagttgagagaacccccaaactttccgggaaagtgcgcgaggctccgccggggacgccgagcgctgggtactgaggacgcgcagctggacggtgcgtgggcgcctgcgtccccggggggcgcttggaggccgggtgccccacgcctgagggcccgggccgctcggaccgcagcggtgctctctgccctagaagacgtccccaagccccaagggtcccttccgagcctgcctgtcccttccggggtcggcgcggagcctgcgcgtaacggagttcatccagcagtccagcgcgcggcttctacctgcaccccgcctccacctggcagaggcgcgagcatcggggtctcccccacatctttcttatgacgtgtattactttctgatgaccccctagatggtccaggcgcgaggatgctgacccagagtccttcggagggtcacaggcgcctgggctttcccggtgccgggtgcgtgtgtactttaaaggctcgcgttctaatctccaggcactgatcgggcttttcaactgcggcgatcccactttaatagtttttatgtggcgtggactgaatgtctcctgcagtttgccagggtcggtgaaattagaggcgccttgtcagagcagtcgcgttcattggctcgagtagcg

SEQ ID NO: 5257 - DNA, 1744 bp, Homo sapiens
ccggtgggtcgggggcgtggcgagaccctgtttcagtggagggagggcttatgcattgccgagacgccgattatcagaccttgaccctgtcgctttcagaaaaaccactggcagaagatccggaccatggtcaatctgccggtcataagccctttcaagaagcgctacgcctgggtgcagctggcagggcacactggtgagcagtggggcgggtgggcgggtgcccgcgacgggaaggggctgggcggcgctgacggatgccggtcctcagggagttttaaggcggcgggcaccagcgggctgatcctgaagcgctgctcggagccggagcgctactgcctggcgcggctgatggctgacgcgctgcgcggctgcgtgcctgccttccacggcgtggtggagcgcgacggcgaaagctacctgcagctgcaggacctgctcgatggcttcgacggaccttgtgtgctcgactgcaaaatgggcgtcaggtatgcgtgccctgccaggtcggttggggggatcaagtaggggtccggggccgggacagctgcttgagggggacccggggcgagtgctcgaaggggtctccgtgtgcgccccctcatgccctggccgctgcctgcgcccccacaggacttacctagaggaggagctgaccaaggcccgtgagcggcccaagctgcggaaggacatgtacaagaaaatgctggcggtggatcctgaagctcccacggaggaggagcacgcgcagcgcgccgtcaccaagccgcgctacatgcagtggcgggaaggcatcagctccagcaccaccctcggcttccgcatcgagggcatcaaggtgaggcaggcgcgcttcgctggcaccgccgcagccccactgcgcgctgtctttcccgatcccccgctcccgccccgcctgcccctccgccctctcccaccgcctcgccgtcccctgcaactgggaggtaccgctgctctacgctgtcctcttccccactggcgggcccggggcccctgacactcctgtcccacatccagaaagcggacggctcctgcagcaccgacttcaagactacgcgaagccgagagcaggtgcttcgcgtctttgaagagtttgtgcaaggagatgaggaagtgctggtgagagcgggatcccaaaccctgaggtgttggggagcctgaagccgaggactgcccctgtcatctggcccagtgccctcggctgtgtccccaccatggccctcaccgcgctggctcgcaactgctctacgctccttcccttctgggccacgctgggcggggccctgggtcctcctcctggcggcatttgccaagcacagcgtgggtcccggctcctcatcgttagcaggggctcatttggcgtttagttaatttgccctcctctcccaccccaccctctgcagaggcggtatctgaaccgcctgcagcagatccgggacaccctggaggtatccgagttcttcaggaggcacgaggtaagcggcggctgcccgggtgcccgggccgcgagggctagggcgggaacccggcaagggcgtctctgggcagggccgcggcctgacggtgcggggctcgcaggtgatcggcagctcgctcctctttgtgcacgatcactgccatcgcgccggcgtgtggctcatcgacttcggcaagaccacgcccctccccgatggccagatcctggaccaccggcggccctgggaggagggcaaccgcgaggacg

SEQ ID NO: 5258 - DNA, 1801 bp, Homo sapiens
tcgtccccgggcgacaggggttctcccacgtgaaccgacgtcccgggctccgggcgaggcgcagggctcagggcgcagggcgggtcccgtacgcagggcgggcgcgcgggcatctttgtggccaggcgaccccggctcgctctcccggagcccagggactcccgaggctggcgcgggctgcccgcgacaaggtgccagcagcctcgggctcgcgaggagcagctcccacccgcggcttccgagtccagctctgtccctccgccatcccctagtcctccggcatttattcagggagacagggaggcagagagaagaggagaaagcggccgtgtctgcacccagcctctgccgcagcactcgatgagggacagcagggaggctggcggggaggcagagattaaactatgattccatcgatcacggaaagaccaccatcacctacagcaaaggaggctccgatgcgcccacccgggcagcgactcgcggttggtgggcgttcctcgtcctcgccccctcggtggctgtggaatccaccccgcgccgcacacgccaggactccctttcctttgactaaggggaggggaaggaacaaaagagaccccccaccccctatacatacatacacatacacacacacacacacacacacacacccctccggtattttactgctggtcaaaggattcattttcgcaacctcttcttcgaacaccttccccacctgagcagtgcattttcccaaaggtaaagagagataagggaggaaacacagcacccaaggtgatcagtcgattggacactgttgatggcacattctcctcgttcccaaccaaccgcacaaaacccgcaacacctcgcgtccccgcggggtctcccgcgcccctggcccggccctcccggccgcccccagcaggcgccccgctctccgcgggaactctgggacctggccgagcgttccccggcgggcaggacactcgcccggttccctgcagcagctgagggcggcgagcggaccgcgtccaggcagcgacgcgggattcaacttcccggacccgcggcgcggcccccgctcccgctcagggcgccgcggccacagctgagaccccagcgccgcgcagccgcccccgccggggcatgggcggtcgcgctctccgccccctccttccttcacctcccccctaccttgaaaaaaatccatccattggtgcaaagcagacattttgatgtcatttacttagcaccgcttgttttggaggcagcgtcttacccggtcgcctggaggtgtgggcagcgcgccgatgggtccgggggagcggggctgggcggctcggtcctctagcggagccggtttgctgccatccgcccaacttcagcacccagcgggcgaggagagagggagagcggcgaggatgcagaggagggggagggggaggagggagcggtgggcggggagggagcgagagccgctcggcagcgcgcatgcgcctcgcgggccggcgcagcccctcgcccggcgcggccggaggggcagcttcccagcccctgcgcgcggccgcgagagtcccggccccgccccctccccgggcggcccccggccccgcccgacctcgcgcgctcgcctgggcgcggcgcccaccgtgcggaggggctcggccgggactctcggcttcggtgacgcccgtccggagcttcgcgggaggcccggagtcccgagagcttccctgggtgacagcggctctccgcccgggcccctgcaactccactcgcccgtagcccgcgcgctgctgtcctgggctgcgcg

SEQ ID NO: 5259 - DNA, 1801 bp, Homo sapiens; identical to SEQ ID NO: 5258

SEQ ID NO: 5260 - DNA, 1684 bp, Homo sapiens
gcgctgggcggtgagttcagccaggttatctctgcgaggacaccggtcggcggcggacagcagcacgcggcgtccaggacccggccttcctagagcttaggtcactgtagcctccaggggcgctccgagtccatctggagggccgcgaggcttccaggctggaaggaggaatagggagaaggaggaatagggagacctggggcagtgttacaattacagaaaagggagaggcgaggtccgctgagtccttggcctgggcaacaaggcacactgaaaactgggttccttttcgacccgcatcgtgcgcgccctagaaatgacagccagacggagcagggtctaaggacgctgaaaacccctgacgtgggcgcgccgggtgcgggtagggacgtggaaggactgggctagccacaggaactacagcgctgcggaccgggtgaggggtcccggcccgagtccccacttggggcgcagaggtgtttctgtaaggggacaaagggcactcctcggcgcgatgggcgacttccccagccagaaaatgagagggttagacgaggggaggaacttcctcagccacttggcccggcacagcgaccgccccaagttcagaaccgctaagtcagtccggggcgctccggccccttcgtcccgcgccccgcccgcctccagcccgggccccgccgcccccgtcgcccctgtcgcccgggtcgcccccgccggccctggccccggccccgcacaccggcagggggcgcccgagcgcagctaaaaggctcggcgggaggtcggcggcctcagtggcggagcgcggctgccggtgtgcggccgggagcgatcgccgcggggcaggggcgcggcgggcaccgcgcagagcgcgcagaacagacggacggcggcggggacccgacggcggcgcctcggcactccccagactccggccagcgcccccctgccagccgcaagcacccagccccggcccaccccgggctctcgatggcccccgaggccggggcgaccctgcgcgcgccgcgccggctgtcctgggcggcgctgctgctcttggccgcgctgctccccgtcgcctcctcggcggcggcctcaggtacgcgccgcgcccgggcccccggcgctcctcagctccccgcgcaccctcctgcgctcgggccccgtcgtcccgctcagtgctggctacgggtcgtgtcactagcctgtgcgtcctcgtcactcgcgggtcggggcacttggcgccctgtgtgggtggcgggagcggggacgcctcggtgcccggggaccgcagcgcgctggcgtttaactttgccgtcgcccgccttggagtcgggaggctccagccgtctaagtgtcccgggagattcaggcacagcggggaaaaaaggaaaagaaaggcgactttcagcgtgcggactggggtaatgcctttctttgcccagaatttctcgggagcgtaggtggtcatcctactttctccgcgttcacctctcgcgaggcaggatgacgggcgcactcgggagaccggagggaggcagagcagggctgttctagaaggtcgtgggggaaaggctgcgagctgccgcagggcgtcgggtgcctctgcgctccagaggagaagcgctccagtgccagctcggctccaggcggcaggaggcccgcgcgcccggggggaacg

SEQ ID NO: 5261 - DNA, 6657 bp, Homo sapiens
ccgggctcggcccgctctgtctccctgttccctggaggtctgggcgcccccgcgcagggactaagggctggacagccgcaggcaggggctccgtccttggcctccacccttcgtgtccagcaatcccgggagcaggcggcggcacttcctccatgccccggcctcaatcacggtctcagtccccccaaccccgtcctgcaggaacaagtgtggtagaggctcggggtcggagggcgggcggccgtcccgcgggctggacggagtttctgggctgcggagaggccgttggacccacgtccggacaggagccccgcgcgcccatccccggcccggccatcctcggggcgcgctgtctgcggcctcccgcgccacccccacccctgtcccgggacctcctccgggaaagacacccggggagcagccccctcccctccagtagtcccctcccctcccctctccctgccctcttgacggtgtggggctccccggccggaggggcgcggcgctggcagcggggtccagagtgtcgcgcccagcgcgcgctgggggtcccgggctccgcagctccgcacgcggccggtttgtgaagcggcgcgcgggggcttagccgggcgagggcgctcttgagcctggtttggaatttttagcccacacgaaagccgcaggctggggaaggggcgggtgggagcgggagacgccctgggaagccgtgagaccgctcggcgagggctcgggaccaccagggagcgacgggggacccctcggctcagagcccgagggcgcgatttcggatccgctgggattccggaggcacatgaagggagagggaaatccgctaaaccgaaccttccgggaatcggaaggcgccgggccgctcccacgcctccccctcctcccggccgaaaggcggggggcgacgcgcaacggggagggaagggagggaggggtcggcgaccttaggggagggcgagtctctggggacgcggggccgccaggggcccgacgaccctctcgctccacctccccgcccccaagtgccccgctctccccccgccccgcaaacgcgcgtcctgcgggctgtgctttggccctcgcggacgcgcgcgctcacagagggtctgacttggggtcaacttccacgaggttgccgggcgcctgtgagcacagccgtgtccccacccaggggcccacctcccagcgccaccagggtcccgacccccagaccttcggacgcttctcttccaaaccgaagcctgggagcctctgggtggcctggggcgggggcagggggcgagcggggcgggccaggaggagggggcgaggccgccactcggcttcccacgccgcccccgcggctggctccaacttcccctccggagcccccctccggccaccccccagcccaccgacgtgcgggcagcgaccccgccccccgcccctccggtcgcccccgccgcggcccccgccccctccccatccctccccgcgcgctctcccacatgaaaccttccatcacgctcagaaagaatgtgctacaacctcggcgctgccgcggccgccaccactgcgcccgcgcccgagcccgagtcggagccggagccgccgctcccccgcctgcccggccagccccgggctccgagcgcgcggtccccgccgccgccgccccgcgctcgccccgcgcttgacgcagtgagcgccgcagcctggctcccgccggctccgctgggctccgggtcgcaggccgagtccagccgggcgggctccgggaggggccggcagggcgggagggggaggagggctgtctggagccagcgagcccggaggaggaagaggaggaggaaggaggggaagccgccgccgccgccgccgcgctcggggaaccggggtgcgcgcgctctgctcgcccgcgacagtgcctccagcccggggcccgcaccccggcccaggtaagaaggggcctgaggggcagggggctgtccggggccgggggacccctctgtcgccgctgcgggatcggagggtccccgcccctaggggaggcagggaagaggatgctctctggggggggcggcggggggcagcgcagggtccccagcggctctcgcagcccgggccaccccatccctggtgccctgacctcggcgtccgcgccagggccgagtctccccgcccgcggggctctggatgcggcgctcggggcccgcggctcccgggcgtccccatccacccacccaggttcggaggcgggcgcacccgaagttagcggccgccgagcctgggccggacaaacttccctccccgacgccgcggctggaagggccaggactccggacccctagggctagggaggcgccgcggggaccccgaaactttccggagcgcgctgagagcaaaaagccggctgggcagaaagagggggagggggctgggcgcgccttcgagtgcgctggggtagccgcggcgccccaagttgaaccacagacgaacccctcttcatctgaaacctggtctcggagtcggaggtggggagggagtgggctgtgggtgcctcgacttcgcaaagccggcgtgggggggcgcagcgccccgccccgcgccgcttgaacctccggagggggtgttacgggacccccgcccccaccccagccggtggctgggctctgccgaccgctgcggagctcccgggaaggacccgctcgcggctattaataggcgtcggtgaccctagcctctcccggtccgggaagctggcgcggcggggctgggctgggctgggctgccgagtggggcgggaccccggggcccagagcggacccccagctctcctggtccctcttccgccgctcttccctccctgccgcctgctttcctcccattttccctcttcgatctcggggtgtcggcccccccccgaactttttctcttcccaaactgcacggtggccacccggtcacggccctgggccgtacccgcgcaatctcagcaccattcccgaccgagtcctccgccgcgggctgagcgcgagtccccggggccaggctgcccagggaggagcagggacttcctacaatccgcgcccttcctcccaacccacggcgagcgcaacacattcgcccgcccctgcggccccatctgagggcggggagaggtcgctgggggcagcttcgggggttgtggagggcaggggggacccgcgaagctcctggagcgtttagggatgcagctcgggcggcgtgtgcagggaggaagcagcgtcccggcgtccccccttcagcgtcgccttcgcgcgcctcgagggcccaggagggttcggtctcccccaccccacctggacactcaggtctgagcctgagtggatttgaggatctgggggacggggaatacggagtccttcttcctgcctcggtgtctgcagagcccagccctcaggcagcgtggggatctttgtccccagggccagcgccggccccgccccccgccccgttaactccgggactccgccgccctccaggttccaacctcccagcttcaccgccgcgtcctctccccggttctgggtctgggggaggggcagggggcgtggagcgcggcgttgggccccggacagatgtcctcgcggcggcggcgccggcgtccgggtaacagcaggccgccaatcggcgcggccacgggggaggggcgacccggccgggactccggggactcggtcgcagccggacggcgcagcctccgctcggggtggggggggggggcggccgcgaggactcgacccctgccgtgcagcccggcctccagtcctctgccgtcccctcccccagctccaggtttcgctctctgctggggtcctggctcctcaggttgcgggatctcgcctcccacggccccgcgcgcgtacccctacccgcccctcaagttgacctctgaggttctccgtggatctcagaccccgagtgaccgcagaactgacctctggggtcaggcagtaccggtcaagggcgctctgaagaggccctcggcctcagtttgcaccccgaggaaatggactcatcatgcctgctcctgggaagtagcaggacgtcctggcgcggctcctccgggcaggcgcccagcacagcgcagggcacacgggggacacctgcgaaggcaaaggaggctcattccagagcttcggctgcacttggccagcacaggcctgggggaacctgctggaaatggggatccagtacctctcttggggtttatgtttggcaggcggagtggataggctggggcccggagcccggtggtcatcttctgcacaaggctggccaggccagaagctggagggtagcttactgggaccttccaagcgtgaccaaggaagctctgggggccgaccagcttctccctagtggagctgcagctggggagacctcacagacaggcagggaggagagggtgccccgctcaccgccggcctcgttccacaggcccaggcctggcacatcccaggcttgcagtatctatctggtgggtaaacaaggacctgctcttggcctgcggcctggctctgaccgtggtccaggtcggggcagagggagaaaggccacagcttaggtgttccaaaccaccggtgcccttcctgccggcccctggggctgtgctgggtttccagggcccctgccccccagtatttgcatgaaatcgtgggggcgcactggctttcgtcctagcactccccttcaaggctctgcacccctatcacgggagccccacccagccagccgaaggaggccacaagctctaaattactaaattcgggccagtgctgggggcctgggagccaaggcagctcagagcccactctccgattctggctcctggagaaccctaggacccgggcgtgtcaggccctgcagccgggctaggccggtccatacaggactgaacggcgtcgtgggcgttcattcacattccctctccggtccccacacactataggatttatcttgatttgctgcctttgaattgagtcaactcttttgtatgctcgttgaattgcccagctgctggcggcgagcggagagcgtgccgggggtactgaggccgggaaccagaggcgggcgggggacaggaagcggggagggggcgccggcggggacgcgcgggctgcgcggggactggagagggtccccaggcgccggccgttctgcgaacgcgggcttgtccaggcaccgccggggcctgcccggcccgagcgtggagtcccgaggctcctgccgggggtccaggctgcccctggggctctgccttcgacgcgctgtgtagggccagattctgggcctctcttgactcagtttcccttcctgtaacatgcggacgggggcttccgcacaggcaggttgtcagggtgaaactgagccgaagagtgctccagaaccccctgaagtcctcacagaggttggggtgaatgaaggaaggaagcggggccagggctgggcagaggaggcccggcctgcgccctgcgttctccgcccctaggtccctgccctcccggataaggggcggaccgacgggaggacctgagaacgccttggctttgcttgaggtggtgggagtcgcgggtagcttgttcagccaacagctgtcgcccccactccccccacccacccacccaccccctccaccttttagatgtgggcggggagggccggggacggaccgcgaggacgccccctgcgctttctaggacctcccctccttccccagcccctgcgcgtcgccgggagagggaaggagcgggttgccgcggggagccgaggagagcagggggctcgggaggccagggagagaaggggagggccagaggctccgagccggactcgcggcggaggaagagggggtggaagggagcgcgcaggcgggcgagggagcgagggagggagagaaggagggagggagggagggaaggggggcgggagggggcagggcgagcttgaattcccccccggccgcgcggcgaggggcggggccgcgcgcgcagatcgatgggcgaagctggggaggaatttcaatcccgggagcgaagttagagcttgaaggacggcggcggctgcgggcgcagccccggaaccgaggccgggcgggcaggtaagcggcgagcgcggccgggcgctgaacctgggggacttgggacccggaccacccccggggagcggcgcggccaagccccccgccacctcgaaccccgggcgtccccgagtgcgcagcgtgcgcccccagcccctgctgcgcccccaggcctggcgcgcgatccgagcgcagcgggcaaagttggaggaacttggcggcggcggagcgggcgcaggctcagcccgacaaagcccgggggcccgggtcggggtcgctgccgcagcccgcacgctgccccgtgcctccgagaggtcccttccccagcgcctctctcccttccgtcccccttcgccgtccgcaccctgcccggcgccccccagacgcggccccctgcccttcccttcccggaaattagggggctgtcctcacctcctggccgagtcgctgacccctccccaggctcgcatcgccctccctgctgggccgccctccccccgacgctgcgagcctcctcgctccgcgcggggaccgtccagtcacgcacg

SEQ ID NO: 5262 - DNA, 546 bp, Homo sapiens
gcgggcgccccggttactccatcccagcgagaagacgaggctgcctgggtcctggttttctcgggcgggggtcaggggtccgccgatcccctctagcgctccgggcggcggggcccgagaaccaaggtggcctccgcggcccccgccgccgcgcgcccctccctccctccccgcggacctccgcggccgccgctcacctcgcgtatttcgtcttctggaaatccagcagccggggggcgaacatcgcggcgcttccatgggaatctggccccgggctcagagcgcgggtagctggcagagcctggggggcgcggcggcggcagcagcaggttggagggcgcgcggcgggggccaaggggacctggtcggcgcccggagccggagccggagcccgagccggagctggaggcgcccggagccgccgacgccaaatcccgagcagatggtggcgggggcggggcgggcgggggcacgggggggctcccgggctcgcgctgccaatcgcctaagcccggccccctccctcccgcgaccccgccgcctccg

SEQ ID NO: 5263 - DNA, 288 bp, Homo sapiens
tcgcgagaggaagagagctgagccgctgtaaccctgggcctgggattgcggggacgggacgggtgggaagcggccaaaggcgcagcggcttctggtcagagccgcagaggcctgagacgtgggccgcgccccggcccaggagaccccgcggccgcgccctaaccctcagtctcccgactgcgactgcgacccgggaaaacgcctacgtttttggaaaggaagtcccatcacagggagctgacccggtgtcagcgcgcagcacgttcccggcccgcagtgcgccgcgcg

SEQ ID NO: 5264 - DNA, 947 bp, Homo sapiens
ccgtatctgttccgcggtccgcctccctgcacacacgcccccgagccgggagagcctccgcagcacccagagaagagaccggaacacaaaggatgaacgaatggggagggggggtttggggggttgggagaacgaaaataccagctgcgcttccaacatccaaggaaggaagtggcagcggggacggggagaggatgggaaggggatgctgactgcgagttggggcgggacgcggtgatgggaggggaccgggccgggaatgcgggaggcgaggggagcgacgggacctgccgttccggcggccgggcagccaatcgattcgtctcccctaggaaggagcgaggggagggtggcccagagagaaagcgccgcgcggcctcggctgcccccggcccgggacacccaaacagaccaaagaggatccggagtggagcccggagcggatcccgcagcccgcgcccgccgcgcacttacccgcgcgcccgctgctgggtccccggcagccgcgccccctgcgctggcggagtcggaggagcctgcgctgggccggcggggggcgggcgcttggggagggcggagagagggcccgcccgccgggacctttgctcggtccgggcgccccagagccgcgggactggccgccggaggctgcgggaggggcccgggccagacctcccagaagccccagagagagccgcttcccctccttcgtgtgactctctgggagccgggttgctgacggcccagcgctcagccggagtccccgcgcgcttttcgggactcacccgggagatgtcggggcctctcgggaagagtgggctgcgcctgccttccgcggccgcctcgcctcttcgctgcgcgggaccgtggggtttgagagcggcgcctcctcgcggggccgaacccgccacccacagtggagtgtggactgacaccgcggcctcacg

SEQ ID NO: 5265 - DNA, 1313 bp, Homo sapiens
ccgtgtcacacggcgctgggctctgcaagctgttgcttgcgcagtcgcccccgccgctgccgctcccgggcgggtgcaccagggtccgcgcgggcggggcggggtcggggcgggaccggggcggggcctgccccctcgacgcgccggccccgcccctcgctccgtccctccccagcggaccgcaatgatttagaagttcaggaatcccacgtgacgtcaccgggggggtgatgtaatgcactctaaatagaatgtattgtaatctttgctcagtccaacgtggtcccttcacccgggctccgctcttgccttctccacacttgtttggtaagttcctaaaaatacggctcggccacttctggggcttttgcatttagccacttttgttgcacttgccgcaggagccatctcgggagtgtacttgtttgcaggggttggttctcggcagcagccgcgaggttacttggtccagtgggcaggtcacagggcaaggagtagggaagatgcgatgcatttttttctggagggtgatctgtgtttgtaaacattttggcggaccagagggaagtccggccccgagtgctggtagactgtggaattcggctgtgtcctgaggccaccctagagaccccgcgccgcgtgagtgccggagcgctcggtggccgccgcgccgcgcgcctggagggatgctaacgtggagccggcgccgagtccgcccggcgtgcgtgcgtgtgtgggagcgcgcgagtcccctgacgcggggaccagttatgaatcgggggtgtgtgtttgcctccagagacctggcaaggtgcggagccctccagaagtgcggtcaagcggcagcggagacggcgagccaggaacctccccccgcgtccccagcttcccagcgtggcggcggaacccccggagaaagtttgcaaacttccagcgggcgcggcgaggacgccgggtcacctagggggcgggtgggcgcgcgcgcagggggctcgctctccccggtgcggagctgcagctgccacctctcccgccgggctgccggctgcagcgggtgggcgcgcgcccggggaggggaggtcgccctcggagggcgcttggctttcgctccaggcgctccgggctggagagcggcgaggctccgtccgctccagtccactcctccggccgcctcctgcctccgctgctttcttgctggcatcgttacctcttcccggccgctgccccaaatgacagctccggctcgagctttggcggcgcccaggcaattcccaagacctggcggcggagtctccccctgcggcagattctcg

SEQ ID NO: 5266 - DNA, 848 bp, Homo sapiens
ccgtctcctcgcccagctcgcgatgcccagccaggcgcggcgcgcgtttgcccggcactttctcggcgcgctcccccttctgcgcccccagactccgacttagagcggactccgatcgcggcaaaccatggccccaggtgcgctccggaggcagctgcgggaaccagccatggtcccgggctaatgcccagggataagcacagggatagggatagagatagggattgggattggactccagctccaagagaaagcacctcgggtctattcgtattctccccctacccccaaacaaagccacagaagcgatcagcgcgcagctaaagggtttggaggtgaaaaggagggctgggtggggaggagagaaagtgagaagggagagaaaagcggcggctgagcaaagcgggagccggcgcgggcggtggggcctgacccggacgccgcgcacccggctccgccccgcgcccagcgccccgctcactccctggccgcgcctgccttcgcgcccctctgttttctctcacttaccagcagctctgctgacaagcgagaaaactgacaagtgagaaaagtcgtctgtcagcgcccgggctggtgtctgggctgtcaccgcgggcgcggagggaggggcgcgcgggcaccgccgtctgccgggcacacgctgggctccgaccccggccgggcacactcacccccgcagggcagccgcggccaccaccgacctgcggagctgcgtgggcttccggaaccctcacctcaacaagagctcggctccgcgcgcaagtaggagggaagggaaatccttatcctcccggggccagggcacgcagaagccgcgaggcttcgcg

SEQ ID NO: 5267 - DNA, 2406 bp, Homo sapiens
gcgcagcgctatagccgcgactgcggcggcggcggcggcgcagggggcgggggaggagagaagcgcccacttcgtcccgctgcctccgcagcagccctggccctagccccggcgcatcagagcggtccttgggaatctttgggcttgttgctccggcggccgccagctgggagcccaccaccgctcgatggtaccgaaccgacccgtgtagccccataaccccagcccaactccgaggagctagcgcagaccgctctccgccctcagctgcggcgaggcaagggctggcagcgctcggacgcctccgtcttgcccttcccatgcctaagcgcggggaattacacgttcccggtgtagaacagacgatcggggctattagggctgggcggtgggagtgggggttgggagcaccatttttggctggacgtgtgtccagactcatcgtctctggtccttaggaccccatcttcctctgcatctccaggtgtcggcccctctgtacccgcctcccacggggctcgtccggcgaagggcagccgcagcccacatctactccccgccctcaatccctgccccctctgcccgccgcagtcactcgcctggctgggagcaagcctcccctctcgctgagggtgcagagagcgcctagggcgccaagagtagaggggccaaagttcaagcgccatcagccagccgaaggccctgagcccccagggccgcggccgggacgcagggaggtcaggacgcgacgctcgcctcacctgtttctccagcggctccttggccgacagcgccggcttgggggagggcgcgcggtcgcagacgcagccctccagcaggtaaagccccgagggccgcgagctcgagtcgctctcgaagtagaagagcaggttctgcagcagcgcgaaccacttggtttgccattttgtgttgtccgaactccgcttgctcaggtagcctttgcgcgtgccgtccttgcgcgccagcagtcccagggacgcgacgtggccatcattcagccggatccccttctgcatggtgctcagaggccagcgagaccccacgcgcttacatcttctccgcgcagcagccccccgtccgtgcgcgctgcgcgctgcctctctctggcgctcgctcgctcgctccctctagctctcccctccccccaaatatctacactccaggatctggcgccgagccgcggcttcttgaatccagatataccattccccgctggaacctcttctccgctccgcagagccccagtacccggaagatgccgcccgaccctcctccggtgccgggcaaactgagggactggcgatctgcgcgctggcgaggggcaggcggagtcatgtgacgccgatccctcgaagagcccgtttcagcagcgcggacagggacacacgcacgcagccccgccgaggcgcagagccgcgcgcaggctgcaacttggtgcctcctccccctccccagacacacacacacgcacacgcacacgcacacactcaaaccctgccctccctcccctcatctccccttctctccctcggatgttaaaaagcaaatcagatcaattttcgtttaacccaatgaaaccccgaaggctcgccatcccgggagtttgcgtctttgcgccccaccgcggcgcactgtagacctggggttaagtgccagttgtcattttctcctccaaaggctcgccccccccccccactttatttctaatacgaggtggaaggaggaaggtgggtggcgaaatagagctgcaaaagcgtccagtcctagtctttgcatagtcagccgggtcacattgaattccagcatccggctgcactcccggcggcttccccagctacctgaggacagtacagggggtgagatggggtggtggttggtgaacgttggttactttattttatattattttattttgagagttgccataattaccggcgccaccccccgtgcaccctgaggtctggttggcgagccgctgctgggagttttctgcaaataccccccaaagcctgaaggcgggcttcaaacgcaggcgccggggaccatgggagccttcaaatagctgcgctggcgcaatgataccttaatgatagattttccgttcttatttttagctctcattcgcctacacagttacacggcatttatccgagaacgtcacagcgcccgcatgctgcaccgggagggcgcgcgggccgccgggcgagccgggagctggggcggggagcgcgcatcgctgtctgccgcagagggcagcgagctcgccccgacccggagcaagccgcgcctggcccgggcgctttgcagcggggatgggtgcccgcgcagccctgtgaaggaaagacaccatctttccgcacggaaactgcgtatacccctcccccg

SEQ ID NO: 5268 - DNA, 1218 bp, Homo sapiens
ccgcgcctgcagttcgtgcacctcttcccggagctgcgccagggaattacggacgaactggaaggggtcgagaagggtcttggccaccacctttagctccaagccttttcgctttttcagatttgggatcctccccggggaggacctcctggcgccccctggcagtttcccgccgcctagggccgacttttccacctccagctcccgggcgggggaggccccgtacggccgcttagacgggctggggcgggaagattgcagcggctttgggtttactccttgtttcttcataatccctagtggagctgggtcaatttcaggcacagcccatccgagtcaggcgaggtccagaaaggcctgactcgcctggcagcctcaacggacttgtccccgcagccgttgactagccgttgacgagcggacctcccggtcgtcatggcgactgtgaaatgtagggtggagcgcatgcgttcgaagccattcgcgcgggcagtccctgcgtgtccccctgcgtgtccccccacgtgctccccagcgcgcgcagcaccccgcctctgcgcttccccgagcgtgcagcttccggtgagggcagccccacgcacagcccccaacaccctccccagcgcctgcagccttcggtgcgcgcagtccccaagcccacatgcgcagttctcaccttgcgcgcagccccacgtacagcccccaacacgctcccagccccactggcgcagaacccatcaccgcttgcccttcacgcgcttcattgggagtgcagctcccaccccgagcgcgcagctccacgcagcctctccacactctccccagcgcttgcagcaccccccagtgcgcacagctctgccagtagcttcccggcgcgccgcccctgcaccgcttcgggccataaccttgctggcgactaagtctgaagaacttcctgtggtttcattcttttcttcaggtttagtcttagctctgacattttaaccaaaaggttacacgttaattaacgaggtattaaaggggaagatctcagctgaaagaaatgactgtaggaagtgtgtcagggaagccaacggaaccgctggcccgccggtggtgcgcccggcattaggaaagtctctacgatcgctgaggtatcgggcagtcagtgcccgttgccaacgcggagggaacgggcggagactgcgggcaacacgtggcagagccggcgtgagtccg

SEQ ID NO: 5269 - DNA, 1848 bp, Homo sapiens
acgacgaaggcgcgcctctctccatccgctcacaccacacccccgccctccgaagcatagcccgggctggagaagccccagcggcggcggcccccgcggcggaggtccccgcgcgcacccaccatgcctcccgcctccttccgcccatcccgagcgccgtgcgcgcccgaagcccgagccgtagagcgccaccgcgcaaaggaaggagccaggcgcgtgcggggctcgcggagttcttctgaaccctttggatgggggcggaggcgaggggcgccgccaccactgcggcaaacttcgtcccccctccgggaggtgaaattctccaatccgtctccggccggtccgcgggtcggactcttcggaaaggaccttccaggaggagggagcgaatgcaagccttgctcggacgcctcaccggcggctctctaaatctgggcgccttttgacagccattttcactccatcccgtccccacgctggggaccacctctggccccggaggcgcgggcgcggccgcaggagcgggctgcggggtccgcgaaacaaagaacttcgagcgggacgtacctgcggcggcagcggctgtcaagtccccgaacttcccatagacccgcggacggggcgcaggctggcggctccccgctccgcgcggccgcgggcggctacggctaccgcgagcggccgggctgggcgcggggtgcgcccgccgcgggcatggtgcggcgcgggcggccgcggggcgcgcggggaaggcgggagagcggcgcgggtgagtgggagcggcgggtgtgcgcgagtgcgagtgtgcgagcgcgccggtggcgctgcccctgcccgctccctcccgctcgtgcagctccggcatcagtttcggggatcgtgtaatccgatcccttctgactcacaagccctgagtgacagttctgatttggttcaaccgcgggagggaggggaaagagaaagaaagaaacccccagccgtacgcctctcctggcatccaatcgactttctggaaaaaggtcccatcccggcctggtgccccgtgctgggtggagaagccccccgccccgacctggcaccgcctgcactactcacggggtggaaaagttgtccctcggctccgcgctcccctcccgcgcgctccctccttcccttctctcctcctcttcctcctcctccccgcgctcctcctcccccaagttttaacagatgttgccggactctcctcgctccctcgcactctctcttcctccgccccggcccccgcccagtcccttttctttcagccactctcgggctcggaggggacgcgctgagcagcaggacgcctgccgccgcagggggcgaagttgggaaaacttggagtgctgctcgccttacttttgctttctcgctccttccaggccgcgccgggagcccccgcttctcccgcccgccgggtccccaagcccggagtgggtcccagctgcgaggcgggcggcggcggctgggaggcggcgcgtcgcgggccggggtcgggggctgggggggagcccgggcgccgcgagccacgcgcgcgctccctccccgccctccgccgccgccgccgccgccgccgccgcctcctcctcctcctcctccttctcctcctcctcctcctcctccgcccctccccggtcttcacacagacacattcatgcctgctcctcctcttccccctacttgaccccgcgccctcccggcgcgccgaagccccacccacccggcgaggggaagggggcccgggcgtgatgtcacccgcgccctctctcttctctctccacaccgccaggacaccccccaaatgcgcgccctggcactcgtgctgcg

SEQ ID NO: 5270 - DNA, 2119 bp, Homo sapiens
ccgccgcctccccagcacagctcccgcagcccgcacccgcccacagggtctccgcgaccctagagcttagggaagaattgccgaggggcggggggtccctcatgcgcatggaagggacgtacgccccaggcctccaccttcctcctgaccccggggattcttggacgtcgattctccgtctcgtaggggcgagggccctgggttcgcagtcagacgcgggcccctctcaaatctagtggcctggttttattgagtgggggaaggcacatattttccaagattaactgccccgcaacagggaatttcgcaggatttcagtattttcgactccccaggtgacgccaagagggtgggttccactgtgcacggtggggaaactgaggctcggaggggacaaggaaggtactcgaggtcacgcggctcctccggcgggcgggaacgcaggacgcggagttggggcgcgggctgtgcgcgcccaggttcgcggctcccggggctcggctgtcgcagcgcggtcgccgccgaggaccacggtcggggcgcgggcgggctccagtgcgcaggcgcggcgggcgggaggggacgcgctccgggcgcgcgcgcggggcagccggcgccccaactccgcccgccccgcgccccgcgccccggcgcctcgccgcccgccgcccgcccgccccggcgccgccgcccgcgccccggcgccccgggccggcgaggggcgcgcccgcggccgcggccgctgcatggcgctgagatggcgggggcgccgcgcggcggaggcggcggcggaggcggcgcgggcgagcccgggggcgccgagcgggcggccgggacaagccgccggcgcgggctccgggcgtgcgacgaggagttcgcttgcccagagctggaggcgctgttccgcggctacacgctgcggctggagcaggcggccacgctgaaggcgctggccgttctcagcctgctggcgggcgcgctggcgctggccgagctgctgggcgcgccggggcccgcgcccggcctggccaagggctcacacccggtgcactgcgtcctcttcctggcgctgctcgtggtaaccaacgtccggtccctgcaggtgccccagctgcagcaggtcggccagctggcgctgctcttcagcctcaccttcgcgctgctctgctgtcctttcgcgctgggcggccccgcccggggttccgccggggccgctggggggccagcgaccgccgaacaaggggtttggcagctccttttggtcaccttcgtgtcctatgccttgctgcccgtgcgcagcctgctggccataggctttgggctcgtggtggctgcgtcgcacttgctggtcacagccaccttggtccccgccaagcgcccacgtctctggaggacggtaagtgcagccgcgcacccctcatctggtctcggacacacttgctgggacgatgctgggaatgcccggagtcgggcgcgctttttcctatgcggcgggtggggacactgaggctccgagtgggggtgtgttcaaggtcactcctacgagttggggacgcagtcggggctggcaccctccggccagggctctcttcagagttacaatccacgaagcgcccctggcgtgaagtgtggagaggggagacaggtgtggagagagaaaggtttggccaaggtcagggagctgatgagcggccagacggcggccagaggggtccgccggtcttttgccgcacccatccccacagagggactgaaagtgggcgaggagagcagacccccagggcaagctccaaggccggctctgcgcgcagcgctgggctcttcccctgcgcacctagagcgcgtgctgggctcgcctcccaaccctgcggacccgagggtggtatatgggtggtgggaaaggacttcggctcttccagccttgctggccacccttctgtggacatgcctccggcccagaaagagtggggtttgccaaggtcaaacacagtctagtccctgccgctgccactcggcggttgccctgaccctgccttttctgcgcccgaactttgtcactgtcttcccagtcgggcgggcgagatggttgcaaggacggggacgctgtctgcctcccgcg

SEQ ID NO: 5271 - DNA, 562 bp, Homo sapiens
ccgtagggcgaaggggtgcgctgtcagatgtggcattcccgttttacggagacacacggtgtcttacacgccagggagaggtctgagacgcaaagagccgtcgagcgggctgcgggattgcttcgctgtcacctccgcctgcagccacccttccgcacgcacttgtgtgtgcacccaggccaacatggaaggcgccatcctaacttctgccgtgagcaggtgggagggaagagagacgagaggtattccattggttgtctgggaaaatgaattgcaccttcccctcccttgcggaggatcaacttttcccaccccctcgggtgggcactcgcatcctggggccggagcctgaacccgggagccaaggggccccagttccagggacgtgaagctgagcgtacagcgggcgctcccagacactggggaaagtgctttacgatgtcccgagtccctccagtctcgccagcggggcgagcgtgagggtgccccgaccgaccagcggccccgggtgcagggtggcgggcccggcggcgcgcgtccccctccccctcctggcggcccg

SEQ ID NO: 5272 - DNA, 1404 bp, Homo sapiens
ccgcttcgctcgaggcgaaatcgctgaaagttcggctatttaactcctgtccccataactcggaatcccggacaccagcggccccagctgctggcgcgcggctctcttccagtcccctggatcccaaagctccctgccacagcgcggcgtctcctcctcctgtcaacttccctccttgcactgtgacggaggcaaagcaactcagcccaggaggttgaactcgagtcatcagagaaggagaaacagtgccgaaaacggcccgtgcgctaccagggtagcccattaacgcattaactccaggctcgttgggcagaagccgggaggaaacaccctggggaccgcactcctggttaaatgcccagcacgagtcaaatccggcctttccaaagcgagccaagcccactactacaaagagatcccccgagtgttttgccttaaccacatttcagacagccagctttgtggctgctgtttgactccaactttccctctaaatctaaaaggatgcacacttccatcagacggaacgtcgcgattccccggcgaagaaaaaggcgtcgcccattcctcttccaaaacgctacaacaaaaaccaccacgcttcccttccttcttccttgcccctttcccttctcccagaccaacaaggaaaggagcgagcgagggcgcagatgccctttggtcaagtactccccggatgttcccgactaaagcgtctccaaatgaacctgcagcctgcggaagccggggacacattcatagacgctctctgctgcccagaccaggaggggtggtgggggaaccaggaagccagggagagagcaaagttcctggacgcgtctcaggaggaaaactttgtgcagtgctgccaggcggaggctcgtcagaaggctccgcagctgctgaggcggggtgggactgcgccccaggggccgcgctgaagctggcgccgcgattactgcgcaccgatttcgcccactctctgtccgctcccgggagccttctctgtctcaggacggttccttatctcccaaaccatgctcgtcctccacttcggacccacagccacccccaaatcccggctatccccgcttagcaccgcggtctccagcacaccctcccactggagtagcaggtgacccaaaccagacttacctgctgtgaactcttctctccctctctcttttcctggtgccttttcagggagaggggaacgggatgcaggctgaggtccagcggcgcggcaacccggggcaccggcgcgcgttcctctgagccgcagccctggctgagcaagcggagccgccggcagccctggcagagccgggaagctgcggccgcaggggccaggccgggaggcagggggcgctgctgcctcccccgagagccgcgctaggacaggcg

SEQ ID NO: 5273 - DNA, 819 bp, Homo sapiens
gcgagacgtgggaaactggcgaagctgctaccagccgccggcgcaaggagcgcgagagtcctgggtgcgcgcagggcacttactttctatcctccagcaagcatcgtcgcaagcctcccaggtgtagaaattgttggcgttgccctcgcagcccccgtacaggaactggcggcagctctgcgtgtacctgtcgtagtagtaacggagaagtagggcccggcagggtccgtagtctaggggcaggagacagatctccgcgttatttcctgaagaaggggcagaaggagagcaaaagagagggaaagtggtcaggcgtagctcctaggaggaaagaacatcccggggagttctgtccccttccgagcggaggggcctctgcagagaaagtgcaaacttgggagcgagtcccccctgccagcggagcgcgcggcagggacctggagaaagcgaggcttggagggcgcctacacggggccccatggcccgctgcgccctctccgccggttggggagagaagctcctggagcggccagatacctgttggctcctgagcagcatcgcccagtgcagcctccgtcaggaaaagcagcagaatcgacagccccagggggcgagcggggtccatggtgcagggggtcgggcggcccgctgggcaaggcgtccgagaaagcgcctggcgggaggaggtgcgcggctttctgctccaggcggcccgggtgcccgctttatgcggggcgagcgtccggccgacccccgccggggcggagcctgaggggtggctgattcatgcacggggactgtcaccccgccgcccccgcg

SEQ ID NO: 5274 - DNA, 1128 bp, Homo sapiens
gcgctggcgggcgcacccggcggcggcgagcgcggaggtgctgcggtacctaccatggtattcttgtcccggaacgtagtaggtggggttgcccgcaatatgcagggaaatgagcacctcgccctgctccccatccccttccagctccccgtggtgggtgcacaggaaaaagaagggcgaaaagcgggggtaatagccagccgccgcgcgcgccctcagcgtcgcccccagcaacagcgctaggaggaaagtctgccgggcccagccactgcgctccatgccgccgccgccgccgccgccgccgcgcgccctacgcgccgctcgctcattcagttttggagacgccgggacggaggagccacgcggagagaaggcgagaagaaggcggacgggagcggaacgggctcgggagcgggcctgggagcgggcccccgccgagaagttccgcgggagacggcggctcccaaagttactttgggccgcgggagcgcgggaccggggctgcgggcgccgagagcgcgtcgtctgccgcctccgtgcgccgccgccgcctctgcgcgacgcccctcggccaggcctgggaaagcgcccgccccgctccacaccttcttaaagccccgggcgccgcgtcccccccgccgccgccacacgtgtcccggccgctcccccgcccccgcgcgccgccccgcccgccccccgccctctcgggctggctcggcggcacctcgcgcggcgaggggcgcacgcgtccccggagtccccggccagcgcccggttcgcacccgggaggacagggaggggcgcccgccggggagcgggacggggacgctgtcgaggaccgctgagcccgcgactcttctgcgagggacgtcaaagccccgcagagggcacctcccgtccagctgtctgaaggggaaggccagcccctttggccgtcagtgtgccctgtttttcctgggaggatgcgtgagggaaggagaggggcggcagggacggccgctggcgccggtttctttgtctgagccggctgcgtcccgcgcccctcggggctcgcagtctgccagtccgggcggcccgcactcgttctgggaatccgcccgaggccgcgaaccgctaggggccctcgcg

SEQ ID NO: 5275 - DNA, 1128 bp, Homo sapiens; identical to SEQ ID NO: 5274

SEQ ID NO: 5276 - DNA, 1128 bp, Homo sapiens; identical to SEQ ID NO: 5274

SEQ ID NO: 5277 - DNA, 1921 bp, Homo sapiens
ccgcggacctgggcctggcgcccaccccatcgccaggactggacagaaaggccctggccgaggccaccaacggagaggccagagcggagcctctggcccagaatggaggcagcagcgagcccccggcggcccccaggagcatcaaggtggaggcggtggaggagccggaggcggcccccatcctgggccccggagagcctgggccccaggccccgtcgcggacgccgtcgccgcgcagccccgccccggccagggtcaaggccgagctgtccagccccacgccgggctccagcccggtgcccggcgagctgggcctggccggggccctgttccttccgcagtacgtgttcgggcccgacgcggcgccccccgcctcggagatcctggccaagatgtccgagctggtgcacagccggctgcagcagggcgcgggcgcgggcgccggcggcgcgcagaccgggctcttccccggggcccccaagggcgctacgtgcttcgagtgcgagatcaccttcagcaacgtcaacaactactacgtgcacaagcgcctctactgttcaggccgccgtgcgcccgaggacgcgcctgccgcgcgcaggcccaaggcgccccccggcccggcccgcgcgccccccggccagcccgccgaacccgacgcgccgcgctcgtccccgggccccggagcgcgcgaggagggggctgggggcgcggccacgcccgaggacggcgcgggcggccggggcagcgagggcagccagagcccgggtagctccgtggacgacgcggaggacgaccccagccgcacgctgtgcgaggcctgcaacatccgcttcagccgccacgagacctacaccgtgcacaagcggtactactgcgcctcgcgccacgacccgccgccgcgccgaccggccgcgcccccgggaccccctgggccggccgcgcccccggccccctctcccgccgcgcctgtgcgcacgcgcagacgccgcaagctctacgagctgcacgcggccggcgccccgccccccccgccgcccggccacgcccccgcgcccgagtcgccgcggcccggaagcggaagcggaagcggccccggcctcgcccctgcgcgctcgcccggccccgcggccgacggccccatcgacctgagcaagaagccgcggcgcccgctccccggagccccggcaccggcgctggccgactaccacgagtgcacggcctgccgcgtgagcttccacagcctcgaggcctacctggcgcacaagaagtactcgtgccccgctgcgccaccgcccggcgcgctcggcctgcccgccgccgcctgcccctactgccccccgaacggcccggtgcgcggggacctgctggagcatttccgcctggcgcacggcctgctgctcggcgcgcccctggccggcccgggggtcgaggcccggacgccggccgaccgcggcccctcgcccgctcccgcccccgccgcctccccgcagcccgggtcccgtggcccccgggacggcctcggcccggagccccaggagccgccgcccggcccgcccccgtccccggccgccgcgcccgaggccgtgccgcccccgccggcgcccccctcctactcggacaagggcgtccagactcccagcaagggcacgccggcgccgctgcccaacggcaaccaccggtactgccgtctttgcaacatcaagttcagcagcctgtccaccttcatcgcccacaagaagtattactgctcctcgcacgccgccgagcacgtgaagtgagcgcccacactacagccgcagacgctttgcacgccccgctgcgatgcggggagggggccgcccccaggccgcacggactgccgctcctgggaaccccgccacgcacaggcctcggcggagggggccgcagggggcagcgcccg

SEQ ID NO: 5278 - DNA, 2872 bp, Homo sapiens
gcgcctctcggaacgccacgctttgcgactgacttgcgagcaaagcagcgggctcagtctgcggcgcgcggaaaaggcggccggcgaagagtcgcccggcccgcgggcaggggagggaccggagggagacggcggggagggagcgctggcccccctctgggctggggctccggaggaagcccctcgccaagattccggtcgtgcgtcccctccggggcccgctctctcctccctcggcctttcccctgtcaccgccctgggtcccaagcaggccgcccagccgggtcacacccggtggatagaagccgggacccagggctggcggctgggcccgtgcatcccccacgcgggcgcctcggctttgaagtgcgcgcggagcaggctctgaccgtttcttctttcctttctttccggttacttttgctcccctcagtcactgataggacccttcccgaaaacctcagactctctaagtcccagcttggcggccccttccttccaagccgcgccccggtgacctgggctgcgcgaccacgaggaagcccgagaactccttggcccaagtgagacaggaaccagggcaacaatgaagagaaagacactcggcctctctccaccccaggccgcagaggcgcacaccgtgaaaagaaaggccaatcagcgctttaacgcacgctcgggtctccctttccgactaccatgtacttttaactccctgccaccgagggctttggatcccttcgaggctttctgcacttcaagtggaatcccctgtttcatttgccagcagctccgtctgctgagaggacgtactttggggactgccaagaagcagcagacacaactcggctttgccaatacagcatacggttttgttctcgcctccctccccacccccttccctgactcgccgtctggggcgagctggagaaggcggagcaggaggtggggagaagggtgggggtgggggaaggtctggcgtagcacaaacaagttctccagcgggttgtttacatagcaggtggacctgacgtcagccaggaggctccgctgcaaatccgaacaatattcttccccgcgtttccccctccttaaagaagttagggaacggggggagataggtggacgggggagaaaggcatcctaaccagctggttccaaacctatcaacaacaacaacgacaataacaacgcaaagtaaaacaaaacaaacaagtggtccggcggtacttcagaatcctctgcggcgtcctgtcccccaccccgcccctccgaggagaggcagccccgcgagcagtgtgtgtacagttcgcattgccaacaacacgcgcgcgcggccgggtgcgcgcgcctgccagcgcacattcacacacacagacacacagacacacacacacacacacacacacacacagatccgggtggggggagcggctgcgcgagacagcgcgagcctccgagaaagcgcgagacacgccggcgcgtgcagctccgcggccgccgcttcgccctagctctagccccgcgccacccgcagcccgcccgcgaacgcccgccccggttatttatgcggcggccgcgtccgctggctgcggcttcctcggccccccccctccccgggcgcgccccccactcgcggcagcagctgcccggactcgcgcgtgggtgtgttgtttgggggcttctgcctcgccgccgcgggtgccacctcccgggacgctgcccacggcgtccccggtcgcggtaagtttcttggccctcactctggcgcgctacacctccgcaccccaccctgtcccagccacctccacgctgggccgagctgcgactttactctgctccgcgctcctcccgcggtggcgacaaagtttcgccccaaaggcagcgccctgcttgccggggcgagtgtgacatgtgtcaaatttgggctcggcgttggggtcgcattccggacccagcatcaccacttgttgttctctttcattttgctttgtgatgggggaaaaaggggtggagaggggagatttgctgttggctcacggatgatttttagtttggataatgcaaaatgttgcttcgtccggagagacctcggctggaggagaatgtgtgtcgaaacaccagatgtgtgtttgtttactctcttctttttaattgtttgttgtcttttccccttcctccccgcacccccacccccaacctcgggaggagaaacaacagtaaaaacatctggcggttagaagcacacactttattgatccaactgctgacctttatttactcagttgggcaagtgcacgcttctcgcgtctaagttgggcacttcagcgttcatctcagaagtacttctccaggaaggagagagatggaaaggggacactcctgtttctggagtcaagaaactcctgggccctactgacgcttcgggataaccgtgcacagggatgactgctgccttgatcgcgttcctttccctgtccacgcgttagcacgaccggcttcccccggtgtctggcctggttttacttttattccgctttagagaggtcgcctggctgtttgtgggtgggtttggggtgaaatcgcacctcgcggcacttggtgaggggacgtgggaggagcgcagacacctttcggtgatagggagggcttctcacttggctgttacctggaagtccacagtggccccggcgggcaggcgggcgggcagagcgcgggtccgaacgcccttcgcgctcgcggcggcgcacgtgcggcggcggcggcggcgccggcggcgcgggcgggacccactgggtggccgcgcgcgccacccgcgcgttttctgcgcgcctctgcccacccgcgaggccgcaacgcgccctgacacccg

SEQ ID NO: 5279 - DNA, 2906 bp, Homo sapiens
ccgcgggggtgcggttttgcgcaactgggtgactcgcgtgtccctccgcatttcatttgcaccaagggagcgcgtgtcagacgaagggaatttttttttcttttttggtgattctgttattttttcaccaactgtacgaagctcaagggatatccgagctttctggctgggcggatgggcttcgcgcttggcatggctgagcggtccatctctacctctccgtttctatctctaccataacagcgaccactcagcccgccaggagcccctgtttcccagcgcaggttcctttttcttctcagttccttgggctgttgaagccgggttctgggtagatagagactggggccgtggggagagcgccaggctgcttttgcctttcccgcgccccggggcattccggcgcgctggggatgcagcctccgcccccgccgcacctggccgcccgagcgcccgcgcccacgccccgcgcggggccgcccgaaactggggccgcgccagccgcgggagctaccgaggagctgttggggtgcgtttgcctttgctttttaaacaagatccccgagaccttttctccatccccccaacccccagcaggacacggaactccggcgtttctcgaaagccacaaaagaggggcacggaaatcccaagctcgccgtgctaactcggagaacgcaaactcgaggcagagcgtgcgccgtgcggggatgtgggtgtcgaggaccccgaagcgcccggcttcccccgcgacccccatcctccctagatcctggttagacatccatccagcccacgctcagagggcgggggttaccccgactcatcccggaagccgctaacttcagaaatccctcctgttaggttcgcgaaacgaaggtacctcgtcatctcggcggggcaagtccggattccaccagggcaggtccgggaggtcacccagggcagacgatccgaggcagagcgctttaaaatcctgccgccgcacgcccagtcagagcgccgagcgcgcctgcccccttcccgtcacccttcagtctcccattcgccgactaaacttttgggggatcacatctccaagccttgggagttccgggtaaagtctccctcttttctgaacctctttactgtaatgtaatcatgggcagacaagaggggtggctgccttgttctttgcaacgtaaaatcaacagacacccaatcaagctccaatgcccggccagcccctcgccccctggtgcccactctccttctccccccattcccgtcacctccgcccgctatttctctcacagactacggacatgcagggccatctacttgtgctcaggaaaaacaaatcactagagtgatatgagaaggaatggtgcacctggctgtccgctgaaaggttttagagaagaaaacggaaaggggaataaaacggggggattctccttttccaacaagcagggcgttttggggaagtttgggggccaggggctttttgtcccgtggttcggcacttgctttcctcggagccgctttctgctgccgggcggcgagtcttaccctgctccccgcagagggcgcggtgaggaagcccgccgggggcccgcagctccatgtcagcgccgccgccgccgccgccgccgccgcgtgaggcgagcacagcggccgcacttgtggctgatctctgggctgagggggctgagctggcctagcaggcgccaagtctcttccatgtgaataacaaatactcccaccggcggccgcgattggtctgcgcccggcgcctcccgatcctccgcccgcggccattcacccggcgcggcgcggggagccgcggccaggatcgcgcccgggatcgccaatcgcttcgcgccaaccagtcacctcgggaagcgggaggaggaacccccgaggggcgggagcctctggatttcggtgtcacccagcggccctggcgcgggcagggagggggaccctcggcccgcggatccccctccgctcttcagcctgaagcgacgaggagaccagaaatgtcaatagttctgatttttaaaaatcatccccccttccccgcccccaagaaaaaggggaggacccaactacagagtgagagggtgggaagaagcgggagcggtagaagaaggaatatggttgtggaggagcccagcggctccggctgcctggcgagcccgggaccggcgcggggaggcgcgacgcccgcccgagcacagcgggcagcacccgcgagcccgggtccccggtgaacacagctccagaaagcgtcaccgagaataacacatggtagatgacaagtgtcccgccacatgctttcttttcgggaatgcttaaagtagagccggcaagccgcgcggttcccttgcaaagtttgcctggcgccgcgcggcggttccgccatttgtcccgccccgcggctctggcgattgtctccccactccccgcccccgagggtctgagggacgcgtgcaacagagtccccagggctcgaggtaccacacagcgcggtccgctgcgggcactgcgcaggaaggggcatgggtggctaccgggacggtcattttattgagatgattcaaggagccgcagacgcggggcaggaaactccgggggagccgtgctcgggttctgcagggaaacctcgggattcccttcgcatgccgcatgcggaaacctgccgggctcgacgtgcacagtccagcgctcctccccactagttactgcccaggccccccgatcctgcacccgccggaatgagagaaagtagcccctcgccgcccagctcccgggtagctgctccggccgggccttgcgttggtgagaaagttccatctagaggcggccgcgcgcaactgcaggcggcgccctaggcccgggcgagccagggagagcggggcgcg

SEQ ID NO: 5280 - DNA, 2906 bp, Homo sapiens; identical to SEQ ID NO: 5279

SEQ ID NO: 5281 - DNA, 1696 bp, Homo sapiens
ccggagccggagccggcgaagccgcggagttgaggcgcgcctgggagagccaaggcccggcgggctatgcaggtgcatgcccccccctccgcccaaggagcggcgccaccagcgcttcccggctttgtccttggaccctggcaccggctcgctccagccgcgggggaaggcgcttcatcgccaaagtgcgctccggcggccccggcccgctctgcgggccgccgccggagggagtgcgggggcgccccgaagccgcccaggccgcactcgctggatgctgcgctccctctcccggcgtcggccgctccgggccggcggcagctgattgcggtcgtgagctcgcggagcggcgagagttaagaggaggtgttcgcggcgccttcgccctccccagacacacaccccctttctcctcgcctcttctcggagggtggaagagacaaaaacggggggtcagttctccagtccgccggctgccggcacgcggggcggcgctccgtccggcccccgaggaccagcggcgtggcggctgcgctcggacccggtccgccggccggaggagcgcgcggcgcccgcggtcgcgcccgcaccgcaggccccttcagagagtccgggggcgggcgcgggtccggcggcggcggcggccgcagcccccggcggcgcgcaaccgcccgtcgccgcccgccgctgcccggcccccggcgcgccgccggctccggctttgtgcggagggagcgagttcgcggcttcggctcccggcgccctcagtggccgcgccgccagcggactgctgcagcggcgtgagcagcgggggtcgcggctgcgggaaacgctccggagcccaggaacatagtccccgctggctagcggcggcagcagcagcagcggggcccctgcgcgcggcgcccaccgtctcctcctcgcgccgggctcgcggtgttgcaggcggcagccacgcagactgctctctcatccttttgtccttcagtcagaacgtgaatgtactgctgacgcatactgttctgggagaagattagcgtgatgcagtgctcttatgtattagcgccgctccccctccgtcgcctgcctcgcggggttaacgccggcgccttccagcgccgcgccggccggcgccgcgcagccccgcgcctccggccgcccgtcttcctctttcctccttccttcctcctctcttcctctctccccctcccccctcccccctccccgggccgcttcctccccgccccctctagacgagcggagcggggccagggcgagcgggcgagcgagccggagtgagcgtcaagtgaggggccgcgcgcaagtcgcaggcgttcgcagctattttgggccggtcggagggagcagttgggtggccgctgataggctggagcggcgcggggctgcggcgggagagcccgcgccggcccccgccctccggcccgcacccggggccccctggctctgaagagcggggctcaggggcccggcggcccgcggcggggctgctgcatttggcctgcctctcgcccggcccgcgtcatcctcacccccgctgactgctgacggggcgcggactcgcgttcggagttcggaactgcgtggtggggactcgggggacggcggccggggccacgaggctcccaggaccgagagcccgggcttcgctgctgcactgccgccagcccctccttcg

SEQ ID NO: 5282 - DNA, 2054 bp, Homo sapiens
acgcggcgatgctttaagccgctttctgcctgaaatctcggcgcattcccggggaagcagtgccacgcttcagaaaggcgtttgtgctgcctcttactggggaaacgcagtgtctgtttcatatgcgccgccctacagaactgcagccccaaccgcctatctggcctcctccccgggcgctgggccaccactctctccaaatatgcgtccgaatatctgtgggtctgtctcccgttgaaatcccagggtgtccaaaggccacggggccgcgatgacactgggtaggtctccggaaacctctcaggacttctcccattttaaagcccagctagggacgaaaggggctgggagctgaaaaattgctccctcaacctccccgggtgggaggcagagccgggaatacacagaatcccaccccgaaagtcccgggaaagagaagtctgagtccaggagcgtgagaggagaacacacccgggaaatccctgctccggccgctgcacctccgcgggcgtccaggtgggacgtgggcaggtgcgcgagcgccgtgtgtgccggtgtggatctgtgtgtgtgcctgcgtgtgtgcgtgtgcgtgtgccgcgggctggctccgggacactgaggactcccgggtcggcccaggtctgtccgaccttgctgccctcgccgcccgcccggccccactccccggcgggccggctccttacctggacgcgccgcgtttccctccttcagcgggagcgccgcattgacactgcagatggagcctatgccgctgcctctcgccctcctctgaacgtgtgcgtgtgcgcgcgtgtggctgcctcctccagccccagccccgaacgcaaatactccaccgaggcacagggaagccgggagcagccgaggaacgcggagggcgccgaatcagagcctgcggggcttgacagcttctcttgcggcgtccaaggtgggcgtaatgtccaacaaaaaggtcggaaaatggggatcgattccgaacacccctttcctccacccagccccggagcccgagcagcggcggcggctctcgggggctgcggtggcgacgccgggctgccccccttcgtccccacccccgcgggctgaatgtccttgatgccaagcgggcacagcggcgtcactccgcgccgcccatgctcgcccggtcgggccgctgcccgggcgcggcgagtgcgcgggggacccgccggggagcgctctcggcgcctctgcgcgcctctctgggtagcggcggccgccccccggcagcccgcggccggccgcgccgcggcagcccccacccttgccgagacactcgccgggcagtgccctggggccggggctggggggccgcgggagccgccggctgctccccggggaggcgcggggctgcggcggtggtggctgcggcggctggcgctgcggcggcggagagctcggccgcgggccgagccgggcctcccgggcgcgcccccggccccccgggcgggctgctcgcaaagtttgcagggggcagggagcggggccgccgctggctcggccgccgccggagctcccgggctgcctgctgccgccgcggctcgctgctgctgtgcattgaagcccggccaagcgctgcaaaaactccagctgcctggcgctctctgggtcctcctctcctccctcccgccctccctgcttcccttcctccctccctcgcctcgcctcctctcctccctgccgcccgccgcccgccgccgctccctctctggctcgctctcgctggctcggagctcgcggctgacatctagagcgagggagagcggccggcagagggggcagggggcgcctccctacatgctcccacccgccgccgcccggcttgccggctctcctccgcaccaacgtttgccgacacccccctgggtcccctcggcccgcacggagctaccctggcggtggcgatgtggggcggagagaggggcatacatgggtgaccggagcgcacggcgcgcgctcagagggaggcgctcagccgcctcggaatttgcagctctgggcgctggccgtcg

SEQ ID NO: 5283 - DNA, 1258 bp, Homo sapiens
ccgcggaagcgccccttgctgggtagaagagtgggtctcccgccgcggcgcacctgtctcggctgccggctccccgcacctacctgtacgagacctgcttccggaaagttaagttcctcagcttctcctccagcgcttcgtccttctccttctggccggcggccgcgggctcgtccagggcagcggcccccgccgccgcggctgaccctgcgccccgcgggtccgcgccgccctcggcgcccaggcagcagctcccggcgccgcttccgctgctgctgctgccgcccgtcgcccctttctcctctcccgccgaggagctggggttcatggcgcccgctccggcggccgcggagggagcgcaggcggcgccgctgcaggggccgggcgggctggcggcggcggcggcggcggctgcaggagcgcgggcaggtccgcgcgccgctggcaggggcagcaaatggcagccccttcccgcagcatccatccgcggctgcaccgcaccggggcattgtgggaaactccgctcactcccccgccccggccaatcagaggccgccgctccccgcctcccgcgccctcccgcgccggcccgcaccctccagccccgccggcctcttcctaaatcccgagcgaaagcccaagctgaacatgaactctgcccggaggcgacgggctgcggcggagggggagagagaggaggacaggctgcgaccccgggctggggacgccagggcagggacagcgagcatcaggaaggagagcgtccggggaactcgagtggccgcgccctgggtcctgcaccgtgaggctggggggaccaggaccggcgggcgcccaccttggtcctgagcccagctgccgacgctgggccagcaccctctccaccgccgccctccagtgagcagagctgggctcaggcagcagcccctgggcgcgggaaggtagcgggagctgcatttaggggaggggggaggtagcaggagctccgccagtgggaaccttggagtgaattcgtcggcgggtgccaagtcgaagcgccgacctcctgtctctggactggggcccggacccctgcgtccccaaactgcgtccccgccttgctcgtcgcccggtgccttccttaggcgcagcagaccctcggtaaacagcggttaattcgatggaatcggatcacagggccctcggtgaagcagaaaggcggaggaaatccaggaggcagaagtgaggaccctggcgcctggcgccgctgcgttgttcg

SEQ ID NO: 5284 - DNA, 628 bp, Homo sapiens
gcgtggaggctgcggctcggcggggcaggcgctgagcgcaccgcggcggcacccggcgcagaggctccagcgcggggagccgggctcagccccggcctgccagcgccgcggtcctagcccacccgaggccggcctggggggcccgcagggcgcgcggagcgccgagtgcgcgtcgggctgggccccgcaccccggtgcaggagcgcgggcgcggcgcggcggagcgccccgcatggagccggcccgggagcccccctcgcgggcccggccgccgccgcccctcgccgcgcgccccgcgcccgcccccgccgcccccaggccgcgttcgcccgcagaggctgaggcccgcggccccgaggggctgctgcggcgatccgggtcgggctacgagggcagcaccagctggaaggcggccttggagggtaagcgcggagcggcctccctctcctggcccagggacccctgcccaggcccgacccgcgacccggaggcggtcagagtcaccttggccgctgtcccggaggggagcgctgggagcgcggcgccgggacgcggcggagtcattcatttcagggcggccagacgccggttcgtggggtggggtgggagggaaccgggggccaccgcg

SEQ ID NO: 5285 - DNA, 1075 bp, Homo sapiens
gcggtccccagggcgagcactcccgctcccagcgcctcctggccaccaaagaaaaaccagacgcctgcgacgggctctcctcccgcccgggcttcctcgctcctcgcccctcgccggccatcgggcgccaccaccgcgggtagcagggcggggcgctctgggagccgctgggtgtctgggctggcgtctgcaggggccccgcgggatcaggccggctgcaggggcgcggcggcgcagcccaccttgttgctgaagagccgcgagaggctgcgcatgggcggagggggccgcggggcacctcggagcccgcgcacgtcccagaggcgcagggcgccgtcgtgcgaggcggtgtagagcacctggccgtgcacctgcgggcgcaggggcgggcgtcaccggtgacgcggtaggcgggggggacaccgctgcccgcgtggatggatcggggcggggcaccttccctcccacgggcggcggccccgagaagggcagagggacctacctggatgcagttgatgatgaatgtgtggccccggaacaccctccgcagctctccagactgcgcgtcgaaggcccgggcgcaagcgtccccgctgcccgtgaacactgcggacacacagcgcgcgctgggcctccctccctgctcggccccccgcaagcagggatggggcggcgagagcgtgacctggggcgtctccgagactccgccccacgggggtatcctgaggctcatatgggaagtggacagtgcccctccagagaaacgggtccccacggttattctgctccaccctgcagatgcctgcgcgccagctggccctgcccctgccctgctgaacaccgcccgggcccagtccccactccgcggtttggtgaagttggtttccgtgcctgcttgggaagcccctgcctggggataatcgtcaggtcctcgagtcgcttcccccctaccttccgctgcgtcggcaaccttatcctcccgtcctcattaacggatcggcactcaaatcaaagcccagccctctggggttcatgatcacgcacccccgggacccctagcgggggcgagcctccg

SEQ ID NO: 5286 - DNA, 5566 bp, Homo sapiens
gcgcttctccagcgatcggggcagaaccaggacgtgcaatgcgactgcccccccctccccgctccccggcagagcttctgtccgcgccaacccacccaccaggctctgcccgcgccacgcgcgcccctggcaggcctggggcggggaaaggcgaagcgctgggcacgcgagggcctgtgcaccccagttcctacgacgctcctggcccttttcaggcccgccgctgccgcatttaaccccctccttccgggggttattctgaagaagtctcagaccctagacccagcctcccagaccccgtccccgagctcgcccggtgggcctgtaggccggtcctccttcgcccagaggagagcgcagacacgcaatgtccgcccgttggccccgcccgccccacccctgctccccgcgccccttcgtttcggcctttgtctacaggccgggtcggaacgtcagccccaggagccgacggtggctctctgctcgccccggggaaggtgttgctctcctatcggccccaattccccgcccggcgcctggggcttggctgcggggctcggctcccagccgagggcgcagggctggccaggcctgctttggctgaggtggagatctcgctctcagggattgttgggcgtctctgccccgcgagtaacgagaccgccgcgagcgaacggctttcattgagtccatttttccaagtgtcaccacgtcaagctagagaagcgaggcgagtggaggggacgcagaggggccggaaaagtcacccttctctggcctcgttttcagataaaaacgggagcctggctcggcatccgggcgcccggtgtctccggggcgcttcactgaggttttgtttgcaaaactagcgtccgtgtcctgaagcgcacggcgtctggaagctgctttcctgctcgccctctccgaggcccctctttgtgcagcgagcctgagaaatatggaggaccgtcctccgcaagcgggtggtcgcgggcgctctccgattcctgggtgaagctagagggaaaacggggttcccgggtcagtgccccactttccatcccgggagaaactaatgtccggagagggctcgtctgatccgcacagaaaggccgaccttgagggcggcggtcgttcgggggagaaagcggaggctctgggctcgcgggagcgcggcagccggggctggcatcgcagaggagagacacgccactgccccgcatccccagaaagcgcgaggcgccgtcccagctggggcaggcggccgaggccggtcctcatgcgcgcttctcgaagcttcctgaaacaccttgcggagttccgtgtgtatagaactcagcaccgcccagcccctgggcagctcaactttctgcagccccatcccagcttccccggccctttgaacggtgacccctcttaccgctttcccagagttgtttcgtgtttgggtccactctggggggcccggtaccctctagttatctctctcttcatttatttctctttctcctattcctccctccacctctcaccttcctcctttccaggagagcgacccacgaattcctcttcctccagccaaccccagggcccagcccgcagaccctgcgagggcaggtctctgcccaccggcccgccaggcgccctggaggtgacgctctgcttcccagagtctctgttgcagccacgaattggggtctgggtcgcaggaaagcacagggctgaagcccagcgtcttggggccatttatactgaggcagtcagaggcaaagagtcccaagaattcagaaaatacttctcaggaagccgcctaattggctttcatgggacaggtggagccattaacctgggatggttttgcaggaaccaaagagctcagggcccctcctccccccaatatcatgttcaggagacccagagtcgttggaccctccctttcctgactggtgatcatcagagtttccagagttgcagaaaattctccccccaaaaaaccaagtaagcgtcaataagacttcccacaaactctcaccagccctattttcccggggggcaggtagactgtggggtttgattttttgagactcggggaggacccctggcagatgtgtgcctagccagaacatttggtaaggactcctccaatgaagaaaaagtggaggaatccagccccagcgagaagaggcttccccaccctgccctagacacaccggacagagggcacactctgaccagagccacgtccagtggccaggaggccagcccagcacctcctcccccaccattcccgtcctgggtgggggggtaattttcctgggagcagctgtgggaactgtcgtttctcatcccagcccagccagcactctgaagcctgcaggggaaggacagcacgtgggatggacactggggaaggagcttcgcaaggccagggtgcaaccttcaggccccaggtggcctggcaggccacgctgcctcggagatgcttgccagactccccaagttcactcagggcctggcagcaacctgctggctgcctctgcgggggtctgggttgctgagcacggtgcagctgcccagggccaatcagccctagggtgtccgtgccaggctgcggcctccccgcctcccccgcactgagggtactcatggcgtgcaaatgctcccgcacccccagagctgccctatcggatgtttccaggaattcacacatttccataaaaatgcattttaaatgatggacaggcgagcctggggtaacaacgggtgtttggtgggtagacaagagcaaatgggaaggagcccgagggaggagggggaagagaagaggaaacagaacttccagttggacattctgacaacagctggaaggaaagtctagaaaagatgaagagagaggaggggagaaaccaactggggctcccacccttgccgttggattcctaattctcgtttcaaatgggccctgctctccggcaaaattagtttaaaggattttaaaacaaagaaaacgagatgaccggtctgggagctcctcaatcagagtagagaagttagaggggggcgggcgacttggttttgaagtcttagctgaacagtcacccctcctctccttggcaaaaaggattcctttagaacctccgaggctcctggatttctcccttcgcaaatggagccgcatactgcattcccccgctctttcggatcgctaagcatgtttcatgagggtcgctgtccccgggtggaatgcggccgtatgcacgcgcctccctgcacacgcacacacacgcacacttacaataagtgtctgcaggaggagtgtcctgcgcgccagctctgcgtttaagacaggaagctgccgggttaccgagtcaaatgggagtgacactattcctctccatcagcaaggaaagcggaccacaaaagtccctttgtatctcggcagctcatttaatattatttatgcattttgtgcaaggaattgtgggatttcgccccacggtaaacaatatggaaatcttaaaaatagcgatcttcctgtgcgtgtccacctacgcgccccggggtgacctggcggggctgtcgccgggtgactcacacccctgaaccgcgaagcgacagggaaagcgcgggcgagcgcaggagacgcggtcgggggtctctccgggttcctgggctcccgcacccggagcgggggacgcggccgctttaaggggaggaggggcggcgggctgctcctgtcacccagcggcggccggagcgtcacgtgggcgcgcggcgccgcggccattggcccgaggcacgtgtccaggagaccggcctgcgacgtcactcgagggggctctgttaaaaataagaacaaaaatccagagtgaaagtgtctcaggttgcgccgagtggcctggaaatttccgagcccgcgcggaggccgaggcggcgagggcggcggacggccggggagcgcgggcggcccagcccggcccggccgggccctggcctcgcgtctctcacccatgcgactcgggccgcggagctctgcggggctcggcgggggcgcggccgcacgccggtggggcgccccggcccgcagcggggcggcggccgcgaggagggggcctccatgtgcgtgcgggcggtggcgggcgcgctgaccgcgggcgcccggcaccctcgagggccggctagggcgtgcgggcggggacggccgggcggcggcggcggccggagccggcccgggcgggcgtgagcgccggggaacgcgctgcctgcatgcgcgcagctctcgccccgggcggcccaggcggcggcgccggagcccgaggcggccggacgcggagaggagcggggagcccgggaggcggcccgcgtccccgccggaccactgcgactgtctagaccccggctgcgcggcgaagtcgaggacttggctctgttgaatctctcatcgtctgggcgagcggggcggctcgtggtgtttctaacccagttcgtggattcaaaggtggctccgcgccgagcgcggccggcgacttgtaggacctcagccctggccgcggccgccgcgcacgccctcggaagactcggcggggtgggggcgcgggggtctccgtgtgcgccgcgggagggccgaaggctgatttggaagggcgtccccggagaaccagtgtgggatttactgtgaacagcatggaggagaatgaccccaagcctggcgaagcagcggcggcggtggagggacagcggcagccggaatccagccccggcggcggctcgggcggcggcggcggtagcagcccgggcgaagcggacaccgggcgccggcgggctctgatgctgcccgcggtcctgcaggcgcccggcaaccaccagcacccgcaccgcatcaccaacttcttcatcgacaacatcctgcggcccgagttcggccggcgaaaggacgcggggacctgctgtgcgggcgcgggaggaggaaggggcggcggagccggcggcgaaggcggcgcgagcggtgcggagggaggcggcggcgcgggcggctcggagcagctcttgggctcgggctcccgagagccccggcagaacccgccatgtgcgcccggcgcgggcgggccgctcccagccgccggcagcgactctccgggtgacggggaaggcggctccaagacgctctcgctgcacggtggcgccaagaaaggcggcgaccccggcggccccctggacgggtcgctcaaggcccgcggcttgggcggcggcgacctgtcggtgagctcggactcggacagctcgcaagccggcgccaacctgggcgcgcagcccatgctctggccggcgtgggtctactgtacgcgctactcggaccggccttcttcaggtgagcccgcggggaccacgcgtcccggctcgccgcggggaggcccgcggagctggggggcggtgctggcgcgggaacttaccgggaggaaaacatctcgaacctcccccgcgcacacgcacaaagactcacgcgacattgtgtgaagctgacgccggcccgggcagcggccaggagtccagcggcaggactgattcg

SEQ ID NO: 5287 - DNA, 5566 bp, Homo sapiens; identical to SEQ ID NO: 5286

SEQ ID NO: 5288 - DNA, 1164 bp, Homo sapiens
gcgacttgctcagcgccaaaccgcggctccagccctctccagcctccggctcagccggctcatcagtcggtccgcgccttgcagctcctccagagggacgcgccccgagatggagagcaaagccctgctcgtgctgactctggccgtgtggctccagagtctgaccgcctcccgcggaggggtggccgccgccgaccgtaagttttgcgcgcaaactcccctccacctgcagacccggcgggtggccactgccacccgaactgaggatgagaagaaggaagttggaaggggcggtggatgcgcccagggactctcccagcctgggctctagccccgaaacggtccccggagtgggatccaggaggggccgggagggaatctcctcccgatcgtgaagcggcggcgcccagttcccgctttttctctctgccgggttcccgcgctatcccttccactctggctgggaccgcgttcccgggctcgcaggctccgccggggaggttccggggtgtgggggccgggacggcggaggcggggagtaagggcccggctggcggtgacctgcagtcacctctctgccggaggggccctggaatgaaaggcgcgcgggccaaggtgacctcgccttggttggcactgcggctcagcccccgcccggggactcgcgggccgactgtggccccttctggggaagccggggcgcggggaggcgttccgggcatctcagccgcacggggtacgctcgccctcggcggggcccctcgctccgctgtgggagtggcagtgggtgtcggggtggagaaagtacgcgtggcgcggagtcctggggacgcggcgtcccacccgctctggggagccccggactctctccagcttccaggctcgcatgcccctcttttcttagtgccctgagaacccagcgaggggctgaccctcccgaaaccgtggcgcagccaccagcaatctgtggtcgccgactcggggggttgccaggtctgcgtttggccaccctttctgtcctgggggctgaggtcagctccgggcgcccggccccgccgcgcggctgcgagcacgtggggttgacgggcgccgcgtggaggcagcgagcacaacggtggtcaccgccgccagggaaccgcccgctcgctggggtccaggcgttcg

SEQ ID NO: 5289 - DNA, 1495 bp, Homo sapiens
tcgcaaacttttctctgcgccgtccttttccgcgtggaatgggacggagcagccctcccaggcgctgcctggctgcggaggggagcgggcagcgagagcctcgggtctccgcctgggttcccgggtctccggggcgctggcctcggtctccgcgcagcgtccagcgacccctgtcgggggttcccggcagccgcgccgccaccccccgcccggccagcgcgggaggaaaaggggctgcgcccgggagcgccgagcccaggctcctcccggtggcgtgtccgcgcctcggggtgggggtgtggtggggaagagggagggggcgaggccaggggagggtgcgaaggaggcgcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggtgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccctcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccaggtgggtgcgcagcgcggcccgggccccacgatcctcctcctgctcctcctactcctcctcctcctcggatgccgtggcctctccctccccctctccctcgcccgtcctcttcgccctgcgctctgagcgcccgttgagtcgcgcggtgcttcccctcctgggggccgccgctcacctgggcgccgagtcctaccgggcgcctacgcccagagctcagggcaagggacagcagtcccggccgcaccctcccagagtcccgggagcgcttcgctccctggcacggcccctccccagcgccttagcggctgagcccagcccgggagtgggacctgggctataggagtcgaggctgcgtgcgcgcgtgccccgcgccataagcgctttgcacgggggccgtgtgccctctagcgggaaacgctggaatgggccgcctggagggagagccggtcccctcggtgtgcctggcagcgcagaagtgggtggtcgagcaagaggccgcgtgggaagttagcttcggcgttttggggcacagggcaagcgatgtagagtgcgcgccg

SEQ ID NO: 5290 - DNA, 352 bp, Homo sapiens
gcgcctctggcagcagccgcccacgcccccggccctgcgcaccgggcttgctccgggaggggcgcgtgacgccaccgcggggcagccgagaggggaccgcgggctccgggcagggcaggcgctcccgcagctccagctataacacaagggagagaaagcaacgctttggttccagaaacttccatcgtcaaggccagttctggccagacgcacagccaaagagcccccctagtctagcggatgaaccgttcgcgagtggcaccccctaaaaccttggccccatctcccaagatgcctctttactgcgcaatccagaaagcacccggaccgccgccacccaccagcggcggcg

SEQ ID NO: 5291 - DNA, 1141 bp, Homo sapiens
ccgcccagcccccagcgctgcgctgtccccgcgctcaccggatgatcacgaacatgaccagcgagttgcccaccaagcccacgacgaacactacggagtagaccgccgtgatgatgaccgggatggccggggagatgtgcgcgggctccagctgcgcgtcctccgagccggcgctgccgttgctgtcgggctcggcccagccgggaaaccaggcgctgctgttggggggcaggcaggcgctcggggcgcaggtagggcccggctccccgcggaagatctggatcggggagtccatggtggggcgattgcagcaggaaggcgaggacaggcggcacctgcggcgctgcgggagcgaaagaaccggctggacgcggagaggcaaactttgcccgcgccctggccagcggcgctggggacccggagcctgcggactcccacccgggccgcaagtcgccgggggcaggacagggagaacggacttctcgctgcctttccggccagcaggcgcgccgctgggtgccagagaggggcgaagagcgctcgctccttctcccccagcccctgaggtgcctccctcaccaattctaggcaccggcccctggtggaactgtccccagactgcctgagtccccagggtcaagcccccttcccacctcccagcacggagctctacctagaactgcacctcgaaagcccaaagcttacctatggttcccagagacaggcgaaggcgaggttttttacgggacgccctggtaggtgctgaaccgcgcgctcacgagtcccgctcagctcttggcatcacctgctctcggaccccggccccgctctccgcccgagggctgctgttccgccgagcgcagcccccgcctctcagcgcacgtctcccactactggcggcggctctgcggggcggggcggggcgggaccggcgggacgcagccgggacgcggctgggcgctgggggcctgcgggcggagagctcgtctggtgcgcccgccccaggccggcaggtccctgccccgccccgcccgcccggagtcagcccccagctccccagcctcccagccccgcgtcccctccagccccgcaggctcgcccggcccactaactgcccgagcggcacaccgcctggtccccg

SEQ ID NO: 5292 - DNA, 3297 bp, Homo sapiens
tcgcccgccgccccgaagctgttcggcctcctttctagcccgctttccagcctcgcaaggttcttctctcaccttctccggcgaccccctcccgaggctccccggaggcgcctggacttctcccccctgcttcccgccctgccggccgcccggctctcgagggggcacgaggagctgccgggccgcctctcgctcctgctcggggcggcgctggcactgcccggccgaccctcggggggtcgtccgctgaggcccccccatccggtagccaagcccagggaagaagacgccaccgctgggcagagctcgcctatgccggtgagtaccgtggtctccactacgccccacacccagcctccccaggacaccagcctctcccgattcttcctaaccccaactgacccgctccgctggggctagcagtagggagggtggcaaggtcgggaaggccgggacgtggctgggcaagtcctaggacgggacattggcggctcccgggacaccgcccctccccgcgggaagacactccaagctactttttcctgggccatttcctttccatggtccaagaaaacgggagggagccctcgctcttccccgaggctgcctttcaaactctcagcgtgtcgctctcctccgcctactccgagcctcccccaaacgcgcctccgcctgctcccagcgctcgctctcccactcccctgccctctcggcaggcaagggaggaaatgacgtgatgttatttttgtgtcaggtcagtttccagcttcagcttagccctccgggctccagggaactaaccccgcggccccaccgggtcccactcccgaagggacgctgcgggctacggggacacgcggtgctgcgagtccggagagctgggcggctgggttccccctcccgctgccccctggtctactcctttccccggactccggagtccctggagaaggggacgcggagggcgactgccgagggtctcagcgggatctggagtcaggggttagttcccccccttatcccccgctcggttgctgggtggggcctccgcgctctggctagctgggagggggcgagggccgctttccagggcgggaagaccggaggcctaggctgcgccggggtggggcggggacagagctcagagaggcgccccgggccggggagaaggtagggggctgccctccagagacgcgcagtccacagacgcgaagctctggggaccaagcgccccctccatgcctgccgcccacccccgctccttcctcccgctcccttcattcacgaggtccgagcacgcagtccagcacactctagtctcgctcggccccgcgcgccgaggggaggcgatgacacagagggcttcgcggacgccctctacgcgcgcctggcttcgcatccacactcttgggacttgctaatgcggggctggagcagtggggctgcggccggggtggaggtcgcgccccgcgtggggcctcgggggtacccctagcacccgcggcggtggagtgcgccgccgctggagggaggcgagacgtgggattgcccggccgggtaaaaggagtgagggggcggggaggaggcagagcaaggggaggaagaggccgggagaagagggctagagcaaagaccgagagccggagaaaggcgaaaggcgcggtgagcaatcgccgacgtagagagggcagccctccgcgctgcaatattgagaaggcacccgcgggacgcatgcgcacggcggacggaggcgagccggccggggcttcctccccggccggcagggtggacggtgggctcgtgagtatcccagttcctcgaactctctttcttcgtctcgggctcgccctgaggcttcgtgctggaaagtggccgaggctgggaggggcgcgccgctcgtccggacctcagggtgtcgccgttgctgcggggcgggagccggtgcgagtcgggggttccttcccgcagtgcgagtttgggggagtggggctgcgagtgcgtccgcgtgcgaagaggggcatcgcgccaccaggatcaatatgtcccgggcctgccagggcgtccgcgattccacctctgcggcttcgcgtcggtgtcttggtggggaacgcgggagtctagtctttagaccctagaaatcgcattgaccacccgaagcgtatttcggaaagaccaggcgggtggaagcgtcggctttctcacgggatagggagaggacaaggaaggggttgggcgcccggggctggtggtttgagcgccgctgggaagggtaaggagacagagcctcctggaatcgtagcgcctccttttaggagaagtgcaaccagggcaggggcaccgaggggcagggtgaggaagtggacgccccacgcgtggaccctagaagaccgactaggtatgggcgttcactcggagcctctgttcacgctcttgaaaaccgaatgaacagagaagtgccctccacccttcgcctgcgccagggcagttaacgtgcaggcgccgccgggattttcctggaacaaacccgggcacttgatcttccgcaccctcggagctgccctgggaagtcgaaacaagtctgggcgcccggactgcggagactggaaagcagggggcggagggcgggagactgggggcgggaagtggaggtgcaggctgcagctggggaccgcggtgggcgttggaggggagggtctgtgtgcgcggctgtcctccagcgctgggggagcggacgggccaggggcctctagggaagcggcgctccgggaccggggtggctttcccgtctctgtgtgcgcggcgatccccacacccagctcgggcggaggagccctgagagaagcggctagctgagagtggggtgggcgttttggggaaaggtttgcgtgcgctgcggccctaccgctgctagagaagtggaagagagagagtgggcgccgggagggggtctataggcgccgcgacctaccccatctccctccacgcttgtgggggagtgagtggggaaggggctttgggagaggcggcgcgcgggcactgaggtgcatcgtgagcttcccggacttgacagcatcaaaggaaaatcctggcgagcagccagggccagcgagcgaccccagcagcagggacgcggccgtgcgagagctcgcggacaggcgagggggatcccaggggagcagctgctgcccacgggccacgggcgatgcacggagtggagaagtgaacgtggtctacaggatttctgtccggaaggtggagagcgctacaggggaatctcctcgattcctgtccgtctcg

SEQ ID NO: 5293 - DNA, 2213 bp, Homo sapiens
ccggctttaaacgcctctccagccacctgtgaaccgcgaaggagccggctttcgcggcggggaccttgccaccagtaccctcgcgggccgaggtcgttctcccggtcggcttcccgcctcacccgaaaaggaattagagcatctacccaagacggtgactggcagggcagatcaaggtgtcctggtctcggccccagccccgcggtgcgccccgcccgcttaccttgaccgggtgcaggtagccatcgccgcgcagggcgcccaacccggcgtccgccggcgcctcggcgtcgtcctgcaggctgcgggtgagatgcgcgatgtaggtggtggccagcagcagcacgtccagcttggacagcttggtgtcgggcggcacggacggcagcgtgcgctgcagctccaggaaagcgtgccgcagggtctgcacccggctgcgctcccgcgccgcattcgccgccgccggccgcccgctcccggaacgcgagccgcccccagggcccgccggccccggcccggtccgcccgggacgcgagtcgcggatggcggcggccaggggcgcgggctcggcgctggcgctgagggggctgcccgctgggcggccgcggtccatggcagcttcccgcgccgcgcgcgctgcaaaggaccgaaggtgcggtgaggccggggggcggtcgggcttaacccgagaggcgcagccccctggttctccccgtgcgcccaccagcagcccaacggggctaagggcgctctcaagcgagctcgttttgcctgggacgcgatttgcttccggacgtctggggagagttgcggaactccggagttcttgggcttcctagaaggataagaagaggcgcagtgccggctttgcttttcaggggcaaattaagcaaaaggtctactctacccgggaagaaagatctcggaagcacagctcaggatcagcactcgttcgcgcttgggtgactttatccaacccggcacgcacgagaggtggcgcggctccttctcgccgacgccgcggaaaaccacggctcaccagccgccctcggcctttcacgccaggggggatttctgcccgaggagcgggggacccttagcctcacctcggggtacggcacccgccaccgttccgagcccgagagctgcgcagtacgcgtctgacgggcccctcacctttcctggagcggctgagtggagctccgctccgtcgtgagggcgggcgaggggcgtggagcagggcctgtgtggccagggccgcgctggtcactccatcctcgtccggccgatgcccaagtcgacggctgtttccaacctccgctggctgtgacttttatgcgggcgccccgcggccaggcgtgtgtgctccgaccggctaaggcaggtcgggcggaggacctggcccaccggagaggctacgccgggggctgaggcggcttagagggtcattaatcaaaccctccggcggggcgggctcgggggcggggcgtcctcctggccccgcccctcggctcactgcctcacgctgctttccccgaggcgcctcgctgagggcggcgtgtggagagtttggggtgtctgccgccggctgcggtggggccgggctggaggccgcgggtgaggcctgtggttaacctcgcgctgccgaggtcttacctcctcgagtccagtctgattccaggccgcttccaggccggtgcccagctgaggcgggaacgctgcagtttggttgagcgtgacttttaggctctgtgaggaaaagtcgagcgcgccacatcgaggcgctagccgtttattctaccacaaggtaaaagattcatgctgtcctagttaccctaaagctgggagatacactgcacttcctaccagaccccgaatgctctcagtgtctgtaattctttaagaagttcctagagcagacagcccttggatcgtgggcacttctccccggggacggggaccctgctgaccgcctccgctgcccccgcgggggccaccgctctttaattatttgggcgaaacattcttttctggttttgcacttgtggactcacgggaagcgtgacttgcagcgaggcaggacccgatcccaggcttctttagaaagcggacgctgcgccccaaggcctgttcagagccgccccaggaagccgtgggtccccgaccgccccaaaccgcagcggtttctgcaggtcctggacccgtcgccttcg

SEQ ID NO: 5294 - DNA, 363 bp, Homo sapiens
gcgctcagcacggcgggcagcgccgcgctgcgcaccgccgccgaccatgagcgaggacagccgcggagacagccgcgccgagagcgccaaggacctggagaagcagcttcgcctgcgcgtgtgcgtgctcagcgagctccagaagaccgagcgggactatgtgggcacgctggagttcctggtgtcggtgagtgtccccggcagacgcagggggacgtccgggcggcgcggggcgcgggtcccggagtggctgcgggaaggacgcgcggcattgtctgtgcggggacccgggacgggtcggggcatcacaggcgcgggaatccacgtgtggactctgcgttcgcgggcgcggtgacccccgcg

SEQ ID NO: 5295 - DNA, 960 bp, Homo sapiens
ccgtcccccgacgtcccaatcagttaccacctccccgaaggaaaacaaaccggcccttgacacatccctccacgtgcagcgcccgacgccacgggccttgggcggctgcacctctcccctgccggccacggctcaaggccccattattgcgcgcacccagctcccttccaggtgactttcgcgtacctggcggcggcgccctaggcctcggaggctgcccgggcgggctggggctcgggcggcgctcgctgagagtcgcggcgcccctcagccgcttcccgggcgccgatcgccgccctcctgccccggggtggggcccaggggcatcagcagccgcgggctctcggccgccgcctgggaactcagggtcagatttagtttcacaacaacgtctcctcgtcacggcaacccaactggaggcagaagccggcggggcggccgagcggggcggggcgggagcgcggccgccgcgagccacggtggggagcgggcgcgggggaccctggcgggccccgggcagcgcggctgcacttacttgtgtcacaactgcggcgacggggggctgaggaaccggttcttccaaaagcaaaccgaaaatgggtaacagagaggccggggcagcgctaagaggggttctgcctcggtgtttagggcaaaaaacccggctccggcttccagaaattcgagccagcggtggctttttctttctttcctctctaaacgctcctgtgcctccgggtcgaggggcgcccttcgcgcggctccgagtgcacagcgacaccagggctggcgctggagaggggagccctcttcccagcacccctcgggtctcccccgtacccccacccacagcccctttcctgggcccgacgcccctccgctctgcagccggagcctgggcctggtgcccactgccccgcggggtgtctcggacgcctggcccctgcagcgttttctacg

SEQ ID NO: 5296 - DNA, 1404 bp, Homo sapiens
acgcggggtccccgggaaccgccgcctttcttcctcgctcccgcgctcgcgcttcccctcccggggccccggcccacccacccctggtgcggccccgccggactcaggagccccggccgcccgggctgcggggagggggcgccccgggccggccctagaagttactttgcaaagaggcagggggcgcggggccgcgcggggcgagctcgggatccgcggggaagaagccctccgggaccgcgcctcggccgcccgagccccccgcgcccgccgccccccacctcggtcgggggcttacctgggagcccgctgcccccggccagccgcccgcgtgtgcccagggccagcagcacgcacaagtgccagcgcacggccgccgcgcccatgctcaatgcgggccccgctgggcgtgcgggcgtgcggggcgcggggacccgaccgaccggccgctcccgcaggcgctgctcgctgctcgccgctccgccaccgctcgggctcccgagccgcccagccagcccggctgatgagctgacagcgcgcgctcattggcccgtggcgtcggaggggcggggcgtcgcccagggccggccaatgggcgccggcctccggccctccgaggaagaggggggctcgggcgtcgtcggggggacccttcccctggggcgggcggcaggtggggggtgtgggcctggccggccggctcgctaggcgcggggtctaggccaggctggggctgcttggaggctgcgccctcccctgcccgcggcgccccggcccccgccgtcgagagtggacgcccctctggggtaacccctcccggcccagaggcagcctcgggggcggggatcctgcgaaccggggatcccgtgaggtcgcccgccatccgtgggcagtgaaacgcgccagcgcgcagagcagactcgcctgcgctgccgtttgctggacgtttcttgagcacctactggggaccgagtgcgggcgaggcagcagcgaaggaaccgggaggggaaacctcgtgaagatcacttgaaaattgacgttcaaaacaaacgaactttttagcactcgtcaaaggacagtggcccgtcagtgtgcttgtcacggggcggccgcaggacctgcgtctggaaccgggcgggcgcccgggacggacaatgccgcttggcggtcggtcccgcgggaggcccccgcacggggctaacctcggccggcgaagttcgctgcccggaatgcgaggccgaggcctccccctgtgacagaccgggcggggccaggaggaggggcagggcgggcatcccggtccgaagacccaggaactgctctggcctggcctggggtctacacctgacgcctggcgagggttggcttcgggtctggtcccaccgggcctgggagggacgggcg

SEQ ID NO: 5297 - DNA, 1247 bp, Homo sapiens
tcgtggggcaccacgcgcggacccctgcctggcggctcctgcgcccggggctgctgagcccggggttcgtcctgaggccgcggctgtggttcctggccctcccggcccgcgtcactgtcgcgcggcgcccgctgcatcttgccttccttgcggcttcgcatgcccttggtggaacccagctcggcggacgacgaggaggatgagatggaagcctgctggaaaccgggcaaatcccacagaaaactgatgaggaagacggccgagagcaggaccctgggagtatccatggcgggcaagtggctgcgtctccccaggaggcggtggcggcggcgcaggacgcgcggggcacggagcggctggacagcggccggggcccggctcctcgggcggactcggagtgcgaggagccgggtcccagccacacaaaccccggccccgccacgccccctcccgcccctcgccgggaggggaggaatggggagggagggcagaggaggggtggggagggtgggaggagagccgggtggtgcgggccggaggtgtgggggagaggggccgcggtgcgccggtgtggcaggaagacgcagcgcccccgcgggacgcgcgcggggttgccgggcggtgcgcgcggcgcgggccgcaagcgctgaccgggggaaggcgggcgctgccggcccgtggccggggagcaaaggctggcccgccgcgccagggtccccctcgaactcccggaggtgtggtccctccgcagcgcggccccggctctcggtcctcgccagccgcctccactttcctgggagcgagcggccccggaggagggaagcggcggcggcgcccccaagagacagcttggagcaggcgcctctgctgcaggctgcgtgctgcctcggggcggtggtaccctccctcctcggccccaaccgccaggcctgccgtttgcgcccctcaggggccagcccggagccagagaagcctcgccctgggccaggcgcagggcccagctcggaacagccccattttctcggttgggtatcgctctccacaaagacaggcgtctattcccgaccctcgaggtcaggcaaaggccacgagtctttagagtttggatcgatgctaaaagctgctgcgctcccctgcaggccccagcctctcctctcgcagtccccaacctcttctgacgcagactttagctgctccacttcttcgtctgctcccgggatcctctccctctcgcggcctgccccccg

SEQ ID NO: 5298 - DNA, 1861 bp, Homo sapiens
ccggtgagcagagccggcgcagccacagcgcggagccgcggcgcccactggtcctcggagctgccaatcggcgtgtaatcctgtaggaatttctcccgggtttatctgggagtcacactgccgcctcctctccccagtcgcccaggggagcccggagaagcaggctcaggagggagggagccagaggaaaagaagaggaggagaaggaggaggacccggggagggaggcgcggcgcgggaggaggaggggcgcagccgcggagccagtggccccgcttggacgcgctgctctccagatacccccggagctccagccgcgcggatcgcgcgctcccgccgctctgcccctaaacttctgccgtagctccctttcaagccagcgaatttattccttaaaaccagaaactgaacctcggcacgggaaaggagtccgcggaggagcaaaaccacagcagagcaagaagagcttcagagagcagccttcccggagcaccaactccgtgtcgggagtgcagaaaccaacaagtgagagggcgccgcgttcccggggcgcagctgcgggcggcgggagcaggcgcaggaggaggaagcgagcgcccccgagccccgagcccgagtccccgagcctgagccgcaatcgctgcggtactctgctccggattcgtgtgcgcgggctgcgccgagcgctgggcaggaggcttcgttttgccctggttgcaagcagcggctgggagcagccggtccctggggaatatgcggcgcgcgtggatcctgctcaccttgggcttggtggcctgcgtgtcggcggagtcggtgagtgggccaggcggaggatgcgcgcgccgtttagggtgtttgaagctacgagaggagcccgcagggaataggggagcgccacctggggaacccccagtccccaagtatacaccggagatccgctgggacaaatgcgctcgtccggtcaccctttccccctcttcccttcctcagaaaagcgctgctcgctggcgttaccccgcggtccgcgggaatgggggcaccgagaattgcggtttggtctagccgcagaggcccctgaagtcactcccaacttcttcgccctcggcgggtcttgctgcgtggtctgggaaggacggaggggaaagggtggcaggaggggggagcctgggtcgggcccgcgagggaacggctccactccgcgcgctcctcgagaccagggatgacctggaaacttcggggtcccttcctccgcacaccatcccccccgcgccagctttcctgtttgactgcatgcaagttctggggagatgggggccagatttaagagacccgcgagtgtccagagagaaaagtttgcaaaagttcttttgtttgatgctccctgcggctagggcgaggtaaccgacactacgtggaatcgcagtaggcgatccctcaaggggatactgggggaggcacggaacgcgtccgaaaatgctgggacgccggccactggattcccagtcctgcggcgaccccctcctcgttgaggggtggaggttgcaccgcggggcgtcagggacgggaggacattttcataggagttacacgggagtgccgcaagcagggcgaggcggggtacgtgtgacacggcgctcggcttcgggtcgcctggccgctgggggacagaggcttccctcccgccacgctcgccctctctggccctggcggggcgcttctggggccgggaggagtctcgtctccggcggagcgcctgccggcacccagcttccctcccccgccctggcggtgggaacttgatttctccttttggtcgcgcttcgggggctggagcttgtttccccacgtcgcccaatgagcg

SEQ ID NO: 5299 - DNA, 3044 bp, Homo sapiens
gcgcgcgtgtggaaggctgggtggggtgcgcacacacgctcacttgtgtacgtacacacacacacacacacacacacacacaggcacacacacccgagctcagtcacccacattgcttgcccagggcgcctggaagagctggcgagcccgcccagctctgttcacccggccccgccccgccccctccgggagggctctccgggcggcgcccagccccgagcagagcaaaggacggcggcggccacctccgttctccggccgctggtttctcgtctttcctcgtcctttcattgaacccatctccgtgcttcgaaaatctgactctaacccgatctcttcgcgtctccgcctcttctttctagagtgagcgccaaaaagggcctgacagacagaagcctttggccccagcaccggcccagcccgtctctagacgattcttgctcctttcaccctcacagcctccagtggtcgcttcatcttcgcaccctcccggccaaccctaactctcctcgtctctcctcgcgctgtctcgcgtcctcccctcaggatccttccgcacattctcagcgtccagcgcggtttcccacaacttcctcacgccccgctcccctcgccctgtccccgccctcgacaccacctgcgttccccactcgctccaacctccctcccccgctatccccacttgtgggcctccagctctctgcccctttcctggcccccatccctgacaccccagggacccttcctccctcctcacgttctccctccttccaggatcccgccccgacacttcggggccctcccgctacgcgcactctttctcctcaggtcctgacacctgggcgccccctccctgtcacccaccttcagctccagccctgactctcgggcgccttgccacccttacgctccccgccccgccccggtccctcgggcgcccccactcgccgcctctacctccctacctgctacacctggcacccctgcccccacccctgctcatactcttcccccgcccccgacacctcgggcgccccctcacacgctcctattctccacacttccgtccccgaaaactcgggcgccctctcccttcacgctcagtctctcctccctccccgcccggccccggacccagcctggagatcgcgctcgggaggggcggctgccgcccgcggggcgcccgcggtgcccgggcctgggcagcgaggaggtgacgccgcccccgcgggatgagcccgggaggcggaggggcggaggaggtgctggcggcggcactgagcggcggcggcgcagggcgcgcgggccttccgcgccgactccatcgacccaaggggcggcggcggtggcggcggctgagcgaccctgggccgggcgcgtgatgaggaggggccggcgccagaccccgctgcacgtcggagctcgcctggatccgggcgttggcagccgaagggccctggccccgggactctccgccgctagcccccgtcatatcttctccgctttcgcttctccactctagccgggggtggggtgggtggggttggggtctccgcgggggtttccggccccgcggcccgctcccgggtgtgcctggaggagttctccctctgtggcgcgcgggagccctgtgatgcgtcagccggcgggacggatgagttgcttctccgggaaaccgtcctcgcttcctcacgaccctctcggctcccgcctgggtgcccctcgggccggcagtactccgcctccgggcgctcgaagcgagttccccgggggcttgttcgcaggcaccccttcccctccgaggcggcgcgcgcgctcccggccctgaccgcggccggacacactcgcgccccggtccgcctgtcgccctcccgcctgctccctccagtcaccccacccttagctgtccccgccaccttactccaccaccctcccccgcctctccgcgcactccgcgtcccggcctccagttcccctttcccttgaaccgctcacttcacagcccttcgcccccgggaagaagaaacatttcccgaagcgcactcctcagccctccttccccacgcgctcgccctcccctccccctgcttttcttgggggaggggggctgtcgccttggattgaaggccattgatttgtatgtatttgtcccagcgctggaggctgccccagccgccgcgccggtgccgccgctgccagtggagttgcctccccgcttccctagggtggttcggctccaccaaacatgtcggctcctgtcgggccccggggccgcctggctcccatcccggcggcctctcagccgcctctgcagcccgagatgcctgacctcagccacctcacggaggaggagaggaaaatcatcctggccgtcatggataggcagaagaaagaagaggagaaggagcagtccgtgctcaagtaaggacctggctccatattcccgcctctctccctgccctccgccccctcgcccactgccctgcggccgcctgcgcgccccagttcgccgccctccctcccgctggcggcgcccaggccacgagggctgcggccagcgccggccgcccgggctgttttaggggtgtctgagagcaggggtgtgtgtcggggagggagggcgccaaggccggctgaggtgagggtggcgagccttaggcggtgtgattttccttggcgcctttccggatttcctcgctggtcatcttggctccggggccccagcgggactggggctgaacccaggctctgtgcgtaccctctcctttcccgccgcgctgaggcagtgactggggcacagaatccaatatggccgtgcacaggtgctccctggacggacccgggcgaaggcgcgctggcaggggatgcggacgccaccctggtcccacgcctccgcggggcggctctaccagcaacgcgggacagagcagggctgcccacagtggctgcgagcagcgggcggcggcgcgggctaggggcctaagctctgtcgcggtcgggtgggtgtgcgtccgccgccatcttccagcccctccccctcggcg

SEQ ID NO: 5300 - DNA, 1603 bp, Homo sapiens
ccgcacttcgcccgaccaaggccggggccgtagtttgcatccggactggatttggatgcagccaatcctcctttggctgatggaatagtctcccctccccacagccccggcgcgcccctccctcgcgcgcctcgccgcctcccgccgcagaacaggagctgcgcggcccggagcggcggcggcggcgccggagtatccgtcccgcacgccggggcgaggggcgagcgagcgcgctcctcctcccgcgccctgcgcccccgcgctccccctctcctcgctgctcgctctcccgtccctccctccttctcttccttctttccgtgttatttttctcttctctttccccttttctctctccctgaccgttcgcttgtacattcccattctccccccgtcgctctcctctccccctcccctcctcactgtcacactctctgtgcccccgtctctcttctctcatttgcttgctcatctccgaacgtgaatccgcggctcccggaggagcccagcgcccggagcacctggagtccggccggcggcgggccgagcctggccagcggcggcggcggcggcggcggcggcgggagccgagggagcggcagccgcgaccgcgggcaccgcgggagccccagcggcagcagccgccgccgagatgtcccggcgaaagcaaagcaaaccccggcagatcaaacgtaagtttgcgcgcggggccgggagttggtgggattattgcccaggagcggggtgcgcgggacgggaaagcggtgggtgggtggcggggctaggggagatccgctcccggtcccctagatgtctcaaactttgcctgagcagtcgaagggacaactagacagtcatagacagacagacggccagcccgagcctcgggcaggagagaggctgcgaggagcagcccatgcttgccccgctcagccctcgcgctcccgggctgcttttttaattccgacccgcgcacgctgcgagtccccggcgctgtcgtccagccggaggggcagtcccgctcctttagacgcttattattgttgttgtcattgctttgtgcgattgacgtgggactactcttgggaaccacttttagtaaccagggtagaaacttctcagaaaagctgggcggtcgagacctcggggcgagggaggtaacttccccacgcggtggaaaatcagagcgtcagggtcccgatcctgggcggtgccagagccacaccaaacccgaagcgaaacaaaaagtaggtgtaaaagttcgcgcctctgcggcgggcggccgtgcgtctctgccctgcgggcgcgggctggtggctggcaggtcgtgtcctgggacttcgggcgggtccggctcacgccgccaggacgctcagccgagcggggattcgggtggtgtctggccctggtggcgcgcggagtcctccctgggaggggccgccagtcacttcccagcgcggaagctgtgagttcaaggcggtgggcgcgcaggggagtgcatggccctgagcccccgggtgcccgggggtcccgatggtgcttagaggacacggcgggtcaagagacaccttccgaaacaggcacgctcgcagagatcaagtcg

SEQ ID NO: 5301 - DNA, 1365 bp, Homo sapiens
gcggcgaacatgagtgcggaccgcacgacttagccctgagcgcccgattggcgcccggctcgccgagctcccagcgcgtctcgctccggctccccgcgcctccagggtacagaaaacagagtgttttgtagagctccagggtcctaaaggtggggactggggacccgcaaaagctggggtggagagcacagccctgaccatctgagcccccggagccagggcgtgagtgagcgcctccacacgccacccctgaagcccaccacgcacctttggcagagagggacccacctcgcttactgcgtctccatcggttgccttggcagtggctgtaatccatgcagttcagaatgatgagggcaaaggagaaaaggcgaaactgcatctgggcggtcgggcgggggagagacgcctctcaaagtctaggaactggagggttcgcccaaagagccggcgccggccgcgctgctggggaggactcagagggagactcgccactcacccccgggccgcaccggtcagttcagcgcgatcagcatctctccgccacgaacctgagagacaagaagcgaaaacagggtgtgtgggggatggagagagccccggggaggcagctgcgccttcgcacgtcccaatttaaagaagagagggaaggaggaagcgaacccactgcctagcacgagccgcggagcggcttaatccagagcgggcagctgcggacgagttggagaggaaggtgattataatcagtgaattagcaacctctgccgagccctaagctccgacccagcggcataatgcgttgtgccggcgctccggggaaaggaaagaactctaaaggcactgagagcgcagggctaaaagaacgctcttaggccatttggagtccacggcggtgtacccaagcgccgcagctgcggctgccttggtgtgggttgcctaccgtgcgcacgtctcgggcggcgcggcctccctaggcgcggtgctccatcccgggctcgggaagcgagccgcttggttagcacgtgggctggggaaaagtttgccgagaccggctgggagcgcctggcagctctggaattccagcggccgccgcggggttggcgacgccaggcaggagcgcggagcggcgggtgcagccactgggatgctccgtccccgcccgcgagcgcggtccccaggcaaggggtgcgcccgctcacactctctgcctccctaaccaattgtgtcgcttcctgcgctttctccacggtcacttcacagctaagatttctttctttccgagctgtagaaggcagaacgctctcgggaggacgaagtgatccgaagggatgtggcaagcgcactttccgatggagatgcagaccg

SEQ ID NO: 5302 - DNA, 419 bp, Homo sapiens
tcggggaggcgacctctggatgcgccctgtgcgagcaaagccgggagagcgagccccaagcacctggcagcggtgcccccagcaggcgccgaggaatccggctatccatttctggtgaactctgcgcccactgaggcattcgaggtacggatgtgtccgcctagtactcggagacgaaggagagagagcggggatatgcgctccagctctgctaggctccagggctctcacccttgcattcaaagcctccaccccatcccactccccgccactcaccttctgcttcggccacccggtgcggctccagcaccgcgcgctctcccggcacggttcccggagaaagtcccccaatcaccagctacggcacttgtagcctctgcacgccgctcggctccgccgggtgggcagcgcccgccacg

SEQ ID NO: 5303 - DNA, 3675 bp, Homo sapiens
ccgcgcagcccagcccgcgccggggcggtgggtgggtgggtgtctgctatgggattattcttagcgctccactctcttcgcaaaagtggcgcctccgccctcccggctcaggcacactcgctcggggctcgcacgcccggcccagacaccagcgcggtggagagcaccgggtggggtccccgaagggtgaggctcggaggcgccgcggagggggggctccctagagaggagggggcgctgcgggaaggcccccaagggaggctgcgtttaaccctcgacgccctgcacccagcccggcgcggcgcgctcagccgcctccccggactcctcccggggcgcgggagcccagcggcgcgcccagcccttacctatggtggtgatgaccgtgatcgcaaagtagaaggagccggcgaatttccactggacgccggcgcggtgcggttccgactgcaggatcaccagctccagctgccggtagtcctcgctgctgatgttgtacttccccttgatccggatctcctcggctttgagtttctcctcctcgcgcatctcgtggtccgactcgagggcgtcgaacacggcggcgcccaccagcaggtaggtgaaggtgcagacgatgagggacagagtccgcacgttctgcctcttcatggccgccagcaaggagccggcgcggggggcatgtcccgcaggctcacagccgcgcgcgtcccactgcagcgcccggcggccgccgccgcctcctcctccgccgccgccgccgccgcctccaagttgtaagcggcggcggcagcagcagcagcagcagcggggaggcggggggcggggaggctggggggggccccctccgctggggccgccacagccaccgccaccgcgaggcggctggcggggcaggggcggcgcgggcccgggctcagccgagaaggcggacaggcacaggaggctgctcgagcgccggggccaggcgtccgggaaccccgacaccctgcgccagacccggccgaagcagcccgccccactgcgcagggccatgcagggcggccccgctgggtaccgcgcgggccttgctgccctccgcaccccgccccccgctcccgcgggaaacgcagggacgggaaccggagccagaaagcggccggagggcggccgcggggcccggtacccctgtgggtccagctcgcgggtggcggtgcccagcaaggagcctgcaggtccgcgcgcccagcggaacctgcttccccttttacccctcctcgccccctctcggtggtggggaggaaaagtttgcgaagtggcggtgtctctggagtcccctgcaagcggggagggggccgagcaggtgcagcgggaggggcagcccgctccccaaaggtccgcgcgcccagcgcccacccgggcgcgcgggtgcgcagcggggtccccgccgggcgtcggccggtgcgcgaagtttgctcggctcaacccccaaggcgcgggagcggggcgcggccccaggacggcagggaccgcgatggagcggcttcgggggcggccgggggacggcgcggtggcggtcggccagcccgctcctccgggggcggcgggcgcggcggcggcggcgggaggggtcccgcgggcctcgcggagcagcggggcggacgcgggcgcatgagccgcgcgggggtcggggccctccggcgtccgggcgtcccgggaggcggccgccgcgctggtctgccccgggcgctacgtgcgtgcgcgccgttgggagcccgaatgtgtgtgtgcgcgtgtgtatgtgcgtgtgtgtgtgtgtgtgtgtgtgcgcttggcagccccgctccggcgggagggcctcggggagcgggggccgggctacgccgaggccgggcctccctccctccctccctcccgcagcctccagggcgcgccacctcccgcctggtccccagccagctggcgaggctgctgtggcagctcccgctgcagacccagcgcggcgcagggcgcacgcggagggagcccgggaggggcggcctgagccgccagggagggggcgggggcggagccgccggcgggttttggcgggggatgggaggataaacgcggcttcttgggtccttctagccccgctccccaagagcgcaagcagccctggcgggtggagagtttgagggactcggggttggaggaggaaaacgggattcagccagagatggcaggctgacagcttcaggcagattgggcagagagtggggagcagaaggggagggggccatgggcacacaggagagcggcagcagcggttcacgaagtcttccccaccccccaccccccacctagccacccggcgcgggagcgtgtcattggccagggacatggcctcgtggagtggtggggtcccgagggctgcctcggccccctcgcctcccagcggcacagcccgcttgggccagcacctgcagacccgagtcgtttccctggagagcgctaaggacagcatgggccgccacttttggagtcaggacagcggggaaagacatcgcaatcccccgacccagtaacctctctgttgctttactgaaggaaaaaaaaaaaatacacacacacacacacacacacacacacacacacacacacacacatatatatatatatatatatatatataatcactctttgatatatataatcactctttggttccccacagctgggcgcaaggtgcgccgtggatgcagccctgagccacgcgatagccccctcgagaccacctggggtaggaacacgaggctcgggctggggcgcacctattccctgcttccagatgagccctctccaggctttatctccttcccattttggcctcctttacctcctccccctccccgccctctccctttaggctatcgaggggcttttccttgaccttcggcttcctgaatcccgcctggagccctggagctccaaaaggacagacccaagcctcagagacccctgggctcctcttcctctcctgaccccagccaaggaagggatggagatgggaaagagttgcctggcggcaggctagcagctggccaaggggtggctggggaatcagacctaaccctcgggcagctcgcgggctccaggagaccagtcccttctgtgggtcgccccctggagcggtgctcgggctccctggcctcagggaccccgggcccagagggtctgggaccccagtgattcaccgaggcctcccagctgggacgctctgcaccccactttcagggatcacgggtgcccaccagggaaggggagcccgcgctgtgggctacgtctgagccgtcaggtcctcgctgggtctgcgggcgccctggggcgagggagcggggagccctaccccgagcaggcactctccccagattcattttggaaaccaaggcccccgcgctcggcaagtgagcctggctgccgggtgagtcaccgcgagcgggcgacaaggattcccagcagctggtaattaattgcgccgtggctcagcccacgacggaaccccagtcaggcctcccgccgccctggcagcggcgccacccctgagtcacagccgtcgggcctccgcgcggtccggaagccgcctgcccgcctcggcgccaccagggggcactggactccgacccacgcggcggccgcgcagccggcctcgctgcg

SEQ ID NO: 5304 - DNA, 3675 bp, Homo sapiens; identical to SEQ ID NO: 5303

SEQ ID NO: 5305 - DNA, 3378 bp, Homo sapiens
gcgagcgcggagccggagagccgggagcacaggcggccgcgccgcgtcctggcccggcccgggcccgcgcgccagcatcgtccgcagcgcgggcatccggaccctccgggcgcccggggggctccagcaggcgcgggggaacgggagggggcctgcgtgcgccggcgggtgctctccagggggcgtcccggcgaggcccagagcgggccgggggcggcggcggctggaggagccccccccacctccggtcgggcgcccggctcagccgccggcgacgcgaggcgctcgcggggatttgcaactcgccggatcgagtcctcgccggcggggccgctgctgctggggaaggtaaggaaggctccggcggggggctgggggcgcggcgggtgggggcgcagcgagggtgggagggggtcgggggaggggcgggcgcccagacttcctaacttcgccgtttggggcttcgcagctccgaggttttgcgctcagagctcaggagtttggacccccaccccctaccccctcagccccctgccttctccagcggtggcgatggaatgtggcaggtccccgcgagcccgcattgggcaggctgaggagggggcgaccctggacgcaggagaggctcctcggcgccgccgcctcctccccatccacacaccacagcctggcacccctcttcatcacatgcacagggcaggctggggagggcgttcccgctgtacccccagcacacacagacgctggcgggggtctaagggagccccccatggcccccaacagccacacatagacgcagcaggctccggagagcccccgagcgtgtccccctcctgctaatcacgtccagggccccctacagacattgtaagggcccgagacgtcctccccccacgcacagagctcggggcaggcaggagaaaaccccagactccttctcgaagccctcgctcgtagaagccctcgcctgtagacctggcattggcagtggagactccctggaggtactctcccccacttcgggcggagggctatttttgcgccccccacccccacgcgaacgcctggctcttccctccttgtctacctttccactgggtcggacaggccgcgcggataagccgctctcaactttgggccggccctatgccgtctccgctccaagcgccgagcactcccgggcgccgagcactcccgggtccgcgtcgccggtgagcagaggccgccggccctccaccgtcgccgcgctagcttggagccgcgcggagctgcctcgaggaacgagcacggcccccgccccctcctggggaggctgggagctctggacccggccaggagccctctccctaggtccccgcggccccctgggcgaggtagagagctcctccggcctcgggagggggcggcggagctgagaatcaccgcgaagcgatgcgaccgggagggcttgacggaggctgcggctccgagcccgcgtccctcctcctggccgcggcggctcctgcttggccactccccggcagcctgaagagaacgcctaatctggcaccccagccccaggccgctgggcaccttacccctttccacttttattttgggcttctaagtttcttggagcgcaggcgcctaggctgggacccgaagagccctaagccagccctctttcagcacccgtccccgccgcgacctccccgttcttcctccgggtctggggcgcagattcctgggctgcaactccggagtagttgaaaggcaggaaggcgtgtgggcgggtagggggcctgcactcccgccccagaggagccgcttgtcgtttgtgttggggagggagctgggaggtctgctctcccgctccatcctgggaacccacggagaccctcggtactctccccacagacacaaacacacgccccctcggagcgagagccgccgcgggggaacagcagaggccgcgcgggcggaggcgggggaaaggggagctgggtcccttttctatctgggagggaggtggtatacggtgtgtggggtctggggaggcgactgtcacgtctcctagaaccctcatgccttccactcgtctgcgaccccggctgccgaggaggcaacgagggaggtcgagccgctccctcccgtgggcggcagcgaaactctgcgcccgcacgccggggtgccgccgagtccggctttgagtacccagcaaggtcaagcaggcgaaggagggggcgggggttcctgggcgcgcccccgtccgcgcacagtcggggccttggaagggggtgtgcgcagcccgccgagtcagtcccgctcgcctgccgcccgcgcccggtccccggaggcggacgttgcgcgcgttcggggatcccggagcgcccggcgccccacgccctcccttcggctcgctagctgctccttggcgctgctttcagacttgttgcgcctcgatctggggggcagaaggctggcccgggagacccggcggctgagggccgagccgcgaagcccagggatgcgccagagaggcgcgcggctccgcgggtgggcgctgcgctggggggctcgagcctggggtttgccgcctccgatcccagggacgggcgcttgttcctgccggggtcccgcgcaggggcggatagagggcgattcgtcgcctcggcctcaggcagcactcatccggatcccgggctagggagggggcgcagccaagttgtggagccctcggaggcccttccctctcccgcaggctccggcccctctcggacctcggtggccgcgtccgtgaaatggggacgcgggctctgctctcggatcccttccagcccccgaccctccgcacttgtcccgagatccaacgtgcccggtccgcagcgtgctgggtctgcggcgtcagggtggcccgagtcccgagaccatctgcgcttgcggacacagccgcggggcctggcatgaagggccccagggagggcctagcaagcgcccggggtccgagcagcctcctgcggcgtcctccgcccccggtcggcccgaccccgcctccgggagtgggtcgtggggcgcggagcccgtcctccggggacgccgcggggctccaggcccaggcggccggcgcggggccgcagtggcggaaggcggagggccggcgcgctgccgctgactgccgggagagggcgcccgcaccgcgcccgcgcggccctgcccgccccttccgtctcctccgcgcctggcccgcggctccggccccatcttgggcagccccggccgccacctccctcccgcccgcccgcccgcccgctcgctcgctcgctcgccgtccgctcccgccgccgggtcccgtgacgcgcctcgcgtctcggccggagcccccctcgccggcccggcccg

SEQ ID NO: 5306 - DNA, 1108 bp, Homo sapiens
gcgtgctcagatgaaaagcggggcagtcgcggcccgtagacagcgggcggctgggtcagaccgcagagggaagtttccagcggcaagcctccccgcggggaaggctgtgtctgtcccaggagatgagccgcaggcaccaggggtgatgaggcccgggggaggtggatgtgggggatggagcggtcccaaggtcgtcagctccagccggcgccctgggccgcggggccggagagctccggagcggaccctcgccgcgctccgaacccgccccgcgcccccaggccacacccggctcgcaccctccccgctccacgtgcgcccacgcgcccctccgggcctccccctccttcccgcgcgggccgggggcgcgggccccggaggagctgggggcggcgggggcgcggggcgggcgactgccgggccccgggccagctctcgccccccgccccgcccccgatcgctcggctcccccgcccggcgctccctcgggctgcgctccgcggctctcggcggcggcggcggcgggcgcagagcgcggcatgggcgcccgggccgcggggcctggcggcggcgggcggacgggcgcgcggctgcgggcgcaggtgcggggcggcgggccggggccggggccggggcgcggagccgccgctcgggggccggggcgcccgcgtccccgccgccgctgacgctccgcctgtctccctcccgtgtcccgcccgcccccagaccctcctcctccgcccccccgcagctcgggccctggtcgtggcgcggctgccgcacggtgcccctcgacgccctccggacgcgctgcctctgtgaccggctctccaccttcgccatcttagcccagctcagcgccgacgcggtgagaccccggccgggccggcgggaggggcgccgggcaggggcgcgggcgggggctgccggcgggcctgcgggtggggagggcccgcacccgtcctgtcccggaggggtcgctgtggcccgcagccgccgtggcctggcccggccggcggggtccatgcgcctctggagagggtgggtgggcgccgagcgggtggcagtgtggagttggagacgggcctgggaggagtcgggacccccg

SEQ ID NO: 5307 - DNA, 1700 bp, Homo sapiens
gcgcggggtgggcgctcccggccctccagcccccaactccctcgcgcacccgggacgggtgaaggcgcccagctgccgagcatacccgcgacgcgggttcaaatcccgccggctcccaggcaccctcaccccgccacagcgcgggctgtttctcctcccttccccggaggaattccttaactctccagtacccataccataacaaaggaggctcggtccaccaatgcgcgatcgtagcctacagggacccccaacgaaccccggcccagagaatgcacctggccgtgccacgcgcgacccccgaggggcaggcggacgggtccaggcgcggacaaaggggcctctcggggcgcccaagctcggggcgggacgccgggagcggagctggccgggaactcaccttcgcagcggcccggctgtgctcctcgtggagcagaagggcggcgggcagcagcagcagccagacgctgagccggggccccatggtggcgcgcccgaggcggcgagggacggctgcccggcgtgcgggggccgcggcggacagctagctctcggaaggccggacttccagcgctacgcaccgtcccgggtgcggcggctccaagcggagacctgagcgcggcgggccgagctccccaatttgttggcgctgccccctcccccccggcggtgcgcgggcggcgcctcaaaggggaggaccctgcggcgcgggtaagaggcggcgggagcgcgcggcccgggagtgtggctgcagtgcgccgggacaccagggctccgcgctccgcactcaagaggctcccgcgtcccaacccctcgcgcccgcgcgttcgcggatccaggccgaggaccgaaaggggccgcccgagcccccggggccggcgcccagagagcccagcaaggccggccgccctgccggtgtgccgccggcgggtgcttctggaagggccaatgcgttcgggcagcagcccctgaagccgagcccgaggtgagagcgacccccgagcggcgcccagaccctggcccgagagcaccgacttggagcgccttgtgcaggctagggctgcacgctctcctgcttgggagtagaaagggggagggtgggagagcgaagaccgagctcctcggccaaggagcacccacaggggcctaacgggaggctctccttctttccgggtcgtgggggggacggccctccggtcacccctgcatgcgggccgcgcaccgcgctgtccccgcgtctcgcggaccgagaccggcggtgaggatgggctgcctccctcatcctgcgctaaactcgctttgtctgtcgcctctaggctaagtgggactgaccggggcccagagtggacgaaccgccagcatggggagagaccagcgcgcggtggccggccctgccctacggcggtaagcgactttctgcctggtccccgtgggtcacgcgcgcatggacccttcggtgtaactctcggggactgacaagccgggcccgcacgttcacgtctctcttcctccctttcccatgcaggtggctgctgctggggacagtgaccgtggggttcctcgcccagagcgtcttggcggtaagtcctggctcccgcgcttggacttgcgcgcccgagagtggttgggacgtttgagtggccttggagaaggcagctcgtccgtgcgctcccgagtgtgtgtgtgcgtgtggatgttcg

SEQ ID NO: 5308 - DNA, 692 bp, Homo sapiens
tcggcgacccggccatttcccgagggtctcaggcgtcccacccaacggccgctccccgttccctgtccgtcacctcctcgttctcctacgaaggcgcgaacgttccagactctcgccggtcctcgacagcactcattcagtctcccccctggagatcccaggctgtactctgggacagaaaagaaggcgggtacgaccgcggtgtcgggtcctaccttagccgctccttctcctgagggagccaggcgggagagaggggaaccaccgaggcctcggtcttcccgcgtcccagagcggccgggcgagtctcacttccggcctgtgacccgctgacctgtccttgtcccaccagtcgggcggtgaattggactgactggtgacccctggcaccaggcttccccatgggcaccggagcaggcggacaggggtggggtcccgcgagcgacacggaagggtcagtgtggcggagcggaccctgtggaggcggggtcactgtgctcctgagaagggtcctcgggggtggagtctatcaaggttgcgggggcgtggtcacggagcggagccaataaaagcggggcgtgcacggccgcgggccagtgcctatgaagggcgaggggtgtggtcacagggcgggatctacgaaggatgcaggggcgaggccgggtctctgcaggatgtgcggtcgcgggtcg

SEQ ID NO: 5309 - DNA, 1924 bp, Homo sapiens
ccgccgtttgctcaatgtccccgccagccttgtcggtccttaccgccgtttgactccactgtttttctcgtggtttctgctgcttctctaaattgtccaacgaccgttattcagtaaaaatgaatgaaacggggccgtgtgatctaggcagcctggagatgagattttggaatcataagctacattccaacgtataaaccgattttactcgttttggatactcgatgtacgcggaatgggcgctgtaaaatgcggctgccccgccggaggcatctgcttgggacttgctggcagccgccggtcccctctgcttgcgaccctcggcccagccgccgggaccctggtgcacctgttcctgggcgtcctctctactccccagtggccgccagctccactcccagcctgtggccccggacccgccggcctgagcgttcgcagagggccggtcgtcgccacagccccgcgtcccggcccccgcgccccttggaccttcgccccaggccggcgcagcccagcttcccgggcaggctccacgctaccggggtccagtgcgcggcgacgaagcggagagctgtgtccagactccggagagaaactccggctccgcggggcggcgcggggcggcgcggggcccggagctgcccaactccgccgcctcgggaaggcggcttcgggcccgcagggagccccggggagggttcccggttccgccggcagcggcgtcgaggggtgcctgggctcctggggaccgcgagaggaaaaagaacggaaatcgcaccggggaggaaggacgcgcagaacgcccccgtgaagcggggtgctccggtcaggcgtgcgcgggagcgcggtccgggggagtccggcggcgccgtcgcgcgcactcggcagaggcttcgcgggagaacgcgcagcccggggcgtggggcggggaactgcccgcgcgaggctttcggcgcgtctgggtctcggcgagagcaaagcgcgtcctggcaccgggggcggcggcgcagaggccgggaggaagaaatccgggccctggcccaggtcgggcttccacccctgcgacccgcgagaggcccaggcgggaaaggcggcgagtggcgtcagcggttccgaaagcaaacctggcccggtgctactgcccgagggtcgccgggcgcgtttcctaattcccccgagtctggaaaacggagacttccgtagcgtcttcttcagtgcgtgctgcgagtgctgaaggaggacccggtgcctggacgacccggagcaggggaagcactcggccgacgctgtcgctgtcatcggcgtcattggcgggcaggacagtggggcgggtaaggggcctccccgcgcctcccggcccttcgcgctcggcgccagctctttggctcccttccctgcgcagctctaggcttagctctcagccatttctcaagaagacgatcccgagggtcgaaggccgcccttgacccttgaccacggactctccgtgtaactcggaagagccgtgattttaaaacccggcctcggggttacagaagcccgagatctgggaggcgtccgggacctccctcccagaaccgcagggacccggcctgggatccagggtgtggcctctcgctctgcgcggtcgggaaggcggccgggtccggtcaccgcgccaagcactgcgcacccctgggacgcgtcgttgcggggggctggggggctggggcgcctccacgacgcctggtctgcccggccagtgcttggtgtcgttggtgggttcgtggctgcgacgggtaaacgtccgttccgcgagccgggcaaggcaacccctgcgggtcgcgcccgaaggccggacccctccaagccgcctgggagcttccaaacaggtggacccgaagctcctgtttgatcggagaataacgttcaatttactccgccg

SEQ ID NO: 5310 - DNA, 1991 bp, Homo sapiens
tcggtgcaccgtgctttggcaaccgggtcttggcgcctccgagagcggggcgaggggtgccacgcgattcccaggccgctctgtatctctcggtgcgcttgcagggaccctgcagcaaagccctggatgcttgcagccggtgcaagtttgcaagcagctggagagcggtggctggagtcggggggcggtgggcgtggccacgctccctcccaggcagtcccgggaatgttctgaaaagtatccgaaagttctgagtcgcgcgcgcgccaaaagaaaaggcacaaccccccaccactccgggcgtggcgtgcccagacctcgccactccagctgcgcctccggctgcagcgcacacgtctcctgcgcctcctcctccggagcgtcgctgtccgtcgggttcatccctcgcagcagtctccaggcgagagagggggccagagtgctcgcacttctcctaggggcaccatgcccaacgacgaggcattcagcaagccctctacaccgtcggaagcccctcacgcccccggggtaccgccgcagggcagagccgggggctttggcaaagcgtctggggcgctagtgggggcggccagcggctcgagcgccgggggcagcagcagaggaggcggctccggctccggggcgtcggacctgggtgccgggagcaagaagtccccgcggctgcccaagtgcgcacgctgcaggaaccacggctacgcctcgccgctcaagggccacaagcgcttctgcatgtggcgcgactgccagtgcaagaagtgcaacctgatcgccgagaggcagcgcgtgatggccgcgcaggtgggtgcgggcgtgcgggagcccgggttcagccttagtttttttttttttttttttttttagatggagtctcgctcggttgcccaggctgcagtgtagtggcgcgatcttggctcactgcaacctccgcttcccgggttcaagcaattctcctgcctcagcctcccaagtagctgggactacaggcgcacaccaccatgcccggctaatttttgtatttttagtagagacgggggtttcaccatattggtcaggccggtctcgagctcctgacctcaggtgatccacccgcctcggcctcccaaagtgctgggattacaggcgtgggccaccgctcccggcggggcccgagtttcttgaatgaagtccccccagcatggccgttgccatgcgggtcctgggttgtggagagatgcggcggtacttgccgacagcggcggcgcttggggtcctgggctcccggccacgctacatcgccggtctgggagcgccggagacgcgtctgatcccgcccgccgggcagagttgcgggcttcgctcggctcggggttccccacgatctctcaccctgtgtttcggcggagttgcgggggttccctctgctcccgggtccctgagatccctgatcccgctctcagggcagggaattccggggttcgcccctctgggcttccccgcgatcccagagcccgcgttccaacagaattgggagggtttattgcgctagaggagtcttcaggatcttcgctcccgccctccgaggtgaggctagaggggagggttcgactccaagggaatcccagggatctctagccccgctcttctagcagagaattaaggaattctctccgctttggggtcccaaaaatctccgaccgcgccttgggagcagagggtttcggggttcgatttcctcgagcgtccccagaatctctgactctccctccttgctgagttgcacttaaattagaaaggatcttggagggcggcagcgctggctgctaggttagcgggaaagggaggctcggccggctgctgcttacgcgggtaacctgtcggaaagccttgtttgtttttctggaaaagtcgctgcaatggacacagcgttgcgcggtttccctgcgcgcctggggcgctttttgtcttcgccctccgtggatggaggctgagcg

SEQ ID NO: 5311 - DNA, 1667 bp, Homo sapiens
ccggggtgcaaccgcaacactcccgtaggttcgagttctcccggagctgagcttctgcggccaaatgtcgggataaaagcggccttgggctcggaaaaacgcggccagatctggactggagggaggagaagagagagaagcggagcggccacctcactcgcttacaggcacccccaccctcactcccgctggtcctccccttctccgccccgcgagcaccgccgcgttctggagcgccgcagtctccagccgcgggctggggtagcggagagggcttggaggagggggccgcgagcgcccccgcgagagtggcctggctgcaggtggcaaggaaggtgaagtgcaggcacccgaggggcgcaaaggaggaggaaggcgtggggcggggagtgcaaggagacagggaccccaggggcgggggtggcggtgggaaggaggaggggttgggggagggcggcggaggtgttgggtccggccggctcacgagggagctgcagaagagctggctcagaccttaatcagagctgtcgccggctccttgcagccgccgcagcgcctccgcgaaggaggacgtgccgacccggctgcgcgcccaaggcagaggcccgcgtcggcgttggctgggcgtgagctgggaggccgagctgtgagcgcgaagggagctggagagacgactgcggcacctccggccgccccggagcacacacgaccaccggggctgcgggaccaagggccgcgtcgcccggaggccgcccctgagcgggcctcgcagccccgccgtccagcgctccctggccctctcccgcagccaggctgccaactcattcgggagcccggggcatgaacggctacggctccccctacctgtacatgggcggcccggtgtcgcagccgccacgggcgcccctgcagcgcacgcccaagtgcgcgcgctgccgcaaccatggcgtcctgtcctggctcaagggccacaagcgttactgccgcttcaaggactgcacctgcgagaagtgcatcctcatcatcgagcggcagcgggtcatggctgcgcaggtggcgctgcgccggcagcaggccaacgagagcttggagagcctcatccccgactcgctgcgcgctctgccagggcccccgccgccgggggacgccgtcgccgccccgcagccgccgccagcctctcagccgtcgcagccgcagccgccgcgccctgctgccgagttggccgcggccgccgcgctgcgttggactgccgagccgcagcccggggctctgcaggcgcagctcgccaagccaggtaagagcgtctgaggtgcgggagtttggccgggcgcgggggcaacttcggagtgccagctgcagctccacttgggaggactggaggcaaagttttgggacgtgggcctgtcggggctttccttcctactctccgccaggccggggcttcctctcccgggagaagccggctgagtctggacccagcgcgagtggcactcgcgcccgcagggaaggcgcctccgggcagccaaacgacgggactgtgcgtcagtatcgccaggtgccttcccaggttgaagggttcggaacgtgtcagattgagcagggagacaacggagttgagacaggacaaaattaaaacccacgtgcgcacactcactacggtggggtcg

SEQ ID NO: 5312 - DNA, 433 bp, Homo sapiens
ccgcgagataaatggtgacttctctcttgcaggcaccgtcatacctcgggtttagattctggacaggcgagccggctgcaccgaaggcccggtaggcggactctggcggagcgcttcagagagaagagtgtagaccgcgggaggcggagggctccctgccagcgtgcctcggccaatcagtattcacaccgcctgacaaccggccaatcagaggacgtaaagctccggggcctgagcggacagtactaggaaggggagcgcagtctgcagactgaagccagtggcgctgcgctgaatgcaactgcgcgcgcccgccgggtgagccagcgatctgagccaggcgggggcggcccgacctttcccgcccagcctgggtcagaggaagccgaaagcggcctcagcaaggtgaggcgcccgaggctgcagaagaccg

SEQ ID NO: 5313 - DNA, 896 bp, Homo sapiens
acgaggaccaaaggcacgaatttgcttccacgccacggcccgggacccagggtgcggggaccacgcggagcgcagcagagctcagggtaggagccgggaggccgcgcaggcagagcccgggcagggcggaggggaggccgcggagggccgggtggaggtccttaccgccagccccaaggtctgcagcatctctctctggtctttgtccccagggccgatgtgcctccgagcgaagtcgtcgtgtctgggcagaaggcgctccaggaggcgcgaggccccagccgcggcgctgtccccgccgccactgctgctgtcccggctccgcggcgcccagcacggccccgatcccccagccaggcggcggccgcccccgaccccgcggcccaggcgcagcccccacgccctggcacaggactgcatggccgcggccaccgtcccctgccccggcccgcaagggtcagccgcgctcttggcccctctcctggcctcggtcccccgggtggcggctgcgcccggcctggagcccctttcgctggacagtcggccggacagatggatggacgctcgcgggcaatgaatgggcgctgcgctcaaccaagacactcgcgcaaagttgtggctccacccaaggcacctgctccgcacactttaagcggcgccctggaggcgggaggtgggttggggccaggaagcccttggccaatgaaagtagacagagggggagggggcggaacagttcccgcccccgccccctcttcctaccctcttcccagcccttccgtggagtcccgcttcccctggaccggaggctgccatctccagtcctacccactccgacgctggctggtgccgggggccgggacgctccgtacgccgcccgccagggtgtggagccg

SEQ ID NO: 5314 - DNA, 1494 bp, Homo sapiens
ccggggtcttcccaagcggagcacctcaaaagccgcaccgcgcagtagaggtctccaggggcccccactcgcccccagtgactacggagcggcctctacctcccgccggcgcctggccacttctcctcccccgcagtctccgcttgatttccatgtgactgcaggcaagaatagcccagcctttgtgcctctgcaaagaacgcaaacaaaaatgtacaccatcaccacccaacaaacgcgcaactccgcaagacacaaagcgtctcccaaacatcgcttccctggtaacatccggcatcctggggctgccaaatcgcagacaaagacgcccatcagcgcggggggtgaggagactaagggagagacaagaccaacgtgctcccaccaacgggagcggcggttaaaagggcgccggtgccaggggtgagggacggggcaccggtaccaattagcggctcgcctcggggtccccgcggctaaggcgagaacgcaggaccaggagcattgctgcccactctctaccgcaacccgcacatcccgggaccacgtaacggcggatggggcgtccgggagcggcccctgcaggggagagcaacaggctcccgcgccctggaggcctggtctgcgctccgggcccccaggctaacaccccacccccagccccccgacaccaagactgtgcccctctgggtcaaggaaaaggaaaaacttttaaacctcttagtcagcgagagcaaaagaaaggggtggcgggggtgctgaaaggtctaggattatccaccgcggggctggggggagtggagacttgcgagtagcaaaggaaacttctagaccccatccttttaaaaaagccacagcagcggcttccgcgaagcgccgggccgcgcggggtggggcaagcgcaccgccccaccgccccacggcccgccgccacccctacccccacccccacccccacccccatccccgcccccacccccacccccaagcgccgagcccagggcgcccgcgcaccttccccgccggcgcgcgcgcagggcgcgggggcgcgcctcggcctctgggccggggctcaagcgccgcttacccggctcgcggcgcccgcccagggccgcgacgcgagggggcggaggactggggagcaggggtcgccggggcctctggatgcctcgcctcgcccacgctcactgtcttctcttctgaagtaacgacccggcgaggagcttcggatcaaaacgcacagacactcacgcgtgactgagaaacttaatcccgcggtggcccgacgccagcctagcgctccgccgcgccccctcccccagcgcgcgccgcacttgcgccgaccggggctgccgcggaggcggtggcggggcccaggctgctggggctgccgtgacgcctgcgaccggcggggcggcgggcgcgccttggccaatcaggggacgcggccgagcaggcctgtgcggggttttaaactcgctcctgggccgctcg

SEQ ID NO: 5315 - DNA, 828 bp, Homo sapiens
ccgcgacctcaccggggaaacaccgcggacagtcgggccagcagcgcccggagctcactccaggtctccaaacttgcagcacttcccagagcgcgcgcgctcggagcgggacctgcttgctccagtgcacgccgcggagcgaaccatcgggctggcgggggtggaggggtgcaggcgtgggggctgcgggccgctcgggccttgggcttctcctgccgccgccgccgcctcccgcccccggccaggagtcgcgcgtgacgcggttcgccgcaggagcctcgaaggcgcggcgccggcgagcccttccccggcaggcgcgtgggtggtagcggccaatttgacagtttcccgggccgggcggccagcgcggaggcgccacgctcgggtcgggggcgggctgacgccgccgccgccgcgggaggagggacaaaggggtgggtccccgcgggtcggcaccccggcggttgggctgcgggtcagagcactgtccggtggtgcccaggaggagtaggagcaggagcagaagcagaagcggggtccggagctgcgcgcctacgcgggacctgtgtccgaaatgccggtgcgaggagaccgcgggtttccaccccggcgggagctgtcaggttggctccgcgtaagtgcctccttgtgccgcgcggttgggaggagggtcgtgagcgtgagcgtgggagcgctgggggctctgctcgcgtgctgctctgaagttgttccccgatgcgccgtaggaagctgggattctcccatccggacgtgggacgcaggggaggggtaggtttcaccgtccgggctgatgactcgtggcctccg

SEQ ID NO: 5316 - DNA, 2705 bp, Homo sapiens
ccgtgcttggtggcccgggtggggcgcagctgcgggaaatgcacccggagctgtgccccctcccggcgaacagcctgcgccacccgccgcaccgggaggtggctgggggctgccgagcgagtggtgaacgcgatgggtggagagcgcccgaaacgaggtggaaaagggggcgggggcgaggcacggcgccttcttgccccttcttcagctacagacgcggcggcggcggctgagtccctcagcctcggtcatgtgatagtctcgaagcgctagctgcgggggtctcggcgtctcggggaccattacaaaacgcagccaggagagcgcgtcgctgccactgccgtcgcctctcctcctcaagacaagcccgggagaaaggcggcagctgcggcgcggacggctgagcctccccggccagcactcacccagcattcgcagacgccctctccagcccgccgctcgctcccagagtcctgcgccccacactcctcagcagaacctgcgggcgctgccgcttcagaaaccaccaaagttttttctcctcagcgacagcctagggctgcgcgtctcttctaaccccggcgacgctgcgagcctcggagaaaagagaggcgccctagaagccaatcttctctctccttaccctgatttttcactccaggaaaaggagaactccagcgcggtctggctaagtgcctggccaggggcctgcgtccagggcactggaagtcctgctgtcactggcctccaggacagcaggcgcaaactcagatttaaagggccagagtctctactgcccagaccttcctcccagccatcttggtctgggtttccctcggacctagaaaaagcaaagaggccgggaggaaacacggccccttgccactctcctctgcagccagctccagcactcagtctttggccacccgggggaagacgcagagaaggcggcggtaaacctggtgcactccgcccgcgactgtgcgcgccagtcggcaaccgtcggggccagaagttgccagcttccgagagctgagtaggcccgaaaggccaaggtcggagacaccaggcaattcggagaaggcaggagagagaagcagagagggcctggagggcgagagggcaaagtggcgggactggaggggccgagtgggaattagtgggggcagccaggccccaggaacggagtgcggagagattctgtggtccagtgcgggccggagggcggtggaggagccgggggcgatgccgcggccggggaagagctcgtacagcgaccaaaaaccgccctactcttacatctcgctgaccgccatggcaatccagcactcggccgagaagatgctgccgctgagcgacatctacaagttcatcatggagcgcttcccctactaccgcgagcacacacagcgctggcagaacagcctgcgccacaacctctccttcaacgactgcttcatcaagattccgcggaggcccgaccagcctggcaagggtagcttctgggcgctgcaccccgactgcggggacatgttcgagaacggcagcttcctgcggcgtcgcaagcgcttcaaggtgctgcgcgccgaccatactcacttgcacgcgggaagcaccaagagcgcgccgggcgccggtccgggagggcaccttcacccccatcaccaccaccacccccaccaccaccatcatcaccacgctgccgcacaccaccaccatcaccaccacccaccccagccgccgccgccgccgcccccgccgccgccgcacatggtacactatttccatcagcaaccgcctactgctccgcagccgcctccgcacctcccgtcacagcccccgcagcaaccgccccagcagtcgcagcctcagcagccgtctcaccccggcaagatgcaggaggcggcggccgtggcggcggcggcggcggcggccgcggcagccgcggtgggcagcgtgggacgcctgtctcagttcccaccctacgggctgggctcggccgccgccgctgccgccgcggccgcggcgtccacgtcaggcttcaagcacccctttgccattgagaacattattggccgggactacaagggcgtgctgcaggctggagggctgcccttggcgtccgtcatgcaccacctgggctaccccgtgcccggccagcttggcaacgtcgtcagctccgtgtggccgcacgttggcgtcatggattcggtggccgccgccgcggccgccgcagccgcagccggagtccctgtaggcccggagtatggggccttcggggtcccggtcaagtccctgtgccactcggcaagccagagcctgcctgccatgccggtgcccatcaagcccacgcctgcgctgccgcccgtgtccgcgctgcagccggggctcactgtccccgcggcttcgcagcagcctccggcgccatccaccgtgtgctccgcggccgcggcctcgcccgttgcctctctgctggagcccacagcccctacctcggccgaaagcaagggcggctccttgcactcggtgctagtgcactcctaggggacccggcgggcgtggggagaccagcggggtgagagacgccgggcccggaaccgcccaaaccacccgacggggagagggcgccctggtcaggccgggcagagctggcgagtctcagcctttgctggaacggaaggtatttaaatagacgaacaaccccg

SEQ ID NO: 5317 - DNA, 704 bp, Homo sapiens
gcggaatgtgggcggggcgcagttggggagcttgcggggaatgtgggcggggcgcagtggtgggagggcgcaggagtgtgggcggggcgcagttgggggagggtgcagagacctgagggcttgaggttgcctggctggccccgctcccagaggcgggtgccgcgctgtcgcccaggtatctggggtctctggtgtctgagtgtctcattgtcggcgcgaacacaattgctccagccacaggcgaggcctggccaaggtgtgggcgcatctggggcaggtcttgagaggtccagcgcccggtggtgcggacagaggcggggcaccgcggcgctcgccgccgcctccccgcaggtgatcatcctcctgcaggtgtcctcgggtctcaggtggctgcgtgtctgcgccatggttgacattctgggcgagcggcacctggtgacctgtaagggcgcgacggtggaggccgaggcggcgctgcagaacaaggtggtggcactgtacttcgcggcggcccggtgcgcgccgagccgcgacttcacgccgctgctctgcgacttctatacggcgctggtggccgaggcgcggcggcccgcgcccttcgaagtggtcttcgtgtcagccgacggcagctcccaggagatgctggacttcatgcgcgagctgcatggcgcctggctggcgctgcccttccacgacccctaccg

SEQ ID NO: 5318 - DNA, 950 bp, Homo sapiens
ccgggacggagcgggccacccgagtggtaaaccttttcccaatggatgcgggaaaagcgcatttgtagttccctcctcaccgctgtcaagcgagctgattgctaaggagtgcgcatttgcttgcctctaacgtgacagtcgcgggagcgccccgcaccccgggcttcagggaatgaaggagtctgccccgaactggccccagaacccccagcccccagggcggcccgcgcccgcacccaccttgaccacgtaggtgactccgggccccagcacctggtcgctggcgtgcggcgccccccgagggggcctgggcagcggctcgtcgccgggccggcccttcctggcggcgctcatggccggggcgcggggcgccgagggcgcactgccgtccggggcggccaggctgggcgcgctgcagctgcccgagagccgcgcgcccgcccgctcccgggcggccgacgacaggccgcggaggcccgagctggagagtttcaggtgggacaccttgtggagcaggtggcccaggctgccgggcccatcgtcgggcgccttgcgcagcgcctcgccggacaccaagtagggagccgccgccggggtcgcgcgcgccgccgaaaccttgcctccgccgccgctcaccgacaggctgtggagaaggtcatcgaccgatgtcaccgagtcattcctgaagcggttatacttggtgcgtggaagcatgcccctccgtgggctcgctgcatccgcccgggcgctgctggtgccggccccggcgcgggctgccgcgcatagcaggcgagccactgtccccggagcgggacggagagtgggggccccgggacagccttctggagaacgagagcagagcaagaggatggtgccctcccaccgttaaaagccagcacagcggcggccgcgcagccccggcccgggagaccgctgcttggggttgcacg

SEQ ID NO: 5319 - DNA, 4861 bp, Homo sapiens
gcgccgccgccctgagtatcctgcggaaaatgtgagaactctggggagccattgctgctgcaaggacccgcgggcgggctaccgcgctggtgggggggctctgtccaaaccttgcgtcctcgacttcccatccgcctcataaagggttggtgaagaccatctcaaggaccgcacgaactggtccttcaagtcccaggaaaccgaaacaacaaccgaggcggctctctgtccgggccacttccggagcgagctctgcggcggacctctggctcccgctcctttgggcacccgcggtgcggccagaccgctcctgccagcgactctctggctggcaagggagaggaggtggagttcagactggcccctcacgcccagagtggaagcgattcctaggatcctgcagccaccgagccgcccgccgtgcctagcccgggcttgatggtgaagagcacagctgccttcgacagagccggaggaaaggaagtttaagaagcaactgcccgcgttccgcttatcttgccgagcccacccccacccccaccctcaccccctgcggattcagaagctgctccaccgagcccgattgtgtcataaaatattttattggaaaaaaagtcaccgtcttcgcaagagggggtaggggccccagcgacatcggggacccggcctccaggccgagccgacgggttgccccggggcaatctcaggccgttgtggcctgagcccaaccgctgggtccccgacgtccagaagcgggtgtgtgcctggaggctccccggccgggagggcaggccccagacggggtgggggtgcaggcgaggagcggggcgtgaatacgcgtggagcgctctgcgccacggagctcagggtagagactgtagcttccgccgggctggatgcgagtctcccaggttagagcccagaagcgcgctgggacctgggtctggcttttgggtctgtgtccttcctcgtttggccccaattgtccgcattcaagatcataataaaaaggcttaggaagtaaacttcttggacgcggaagggccggctcgcgggtttccgccgagtgagggggctgcgggtggcgcgggcatcccaggccccgcaccgtataccgccctcagtcctcgcggctcctgtcgctgggctcgcccggcacctccgccggtttctctgcatccttggcgcgctcctgctcagtaagctgctcgctcgttggaattgagttcttcttgggccgccccttgggcttggtgggagactccaggccgccgccctgcagcacctgcacgggggaccgccagcacctgggtgagccagcacgtggactggggacccccgaggagacttgaacccaggtaggactaaggagtgcagggtccatatgaggaaatggtggggaaatgtcccgggaaatggcggccatttgtccaaatgccgcctggggagcggcccggcctggggagcataagactgccaggaggcctgaaggtgccgcgggaaaggacgaaatgttggcttacccaaggggcagaaaaaactgagaggattccggtgcgtaccaggcaccgagggaatcggggggttgggcagagtctcagtggggagaaagaggagagcagctctgcatgcaccggggcatggcccaggaagctgaggggtgggaagccaccaggcacactcactattttcttccacttcatcctccgattctggtaccacgtcttcacctgcaactggctcaggcccagggactcagcaagatctattctggaaagagcagggcgcaccctcagcaaggcaagtgaccacactcccacagcccgctggccccagccttgtaccgccctacctgtccggcgtggaaaggtacttctgcttctcgaagcgtttctccaggcccatcagctgcagctcggtgaacacagtgcggctccgacgccccttcttggctttggtgcctggctccccagggcctgccgcctccagcttcccgcggagctgcaactcgagcggcaggtgtggcgcacccgcggcgccgggcagcccgggccctgccgccagcaacgcagagctcagccctgaacagcccagcggcgccagtgggaacttgaacaccgccgcctgctcggccttcagcacggctgcgaagaaagagaatgaggacccgggtgagctacggccgcgctcctctgccccagggactgccgcaccacgtgccgcgggggtgctcgcgcttggccagtgcctcccagcgcaaaacctccacgccctgccggtcggcgccggtggcgcagatggagaccctcctcaacgttgccgttccccagatttgggagggagtatctcctcgaccctgtccgtgttctgtcctggagttccccaggcctcagctgcctctgagatctcggggttcctgatgaacatgtttgcagctgcgagaaactcggagtgtgtcttgtctttcggggaaagtagaaaccaaaaagaaaacggcagctggtcctaagaagatggcgtttgctccaaccaaatcagccttgctgcgttagaaaaagaacatgcacggagcgtgcacatttgctcttccgtgcgtggcacaacagccatgcggtggccaggagtcatctgggccggagttgggtgcttcccggaaattccaaagtaccctgagaacctggaaattattgttcacgttttctattttcagacgcttccccatgcagatgtttccattttcttcagtcctaaaatgattgtgtgcccgcttcaaacgaattagtagcaacagagcagatggagacgaaaggtagccgaatggccgagtcccagctggacttagaaggagcgcgctggccctgccgtctccaggctagggagcaccgactaggaggtgggggggtgcagggaaggcgacttgaagggctggggtcccggctacagcgtaggagcctcccttccccgacaggcctgtcactgaggtgcgagtcctagcctggctggagtcggaaagggcagggcaaggcgcaggtaaatgtggggcagaggacccgtagggaaaaggtgggagatgggaggcaggccgaccccaatgagagaagcgagggaggccgaccggcagacggttggaaagcgagatagggaaagacaagacgagggtggagtgcgatggagacagcaccatcagggcagagcaggccccgccaaattagaagaaagggcagaagctgaaaaggtctgcgcaggccgttcaagccctgcagaggcccagccgacctgaaaccagaagggacagccaggcagctgctcacagtcaggcctctggccccaaggcaaggccgaagcaggtccgcactgcggccaaggccgcgttcctcgcccgctggagctcccggggactccgggccggcttgggcccgcgtcagcacccagccctcgggagcgcaggcctcctccccagaggtccgacttccctgggttgggcagccgcggccactcccggccatccctctgcggcgaagcccaggcgcccgtggcctgaggtcgcttccacccacgagagtccgtagcctggcagtgcgcctgcactggggatgctcactcggggtccccgggctggaggccgaagggaagcagtgaaggaaagagcgaacaccctccccgggcggcccgcgggcacgaggcctggtttctgtgaggcctggagcttgcaccctccgcctcccgcctggagggctccgagagacggtcccagaacctgcgctcccagagcagcttcccggggctgcttcgatgccggaggaggctcggggcgcccccgcggttcagctcgctgtctcccgccaagcccggcccgcgaccccgcggccgccacacgtacccaggtggctgtggaagggccgcgccgccagcagcgcctgcacgccgaacttcagcagctcgcccgccgcggcagcggcggctgcgggcgcggcgcccttgggcccgggtggctccgtgaggatctcctcaatcatgaagctgcgatagcggtgcggccggtggtccgcgcagccctcgggcgggccgaagcgcgcggcgcccggctcccccggccgctgcatcgcggcgcccactgctgcgcccgcggtttggcggcggcggcggcgacggcttggctccggcgcggggcccgcgcggggctctaggccggcccgcagctcggggcggcgcgcgggcgccggctcatgccccctcccccgccggccggccgggcggaggcgcagggcgcgggcggggcgcgcggggctcggccggtcgaacccgggactgcgccccctccccacgccgccgcgcctcttgcccggccagccccgcgtcaccgccccgccccgccccgccccgcgccgccgcccccaacccctaggctgagccggagggagggacccagaagggagggaggcggaagggaggccaaaaaggagggggccacgtgaaagaggccggccgaccgagaccgagggagactgagcggagcgcacgccctggaaggagagagccggagagttcgggaggcaagacccccagagacgagagtcggagggatcaaacgacacaggtgagagaaggggcagaggcagacggcgtgggccaaacaagattccagacagtgatgtgagggcaccagagacgccaccgagatgtgcgcagagagaccaaaagaggcgtgagagccagcgggctgtgacgtgacggagggcacagaggcaggcggggcagaggaagggggcggtaaagaaatgggaacagctagaaaaccggcggcttgatcggcttttaggtagccccggaaaggtcgggaggaggaggggcaaaggccgcg

SEQ ID NO: 5320 - DNA, 999 bp, Homo sapiens
gcgtaacggcctgtttgcgctccctgcggttacagccgacacacgctcgcagacgcacgcacggacaccccgctttccaccagcgcacgaagacgggacgcgcgctcacagccccagggctcggccctgcaccacgagctaacgcgcggtccccagggaggtggcgcagaaggcatggcgcctctgcccacggcgtcccggtcctggtagtccctatagagaccttcgttgatggcccaggtctaaaaggctttttcctccgagcctgcgttcctccagccttcccgctgggccagggctcaccatccttcctcgccggcgagcgtgggcctccctggaggcgggggtggccctgcagaggcagccccaggtgcgcgctggagaggccggcccgccgcgcgggagacactctttccaaagtggaagcgctgcgtgggcagcagcgcgggccgggccctcggatcccagtctctgttgctcccgagacccccgccccgcgccgcatcctccgagctcagcgccctcgggctgcgctgggcgcagtggctcccggtcagggcgcagtcggcctgggcgctagagcccctctcagctcccggcctagggcggggaagcgccagctcccgcagcccctgtgaaaggtcccctgtgcctcctgcctaggtgcgcgctgtggcatctctggccagaagcacctttggcggcctgttgggcccctcgcagcctctggctgagactctgccgccggcgctaacgggctgcgcccgcgctcccgctctgtccccgcccgggtcccgggctccgcgtgcacaccactccttggccttttccaccaaaacttcctgatctccagttcgatgctgtcgtcgcggttcccggaactgctgtcttcagacggcgagccggggctgggagcggccctcacggggacggactccctccggaggcggaggtggttctcctgacgcgaaaggcaggggcgcgccccggctcccagcg

SEQ ID NO: 5321 - DNA, 1750 bp, Homo sapiens
tcgcggctccagggcccggcgacctccaaggcccccgcctcaggcgctgcgggcaaacagggcctgggggccccctcccaccgcgggctgagcccccgctacctgtcctttctgtcgcgggcatccaagtcccggaacctgcgagtcaggcagcgctccacctccgcggcgtcgcccttgatggccaccctgtggatcttccgcagttcccagtccccgatgtggtacccccgacccgcgtactcttggtccatggagctcaggagcgcctggcccaggcgtctcccgaaactgaagagtttcctcatggtggcgacttctcagacgccaaccacccgctactgagccgccgcggctcctcgtggcctttccaccccgaccaagttccaaatccgcgatccccctccccaccccgctatccacccctaaatccaagatccaccaccaaaccagcaatccacccccaaacccaagatccacccccaaccccgcgatgtagctcagaatccgcgatccagcccggtccaccacagccttcagcagcgacactcgcagcctccgacctctcagaccgagtgagcttaactaagccgttactcgcgtgccagcagttgggcgctccgacctctcagaccgcgtgagcccagcaaagcggttaggcgcgcgcctgcagctcggcgctagcccggactccgggagccgctctcgagctcgcgtggacggcagagggcggctgcagctcgggcgcaggcgccgctggcttgcgggttctcctgggctcgcgcaggacatcccggaatcgcaggcgcgcatcccttcccgcctgagggcccgcctggccgtgactcccgctcctctcctcctccgaagagagatggggccgctggcaggggctctccgcagccaccggggatggggctgagggtcggttcctgccccggtgcagccgccgcgggcagaccgcctggcttggccgcagccacagcgacatctagccccggttctgcgaggctgggcgcgccagccagcttgggagttgcctggcgcctgtagctgggcgcccaggtggtggagcatggcctgggcggcctctggatcgcgagtgcccctggcctgagagcccgccagaccctgcccccacccggctcctcctctgccagagctcgagacctctagccaggggccctctgcaaccaccggggatggggctgagggccggttcccgcccctgtgcagctgctgcaggacagaccgcctggcttggccgcagccacagggacatctggccctggttctgagatgtggggagtgcgggcgggctcgagagttgcctggaggctgctgcctgcacacagaaggcggctgcagcttgggtgcccaggcgggctggaggtgcatggcctggtcggcctcgggatcgccagcgcgcccagcctgagggcccccaggtcgtgcctcccgcccactcctccacctgagggggattggggccgctggcatgggcactcggcagtcaccccgtgtggggttgagcggcgggttctcggttctgctcctgtgcagccgccgctgggcagaatgcctggcttggctgcagccactgggacacctggccctggttctgcgatgctgggagcgcgagcgggctcggaggttgccaggcagctgctgcctgcacacagagggcgactgcagcttgggcgcccaggcggcggagcatggtctgggtggcctctggaatgcgtgcgcg

SEQ ID NO: 5322 - DNA, 391 bp, Homo sapiens
gcgcaggtcgtagaactcccccgcgaaggtgccgtaggaggagtcgtggcgcggcaccgcctcgtcggcgcccgtgtccccccgcgcgcgtccccggggtccccggccccccgggcccgcaccgtcgtccgcggggctggctgcgcaggcggcgggccccgtcagtagcagcaggagcagcgacgcccagacccccgggtgctgccggggcggccgcgccatccgtgcgcacagatcccgcagccaggccgctcgggccgcagcgggggcgccgcgggcgcgggccgggactgagcctccgccgaggccaccagcacgcgcccgcgcagccgcggagcctcccgcacccccgcctccctgcctcggtctgcgcatcctcgctccagcaccg

SEQ ID NO: 5323 - DNA, 817 bp, Homo sapiens
ccgggatagagacgggcaggcagcggtgggtcgaagggcccggggactagggcccgggtcgggaggggcgggcgccttaccgcggcttgctggaaggcgcccttggtgtaggtgccgccacctcggtaggagatggcagggatctcttggaggagcagcgcgcacttgtgctggcgcgcgcggcgggtggagatgtaatcgacgcgcggcaccacgtagttcttggacgagaaggtcacgatggccacgcgcgtggccgtgggcaccacggggaagtcggacagcagcttgcggacgaacatgagctcgctgcggaagttgacttcgcccacgctggacgaatcatccaccaggaagacaagctccaggcgctcgctgagctcccgcagcagccgcacgcgtcgccggaacgcctggcccagccgctccactctgctccccgccgcttcgtcgccaggagcgggcggcgcggggatactcccgggggccccgggcgcggtctcggggaagaggcggaagctgaaattgcgcgacggggacatctgctgaaaggtcgcccagcccgaaacgagcgccagaccccagcaacaaaaggccaggcgaggccacatcgcgctggagacagagcggctgccccggagcgcaggcggcggctcgggcgggaagaggcgctgggcggccggactcgcagaggggcgtgcgcggagctgggcgcggggcagcggccaagagcctcagcgccctttcatctgacactggggacagacacaatccagactcctcagcagctcgggaactccggagggaacggcgcgcg

SEQ ID NO: 5324 - DNA, 814 bp, Homo sapiens
gcgaagaaagtcgaggcgccgaggctcccaaagctggcagctccgggtggcggtgcaggggcgaagggggggcggggggaaccgtcggacatgcggctctggagttgggtgctgcacctggggctgctgagcgccgcgctgggctgcgggctggccgagcgtccccgccgggcccggagagacccgcgggccggccgacccccgcgccccgccgccggcccggccacctgcgccacccgggcggcccgcggccgccgcgcctcgccgccgccgccgccgccgccgggcggtgcctgggaagccgtgcgcgtcccccggcggcggcagcagcgggaggcgaggggcgccaccgaggagccgagcccgccgagccgggcgctctatttcagcgggcgaggcgagcagctgcgcctccgggccgacctcgagctgccccgggacgcgttcacgctgcaagtgtggctgcgagcggaggggggccagaggtctccggcagtgatcacaggtaggtgagggcgcctcggcgggcgctgcaccgtccctgcggccccagaggctcgcgggtgtctgggcgcgggtggcgggcgggtcgggggcttgcgggcgtgtctgtgcgagagctgccccgcgagcggcgcagagacatccgggcgagctgagagcctcactttgctccatcggtggaatgggcacactcggaaggcgtagctgctccatccctgggaggaacctggggagccctcctggcggccccgcggaccctcggccagtgagggctggttcccggagcctagggcacgtaacccgtgctccg

SEQ ID NO: 5325 - DNA, 1429 bp, Homo sapiens
gcgcgcacaatgaagtagttgcctgcagcgtcaattagttggcgattctgaggttattgcgtggccctgctttggccgcctctaataacgggacagagcgccgggcaccgcgcactgatcaatcaccctccttccgcggccgcccggctccctcccctctcccccgccgggtctggcctcactttctccgggcggcttgcgcttcctccctccgcggccccggctccgtggcgccggcagccccgggagccccgggaagtttgcgcgcggcagctccgcagccggcagccgggagccccgcagccttcggggagcgccggggctggtggcccctttgttggaggaggcgtggagggagcgcttttgttctgagttagtcacggtggccggctggaggctgctacctcattatgcgccgggtctgcttgtctgcgaggaagcagatggtggggaggtaggcagcggcgagagtggccagacctgaattccgttcacctgtcacctcccacaaaaggcaggttcgggggacttaggcattcgttgccactttctgggggagggggaggtcgaggggccgccgtttccggcgcctgcgaaggttccgtacctgtcggtgcccgctccccccaccccttgcctttcccttggctgcagcttctcgcaccgcgtaaatgtcactcacgtgtcaggatgtgtgtttacagcctgttcctctgcttgtttagtctcggcggacagggctcagcggttgcgcgacgttccccgccgctgggggagattagcaaagttacccgcctctggaccccggggcctgggcccctagatcccgccccgcggcgggagatgcgtttgagccttttacagacggagcgcgtcccagcctgacgcagagggatgaatagacaagcgcaccgggcgggaatcccgactgcctgtgtatctggggtcggcccagcgttggacgtgggctgctggtccgagaggtggcgacggaatcgcgtgcctatatgtatgggggagtggaaagtcgcagggtgtgtttccacgtttcttgagcagcccgcggcaagagttgctgagtaccccaccccccgcccccagatcctaaggcagcccctcgagctttccaaacgtattgtatccagccctcccgagagtggagttgcaccaaggacaaacactctagcgtcattacaaattttttctgccccttgggcgacctccagatgaaccctggtgactctcagattggattttcattccttactttctttgaaagaaagtgccccagatgcgtcaataaaacatgcctatgtattcgtgtaggcgtccgcatgcctgcgcgccggccgtgtgcaggcgccgaagcacacgtctgtgtgaacacacgggcacgcgcgtctttgggtttagtggtccttccctcgcg

SEQ ID NO: 5326 - DNA, 7708 bp, Homo sapiens
ccgggaagagcgagaagctacacgctgggctgcagattgggccctagcgggcttggagcgtggatatgctggctggcccccctccccgggagtcacagctctcgccggtctcgccactcaggctctgccgggtacccaggaggcttgcacggccgcctgcagcccgctgtgcagagcccgggccgaaggcggagctcgatgggaaacggccggccgaaggctcttgcaactctgccacaggcctgccttcccgggcctcccaggcgggtgcctgaggccgcggctccaggccgaggggagaccgcagtgagacgagcatccccttgctgcgccttcttaggatagagggtttaattttcctttctgaagatatcgcaggaagctgttcgtatcttaaaaactccaaaccccgcgctctccctcctccctgcctcccccccacccccgccctccagcctcgcccaccagctcccaccatctcgactctcctctgctcctcttgcctctcccctccctcttgggtctcccgccttcccggagcacgcgctgccagggcctggggcgccgagcggccaatggcacggcggcaggacgtgatgtcaggcgcggctgtagaaaaggcgcggaggcttgcgctggcgcggactgcagagccggggctgggctaggcgcgcgcttggagagcattgcgcgcggctgggcccgcggccggcggctcctcctcccactctgctcctcctcttttttctcctcctccacctcctcctccgcctcctcctcctcctcttcctcctcctcttcaattctcccggtggctcgactcggctcgcaggcttcggagaaacccctactccagtcgccgactcagcgcccaagagggtcgccttgggctgggggcgcaccccagggaggggaggggtccaggcagctgggccgccgcggacacctagcggcttcagggtgaaccccgaccgcagccgtcgccgcctcgggcagagtttgcgcccttgctttgcgccccgggcgctgaagccgggcgggcgatgcccgcggcgtgaaagcgcccgcggcgggcgccgacctctgtcctagtctcctgctccccccgccccgcttgtcccgtgcccttgtgaccctggctttggcgccgtcgcccaggcgccccgcaatgtagctgcccctgcgcctcggcgggaggcgtcctgccccgcgagcgcccggggcccggagcccggcctgggggctcagccgagctcgggcggggccggggccgcggtggcgatgcaccgggcccgttagcgccaggagcgccaggcagctgaggcggggggcaagccctccctcggaggagccgcgcccccggccccgccggtcccgccgcgatgctgttccacagtctgtcgggccccgaggtgcacggggtcatcgacgagatggaccgcagggccaagagcgaggctcccgccatcagctccgccatcgaccgcggcgacaccgagacggtaggcgcgcggctgtggggtcggggctgagagctgggatggggccgggccagtcagcgcctctgctccccgaagtttggggagcgtccttcgtgccgcacgggactgggtgctggggatcctcggtcagaatgcaaggccggtggctcccggttcgggggaaacccggctgctgggacgcagaagggaaacaaggttgaaaccgaaatctcggccctgggggtagaggagagcgtttcttccgaactggaagcgaagtcccatccgcggcccggggcggctcccttctcaccttgcccggtgccggggtcgacagccccgcgctctcctccacctctcggctccggttgctggcggcgccgcgagcggcgccagggaagggcgaaccagctgggagcattggggctccagccggcttgggccgctcccagctttccggcaatcggggatcctcctcaacccccagcgcagtttcagaggccgaagtcttcggggccaacatttgtcgttgatcgcgtccccagacccttgactggtcagacttagccaggccagggctgggagttcaggctccggcctggccctcgccgaaggagactccatttggatctctacacctggctccgcgggcccagccccaaatagccagttcctcgcctcaggcctccctgggggccagacgagcagacactgcccgaccagcgggcccagaagtgacctttaggaggccgcggaggtggggagcacgggagaagcttctctgctccgggagcaggagcagcggcgccagtgtcctcccggcctctgagcgcttcttcggttagaccttctctgctggtcagtttggatagggaagtatttgggttgaacctgtccttcacccacggactttgagggtgtccctgcaccccacttacctcatccccggacccaagagggccccagcccgtgtggcagaggagccagaagttggctgacttgtcctggccttaacctctggtctaaggatccagggatcactggagctggggcccaggaactccgctgtctctccaaagaggattctgtgtggagggtgacttaatggtcaccttatcccccgggtggctcatttaagaagcagtttagggaaagctcttggagggcttgactggagtagctgtcctggtccctaaacacagcccgagcattttgggggaaaggacagggaggactggaaggaagagaggtaagcaccagagccatttaggccaggagcccggcctgggcccgtggctggcgagggctgcgcaggcaggcctgggttctgaaccgcccagaaatggaaatgggccttttggggtggggggaagcgcgccgcatgtcctggcagccccctccgcgttcagggtagccaaggccacagagggagttgtgggtgccggtttcccggcggcggaggggccgctggctgacgcaggcgctgctgtcttccgcctccctcccttcgcagaccatgccgtccatcagcagtgaccgcgccgcgctgtgcgccggctgcgggggcaagatctcggaccgctactacctgctggcggtggacaagcagtggcacatgcgctgcctcaagtgctgcgagtgcaagctcaacctggagtcggagctcacctgtttcagcaaggacggtagcatctactgcaaggaagactactacaggtagcccccccacccaactgcccctcaggacccctccccccaatctcaggcacagtcttacagtttggccctctcctttccgtttagtcccaggagagggttcactactcaggactcccccgctccccccccaagttctccaagccaccacaagttgggtgataaccttttaaagcagcaatttggggagctcttggaaaggtctacgaagtaggagaaccagaaaaaaagcagaagctgccctcctgctcggagcttagaccacaaaaaagcttgagttgggatccttgctcccctctctctttgaagtttcttgagttaatccgaggttatagaaacaggcacccccaaacctaggcagcccaagctggagtgaaacacagctggaaagagagctgtgggagtgggtgcatttccaggtcttttgagaaaatgggaatgaaaggtggccaagatcaaagaaccagaatcactagtagactccaagttctctgtttctccttctccccagttttaggattagggtctatgtatattctctctgtctctgtctctacgtctgtgtctctctctctttccctgtctctgtgtttcttccaaattataaaagtcagtaggattcccaggcgctggtttggagggaggagtaaaggttgaggagggggtaagtggtaagtgtctccctccactcccaggtaaaggctttcctagggcttgcggagactctgggtgaagtagaagtctctgtaggcataagtgtgttaagggaaactattttaggacaggaccaggcctgggtcaaaatctagttctctctcccccccatcctccaaataaaggccgggttgttcgtcttgaggaggggattgccccccgcagcagcagcggcacctggaggaggaaaaggggggtacccaaccgtgtgttcccacagcccctccctccatggtccctacaggcgcttctctgtgcagcgctgcgcccgctgccacctgggcatctcggcctcggagatggtgatgcgcgctcgggacttggtttatcacctcaactgcttcacgtgcaccacgtgtaacaagatgctgaccacgggcgaccacttcggcatgaaggacagcctggtctactgccgcttgcacttcgaggcgctgctgcagggcgagtaccccgcacacttcaaccatgccgacgtggcagcggcggccgctgcagccgcggcggccaagagcgcggggctgggcgcagcaggggccaaccctctgggtcttccctactacaatggcgtgggcactgtgcagaaggggcggccgaggaaacgtaagagcccgggccccggtgcggatctggcggcctacaacgctggtgagtgcgcggcgcacgaagcgcccccatagggttgggggaaagtgtgcggcctcgacggccgggagctggattgaatctctgtgtgctgggcaaatagcgagccttaagcaccggacggcctcgcagaagggacattagccccctgggcttccagactgtgcgtcctcggctggagcgggaggagagggtgcagtggtcccttgctgctccgggtgcagggccttgtctctgataaattgtttttttggagatggctttttggtttgggcctttgccccactttgctaggcaggaagtggcagggatggagaaagcaaggcggcgctgacgccaaacaggttttgggttggcgcggctgagggccgggaactggggcagcgaaggaacgaggcagggcggcgagggtcccaagagaaagggctggctgtggcccggggcgccgagctcggcctggagtgcggcctgacctcgtgaaatgtcccaagggcggcaggcttggggaactcgggcttggggaactcaggaaagcaaaggctgcggttccttttgctcggcccgatcctcctttaaagacaggtctcagttttcccggactttttcctccgagtttcctggcgcctgctggggtgagggccgtgaccctcggaagcgagccccccgggcggggacgagaccggagcaggcctggcctcgcgccggggtggggtggggtggggtgaggtggggggcttggttcggatttccggcatctttgaaccccaggccattcccggagaagctctgccccctcccgcgcccctccctgctcaggacagctgcagaggttctgagttccggcaaatgagccgtcaacatctgcccgaagtctgcaaggcccggaaaggtttatgactctccgggcttccgaactagagtttatgtgcaattattttctttctttcgtttgcaacagaattagatttggagattttgtgttcttcttccttttccctttagtctaatgcacaagcagaaaaaagcaaaaacaaaaacaaacccaagactgtgcagagggtgctacggcgggaagaagtcagttattttcatcttaaagaatctgagttgaatagagagggaaatgaggggcgggtgttcgctccaacgaaatcgcttggaggatcatggggcgtgtgtccctgtgtgcggaactgggaggaaaacgcagcccccagtttggtaaatggtgaagcagcggtaggccggtcggtggcgcggatttaagatttgctgaaggcactaccacagatgtagctctctggaacttccatccctcctctcctaccaccccccaaaaaaagacaaaaccgagttcagaccggctcccccaacaccaagccgcttctatttatcaagtgggtcaacttccactcggaagcacctcgcggggctcggctccagggcacctggtggctggggagctgtattgttttcctgggcacggaggttcggcgccggttttaggattgtgcaaaaagagagtagaaggtacagagatttatttctgctttttgctgttcagccgccgtttgccccagcgaggtgggctggaggctgaatttcaagccttgtttaacctctacaagagacaccctccattcagccatctcactttctctctggcctccctctctctttttttcctttccgttctctccgtcctttctctctatctctgtctctgtgtgtgtcgtgtttgttcccgtgccctcctctccgaccttggccggggctcctagtcctgagagaaacggcgttcggtgcgccggcggtggctatgcggctggctctttcggggctcccgggactaggttggggaaagagggcatctccccggcctctcggggcccagcccagtcttcctagatctggcgtccgcccttccctcccctcccgcactggcaggagagaaatggccgcagtgtgggccgcggggcagctaggactggaaagcggggaccctggagggtgcgatcgcggacggggtgtgcgggcgcgggtcgtgtgcgtgtgcgtgcagggttccgaccacggggacacgagcttgtttgtggcagtgtcccacatcctgtggcccagccacgacgaccccttgcaaagcctcttgctctggggacagtccctccgaggcgcggcggcaccttactgaagggcggcgagctgggggccgagtggggagggggcgccgtcggggcgccgggcgctgggcttacagcagagccgcgggccgcggggtcggaaagtccttccggggcggggccgcagcggcctcttcccgcagcccctcgggcccgggccccggtggaacggaaacctccccctaccccgggaggggctgccagcgggctgggggtgcgaaaacggcggcaggagcgggcgaggggcccgggccgcgcactttgcgcctgggtttgcgcgccgcggccgcgggagtcccgcgcggaccggccggacgcccggcctcccccagccccagctttttgtgtgtgtgtgcctggcggcgtaattactgatttgattccaatccattatttagacaattgaacctacaatctcgtctttagtaaaatgaggcgaagtcagatttgattacaggttcagtcccagcgacaagagctcgaaacccgatgggttaataacagatcacgagtaaattattcatgattttacgagctctttagctccattgaatcggcctaattgagaggaaaaaaaaaaaaaaggagagagaaagcccgggtcctccccctcccctcggcccctcgctcctccccggatccgatcctggggaatctcgacccgcccccgggcactgggggcgggagtgagggggttcggggcgccggccaaacctgggccccacggctgcctcccccgccgccgccccctgcccttgcctctggccggcctcggcctcgctacttagggccggctcctttccctttttctccactccccttctttccccttttctctactcccccgccaataacggcttcggaaaaggcctcccccgcagggaccgggtctcccggagccccgggattcagctcggccaccggaccctcgccacaagctgcgcctgtttccgggactcgctttcccctccg

SEQ ID NO: 5327 - DNA, 3969 bp, Homo sapiens
ccgggagtgtgggtgtcccgggggcgtgggtgtcccaggagtgtgggtgtcccgggggcgtgggtgtcccgggagtgtgggtgtcccgggggcgtgggtgtcccgggagtgtgggtgtcccggaggcgagggtgtcccgggagtgtgggtgtcccgggggagtgggtgtcccgggagtgtgggtgtcccggaggcgagggtgtcccgggagtgtgggtgtcccgggggcgtgggtgtcccgggagtgtgggtgtcccgggggagtgggtgtcccgggagtgtgggtgtcccggaggcgagggtgtcccgggagtgtgggtgtcccgggggagtgggtgtcccgggagtgtgggtgtcccggaggcgagggtgtcccgggagtgtgggtgtcccgggggcgtgggtgtcccgggagcgtgggtgtcccgggggcgtgggtgtcccgggagtgtgggtgtcccgggggcgtgggtgtcccgggagtgtgggtgtcccgggggcgtgggtgtcccgggagtgtgggtgtcccgggagtgtgggtgttccggaggcgagggtgtcccgggagtgtgcgtgtcccgggggcgtgggtgtcccgggggcgtgggtgtcccgggggcgtgggtgttccggaggcgagggtatcccagaagtgtgagtgtcccaggggcgtgggtgtcccgggggtgtgggtgtcccgggggcgtgggtgtcccgggagtgtgggtgttccggaggtgagggtgtcccgggagtgtgggtgttccggaggcgagggtgtcccgggagtgtgggtgtcccgggggcgtgggtgtcccgggagtgtgggtgttccggaggtgagggtgtcccgggagtgtgggtgttccggaggcgagggtgtcccgggagtgtgggtgtcccaggggcgtgggtgtcccgggagtgtgggtgttccggaggcgagggtgtcccgggagtgtgggtgttccggaggcgagggtgtcccgggagtgtgggtgtcccgggggcgtgggtgtcccgggggttgtgggtgtcccgggagtgtgggtgttccggaggcgagggtgtcccgggagtgtgggtgttccggaggcgagggtgtcccgggagtgtgggtgtcccgggggtgtgggtgtcccgggggtgtgggtgtcccgggagtgtgggtgtcccgggggagtgggtgtcccgggagtgtgggtgttccggaggcgagggtgtcccaggagcgtgggtgtcccggaggcgagggtgtcccgggagcgtgggtgtcccgggggcgtgggtgtcccgggagtgtgggtgtcccgggggagtgggtgtcccgggagtgtgggtgtcccggaggcgagggtgtcccaggagtgtgggtgtcccgggggcgtgggtgtcccgggagtgtgggtgttccagaggcgagggtatcccagaagtgtgagtgtcccgggggtgtgggtgtcccgggggtcgtgggtgtcccgggagtgtgggtgttccagaggcgagggtgtcccgggagtgtgggtgtcccaggggtgtgggtgtcccgggggcgtgggtgtcccgggagtgtgggtgtcccgggggagtgggtgtcccgggagtgtgggtgttccggaggcgagggtgtcccgggagtgtgggtgttccggaggcgagggtgtcccgggagcgtgggtgtcccgggggcgtgggtgtcccgggagcgtgggtgtcccaggggtgtgggtgtcccgggggcgtgggtgtcccgggagtgtgggtgtcccgggggagtggatgtcccgggagtgtgggtgttccggaggcgagggtgtcccgggagtgtgggtgttccggaggcgagggtgtcccgggagtgtgggtgtcccgggggcgtgggtgtcccgggagtgtgggtgtcccgggggcgtgggtatcccagaagtgtgagtgtcccaggggcgtgggtgtccggggggcgtgggtgtcccgggggtgtgggtgtcccgggggtcgtgggtgtcccgggagcgtgggtgtcggggactgcagggacatgggcctcccctcccactcctgccgcccagggcacctcctgtgaggactcggagtccgtgagttcccacctccttgagcccgattctttggtgtccccgcctgcatcctcagcctccttccaaaccagaccagttctctaggggcgtcgacgtgtgaaactgattttaaagaaaacaggcagtggcctttctctcggccccacgtggcccagtagcgctcaccttccgtcccttcttccgcgctcagtaaccaatttaggccgctcctgcagaactcgggctcctgcccaccggcccacagcgtccacctgaggcctcgtcctcccagcaaaggtcgtccctccggaacgcgcctcctgcggcctctccagagcccctcccgcgcgtcctctcagccccgctcgcctcctcccggggcctccctctcccgcctgcccccaggcccgtctcccctcgcgggctgaggcaggttcgggcagcacggccgccccggggcgggggtcactctccaccaccgcgtggtgcccacagctcacggcgctcccgggtgacggtcccctcggctgtagggcgtcctgaagagcggcctgctcggagctgagcgcacggggttgcctcgccctgggcgtctctggccctcaccagccccgtcttcccatgggcaaaacggcggtcctgtttgtccacaagtaaccgtcggggttacggaggggccaggagctgcggcggggggctgtgctctcaggaccggccccaggaggatccgcgcgaggtctggagctctcaggggtcgcgggggacagaggggccccaagcggaggcggggaaggcggcagaagcccaggaccgccaagagctggcgaggaagcccggggctcgctgtcgggggagccgggcaggggccgcgcctcggaccaggacggaggcctggggaaggcggatctggccgccggagacgcggtgcgggtggagacgagggatttggatttccgcgggcggctgtacggatttccacgcgcggttcacgtgggccccagggggttgcccggcacccggggccgcgccgccttctcctcgccggcatcgacccgcagcctcacgtttacgcggcggcgcccgcagcccccttcggcccggcttccgcgcgtgcccccgagcgcgccctcgggatcagcccccggaagcagagaggccaggccgggaaggatgggcgacgggggtggctgacccgggagcacggcagggaggacacccagccaggcccgcgagcagcgccgctcccctcctccaggacgggcgggaacctgcgatgcccccgccgcgtgggccgtggggcggtctccgaggcactgggcggggcacgcggtgggcgcttcacggaactcgcatttcccagtcttcgtaacccaggaggaagcccacggcgtcctgcaccggcgccggcgcgccaacgcgttcctggaggagctgcggccgggctccctggagagggagtgcaaggaggagcagtgctccttcgaggaggcccgggagatcttcaaggacgcggagaggacggtgagcccagcctcggggcgccccgcgccgcggacactgcaggcggcggtgaaccaggccgcgtggggccgcctgcgtctctttggctgcggctgtgggcggcgaacacgcagcggcgcccgcgcggcgctttctgcgggggtcgctttccgcccggggtgactccgctttcctgggcgatgccccccacccccaggcacgcgctctccccgtgcggccgcaccgcgcatgccggttttcacatcagaaaatacgatttgcaaagcacacttagggtgtcccccttaacttcccaagggagtccccccagtccccgaagggtccagggcagcctgcgcatcgcagacgcgcgcggctcgcagaagggacg

SEQ ID NO: 5328 - DNA, 2490 bp, Homo sapiens
gcgtcccttccccgcccgaggcccacccagcgccagcgcccggttctcttgcagcgactgggccctaatgtcgcacgaggggccttcgcgaaggccaatggtactatcccctcagcccctctcccacccccaccccctaccccctcaggctgtggggggtcaggggtcgaggcccgcgcggcgcgcaccttccaggcgcatccccaccgtcaggcatttctggaagcggcagaagggacagcgcttgcgctgcgtcttgtcgatcttgcagctctggctctcggtgcacgtgtagtgcttgttgttctgcaccgtgcgcttgaagaagccctgcgggagctgagagtcagcgaggccccgcagcgcccgtctgccgcacccctgccgcgcgctcgccgctcaccttgcagctctcacacgtgagcagtccgtagtggtagccggacaccttgtccccgcacacggggcacagctcgtccaggtcctcgtcgtacgaatagtccatgcccgcggcgtccgcctgcggagggacagcgggtcagggagggccggcggagaccggcagcctggggtccccgcggccgccgccccagccgctgtcgccggcccgtcgcgtaatcccctctctgtgcccaggcgctgccgccggcacccaccgagcgccccgcgcagcgtcccggggtgggtccggtgcagtccccgcgcccggccttcccctgccaggccccacgctcccgccccgtccggggggctcctcccgcgcggaccccgtcgcgcccgatctggggccctcgggttcgatgcgcttcgattgggattcgtttgtctgagaacaaaaccccgattctgagaaaaagagatgggctcagccgcggggaagacgccaggggacccaggagcgctggggcgcccggcccgggtgttctgggaacccgacagagacgaaggaggcagagacagagtccgggggagccagagatgggaagaaactctggcgagagacaacgaccgacgccaccgggcgcagacacgaggccagtccgagagtgccagagacacagacactgagacgcccagctagagagaacccggcggggacgagacacagggagggatggagagagacagggagacagagagagagagagagagagagagagacgagagagagagagagagagagaaacgaggggtgggggattggatcagagactcggagagacagcggaggcccgaagagaaaacccaagagagactgacgcagagccagagacacaacgatagacgacagacagagacgccgagacgagaggagccccggagagacgaggccggggagctacagaaacacggagagaaaacctggaggcggaagcgcccagcccgagggtcggggacaggggacgcgcggaaacctgccgggcaggagcccaagcgccaaggcgaggccccgcagggtcggacccagacgggggcccgggccgcaggaggcggaaaacgacggcgccgggaccgagagcccgaaaacgcagagccgccgggaccccctccccgggggagacaaagccgcagcagcgacggcaacgggaggcgcagcccgagccgccgctgccaccgggacgtcgggcggggagacctcgggcgggggtcggcgggctccgggaagccgagcccgaggcgagggagcgacctcgggcggagaggcgaagtccggaggagggaagcgcgaagagccagggcccgggacgcgagagggggcgcgacggcggctgcggtcggcccggcgcccacctggtcgctcctgcgagcagcgccccgcgtcccgcccgcgcggagcccgcacctctcggccgcgccgccgccgccggcgaggagccgcacccgggcgcagcgccgcccgcccgcgatgacggccgctcgggccggggacggggaggcgggggcgcggggctggcggcgcgggggcctcggctcccccctcccgcctccccgccccccatcctgcctccctgttcccccccgcaccgccgccggggccgctccgaggcgcacctgggacccgggcccctcagccgccaccccgccctgcgccaacccgccgcgccggggccgggggccggcccctctatatcggcgcgtgcggtatccgggggcggaggcccggtcgtgtcctccccccaagcccggcccgcgccggcaccctctccgcagtccagctcgagtcttcgccctcatcctccaggccccccagccgcagcccggctccccggaccccgagcgcggccagagagctgcggagcccgagtgccccgcgatctgggcaggtatagggcagtgggggccttgggtcacccgcctgcagtgggaggaggcagctcctgtctgtgaacccagctgggtcgtggcgaatgccacgcgggtggctggtcgcactacagcgtggaagtgggtaagggcgagtggcgaccgtggccgaggctcggattcacg

SEQ ID NO: 5329 - DNA, 5370 bp, Homo sapiens
ccgtgctcgagggaggcgggtagcgcagaggagagggtgcaaggccctaagaagaggagcggggggactagggcggggctcaatggagctggggcgtccgcagactggaaggagccgggacccccgctccagagcctccctttccattctcgcttcttccagtgattccgagcccccgactcagtctttcccccaggtagagagaatccgaggctgtttctgccgctgaaatctgagcgggagagcatcccgaagccgcctgcgtggagcgagcagcccccgcgtcatgggccagaggcgcccgggagaatctgcgggtcacggatcacacccgcaggggcctggcggagcaaggtgccgttcgccgcctgcgggcaggagccggctctgggcctcggcccctgctgtgccgtccagtcggccgcttcttcgcttcttcggcaagggaagcggtggagaggcgcgggagccccgattgtgctggagagatctgggacccctgcgcgtctgcgtgcgaaggacccgagaccggccaactcagctgggagcacgggacacgaggagtgaggacaaagggcaaggaacggggcctatagggagggtgtgtgtgtgtgtgtgtgtgtgtgtgtgtgtgtgtgtgtgtgtgtgtgtgtgtgtgtgtgtagggggaatgaatggacagcggggaaggcatgcagaggggcccaaggggtgtggactcagcagccccaccccagaccagagaaggcagccaggctctggcgtccaccgagccagcgcccctatctgggcgcgggccgcatggcggcagaccaccctatatccgccttggtggcgtgggatatgactggcaggagcgcggaagaggcgctgagaatgcatgcgcacccggacagaccagacgcggcacggagggggtacttcccacaagtcctcctgccttgagaccaggccttcgagtggtccggggaatgcgcctctgggcacagccagcggccccagatcggcactggacgccaacccgagttagagaagcctgggagactggatcgcaggggccctcattcagccaaggagggggaaaggagagctgtagggtaggagaggccaggcacagggaaggtggggaggggatggagccttgcgccaggagttgggggtgcagggcctgtgacgagagagtattaccatgtgcaccctgaaggagagggagagggtctgggcctggaacgaggactctcgcctgcaggcagtcgcccagccccggttgcagggatggaccgcgaccagcagagggcagaaagtgcctggtccgcccgccggccccgagccgcgctccgcgcctcgggactctggctctgtgcgccgaagccttgcccgcccggcttctccctgcagcagccgcgcccccgccccagatgcccggagaaggcggctcaggcccagcccaacttcgcgggtccaggcctggggtttccaggtcaagcaaagaggggaccgagatgtgggagagaaactccacattgactgtccactctccccgacctagccacacaaaggcgcctagaaatacacgaaggcacaaagccccccaccacacacaaacacacacacacacacacacgctaggagacacgcgagcacacagaagcattcagaaccccggagataagcacagatacgcaaagctgacagagacacccatacagaaaaggatcgcagacacaacacagaggctgagacacgcacaaagacttaggcccccgcatgaaatgatgcggacacacaccccagacacaggcacgaaggacccacacattcacatacacacgggtgcaggggactcagacacagatccacagattcacccctgggagtctggaaggttgcagggacacacataccgtgtgtgcagagccaaggagcacacggaggcaagagccgcagaggcgggggcccgacacgcacagacacacacagatacccaccgacacacacgcaggtagggtagggcgggagcctctaatcctccacaaagccgggcccctccgcggggccccgcggcgcagggggccacttctgaccaagcctcccgcaggttccaaatccgatccgccctttcgcctccagcgaggtcaggggacccgccccccatgccctccgcccccgcccggctccgcgccgctgcctcgctccgggaggggccggggccgccccgcagcggatcgcggggggtcagcccgccgctaccccgggccgcaaccgcccccctgctccccggtgagccgcgcgtcggtggggaccacgggccgcagacagccggtccgacgctgtggcctctcgcaccggacgcgggtgccaggcccggctggcgcggaagtcggcagctccatctcgccagctttcgcgtcccgttgccgaggtccactttgcccaggctggctagagcactgtccttgatccgcgcgtcccagcgacccctggccgggcacccgacccgccaaaggaccccgatcttggcagccaacctaatttcttcagagccgctaccctggggccaccactccctcctagcgcccctcactgcaaaccctaggaggcccgggtcttgcccactgctcctgcccctgcccggggaccccttttccagccttagttgtcctctaaactctcggtcgcctgaacccaggcctgaccttccttgtcgtcccagtgtcccccattctcgatcccggggccccaacctcccatcggctcagtcccccgcccaatctctgccaggcccggagctttcccagacccctcacccacactccaggctcactccccgttcctgggcctgggccccccttgcacgagtccagggccagccgtcctcgccttctgcccgcccccgtccttcgttcctgggagccggccctctccgcggaccaagcggccccgagcaggcgccgccgcccgggggactccgactcagcccccgcgacctacctcggccgacagtcgggggttcccaagcggccactcccggccggcgccgtcccctggcggagccgccgcgctccctgccgtccgcgcagtctggcctcgctcggggccactcctcgtagcgctggagctttacaaaatattaataataaagaaggcagaggagaaaaaagaaagccttcgctccccaactcccaaatcaatttttcaagggggtggagcagagggatttgtttcgaagacgatcaaaacttctgcgaggggcccgcggggcggccgggccggggagccggggcctgagctcggggccaggcgcggcgcggggcgcgggccaggggcgcggagccccggggcgcgcgggggggcgggacggcactatttgacgtggagccggcggcgcatcccggcgcagggataccggccgcggggttcaaatgtcaggaagtttcgggaggtgaggcggcccgtatccctccgccgccagccccagctctaaacccggcggctcagcgggcgcaccatggcactggagtagcgcggggagcgcgcccggagccccgcggcccgctgcgccccgcccgggaccccgctgcgccgcgcgccccccccgcggcccgcggggccgcccctgcacccccaccccctcccccgcctgccgccgccgccaccgccaccgccgccgccgcctcctccccgcggctccgtctgcagcagccgccgccgccgggttccgggactgacaagcaggtgacagaggagccggcgcgcgtggctgcaagtgtccgggagagcgcggcgcgggctgcagccgccccggcccgcccgcacgacgccggggcccggggccagcgcgtcgccgctccacgatcgccgggggccggcgcaacccctgccctgcgggggccgcgcctccccggttccagggccgcggcggcggagagcgggtggacgggccggcgggcgagcagcccggccggcggggtccgcagcgcgccccgcgtcccatggatatagcaacaggtcccgagtcgctggagaggtgcttccctcgcgggcagacggactgcgccaagatgttggacggcatcaagatggaggagcacgccctgcgccccgggcccgccactctgggggtgctgctgggtgagtgcggggtcggaacgcccgagtggtctcgggcgtgggatggggcgtcgtccggctgtggacacgggcgttggggccaacggataaaggaaatgggtttgcaggacatggggaggaggcagagacaggactcctggagtgatcgccagagggccgcaagtacgcctccggcaggcgtcctgaggggacaggacagctccagtcgccacccaccatcctttccaggcttaggttctagagctgccactccgatgtggtaggtggcgggtggcaggggtgatggaggacctagcaatcaccttggcgagcttgggagaggcgcaaggtcacctggggtgggggagattctaagagaaaaacgtctccctggtcactcaaaccacagattttggggagatcggggatagaagaccacgaacgccaccgtggggcgtgtcagccagcgagcgccccagcctcacctcgcctgtcttggtcccagccggccaccctgcgccgtgctcgttgtcatttgtcttaacacggagcgcggattctccggagaaggggagagcacagcgccgagccaaggctcgaggcccgcggcctctccacgccggagcccgaggactgggacggactagccggggccgcccggcccctggcgcggcggtccggggagcgcaggcggcaggcggtgatcccgggcggcccgagccctcggggccgagggctgtgggcccggtgcgaccgggacgccggggctgggccgggcggcgctgacggccgggctttcgccctgtgcgctacaggctccgactgcccgcatcccgccgtctgcgagggctgccagcggcccatctccgaccgcttcctgatgcgagtcaacgagtcgtcctggcacgaggagtgtttgcagtgcgcggcgtgtcagcaagccctcaccaccagctgctacttccgggatcggaaactgtactgcaaacaagactaccaacagtaagcgcttctcgtcctccttccccgccaccgcccggcactcgagcccggtcagccccctgccgggcccggcccgcgcccgctctgccgccggctctgtgcgcggctgggccgggcagctccaagggttccgagagctgcgcgtcttggggctggggcggaccagcccagcccagcgggcactgatggggtcctgggagcctccggacggcccccagttgccatccgttgtcccggaatcctgcgctgggccggccg

SEQ ID NO: 5330 - DNA, 3120 bp, Homo sapiens
gcgggagagcttccttcgacgtccggacacgcggatggggcggctttcagcggcctccacccgcgcacccctccaggcccacctctcggcggttcgtgcagcatgttctttactgggagtgggatgacaccatgcataggctcctgggctccgcagccgagccgcgggcaccagcggcggttgatgaatttcggtgtcaccaggggtttagcccggatttgggaaccgcgcgctctaatacgcgcacacggtcctgccctttctaaagcgcagccctttcacccagcagctgatttatggaggaattcgatcctgggacgcgctaggctgaagcccggagtccagggccctgcagcagctttcgggcttctcagcgtttcggggacccttggtggctcgggggctctcttgggctggggtcggggtgccccgccaggtggggccttacgcggtccagaaagagccagtgattctccttggagccactgcaggctcccgctggagggagtaagactggcggggagagctggcattttcattccttgttgagcacagccctcgcccctccccaagccctcctgccgaccccctcgggctggccaaaagcagcaagttcgggaggtttgtttattgagagaacagaaaattaggggttgcgggggagaatctaagacccttttcccgcctgagaaacgtgcgaagtccctcagctcctggaggcaaccaggcggcccgaaagccgagttcccggcgcggatgctagggccgaccccagccccctccctcctgcgccccagcccgagggcggcgagtggcaggtttttttttatcttgtttttttttttttggatttggtttgcaggggggaaatgtggttgtatcaatccacaaatatttactcttaacagacttgtatctgtggagatttcgaacaaagacagtttagggggattacaaaaaccctaaaccccgtttttctcccggacttggtgctttaaatgccaattataggcgagccatatccaacagcaacggggaaaggcgagcaggctccggggagggaggtggggggagagtccggccattaaatgtaacttttcattatgaaaaggatttcgccggttttatcttctaataagattatgtcacgaacacaagtacctaggatggtgctgagtgacagggctctgtcgtttaatcagaggctgtgccgctcaaaccgcggggccctttgtcccacggagtgaacgacggaaacttgccatcctaatccccttattcatgtcaagcacagaaaagaagccgagcaccttacaaccgtgtcccctccaccccttccgaggacggcgggaagagggggctccggccctgtagccccctgacgcttttcgtttccgagcgcgcttgggcctcaggagccggagcgttgccgtgggggcgggggaaggggtggttttgcgggtgccttaattggcagcgtctggaaaatggggacagtgaccccacgactagaggatgaatggggggagggttagtgggatgtgtttgcctcctctgaccgagagcacgggtcctgctctgtcccctcttcccaggaaaggtggcactccgggtgcacacccaccacccccattaaagcgggattgaccagaagagagaggccgaatggagatgccaggctggggccctcggcggggcagatttcgttggatccctgggactaatgtcgcagcgctcgcactcctgcaggtctccagggttggccattcccggctgcatgctcggcccctttcttccgagggtgaattcctttgttccacccccacggaaaccctcttctccgccaggcccgtggcgcctttctcgccacctccgccgccgccgccgccaccctcgtcccaccgtttgcagggctttcctgcggcgctctggccgcagagacccagccctgtctgccgactggcccttcgacgtcgccgccgtgcctgagccccgctgcctgctcggacaagcagaactccggcaggcgcagcgggcgccgaggcttgggctttagccgtggcgctcgcctcggcgcagtggggagccgcgggcgtcggagaagcggccgcgctgttccgggtcactgcaccggctgaaaaaaccaaaagcaaaaccaacacccagaaacgaagcctgcgtgcccccgggggctccgttttgctcccctcatggacatgggggtggggagctcgtggggtttcagcccaaaggctccagtcagtggaaccggagggggacttcggaggaatttgtctctgatgtcccggctccctggcctcctattagaactcgtagaggatccgctctggagtccccgtgcgccctggcagaggtcggggacgccagagtgcacgcagtctcctgcgcgccgagcccaggctccgggcgcagggaggatcgggctgagagcagggtgtcacctcgtaaaagcgacaggcaaggactgttttatggggagggagaaggagcaggaagtgatgcttccatctctgacagcatagggaccgggagctccgatggaggaaaccctttccgggcaggacgagtagagggacaggacatggccggggaccatgggattcgctgccattaagtatgggacgggcaggcgagagcggggaaggggaccgatggagccagaagccctgagctcacctcccgcccgtcctctcctggagccccctctgcaatcccggctcagtcggcaaccggcccttccttccaggtcaggggtgggggagagactttctccctcgaaacacttgataccaactttgtttttttggcaagaaaaataagccttgtttggaaaggggtgggtggggggcgtcgagcgagcgagggaaggagcaaggaggcggcggcggagcaaactctgcggattaggtttcagcgcctccgccccacccccagccccgcggcggtgatttgtgtgcgggggtctgtgaccctgcaagcatcaaacggcccgcgggaaccggccgagttcagagggacagtgggccgaagggcggcctaagacaacgcagatggttcctatcagcccggccgggcccgcagcgtccgccggtccgtccg

SEQ ID NO: 5331 - DNA, 3120 bp, Homo sapiens; identical to SEQ ID NO: 5330

SEQ ID NO: 5332 - DNA, 7861 bp, Homo sapiens
ccgctctttcggaagccgtgcctctccccctctgcttccttcatctccgagtctttgtacccctgcgtctccgactcggcctttcatctgctccctccacctcggcatcgccttgcctcagtctcccccgacccctgtctcgccccctctgcttccagaagcctgcgcctctgtctctcccaccgcccggtctcctggtgtccccggcgtctctcccgtcgttcccgccgccttgatcagcctgggctgtggcgctggcatcgctggcctggggaccggggtgtgggcgatggaagggggttcgagaggcgcaggggaggggcttcccctcctccgcccctgggcgcctggggagactcgcgtgccagtcacctgccggtcggggcgccgacttcgcgcctacgcactccacgtgggcgccccggggcgcgcctttgtctctcccgagccttgaaagctaattacattgggaggggacaggggtggggtgggagagggggccgctgtccccattcactgagccgaggccgccactccgccggcagccccgcgcaggcctggccccgagtcacgtctgttgaaaccgtttttttcggcctcgcccccacccgccttggcagccagccgcgcctttgtacgcgccggcgggggcgccctggaaccctgaaccgtcttacggggaacgggggtggggggaggggagcggcgcgggccccacgcgaggaaggaatttcctgggccactgcgaaagattgaggctcagaaagccagagagagacgtgcgaggaggaagcggagagggtgtgcgaagctggagagggagtcggagcgccagcgaaagaggggagcgctggggaaggaggaagagaaggagagggggagaagagagacgcggatgctgggcgcgcgacggcagcgggcggaggaggggagcggccgggaacctgcgcgcaggggaagccaggacggagcgcagcaccggcaggggagggttgccgaggggctgtgccgaggagcccgggtgggggcggctggaccgcgggccgcgggactcacagacagtgcgaggcggcgcgggggcccctctccctatgcggggctggggcgcaggggctgggcggggcgggtgggcgtctgagcgcggcgcgggcgcattcttcgccttttcttcctcgggctcattccggccgatcgatacctgcgcgggacctgcccccgccgctaatatctttttaatgagttcgccaggcttaaagcgagcgcgatctgccctccagggtggattttcccccggcagatgtttcgggaggaggaggcgcgcggagctcccgggaggggggacaaatctctccctccgaggggcgagaacaggagactttcttctaaagttcaaaagaaagacgggctttcactcggcccccaaaaatgtatttctcggcggacaatgggcttctttctgcgcctctgagggccggcggggcgggcagggcggggacccgtgcgctttggccccgcctgaccgactcgcacccccctcccccgcacccaggcccgggccccagagcgagggcgcaggagccgcgaagccggccgcccttccgagcgtccccctgaagcgcactgtcgggacctggctctcccggagctaagccccggcgcaccggcgagaacgaaagcgtcgtgcggggccctgggctgtcccacacgcccccgttctcataggtgcctcagccgggccgaagggacgcgcgctggtgcctcaaggggaggacgaacggacctccgggcttgggccgcggcctccttcccctcggcgctccgccctgagcggggcaacaactagaaattagccaaccccgggcggctgccgggccctgagactgtcttgcccgccccggcccagccacccctccgggtcgcccctgctcttctcctccacttccccttcaatgtccctccgtggggccgtcggcctgccgcggcggccctctctccactcccgtgggctcaggggaagagggcacccgggcggcgaggatgacctccgaagagccgcggcaaattgattcgttccgcccggagccggggccgcgtgaatgggggcccgggcggcggcggcagcggagaagaggataaagatgttctccctgaaagggggagggggcgcggagcgggaagcggggccattcactcctggcccggcccctcgggaagccgcgccgaagaaagggggccgaggcctattcaagtcctacgagccgcccacaatggaccgatatactgagggcctctctattaacgcccatgaatattaaagagatcgccaagtggcggccagcgggcgaggggggcgacggagcctgagagctccggcccggccgaggggagggggcttttgcgcgagcacattccgcgcctgggccccgcggaaaatgacaaaataacacgggtcatccgctgggaaagcccggaatgtttcccctcgaaatctcctcccggggagatgtgagcacagggtcttgctccctatttcaatgcaccttgagactgggcgctacctacgggctcctttttccccgggcgggggtccaggtgggttttgccgctagactagaagcacaaaatgtgagcgcggtggagatttgggcgcaccagctgggaggacgttctgcgctccgcttctgcccggctcccagtactgctctccgggcttgcgggtccggaggagaggaatgggactccctggccgcagtccgagcccgtggtcactgcgccagcggaatccaagcctctaactctaagccggggttcaggacccaaacgctgcaccccagcacggaggatgcacagacctgagggcttcccgcagtgggacgtggccctggagagggcaaaatcctcggggttgtcgtggggtaaagtgatcttacccaaagagagaccaagcaaagaaacctcagttcacaaagtccaactcaaaccattgcacagacagggacaccgaggcccagagaggaaaggggcagtccacaggacacacagcagtccttatccccctttggtgtcctggaggaactgaggtcgctttcggggcttgggagctgccgcagcgcttggctcctggcagcgctccccgacgtcgtctccctcgctcctagcactttgtcctctccacctaggtcttcccagaagccaagaagtaggccccggtgaggctcccctgcaggagccatcggactccatacgccccctcagactcgagctctggccagggagccgatgcgacccacaagctgcgtcgaaaaatgagtggagggttcggcgaccctaacccacctccctcctcagcagcgctgccctctgctggcgccctgcccaacggtcctgccttctgccaggtgtgcccttccttgggctccagcctcgggcggacccggacgcagggtctgaaggccagctaccgccgccttcctccctttgcgtcccaacggggacgggggatgccggagactactggcaggaactggggaccaggggtctggagtctggacgccaggtgtgagaccctcttagccaaggcgcgtccgggtggtggaggggcgtctatgccaacaggcgtttggacagggtctcgctcatgggaggtcagctcgctgttcttccacccaagtcctccgcgctgaggagaaggtctagggagtccacacagtccagcggagactaatccgtgagcctgacccacgccgagagggtccaggcacctctgttagcggcatctgaaattgtaggctggtgatgggagccagaagtgcggcaggtggggtgagctccctcacccagcatgtcagggcctggggtccgaggcttgaggctgacactggggagccgcgaagcctgcaggaagcggggccttccgctgggctcagcagctacctgcttcgggagaggggatcgctgggctccgaggtgcctcgaaaccgccgcaaagcaagtctgctcctgggatgatgggcaggaggaatagaggagaggaagggaaagaagagagaggcagaggagaaagaaagaactaggaggcaagaaggaaggggcgccgcaacgccaccggcttcccgaggttgcagctcagcaaggagccggaaagccgggccgcaagccgaacccgcactgaggcctctcgcggagctgcctgcagtttctgagggacttcgctctcaggcacgcctgctcccacctaggaagggtctcgggacccctttcaatccccctatatcccgtaggaaattcttttcccagagacaggctgccagggcgattcctgtccgcccatctcgacccccgacctggccccgcaagggccgggagcctggccttccatgaagctgtctcaggccgggaccagccccagccccgacggccgctgcggccccgcctcggcagccccgtgagcccgcggaggagtttcgcacccgaccgtgcacagcgaccgagttggcgcggcccgtatgaagcgaagcgccggcttcagcagcgcagtctgagcaggggatccgcgtggcaactagggctgcgcgcgagctcggggcgactgtggcggcccggggagtgcagggccggagagggaagaggacgcgggctctggccggggagggagagcggtgcagggctgggccggccagccggggcagcaaagtaaaggtgaacgccgggctgggccaggccggtgaacatagatcaggcctgaggggagcgcggggcccgaagccaggcgtcccctcttgtctagcctggtccctggagtcctagagagcctcgccgcaccccctccccttctccgtcccctcctctcctcagagccggctgagcctccctccctgccctgcgcttcccacggggagagaaggaaaaacaggaggggggaggaaggaccaggaaggggagagaggagtggaggggtactgtttggagcggtccgcgcgcccccgcccctcgcgctctcgcgacgaaggctcctcgagcccagccgggtacaacaagtctgtcctccgacgtcagggggtcattaataaccaattaggagggtcactgcggctcctataaaggcgctgagattttgccaaggggaagacggccccggccgagtgtgcgagaggctagcgcgcgcctgagccccttgctgccgcttccctgcaaccacccgcctctcacccaccctgcaccccccgcacccgcctccgcctccacccgcgtctctccaccctccgcgccgcctttgccatctctacagatttcaccatctctcttcccctctccccctcgttcgctttcctcccagtcgccccctcacctcccgctccctcctgcgtcctcctcctctccgtcctccccctgctctggttccttctccatcgcagcgctctcctctcgccccttgggctcccctctcgcccgcccacctcccccgtcggcccggccgtcccccggcgccggggagctccgggccgcccatgatgggctccgtgctcccggctgaggccctggtgctcaagaccgggctgaaggcgccgggactggcgctggccgaggttatcacctccgacatcctgcacagcttcctgtacggccgctggcgcaacgtgctcggggagcagctcttcgaggacaagagccaccacgccagccccaagacagccttcaccgccgaggtgctggcgcagtccttctccggcggtgagtccagccgtcggagcccggcgcaatccctcctcccggcgacccccattcccgtcctggcgatgcgcgagacgcggctgggatacccggcctcgctgctactcgcgccaacctgggctctcccggcgctcggtgcacctcagtttccccatgggccaaaccaggacgcgagccaccaagcagctccgcagcccacccggctcaaggaccgaccccggcgaccccgtcgctcggccccgacgcccccgccggcccctcccttcccctcctgcgcttgagctggcgggttcccggcatttacagccttactaggcgtgtaatagcagttgactcaaaaagaaggggttttaaattcatttagttaacttgggcttgacccacgaaagttcccacttaaaccaagaactttaaaaggcagccggggctggggagggggtggagggagggcgggcggggagaaaaagccgcggggagagcgagggagagaaagagagagcgagaaaagtttcttttctttaagatgtctcaagttcttattcctcattcatcaacccgcaaacaatatctttccctggctctggcatctctgcgcgtcgccctcttttccccctttacgatttctgttcctctcttaatttaccgtgaagactaattccacttccattcacgctatgtcaaccatctaatcccccttttttgtaaggggaattcctcggccccttttaaacaagtcccctccgcattgagctacaatttactgctacagcattcttccagggctaatgaatttagaattagcaatttctttcgaatggagccgaatgaatgcgatcactttaacagcgtgacaaattgcccgccgcgccgcaatggacaccgtttaacccccccctttcagccggcccgctcgccgggtattttcccaggtagcttagaggggaaccttgtaagacatggaggccgcccttgtgcgcctcgccgcttccagccctgccgcagatgcccgacaggggaaccctcggggagctgggggccgccgcggctcctccccgcccagagagatgacatcggggtttgtctgagcccgggcgccgccctccctggcaccccagggcctgggagcagagagggactcgggcgcgcccggggtcacacagcgagcgcagagcctggccagctgctgccggtgcttctttggcacctccaacacctgccagcccgaggtctgtccccagcgctgatcacggcccggctcctctgccagtgcccagagcctggacacacagtgggctcccggaagccgactaggcgaaagagtctccggttggccttcacctccttgcaggacctggcctcagtttccctgtgcataaaaccgctcgctgccgttggctcattaattcttaaacttatccggggcagaggatggaagaagttgcgaatgctttgagaattcgcggagagactaaaaacccacttctaaaaatgatccccaacgcaccactcgctttccagggcacggagggtctccaggttgcaaacagaggagaggtcgttgagcctccgcacatccgacttcctccacacccgggtggcttctctggatttggggccgacttgggtttggctggtctgggcaggaccgaagccggggtcccggcggggaaggaagggccgggcctcggctgcctcgggctctgaccggttttcctggccccgccgccgcagaagtgcagaagctgtccagcctggtgctgcctgcggaggtgatcatcgctcagagctccatccctggcgagggcctcggcatcttctccaagacgtggatcaaggcgggaaccgagatgggccccttcaccggccgcgtgatcgccccggagcacgtggacatctgcaagaacaacaacctcatgtgggaggtacgcgcgggctggggcagaggggcgcaagggccggcgaggggcgctggtcgcgggtaggactcgggcgtccggccgtcgccgcttccacccgggctgagagcggcggacactcctggcctggacgccccctgagccgggactctaagccgcccgagcctggagctcaccccgcctctaggctcctcccaacccgtgccgaaaatccg

SEQ ID NO: 5333 - DNA, 1434 bp, Homo sapiens
ccgggtgtgcgccctcccagggccctcactgcgcaccgcgggccacggcagaccaccccagcccccgccttgctgtgcaggtgtcaggagtgccggttggctcccttcctcccaagcaaggccttagggcaccgcggctgccctgggatcgcaggggcgcctttagctctccaccgatgccccgacgcccccctggcgctggaggccctcgcgagtctggctgcttttcggagcctgccctgcctgctgggtttcaggcgacggcccaggctggctgggaccctcgaatcaccgcggaaaagggctccagtaggcaggacggcgccgtctctctgccggcaacctttgccccaaagcggaccctctgcggggatcggagagggatgccccggcgtgaggatgggagaagccccgggacgggagggccgcgggccgtgcccccagctggagtccccgcgccgccgccgggtattttatgatctgggggtggtggtgtgtccgtctcctcatgtcaccctgatcccaactcctgggcggactggagtttgcagacctcgctgccagcagccagggggcggcggggagccgagcgagaggaaaaatccacccatttcctgggcggattgcgtcggtcccgcccggccgagccccgcctcccggccgcggcccccgcgcgcagcccgcgcagcgctcagagccggacggcgcttcccggtggcggcggaggagcccggagggacgcagccgggcaaggcagggcgcagggcgggcggcgcgaggcgcagggcgcggcgggcagaggccacctggccaccttccctggcgcccggggaaggcgcggcgatggccggggcgcgcggggcggcggcggcggcgggcgggcggcggcgggccgagggggcgcggggacacagccaggcgcccctgcccgccgcggtgcccgccgcctgaaggccgcctgggcgcgggagccggtgccagctcggagcgggcgctggaggcagctcgaggcgcgatgtcggtgccgctgctcaagatcggggtcgtgctgagcaccatggccatgatcactaactggatgtcccagacgctgccctcgctggtgggcctcaacaccaccaagctctcggcggccggcggcgggacgctggaccgcagcaccggcgtaagtgcgcccgccggccgccttggcgcggctcctcctcctcctcctcctccccctcctcggtccggagccccgggctgggcgggcgccgcgcgggacccgagtcgcccagggaggcggcggggagcagggcgggcaagggcaggcgtcgcgggccggcgcagcggtggcgaccctgctccccgctcccccagcctgggccactccatctccgcccgcgcgcccctggggcggcgtttccttcgtctgggcccctcgccgcggggccg

SEQ ID NO: 5334 - DNA, 5053 bp, Homo sapiens
ccgcgggctccctgggacccctgcgaccccgccgacgcgcgctcgtccccccccgagctccgcgatccctccgcctaccggggaaggagacctcagcgtcgctgtcctgcccctcctgaacgctgtccttgtccgacttggagccgccgcgggagcgcttcatgttgcggaaatactgcccccagcgctgccggccggcgtccttcttcagcctcttctccttggcccggcggttctggaaccaaacctgggggcggggcggggtgagcggccgcccggctctgcgggggcccccaaggccgcgggcgggagggaagcaggggcgagcgctgacctgcaccacgcgcatgtccaggcccgtctcggacgagagctgctcgcgcacgtggcgcgccggcttgggcgaggtgttgtaagcgctcttcagcgtctccagctgcttggcggtgatggtcgtgcgcggccgcttggccgtggcctcggcctctgcgcggcgggcgagcggtgaggcgcggcagcccctccggccccggccggacccccagccctcccaccccggccggcgcggggacgtcggggcctcaggtgcccacccccatcccgccccacaggcttctcggaaggcgcgggcgctgggagcgattggcaaaaacgggcagcacccgggctggggtggagggggcgccggcggagggcgggttctgccgcgggggcgggggcggcgccttccctaaaatcgcacctccacggcgcccccgccttcagccttggctcccttctccaagcaccctgatttccccgcgggctcccctttattctaagggtgtgggtatggcccagccttcgcggccaagaatttagggcgataattccgaccaggggcgaaaagccgcacacttcggaccgaacgaagcggttcgggacgcgggtctgtccgtgactccgccgttcccggcctcggcttcctgctgcctacaccgccctagcccaggcccccttagtgagcgcttggggagagaatttccccggacgcccccctgggcgtggcctcagccccatttttttcagaccaggaaaggtgggagcgtcgtcccctcggctgacctcgctgcttggcggtttcgtagtccgccttgcacacgagccggctgtcctccatgaggtagaactcgtcgcccgtggccagctgccgcttgcacacgacgcaggcaaagcagtgcaggtggtacacgaagtcctgggcgcggcgcaccacctgcgtgggcgggatgcccagctggcacgcggcgcacttggtcccgaagcgcctgcgggacgcacagggccgggctcagcgcggaagcgcgaggctcatttcgccccgagcgggttggagagaggcaagcggctgcctgggaaggcggccccggaggaaggctctgtccggccctgcagggtggtcgccagcctggccgccggggcagagctgcccactcccactgagaagggaacctcaatctcagaaagacctcggggagcccagccgccattgcctgcaggacccatgctggatctgggaaggtgaatccggagggagaggacccatctggggccagtccctcacaccccacagctggagccatgaaggccactgggccagagccgctgggtgccagcattaggaactaaaacatcaccaatttcggaggaactaagtccagtagaatcctacaaataggggtgtatcttctctaatgactgcttctgtgatttaggtaataaattgcttttttttccaaataatacttgctgatgtcccagccaggcccagccacccagggagcacccatggagaggccccacccttaatttggccaggccacagggtgccctgcctgggtgacaggagtgggctgggattgcgagagacgcaggcttcgagggcctggccttggtgattgtgaggggaggagtccctggggcaggcgtgccctccgctcccacactgaggtgaggtttcggggctcacttgaaaaagtcgtccttgcagtaaacgctctcccctcggctgaagcagcgctcggccagtggcgtgtggcagtcgctgcacttgagacacttgctgtgccagtggcggtccagagccttgaggatgaagcggtccaggatgtgctggtcacagccagcgcacagcgggatctctgtgggcacgaggaagttctgggtcacctcgtagaccaggaggcagtgaagccaccttcccaccccaacgcgagccagtctcccctccggcccacaggactcagggctgccgaggggtcctcctttccctacacaccctcttccccagccagcttaagtggccccgcaagttccgggagtgtgcaggcaccgcatcctatgtcaggagctaaggggaaactgacatcggtctaaaaatgtgtgtgagcaagaaagcagcccaggccatttcacgaggctgaatactcaattacaaaatgttgccagtgccaagaagggtgcatgtggagctcaaatgaaaaccccaccccagggggatctgctctctgaagcccggcaggaaacatagggaaacgggtcttcaccatcacctggagctggggcaccccatcgggtctccttcatgttaagcgtcatggccactctttctagggactcctcgcaaatgtggctgccctgcctggtggccctgtctgcaggcctccggggtaaatatcaatgccttccccatcattgggcagccgcaaaattacttatgagtggactggacaagccgatccactgcctttgtgtcaggcgtgggtgcccccaacaccgtcagagttactcaaacgtctggcttcccgctgcttctgccccccacaccccacttcggtactgcaggccccctggaggaaccacactggggaggtccaagggtgccctgtgggagcctcgagtctgtgagcgggttttccaggtgtcaagggctgaggactccctcttcacttagaaaaagtctctggaagagaggagtgcccgctgaagggaccgggatttactgacatattgcacccgcctccctggctgtggaccccgccggctccagcccatctcccagtgggtgagagacaccaggaaggggctccctcgacctccggcggaaaaaactgggctgcgcctccccacgcagtggcgggaaaccggcgatgaatgcgccccgcatccggcaaaaccgcagctccgggtgcggagcgtcgaggacccgctgcgcgcccggggtccccatcgtgggcagcgatcgcaggcgaggacccggctcggagcggggcggcccgacaggccgacacagcgcggattcagcaccgcggaccggacagcgcctcggccgcagctcgccgccggcgcccgcgtcgggcaaaagccgccccagcccaccccgcgccgcgcccgcgaccccagccttacgctgcatggcgactccagccctggcgggggctcctgtgtcagggatggcggggtcggcggagcctggacgccagcccgcccgctccggccagctctcccgagcgcgggcgcgcagtcctccttcctccctccctctctccgccccccagcccccgcggccaacccctcccaggaaccgtcgaaaaataaataaataagtagggaaccgcgagcccccacagcctggatgtaacccccttcccgccggccggtccctctcactccccactggctccggggcctccttccccatcctgcggctccagctggcccgggagtcgaggagaactgcccaggttccctaagaaccaaagtgctgggagctagagtggtgccaccaggaagctggggggcctggagaagagaggctttttcctacagacgggccctgagcggggataaaccgagcgggtgtctgtgggcgcagacgctgaaacctgacttcggggagaccgacggtcggagttcagctcgaccttggcccctgcatctgactctgttccgctggaacgtggaaagagtccggctggggcggccttcttggggaccctcctgtcccgtggtcactgccccgccactgctccctgcgcctcctccagcccagggagctggctccgggctgcagaggtctcctaagcccaccctggacccccgagagctccctggccggagcagcgcagtgccacaacctcactcactccctgacaacccaggccaggggccctgcaacaaatacaggctgaggcgcccaggcgcggacgttccggggtcctcgcgcccactcccgcccagatcctctagctcctgccagcctccgcggccaggcccggaaaggcctgaggatctcctggtctccccggtgcagccactcggcccgggcacccacctcggcgcaggtccgccctccgcgccagcagtgctagcagcaggtcgcctcccgccgactcccgggccgggcccagctccccgcgcgcctccatgggtcccgccgcccggcgtcgccactctccagtcccgaactttcccgggcccagcgacgccaccccgcaatagccccgaaccggcgtccaagcgactccgggtgctgctgggcgctgcgcccgcgggccgccctggggcccggagcctctggccgagcggagggcggagcggccggggggcggggccgcggggcggggcggggccgggggtcgcggagaccagcccgggccactgcggactctgagcgcctttgcgccgggacctgcggtgcccagaggccgccccgcgtgcccggcccgagggcgggcaccggtaagggagggcccaggtcagggcttcccgccagcgttcgtcccggccccgcagcttcctgcgccggagcggcccagaggcagaggcctgagctggagcacacgccaggagggctaaggttcccgggagaggggtcgagaaggcagcagggtcctcccgccgctgaggtttggcctcgggagcagcagatggtcggcgggagctcaacccgaaacgcagaaggggtgagtgtggcgccgagggctgcgtaccggaaccgcaaggtgccggaccg

SEQ ID NO: 5335 - DNA, 6343 bp, Homo sapiens
tcgccttccactgtgcgcgatcggaggggtcgctctgcagtgggcgctgtgacgggggcgcagtcactgacgtctcctggggcaacacctataaataaggcccaaatgcggcccgtccttccaactgcggacaccagagggcgcagccccaggaccacgcccccactcccctaccccacccggaaaggggtccacccgagccgaccccgccgtcactagtcgggggaggggaggccctggagcttcacgcgggagctcccgccgcgggaaccacaaccacggctaagcctttctggcccgcccgccccatcgcagggagaggacggggggacgggcaggacgggcgcctggacagctgggttcctcccgcaggtgcttctgaccccggcatggaggaagcgcccgcgttctcggcccaggcccgcagccagggctgctccgcccgctgcgccccaggtaagccgggccagcgtgggggagtagcggggcctgggctgcggagggggccgccctgacccgcgtctccccccagggcaaaagccccgcaaggcagtgtgagctggagccgccagcctggggacctcttttaagatgacccgtacggaccctccggacctgctggtgtcgaccgtgtaccaggacatcaaggtggcgaccccgggacccgcgtccaagtgctcgccatgtgagcgatccgtggcccggcctgctgagcccgcgcctttcaacaagcgccactgccgcagcttcgacttcctggaggcgctggacgggccggccatggagaccctgccggagccaccgccgccggagtccgctgtgccgcgcgcccggacccgcgaagccgagccacgccgccgcgcccgctccaagagtgcgccccgcgcgcccccgggcctgacgcccgcgcccgcctcgccgccggtgttgccccgccgagggcgggaggcccagcgtgcggcgcgggccgaggcatcgccgcgccgggagcccgcgtacccggcgctccgcgcccttgccaacgagctgcatcccatcaagttgcagccgcagcggggcggccccggccgcgtcgcgcccctgtgcgccgccgcgggccgctgcgcaccgcccgagccacccgcgggtcccgccccccacgtgcgctgccgcctggacatcaagccagacgacgcagtgctccagcacgccacccggggctcgcggtcctgcgggcccaccgaggccgcgcactgggcccgccccgccccgcagttccacggcctcacggtgcccgggccccgccacatggcgctgtcgcgcaccccgacgcccagcgactcatactgtgcggatccccgggcgttctactgcgacgggcccctgcctgggccccgggactacgccgagcgccgcagtctgcccttcaccaccccgccgggccccacccagttcttctatacagaggagccccaaggcttccggggcagctttgcagccagtcccggcccaaccttcgacgcctactaccccaggccctatccgtccgaggagctctcggggcccagtccaaggcgcatgggcggctactacgcaggagaggtgcgcaccttcccaatccaggaaccgccctcccgctcctactatggggaggctccacgagcctacggcctgccctacgggccccgctatgtccccgaggagccccgggcccactccaccgcccgccccttttacacggaggacttcggaaggtaccgcgagcgtgacgtcctggctcggacgtacccgcacccgcgcagcagcccggcctgggcggactggggcccgcgaccgtaccgcaccctgcaagtggtgccgccctctgaccccgacccgttgctcgcctcctggcacggcggcaccggcaccagtccgccccggctggccaccgacagccgccactactcgcgctcctgggacaacattctggccccggggccgcgccgagaagacccgttgggccgcggccgcagctacgagaacctgctggggcgcgaggtgcgggagccgcgaggcgtgtcccccgaaggccggcgcccgcccgtcgtcgtgaacctgtccacctctcccagacgctacgccgcactgtccctgtccgagacgtcgctgacggagaagggccgcgcgggcgagggcctgggccgcaactggtacgtgacgcccgagatcaccatcactgacaatgacctgcgcgccaccgagcgcccgagcgccagggcctgggagttgcccgggggccgcacgcggccacctccccacgcggcccccgacggccccacctctggccgccagcggagcctagagcagctggacgagctcatcacggacctggtcatcgactcgcgacccaccgccggccaggcctcagagcccgcggccgactgcctgggcccccaactgcgccgactgctggactcgcggcccgcgggctccggggcccccgcgctggcgccgccacgctcgccccccgcctcggccggcagcgccgaggagcccgcggccccgggagaggcggccgacgcgtcccccgaacccagcgccgacgaggacgacctgatgacctgctccaatgcgcgctgccggcgcaccgagaccatgttcaacgcctgcctctacttcaagtcctgccacagctgctacacctactactgctcgcgcctgtgccgccgcgaggactgggacgcccacaaggcgcgctgcgtgtacggccgcgtgggcagcgtgtgccgccacgtactgcagttttgccgcgacagcggcccggtgcaccgcgctttctcgcgcatcgcgcgtgtcggcttcctgtcgcgcggccgcggcgtgctcttcctgggcttcccaagtccaggctcggccgacaacttcctgcgctttggcctggaggggctgctgctatcccccacctacctatcgctgcgtgagctggccacacacgcggcgcccctgggcagctacgcgcgcgagctggcggccgctgggcgcctctacgaaccggcagagtgcttcctgctcagcgtgtccgtggccgtgggacccggcaccgcgccaccggggacaccggccctgcccgcgcccgcgccacgcagccacgggccaacagtgcgcaagttcgccaaggtagcgctggcggccggcagccccgcgcggccgcccccggcgcggagccgcgagcccgacatggagacgctgatcctgacgccaccgccgggcacggcgggcctggatcaggacggcgaggcgggccggcgcgcgcgcgaggtggccttcatccacatccagcgcgagctgcggctgcgcggcgtcttcctgcgccacgagttcccgcgcgtctacgagcagctttgcgagttcgtcgaggccaacaggcgcttcacgcccaccaccatctaccccacggaccggcgcaccggccgccccttcatgtgcatgatcatggccgcctccgagccgcgcgcgctcgactgggtggccagcgccaacctgctggacgacatcatgtgaggcgccgggcccaccaggcctagcccaggcgctggcccgaaccctgccctgcccactcaggccccgcccggcccacccagggccgcccccgagccccgccagggccccaccccgacttcttctaggccccgcctctaattccccagccttccaagctccgctcagttcggcctccagctccgcccaggcccccaccccccggcccttcgtccccgtagtgttcctcacaggcccttcgccttcccacccccagcaacccctctccctcctccgggcctcctccctctcccagctcgccctcgaggatccccagaagaagtcggtcctcgccctcggtgctccccgctgggaggcggggtgggcctgaggaccgccgagctctgccttcactcggaggggtcactactgcacagaccccacccgtagagatccggtccccgtcggtccgcggggctctcgctggagcctccccgactccggtttcccctcgtccagaagcccgacgtaaccaaagcccagtctgtcactttaaacacgccccgccccgcctcccgcggctgtgttgcctcctcgctggagaacaccctggtcgacctctgtgcgtccgtgtgcgcgagcgcgtcccgccgaggcggtgggcagggcggacggtgcgcagtgcgttcccgctggtcggagccagcacactaaccacgccacgcgccctgccgtcccttcgcctccagccgctgcagtctgggccctgcaggagctgggaaaaaccgcagggaggtcttcaggccgatatgcaagtctcccagccgaaggggcaggggacctgaacaggggaagcagagcacctgggcctggccagagctgacacctggctaggagaggaaggaccaagggacggggcgttcccaggtgggagcctggagggcaaagcgtggtgcgagcaggtgagggagagagctagttggtaagcgtggaagcccacccgagggggcttgacctgtcccgagaggtccccgcacacccgctctggccgcacgccgtactgcgggcgtggaggcgcaagcccggcggcccggcctccacctgtcccccaagtgcaccctggtccgcgcccagagctctctggagggtggggtatgcgggagaggggtggaggccaaacgcaagggccctcctggagtccccagccctacttcggagccaggggagggggcaccaagtgagagaaattgggcacccccgcctccgctcctgctttcgcacccggcacgcccatctcgtccccgcgcgtctgcaccggccaggcgtcccgcttgcccacccgccgccgcgccccgcgccccctaccccagggcctctgcattcggccccacccctgagggccggccgggaacgcccctggaccggaataatttccagggggcaagagctttcgaaccaagtaaaatagaacttgaatgtagcggctgccgttgcctccttgtaccggtagcggggttggggacggaagccttcggtcggtggagaggagaaagggagaggccttcgggcggtggacggggaagagagggagtccttcgggcggtggagggggtggagagcgaggccttcgggcggtggagagcggggaggggggaggccttcgggcggtgggagggggagagagggaggcctttgggcggtgggggccacggggagggtggtcttcggactacgtgcgggacaggaggtcagggctggcaagtccctcaggcctccctcgttgccccagcctcgcgggccgcctaactgccccgttccaagggtgccaccggaccccgctggagaggaacttctccgttggctggatttcatcaccacccattcccgattccacgtttcctttaagcggggctggcggagccgcaaggcggcaaggaactggattgcgattggtcagcacgtgcctcggtcggcggtacaattggctgaggcgctgggccttgggaagcattccccgacgggattggtcgtcgctctcgcagagcccgcctcccgcagtacaagcggcccccgggtcgggtgggaggaggggactccgggaggaggaacatggcggtggcggacctcgctctcattcctgatgtggacatcgactccgacggcgtcttcaagtatgtgctgatccgagtccactcggctccccgctccggggctccggctgcagagagcaaggagatcgtgcgcggctacaagtgggctgagtaccatggtgagggcgggacctgcgggcatgccaggggcacgcctggcgaggcgggggcggggctggcgggacggagacggggctgacgaggcaggggcggggctggcggggcgggggcggggctgcgggccgtagcggactgcgctctgctccgagtcctgcccctgctaggtttgacccaggctgaggtcctgggcgggaagggcgtgacacggcctgacaccctccccagcagtctcccagttcccgcgccctccccggttccaccctccttcgctcattcatccctgtcccagcctcaaggggcttcgtctctcctggggaaggggctgttcagagctgggatttcagaccccttcggctgggagttcctcccgcggcctccaagggcggccagggcacgtcctgaggccgccctcccatcccagcggacatctacgacaaagtgtcgggcgacatgcagaagcaaggctgcgactgtgagtgtctgggcggcgggcgcatctcccaccagagtcaggacaagaagattcacgtgtacggctattccatggtgagccgcagccccgtcccgccctgccg

SEQ ID NO: 5336 - DNA, 1089 bp, Homo sapiens
gcgggaaacgccgtctcccctggcgtctgagatctggggtcccctccccacctggtctcctcgctcccgccccagccccgtgcgccccaggagggcaccgccgagcgccgggtccccgcagggttcgggagactccgcggaccggaggagggataggacccccgagctttgggggcgggaagggagggtggaaggaggaggggagcggggttggggaaagttggagcttcggtatcttttctccgggccaggccgtcctcggggccctgcgctgcgtctccaagtgctgggaagactccgcggggaaaggtctgaggacgcggccggctggcacaggtgtggcggcttcagagggccggggagaacccatggcttcgaggctgtggactagaaatgtccctgattagaagctgagaacctttggccagggaggtggggcggcggggaggggtcgtcaagccggtccagagcgcgcccacctgcgccacaagggagaagaggtgccccccgcccccctccgcccaccgccgccacgatgcgccgcggacctcggcgacccagcccgggtagaagcgcgcgctcccctcctccagcctcgtgcgccggcccctgccccgccagccccgctatggtcccccatccacccccgcgggagcgcccctgtccccccatcctgcacttcccccagagtcgcgcgccagtttcccgccccgtggaagcgcccctctcccgacttcggctgatccccgctcgccgccctccccgcgggtgcgcgcccggcccctccctcgcccggggcgggtctgcgtgggcggtgctccgggtcggcgggcggagctccggttccccagccctgcgccccggtggagcccgagccggagccggcagaggggcgcgggcgcggacgcggcgcctggcggggccctgggaggctcggacggggtcctggcgttgagctcggccggcccggagcgcggacccagccgcaggggcggcgatgggcaccgagggacccccgcccccggccgcctcccgcggacgccagggctgcctgctggtacctgcgcgggtgagtgcggcccctcagcg

SEQ ID NO: 5337 - DNA, 1020 bp, Homo sapiens
gcgggcgtgaggccccgccctcgccgctctctgcccgcccccagacccgcggcccgcctggccgcctcacctggccgatggcgttggtggtgagcacaggaaggccattatagtcccaatccttgaggcaatggttgaagtccggcggggcgaagccgctgcacgaggggtcggtactggtggcgacacggctggcggcgctggctgctagggcagcgctggcgacgctgacgccgctggcattgggaggctgctcccagccagaggcattaggggggaaggccccgtagtggcaatgcagcgggggcgccagcgtgaagatggggtccgaggccatgcccagagccacgaagagcaccggcaggcagcagaggccgagctgcagctgctggccgccgcccagcgcccccacctgggcgagcagcgcctcaaagctgagggggcctgggggcacggccagcgacaggctgctgcccagtccgtcgccgcccgcgtctccctccccctcccgctcgcgctcccgctcaccctgcagctgctccgtgggcaccgcatctccgagggtcccgacctgctgttggggggcagggggtggcaggagaagggtgaagcggaggaaaccgcagagcaagggcagggggcaggtgggagggagggctaggaaggcagtcaggggcgagggatgcgcaggaggaaaatgccagacgctccgcgggggcgggggtgctgggagaggatggcgtcgccacctggggctcgggcacttactccgttggaggtgggggtgatctctacagtgttgtcgattttgccgccgcccccgccattgggctcgggggtcccggtggccacccggggagccagcttgccgaccgcaggggccctgccggcccgcgccgaaaggatgcgctgtcctctggctcagttgcgcgccggctgcccggacacagacagctcgaagagatcccgctctgcagctctgcagccgcgggcgcctccttggtctctgcgatctctgcg

SEQ ID NO: 5338 - DNA, 6343 bp, Homo sapiens; identical to SEQ ID NO: 5335

SEQ ID NO: 5339 - DNA, 1109 bp, Homo sapiens
gcgaagtcacagtcgcacagccaggggttcccgtccagacgcagggagcgcagcgcgggcagcgcggccagggcggccacgctgaggctgcgcaggttgttgtcgttgagctccagcacctgcagcgactccagggtctcgaaggcgtcctcgtgcacgcccaccaggttgttgttagccaggctaagcttcaccagcctcccggccgagcggaaggcgccggcgcccagctgggtcaagttgttgtagctgaggtcgaggaacacgagcttggccgagccgctgaacgtgccctcctccagcgagcgcagcgagttgttcctgaagtccaggtagaccaggtcgccgtagaagatgaagaagtcctcggggatccgctggatgcggttgccggccaccagcagcttgcgcacgtccagggggaaagggtctggcacgctgggcagcccgcggtcgcggcagtccacggtgtgcgggtcggtgcaggcgcagcccgcggggcacgcgtgcccgggcgcgagcagcagcagaaggctgcagagcccgagcgccgcggcggcgcaggctggggctcgggggcgcatggccggggggcccgcgccggccgcggcgagaaggaagcggctctcggagcgagccctggcgcgggacggcgcggtgaggcactggctgccgggcgcggggagccagagggcggcccgggcggggagggcgtgcgcccgggcgtgcgggggcgatggagcgcggcgcggacggactggggagccgggacagcagggatggagaggggaggggcggggagggaggggcgagggactcaccaaagggtttacccggacaggaaattaacccgctagaaaaatctcttgggagaggcgggagcggcaggggtggccgagtggccgtcgccaaaacgcggccccaccctggcagctgatttccgagatctggcagtaagacgccgcgcgcaccgggcgggctgcactcgacgtctaagttcagctaccaagcccaggagcggtttccctaaggcgtgtcccgggcgtgcgccctgccccctcgcgcccgcctggtgccaaagcacgctccctgcacgccaccctatgtcg

SEQ ID NO: 5340 - DNA, 1109 bp, Homo sapiens; identical to SEQ ID NO: 5339

SEQ ID NO: 5341 - DNA, 1384 bp, Homo sapiens
gcgggagcaccagcggcccacgccgaggaagataggcgctccctcctggggtgggcagcgcaggtctggcctgcgggtggggggtggagagtgagaggcacgcggggcaccagctcagctcccctctggggatttcgtactcgcagtttaaggaaccggtggagcacgaactccactcctgagctggcgcaagcgtctcccttccatggagatccaccccggctcccctctgaggccccctttccaagcaccctctcttccgagcacccagcacctccccaaccttagcacggctcggggcaccagttctccagggcgggggctgccccaccgctcaagggaggggacagagggccggcctcggtccaggcgacccctgcccctcgccaggggcgccaccttggccccctcccgactgccgtccgccgcctccgcccccccggggggtgtgtctccgaagtacgggggcgcgggaggccaagggtgcccccagcctccgaccgagaccccctcccgagccggcggcgaatggtaggctccatttaaagagtgcctggtggcgcgcggtgtccttcttggagcagctctcggcgcccgcccgccggggtctcggcgatcgctgctcctcctcctccttctcctcctcttttttctcctccgcctcctccccccgccgcctcgccaccgccgcggctagggctggaggcgccgctgtcattcctgtgccggaggaaccggcgctgccggtgcctgggggtcggggcgcgggcgaagccgggccgcggaggacacaacaggtagagccgggggtgcccggccgcgcgccccccgcgcatcatgcagctctttgtcacctctctcgcccccaggccaaaatcctgagcatgatggaagacaataagcagctcgcgctccgcatcgatggggcggtccagtcggccagccaggaggtgaccaacctgcgagccgaactcacggccaccaaccggagactggcggaactgagcggcggcggcggccccggcccgggcccgggagccgcggccagcgcctcggcggcgggggactcggcggcgacgaacatggagaacccccagcttggagcgcaaggtaggatcgccccggcgcccagggcggaggaaggcgagcagagcacgcccggcctcggaggtggccggggacccggggtcccccacacccggggcgaaatcgctttgcattctggcttgtaaccctttccgcccggcggtggccaccgctgctctccggctgggagttgcaggctgctgtcattcacgaaaacccgagcgcagtgtgcacggggtcacacggtcacaccggccccggccagcctgagcgaggcgcagccggcgggtcccttccg

SEQ ID NO: 5342 - DNA, 1384 bp, Homo sapiens; identical to SEQ ID NO: 5341

SEQ ID NO: 5343 - DNA, 835 bp, Homo sapiens
ccgtgaggccgtgtgtgagcccttgcgtgggccgtgagtgcggcagggagcgcggtgtccgggggccgcctgtcggtgtgtctgtgcgtgcttgtgcgctagcctttgcctctgcgagtgcgtatttttaggaccgagtctgtctatatgagcctgtgtctgtgtgtgtgcgctcccggccctgcgtgtgtctgtgagcgtctgccggggcgcgtgtgtgctcggaaccccgcggtggtgtgcgggtgtgtccgtgtgtctgtgcacgtgcaggcgagcgttcccatctgtgtgtgtgcatctgagtctgggctatgtgtgactcagggaccagtctatgagcctgcctgtgcctttgagccgatacctgtgtgtgactcagggacgagtctatgagccgatacctgtgtgtgcttgggtgtctgtgtcgtggtgtgtccctgcaagcgtttgtgcctgcaggtgctggagtgtgtagctgtgggaatgagtgcgtgtgagtgtgcggaaggggcaccgcgcgagggagcgccggtgcggaaggctaagcgagcccgcgccctccacggacggtgccgccaccccctccctccgccccgcgctatgtgcccctgtgtgcccgcgccgccggggccgtctctgggctccgggagggggctgagcgagcggccctttcctcccagggaccccgggcccgccgccagccctgggcacacccgccccttcctccagcggccccgctcgctgacccacgggcactcgatgggcactcgggaggcaatggccggagaggatgggcagttagcgggagggactgagtggcgccggcttcacg

SEQ ID NO: 5344 - DNA, 2248 bp, Homo sapiens
ccggctcccgggcggccgcccaggaggagacccacccgctgggtttctgaccgcctcctaggaaaatctcaagtacggaaaccaagcccgacaccggttccggcacctctttcacgccgctggcagcccaaggtccgccctgaagaagagctgtagaggaggaaggtggccctggctcggcggagtccggctcgcctggtgccaggcgctggtgctggcgccgagtgaacccaggcggcccaggtgtccggcctggtggcgggcgcagggcctgcggtgatggaggctccgtcttagcccggccaggcccagccctgccggtcgtcggcccgggacatgcgcggcgctcaggcctgcagggtgccttgggcggccacaacaaagttaaagaccggagtaagagtctccggcgagaagagacgcggagaagccggagccccggaaagccgcgcgcagccccgccagccgccgccagctgcggaggaattcgggctaactttaaaaaccgctggcgtccctgggccgcctgcccgggccgcactgggcggcctccatcgtcccttccctctacctgcactgccccaggcgggagagaggccttggccccgagggaccagctgcagcgggcagcggggtcctgctcccccaacccccgccccatggcacggggctgaaccggtaccaccgaggccaagggcgaccaccaggagagaagaccggctgccctcgtcatgcgaatctgtgccctgcgacctcgctgcggctgctcgagctatgccagaggtggggacgaagggcccgcggggagtgaggtgggcagaggagagaagttggcgccttccccagggtccccactctgcggagaagcccgatcgcagaactcggtcggctgcggttcatgctggcagtcaccgcgaaatgcgccctcgactcgggatcgcactggaaaccttcgccacactgtgccaggtctgacctcccaggagcgcgccaagggcccctcgcccactgcggcccggcggcctcctccccaataagtaaggcccgtgaccccgactctggaactttgtcctcacagggaggagctcctggtggtcaccgatcggctcagcagctcggagagaggttaggaaaatctctccggaacgcgttgggaggccccctcattcccgccccctcccgggcgcacggagacccccggctccagggagcgcttaccgatccggatgacgtggggcatcccgcgcgagtccgggatccagaaggcgcacacgaggagcccggcccagtattcccaaaccagactccggaggcgccgccagggagcggtcatcgttgggcgccgccgagcgtgcccggggcgcggccgtggcgggctccctggggcggcagctctaggcgcgggcgcgcagcagccccgaaggcgccgcctggcccagccgcccggctcccgagcgccgctgcaagtggggggcgccccgcggcgccgcgcacatcttactggggggccgccccgccggcgcccgccccgcctggctgccgcccacgggctgcccgcgagcgaggctcctgggctccgcccggactccgctcggactcggctccggctccgactcgcgtcggctcggctcccgcgcgggctcccacctgccccggctgccgggctctggcgggcgggctgcacgcgtctccggccgctcctcctccagccgccgccgatgctatcgcccgggctcgcacaaagccccggagtggagttgcacgcgcgcacactctccctcccagccccctcccctgcgccctgcctcccgcctcccgcgccgcccgccgcccgcgctccctccgcgcactcccccgcgcacacacacttcacactcacacttgccgaggcgcacactcgcgcgctcacacctgcgcggggggcggggaaggggaccctggccccattgtagggggacgcccggagaacgaggactctcctcgcttcccagacgtccccacccgccccgccggccccagtcccttctactgcgagggcacggagcccgggagccaggcgtggagcgcgagagctggcaccgcgagctgggagacggcggcagcccagcggccggaccagctggaggagacgcgcccgccgggagcagcgagaccgggagcccgccgtctgcggagcctggcctcgcggctcccacgcggcgggcgctggctggacggcggtggcagcgggagactgacccgggaaccg

SEQ ID NO: 5345 - DNA, 3541 bp, Homo sapiens
ccgcggggagcaggggccgcgctatgcggcggtcggtctgcagcagggcagaagccccttcccgtctgggtgtgtgggagcgcagacccctccggcgtggccgggaaccaagccggggctcggatgaaacgaaacgaaaaatgaacactcgaattttttttgttagttttttttttttttttttgcttttttttggggggagggtagggtagggaaatataaggggaaaaataaattaggctagattaaagctttggctatttcctgcttttatacacagacgcggctctcgcgacctcccctccggggccccgataaatacagtatactgcgatttaaattaagggcgcgggcggagttagaaggaccccaggagccgagaggctccacgaataaataaaaaccgtaaaaaaccaagcccggagaaaggggaaagcggggtggggcgcatccttataggagagaagaggcgtgtagcgaataaagtgacagccccccaccctggacccgcaggctcaggagtccacgcggggagaggggatggagaactctcctcgcttcgtcctctctcccggggaatccctaaccccgcactgcgttacctgtcgctttggggaggccgctgccgggatccggccccgaacagcccgggggggcaggggcgggggtcgtcgaggggatgggggcagagagcaggcggcgggcaggatgcccggggtgagttggcgagttccggatcttcgctcctctctcccggggctcgggcgacgcagcctaccgggctgtcttcgccgctcaccggagagggtcgtccgggtgtttggttttgttcgaaagtttctgggcttttttttttttttgtaaaatccaaagcaaccgaacaaaaagagtccaggccgcgcgggcgggctgcgcgcccgcgccctgcagcgcgccggcgggggcccggcccgcggggtcactgcactgagccgggcagtgtgtggtggtggtggtggtgcagcgccgccggcgggggcggtgggggcgcggagggtggcgatgcgccgcccccgccaggccctagctccccaggcgcgtatacatcgtccatgggcgggtggcccgcgccggccgcaggggtcatgcgcttctccttctgccgccggttgcagaaccagacgcgcaccacctccttctccagctgcaggctgtctgccaagccggtgatctcgtgcgccgagggcttggggcacttgagaaagtggctctcgagcgcgcctttgacccccacctcgatggacgtgcgcttcttgcgcttgcggccctgcgccgcgatcttgtccaggttggtggggctgccgctggacgagtcggtctcctccagccacttgttgagcagcggcttgagcttgcacatgttcttgaagctcagctgcagggcctcgaagcggcagatggtggtctgcgagaacacgttaccgtagagcgtgcccagcgccagccccacgtcggcctgcgtaaagcccagcttgatgcgccgctgcttgaactgcttggcgaactgctccaggtcgtccgagctgggcgcatcctcgtccgagtgctcgcccaccgatgagccgccgccgcccgcgcccgggtgcaggtgcgccgccgccgcgtgcaggccgcccgcgtgtgcatgtccgtgtgcgtgtccgtgggcgcccagatgcggcggcggcgacggctccagctgcgcctcgtggccatcctcgtgcagcgcgtggtgcaggcccggccccgcgccgccaccgcccgccgccagcatcccggccaggccgccgccgccgccccccgggtaggccgcctgcgcgtacagcccgagcggctggggctggtggcccccgctggccccgggcgagggcgacatggccgggcccaagtggtgcgctgtgctgccctgcgcccatgccgcgcccgcgtgggccgccccctggtgcaccaggcgcgcgtggaaacctccgccgccgccgccgtcgtcggctcggccggtgccgccgccgcctgccttgccgtgttctaggtgcgggccgccggcccaatcgccgccgccgcctcctcccgtgggtagccactgggggtgcgctaggcccacggggtggcccgcgcccgcgcccagccactcgtggtgcatcagcttctgcacttcgcggtacgcggcccctgcatgcaatcgctccgcggccgccgccgccgccgccgccgccgcggcgtccgggtgcataagcggcccggtgcccccggctccgccaccggggccccgcggcaggtactgcgcggtggtggccatgccgccccgcgccctgcgccgcgccgccgccgccgctccgctccgtctgcgggccccgccgcctcgctccgccggcttaaagccccgacccgctcggcgctccggagccccaccccgcccgccgcccattggctgcccgcggagctgcctcccgcctcccctgcccggcccccgccccgcgcgcccgcccgccaccctgcccggccgcccagagctctccattgggcgtcgctcccggggtcccgcgcgccggccgtgctgattggccgctggggcttcattcacggcccccctaccgtccgcgtacacactcacgccccgggggcgcggccgccacgtggggagtggcgcgggggtggccctgggaccgcaccccctctcgtcctggctgtgtgggccccgctttcccccagcgctggagactccgagcccggccggtcccacattccacgcgagctgaattcccgcccgcatcccgcccgggcagcagggattgccggctccgggaggcgctcgggctccgagaagcggctcagccccgcgcccctccctcctcagtaccgctgccggcggaccaggattcccgcgggtcctggcggctgcgagcgcgaggcggcgcggattcgcggctcggttccggcgcgactgctcaccgcgcccgcctcgcctcccgcggctgccagcgtgcactgggcgctcctcggcgcgtctgcccggcccgtctcggctttccttctccttcctctagtcccagcgtcacaactccgccgacctcctctgccctgagagcgcgtccggtgcgggcggagtcggacggactctggcttcacgcctcgcgcgggcacaccttctcccgggcactgaggcccaggtgagtaccgcgcgggcagctggggctgggacggcgggcggcagcggttctacagtcctacgcgagcccctggtacccggccgcgctccggggttccagaaggagaagatctcgaggtggagactgtggctccggggaaaacgctgctggcaagggcgctagttgggggtggacgttgggcccaggggtatctgacctgcgccgctgcagccttctcgctccttctcccagcttgaacggctcatcggctgtggtcgtggtgggatcacgccccgggagaggagaaggatgggctcagggaaggggctcgggctctccagaaatccggcgtgcaggccgggagctgtccagcctcg

SEQ ID NO: 5346 - DNA, 1513 bp, Homo sapiens
gcggggcgggccggggcgtcgctgcgggacggcatccaagggcgcgcgctgcgtgctgtccccgcggcctcccgggcgccaccggctcggccaggccccgggagctgcccgccctaggccgcgggggcgccccgggctcgcaggatccgaaaattcccttcccgggccggggcgggtgagcaggcgggcgctgggctgcgctcgacgcctctccaggccgctcaggagagcctcgagggctgggagaagccgccggggcggttgggctggacgagcgagtttaggggccaaccgtctccacccgccggccgcgctgcagagcggtgctcccagggctggggtctgcggcgaccccgctgggaggaagggagagcgagaactgagacgcttgccccaagttgcctggagccaaaggcccccgagagcgtggccgtggggctgggtcgctggagtggccgcttcggcccagacactcgcacccccggcggtgcggcggttttcacgcgcgcactcactcagcgcgcccgggggtctgaggtcgccgctacggcgcctcgccccgggcagcagcaaccagcacgcaggcacccctggaacaggcgggactgccttcccgacgcgcggcctgcgcccaggcggcggaggggcccagcccccttccagtcctcggctccagggcgcagggccacgagctcccgctcccaccctcggcccctggcacccggcgccggctccgccgccctctctcacacgcacccttggcagggccccgcggggcgccccaaagcttgggggcagctcccaggtgtctctgggaagggaaagaaaggccacaaagcaaaagaaggagcaaagagaaggcgagggaggagcaggggcccgggtcctgtggactcgcctgggctgggagtggggacactgagagggctgcgaaggctccgggggtcgcgcgtggcccgcaggctcacccctggcccgcggctgcccttccctccccttcctgggctcctggcccctctcagtgctgttcctttctcctcccctcaggccctctcctctcccgcgcagggctccgtcctggggattaagagaaaggagggaggggaaaggggaggggaagggaaggggcggaggagaaagagggacgatccttccaaaggcgggtgttgagtttcagctcaggaccctcgggtccaactgcctgtggtaccccccacaccccccacccccgtcccgccctggccctgccccagtccccggcgccttcctcctccggactccgctgcatgcctcgcttgcggtggtccgatcggctttctccgggagctttcctctccccgccacgcccccgtctccccggccgtccccgcgcctctcggcctccctttcattagccccacatctgtctttcccatgggagggagcgcgcgccttccgcccagcggggcccttagcagagcctctccaatcctcggcgcctcccctacacagggttcgctgggccgttcttgcg

SEQ ID NO: 5347 - DNA, 3541 bp, Homo sapiens; identical to SEQ ID NO: 5345

SEQ ID NO: 5348 - DNA, 558 bp, Homo sapiens
ccgagagcgcaggaccaccaagagaggccgggccacctcctccgccgtccgctgacttctaggggctgggccggcgcacagcaagggggttggaggtggggtcgccctctcccacgcggctgggtttccaggcggtgtcctgggccgagccgcttggagatcctagatcagcatgtgggtgggaaagggcgccccgtcctgggcccccccgcccctgcgcgcagagcagagacgcgcagacccgctcccactccgcttggctcccttggagcagccccggcggcggcagcgatgggctgggaggggccggcacgctggcctgcgcgggtccccagccgcctcccgccacccggaacccctctccttcaagcgttgaccgccgacccacagctccccttcaacccggggcgagcggggttcttaccatacacctcccctctccgctcggttccatccttctcccgttctcctctaggcttcacggtttgcaagcacccttgcaaataactcctagcccacccacaccgtctcgtccgcactttccgagagccaggcacg

SEQ ID NO: 5349 - DNA, 7244 bp, Homo sapiens
acgcccagccagggcgcagagagagcgctgggcgaagaggggtcgatggcccgcgggaacagggctggggttcctgtttggggaccggccggctgccaggcccctcgccctactgcttctccggagcgccgttgaccataggcccgtacaggccgccgccgtaggtcggctccttgtgcaccgccgcagcagcggcggccgagcggtcacgcatgagatcgctaaaggcgtagtccatgggtgggcggaagccgagcgtgggcaccaagccggcagtggagtagggcgccatgaaggccagaccgcggctgtgcgccgccgccgcggagtaggccaggcgcagggggctgaggccgagcggcgcgcccagcgggtaggcgcccgcgtcggcaccgaagtgactggcgttgggctgcagcggcgagaaggccgagcggctgctcagcgagcccagcgccccaggcgccatggcgccggccagcaagggtctgtggtgcggaggtgcggcgggccccgcctgcagcggcgcaggcagcccaggccccccggcggcggcggcggcggcggcggcggcgtcgacgcggctgggccacgcgtcgtctgcagctgctgcagcacccacggcggccttatctgggggcgccgcagggcccaggccggccgccaggcccccacggtggtggttcagcacctgctcgatggcctgcaccacgtcgccgccgcagccctgcaacaccagctccaggacgcctcgccggtggcctgggaacacgcgtgtcaagatatccagcggcgtccgctgccgtggacccgagcctccgcccagccctggcgccggcgcggcctcaccctcttctttgtcagcctctgaaccggattcagagcccagagggctagcggagcccgggctgtcctcctcgccgccgccgccagggccagcgctgcctgggcagctgccacctgcctctttggaggcccgagctaggggcgaaccagaaaaggactcgccatcgccgttctccgagcctgagccgggccgcacctctggggacgacgtcccgggccccgagtctgcgccgtcgggtgataagggcttcaccggcggcggcagcgggctgcccgggcggcctgcctgcagcagcgtcttaggaaacaggtcaaacttctgcaacttggcctctgggaggggagaaaacgtgtcgtgaggagcggttagctagaagacagcagtcacagcacctcggccctttggatctcagtttcctctccctcagccccacagcccttattcactaggctccagtgcccctctttctttttgctctagcattccttccgctctgagcccctacagccctgaccccagggctccctctctttctgtactcctcagaaccccaactacctgtgccctgtaaactcgatgttcagtgctgctttccccacgtctgtgccccaacacctccacccttaactgcccttccagtcctgccctgccgtggagaagtggccaggtccagggttcaaacaagagacaacataacttctgcctaaccacgctgtacagaagagcccactgtatagaaaatgcctgccctggcagtgcagcctgtaaggaaaggcgccttggttatctaggaggtcccaagcttctctacaggcagaagtacagcccctgtttctaatccaccctttccaaaattgagacctgagaagttcttccctcccaagtttagagcggatccctcctttccctcaacggctctggcctaatttcttccctccccacaaaaagccacgggggtccagaaaaagagggtggtgctaggcaggcagtaggaagcgaagaggaaaagacataggaaagcagacctgagaaaccagggagggtgcggaagaaactagaaggagggagggcgcagcaagcggttgtccagagggcgttaggaacgcgagaaggggaaaagaaactagggcgtctcagaacctagggcgtctcaaaacctagggtgtcagttaaagggggggggattccttaagggagttgggaaggagcagagggaaagggcctgtggagaagcgcagagcgaacgaagatgcgcaggtttccacctggggagaagacgaagcaaagaagcagggacctgcctgcgtttgggtagaggcgagtaaaaaaattaaagcgtgtacatttcggcccgatgcaggagaaaggggtaaagtgcaaatgctccagaagcgggagaaaggagagtttctgtacccacgctccatacccgaggctgggcgagcggtgaaccctagcagtcgcggcgactggacacgggggttctactctttctgaaccgagacaagcccctgggccccgtgccccagagctacgatcctgctgcccctacctgcggcctggccgcgctctcacctgagccccctgcgccagctgctccgcctccggtccccgcgggcgctcccgctccaggtcccccgccgtcggcggcgcacactgaaccgaagacctcgtaggcgggcctcggggggatgatgccgttggcggcggccagcgccagcccctcggcagtgccgtagagcagctgcagctcgcgcgcctcgttctcctcctgcgcctgctgcctgcgcagcgccacctgcgccgccatgacacgctggcgctccgcgatgagcgtgcacttggcgcacaggcagtccttccagcgacagtagcgtttgtggcccttgagggccgacaccacgccatggttgcgacagcgcgcgcacttgggggtccgcgggtacttctcggctgcccgcagcaacagtggcggcccccgcagcaagccgcctgccacgctcaccggtagcgatgcagcggccgccgcggctgccgccaccgacgccaccgacgccacaggcggccccgtcgctgttgccgccgccgccgtcgccgcgccgggcacgctgggcagctccgagcgcagctccatgacaggacctgacgggaaagaaggtgggagaggggagagacctggtgaggagcacaccgcgcgctaggccaaagcgccgccttgaggaacccaagctggagagggaaatttgggccgcggaggctgggctagaggggccagaattgctgggaggaggtgcagtcggaacctccttgtgagccctagcaccttcaccccagtctggccatggctgctcttagacctgatatacacgctaggggtaagattttgtctgaattagtgattccgctggaaaaaataaagagacatgtaaagtgtgaaagtcactgattcagatggctgtaatgagaatttggaaaagttaagatgataccccaaagcttagcctaattggggtgagacgggtgagagaaatgctcgtttgacgggactgggattagagcgacagttttggcccagaagttaggctgatgccaagggcaaaacaggaaaacccggagcaaaacggtcagtttggtggaagggtgaagaggagagagatgtgaaggcgcagatgtgaaggccggttgggccggagttttgtttctttttgtttgtttatttttaatgcagtttggggcagaagctttggagagaaaaatcaacaacagaaagaatagctttaggaagcagagtgaggacgaggaaacaacttgggcaaagttaggcccagtggctctgggacccgtaaaaatgtgagcgccaaaagttccacggtgagggcctccagagagtgagagacaaaatgtatgtggaatttagcttaggactgggaagtattaaagagaaaaattcggccaaagaaactttctgtataggcaaacccagcccaaagatgagcttcatgggcaaggaaaacagtgaaaagcagctgatctgggtgtccgggatccaggggccgcgcctgggagaggggaatgtgtaagaaaaaaccccacaggcaaatgctgggggaggggattgggtaaaacctgtggtgcagttttttagcttcgcagtctggagtagtagtcggggcggaagacgtatcctgcgaaaagttaggcatttcgggagggggatctttctcgaagaccacctcacactgccctcccctcccctccgggtttagggacagagtcgtcagacacgccctccccgtcttggggtcccaggggacccctctcgagcgcaggctcctgcgttctgatctcagagttggggtcctaggacacggatggcccagcaggccgcaccaagccaggggagtcgccttcgcaactggccataaacggacaccagagtccctcccacgccgcagccccataaggcccaagcaggcccagctccccgcttctgccgcggtctcctctgcttcccgcgttccccgtccctgccagagcccgcgacagagtccttgtgtctccgtccgagagtcccagacctcctctctatgagcgttgcctcctctcccagacccttcgggcgtccctaaggcccacggggcccaggcctcctcaacaggggccgcagaccaggtctccacccactgctctccctgcggccctcaactacctgccttgggctccgggatcctcctcctccgctggcgctgcacgcgcctcccggctccactggcgacgctggagctcttggccgcttccctttgcccccggccccttatctgaccacgtcaccctccttcagtcaccatgtccgaacttccggacccctcagaacgcagcgcagtccaaccctcccttcagaaatccgggtcggaggctcgtctgcgggccgcgtggttggaacccgcgacctgactctcgccgtgccgggtcccctcgcggtgcgcgccggacgctgcgcgcagccggggcccagttgcccggcgctgccagactctcaatgagccgctcgcccgctctattgttggtccttagggctccattagacagaattggacaacaatgtggcgcctgccattggccaggggaggcagacggcgctctgattggccgggcccgcgcccggggagccccgcattctgcagtgtccgaaagattcgaaactccaaaagctccactgcgtgcctctgggaggggagggggcgcgccaggaaaggagtggaaaaaagtgggcgaggaggagcgttgaaaatttcctgacaagtagtttccgtgcgcccgagagcgtgtgaattgctcctaattaccgtgtccggtgcgcctctctgcgtagacttgtgtaacctctcggcttctggggcgccggctcggctgcaccgctcttactggcctggggcgcttggcaaagccgagcttcccaagtggctctggagccctgaggcgggatggggggcaggtgacaattcaattactgcggtcggggtaggggcgggacaagggtgcgggggtggggaagggagggtgttcaaggcataaatgccaggacgatttttcctgccttcttcctgctatgtttcggcgcgctcccaaatccgacgagtttggggtagttgggggctgctttggttttttcctcctgtctccttaaagctcagttactttattttaaaagtcctgatacgatagtcatcctggagggtaagtgtggtttatgaagattttcgtgtttaaagagaagctcagcgaagagaaatgagattgcacttcctgtcggtgcccgccacgtccctcgcgccctgagcctttcctctccccgcccctcttttcgcgtccctcagccccttttgagctctcttttcctcacttttcagcatctcgatttcttttccgtggtggtgggattctttttgtcgttattgcaaatgaacaaatagcccccccccctttttttttcttttctaaacgaaagtaaaaagtggcctctgtgtctccgcagattctcttaaactcaggacgcgcatcggtctgtccgaccttcccggcaagagacaaagtcactgctgggaggccccctcggacagttttcagttttaactttcgccttattctcgtcttgtcttgatgtcacggccctgaggaacagctcgttctgcagaagaggtaacaggtttcagattttgtttcctttttgaaaggctgttgcctttcaaacatctggaattaatgccgcggccctcgggcgagtcgccctcggtttctgtagctctgattttatctctgtgtcttttcccctctaatttctaaagttctgtttttccctctaattctgtttttccctctaatttctaatgttctgtcactctcgtttttgttctctacttttctctctctccttcagaataaagaaaattcgtttaaataatgaggaaaatgagcgttcctgtcgttctccctccactcttgaccgtgcgtctctgcgttgctctttcgaacctccaggccggcgggaatctgggcgcgcagactcggcccgggtcgtcgcggcctcaggacgcagcccattccgcctggcacgactactgggccgcgtcttgtcagtctatcagcttctgagcccaggaatgggggtgggggaaggacggtgcgactaacgggcccccacccgaagaccgcagaacctggcgccccggaagagccctggaagatgcccaccgggaggctgaggctggagggaggagtgggtgggggtgattcgctggaggaccgggcggagagcttccagaaagttcaccaggccccggcgcgagggcgctccgacacggacaaggtctatgatagcgataaaaagctggttactcgctcccagaaaatgccacttgctggagtctgtgaatgggtttaggagagagaagggtgtcagcccccgcgagggtctcccgcgtgaagtgaggataagggagtgcttcagggataatatgtcctctaggagcgcaggacccagaccccaccttccaacacctggaggttccgaggccaagtatgtctagccccggctgcacctgggtaggtgagccatggggtcgggggaagagcgccgacaaccgccggattccgcgcaggggccgccaggcgcctgctcccagagctcctttggacaaagttttcgggaaattctattaaaccgaaaacgaaataaactatacaaatctgcctagcttttgagggggcggtggcccaggtatccttctcgcttgaggccaggtcaccgtgagatttccccactccggaccggggatcccgcagaagccaagggtgtagccacgaggactcgggaacccgaggcggcccagcagatgcg

SEQ ID NO: 5350 - DNA, 824 bp, Homo sapiens
acgcggactgagcgaggaaatgctcaagaccacaggactgaaccccccggaagtctcgacgctgcccagccagccagagtccagtcgtcgacgcggatgaagttgtttccccgggacaggaagggttaaatggctgcgcgtcaactcggcctcgactggggtgtcagggagcaagagccgcttgtctcgggggattccgcttggggggttcccaggggtcgccctggcgctccggccacaacttgggcggctctgtgcggcggccctcgcctgcgcctttgcgcgccacccaaaactttgcgcacactgcagccgccgccttcccgctcttcgcggtgagacgcgcgccgccaagtgccgcaggcagccctccacagccgccgcggcagccgctgcctggcttctggctccagacttttcccccactgcctccagttcccacccaggaggctccctcgcggccgcgagagctcggcgcccgacccacagtaggcagtgcgggcacagtgttgcagaccaccacctcgccaggtccgggcagcgcccactagacggacaggcgcccgcggccgcccctaccccggcgcgcccacctcgagcctctcacgccgcggcgggcgggcgcaacatattctcctacctccagccgccgaggaccacactctccgctcagccctctcgactcatcctccggctgcagtagagggcgagcgggctccgcttttgttccctggggctggcaggtccgtgtggggccagggcgcgcgggagacgccgcggagctgggtatcccggagaggggatgctcactcctagcggctccg

SEQ ID NO: 5351 - DNA, 824 bp, Homo sapiens; identical to SEQ ID NO: 5350

SEQ ID NO: 5352 - DNA, 1415 bp, Homo sapiens
ccgcgctgccagaagccgacgctagcgagggaggtgtgaagagttggccagaatgaccaactcctcctccacatccacctcctccaccaccggtggctcgctgctgctgctctgcgaggaagaggagtcgtgggcgggccggcgcatcccggtgtcactcctgtattcgggcctggccatcgggggcacgctggccaacggcatggtcatctatctcgtgtcgtccttccgaaagctgcagaccaccagcaacgccttcatcgtgaacggctgcgccgccgacctcagcgtctgcgccctctggatgccgcaggaggcggtgctcgggctcctgcccaccggctctgcggagccccccgcagactgggacggcgctgggggcagctaccgcctgctacggggtgggctgctgggcctcggactcacggtgtccctcctctcccactgcctcgtggccctgaaccgctacctgctcatcacccgggcgcccgccacctaccaggcgctgtaccagaggcgccacacggcgggcatgctggcgctgtcctgggcgctcgccctgggcctcgtgctgctgctcccgccctgggcaccgcggcccggcgccgcgccaccgcgagtccactacccggcgctgctggccgccgcggcgctgctggcgcagacagctctgctgctgcactgctacctgggcatcgtgcgccgcgtgcgtgtcagcgtcaagcgggtcagcgtgctcaacttccacctgctgcaccagttgcccggctgcgccgccgccgccgccgccttcccgggcgcccagcacgcgccgggccccggtggcgccgcgcacccggcgcaggcccagcccctgccgcccgcgctgcacccgcggcgggcacagcggcgtctcagcggcctgtcggtgctgctgctctgctgcgtcttcctgctggccacgcagccactggtgtgggtgagcctggccagcggcttctcgctgccggtgccctggggagtgcaggcggccagctggctcctgtgctgcgccctgtccgcgctcaatccgctgctctacacgtggaggaacgaggagttccgccgctccgtgcgctcagtcctgccgggcgtcggcgacgcggcggccgctgccgttgccgccacagccgtgcccgcagtgtcccaggcgcaactgggcacccgcgccgcgggccagcactggtaacctagccggggcccgagggaagcggagatccccggcttccgacgtccttgggcaccgtcgcctccttccctcctagggcatcccctgcctgaacgaagacttccgccgcgaagcccgatagatcgggggaaaatggggccttcgaccccagcgggctacctgaaccaaggcgtctctttaagtggggcgcccgaagtcattttggacg

SEQ ID NO: 5353 - DNA, 1415 bp, Homo sapiens; identical to SEQ ID NO: 5352

SEQ ID NO: 5354 - DNA, 3039 bp, Homo sapiens
ccgcgggaccagccttggctttcacatttcgctgcagccttgtcccgcgccgcactgtttcctccggccactgtggggtcactaagcgacctgcagaactcgctgaggcccaggctcctgcagctcccgccgaagactcaaagccagagtggacataaacgccgtgggcaggaccccggtgaggcctcggtgcccttcttgggggttctcagcgttggcccagaagcctcagcccgggtctaagaacttgggactctcctcgactttggcgatcggccgggtcatccggctcagggcctcagcggcagcgggcaaaactctagtaggagtctcttgccgagggcgtgtttcgacgtcagagccaaactcgggacagactagccaagcgcggacggcgcgagagtggctggcagcgccagcacgcagcctgggttcagagcaaggctgggcgctctcagcaaagggcggcctggggctgcgcgggcggcggactgcaggcgggagaagagcgaggtgcgccaggctctggggcgcgcaactgcccagcctcgtgaaagatcgcgccgcagatggggcgcagctgcgcgctcactcgtgtggactggaaacgctccgagccggttattttaaaaaccgggaaataaggcgggttccctcttcgcccgccacttcccaccaagtaggctgtgcggccctgggggctgactgtcctcaagcagccaggctccaccgcgcgccgcgctgcgccgaggtccgctctgccgcagggacgctggcagcccgttgaacaccggcaagagcgccagaggctagcggccgccaggatctctaccaggctctgctcgcacccgcctgcctccctttcgtttggcctgtcctccgttcaactgaaatcgttaattttcttacccccttgttctcattttgatatattctacgctttaaacatgctccgttttcttttgtttagtctgctccctccctctttgtcctttcccccttctctagttatccgtttcgttcgatcttgctcctgctttttttattcgttcgttcctcatttattcattttagttcatcccagctcgccgactgccatttaccctctcgttctcgccgcgctctccgttgttttgttcaatttcccttccccttttcttggttgtcgctcgctttctttggttttctttctcggtatttcgttgtcaaggccacccttgccgtcggatcccggggtgctgggtttctcccggccgctcgttccgcaccagcgctctctgcagttcgcgcggcaccggtgtggtccgggggcccgagctgtcggtgccggatgcggcgcgcctagcagggacgcgggcctgggggggtggctcctgcccgacgcggagcgctgagccaggccgggtacctgtctctggcggtgctcaccgcactgcgcggcctctgccgtctggctgggatcagaggagccaggccaactgcttctcattaagtcccaactgtggtttttatcaggaaagcctctttcaaagggcacagacacgaagctccgcggactcgttcatttcctccgttgacccacacacacctccccgccctcccctacacattcccaccgccccggctgggcgaaagccggagatgcccggccactccgtggaggcccgcgaggcgccagccgggcggcggcagggggttgaggcggatcttggaggatccagttctgggcctaggctgcgggatatggcagcgcagataaggtgggtgcagtgcggaagccgagacgccttacaggtcatagggtgcggcggacggccgcagagctgccgatcagcctgccaggcccctgccttcaggcgcattctcggatgccggcgcggtccagccggccttagcacagggcaccggcccgtgagcccgcggcgccagggggttaggctgcccagggctgctcctgactgcccagcggtgatgatccagcgcggggaagccaagactgccagaagggcggctatcatagtgcataacggcagggaggccagcttagtatgagaaataagaatacagttattccgtcttgaggacagccctggcattgcacgaccagtcgcggccagactgtgccagtctgccgcacaggcagcacccttcctgtgaaggctaggcccggggaggagagacgggccaagaccaggccgcagtccccagccgaccccgatttgaccactctaggttgaggcccagcctcagggccctcaaagggcgccagacacaaaagccgcgcttcttcgtcaggtctcagtgtggctccacagccctcggccgggtctgggcttcagggtaggtggcagttccagtccaacttcggcagagcatgctctctccttcccaggtccaactgctttcgggccccgactggactccgggccgtcgccactgcaccttccctcgacctcccgccttccattcccgccgccgaggaacggtggttcaccctcccgccccacactggcctttgcctggcccgggccagcgccaacccggcttccgtggaagccgtggcgaaaggcgagaggggcaaaaagttgagaaataggcgagcgggagagataagcaggaaggcccgggtgggcccgggtaaggaagaagaagagagggtcgggctgcgcgctacgccccgcgccgcgcgttaccttccgcggggccctcgtagaagtggccgccgttgagggccgggccgggcccgaggtcctgcaggtacttggcgggcggcttggccggctctgggaggtagggctccaggggcccgcaggccggaaagcgggtcagccgcgggccgcggggcggcgcggggtgcaggtgaggcgcagcggcgggggttccctgcgggcccggaggctcgtcccccgaggccacataggggccgggtgcaggccccacgcggaaaggcgcgcagtgctcggggtccatgccggctcagggcgcacaggcctccggggctccggggctcgcgctgcccgcgccgcctgtgagcgcccg

SEQ ID NO: 5355 - DNA, 1277 bp, Homo sapiens
ccgccccacgcccaccctctccgcctacgtcggccatcagagcctcgctcgctgcccgagagcctcgcattgacgccggcccgcgcgtgagtcaagcctgcgtcacggcgccccgccgccagggtggcctttcggaaagcgagggaacagtgcgcgcagcgctccgcccagctccgttctgctccgcagagccggcgctgccagggcgcagggagggcggcactcggccccagtcttcgcaatcccgcgcgctctctccgccgtgggacctgggtccccgcgccgctcccctgagccccgagcgcgcggcgggcgggagccaggttgggactggtggtgaggcagggagtgaggagcgagcggagtcgcgtgcgccggcgcgcagctccgggtcgccccagccccagccgggggcctgtggcccgggggaggagctgtgcgtccgcgacccgtcggggatcgcagctgctcggccggagtgcacgggccgagtctgcgcgactacccacgcgtgacaggtgagtcgctggccgcgccccgcctggctttaccgggccggccactgcaactttccctgttctggccccgccccagccagggagggctgaggaccaaggtgtgaggcggcgctgcccccgcatccgcccgaccctgcgctcgtcccgggctcctctcgccgctccagccgccgttgcctggcgacggagccccggggcccgctctccttcgcgcatcggggtccccagcggcgtacgcacgggttggacaccgggcttcagcttctggtgctcagaagggcccaagaactccggaggaaattgggcttagctgcggaggcaagcgcccgcggagaaccggagggggcctgtccggcccatccgcggcttgaaactgcgcgcccagggcgcagttccactgggagcctcttacgcagctggagaccccagccccagccgctcggcctcaggcctgtgaccttgacagtaacattggcaagcgaagcagaactgtcacgcccgagatgaatatttaattctcagtcctggggctggtcctcgctggattcggagctagcagagagcccttcctccctcgtgggaagcgcatctggggaacggaatggctgagacaggggacgtgcgtgtggtgcccatctggagggggcgccgtcctggcgggtcgagaggcctctgctgcatttatgcctgtgtgcgccgtgctctgaagcgatgctggatgctcgcagtactatgggtgggccgctccccaggggcgcg

SEQ ID NO: 5356 - DNA, 2394 bp, Homo sapiens
gcggcccggcctgggctgctccggtgcagcgcgccccgcacctggcctcgccggctcatctccggagaaactccttctgccctgtcgtggtccacagggttgacttttcggtattcgaaacgccagcagctctgggagcccagcggagagtcggagtcactctggggccagtgacgcctcccgctgacaagaatcccaaagttgcctcagcttcctcctctccttttcttcccgcgcccaaccctgacatcaccacccctccatcccccaggtatcttcctaaagccgtgtcgggactgcaacccgcccttcgatccagctggggccgggccccacttagccagtcaaggggcgagccagcgatgcgaacaccggtctggggggcacgactcccgcctacgttccccgcaggcgcgcaggggacccaaccccacacattttattctcgaactacgaggaaaaatactctattttttaaaaaaataacttgcttcctatacaaatcgctatttaaaaatatacaaataaggcccaagcataaaatctaactctggggctggcggtggagggaaggtgagggagggggctctggcacacgtccctcgtgtgtgcttgcgcgacggctgatgagggcgcgccagggaccctggcgcccaaggagatggggctgcagggaggcggacggagagcgttccaggcgttcggctccggccctgctccaatcgcagagcgcgctccaaagtcgagggtagccccaggtgccgccctgcggcctcaccagttccaggagaccagggcgggggatgctaagtgctggtaggcggggaagaggccaagcgccgagccgggaccgaaggcagggtagcccggcagagggcaggcggcggctggaggggcgccgcacttctcctgggccgcggcggttcccacctcgccaccgccgccgccgccgcacggctgcccgtcgcgaacaagcaccggcaccaccacgcgacgcagcaggccgggcgcggcgtgcagctcggcggatgctgccaggtcaggcgactccgccgcccctggagcgcgagcgcgcttcagcttgtagcgatgattctggaaccagatcttgacctgcgtgggcgtgaggcgaagcaggctcgccagctgctcgcgctcgggcgcagacaggtaccgctgctgccggaagcgccgctccaactccagcgtctgcgccttggagaatagcacccgccgcttcttccttttctcggcgtccgagcccggagacgcgggcctagcggacggccgctgcgacgagtctggcgggctggtctccaggctgctctcgtccgaggctagggacagcaaaggagacacgggtgggtgagacgccggaccctacgagggcctgctgcccttctggcgcgggcgtggaggcactggccagagggcacgcccactagcccgagactttcgggatgaggccatttcctgagtccacatctggacatccacctctccgaatgcggtgacctcattcataccacagcggtcatcagcgggcctgagatcgtgccccgaaaaaacccaccccggggccctcttaacatgtccgcaccggtagttgcgctggccgaccagtttatcacaagctgggtcaccagcgccggcctcctccaggtcgactgcactgcagtgtgccgaggtttgcggagccctgagtgggaacggggtgggggtaaactcgccaacactggccatcccagacggaggcctggagatcgtggccgtgttttcaggcatggagagggggcggggggtggggtgggggcggcaggtggcggcgcgttttaaatttcaattattccgacctctagaaatcgtcagacacagaaaccccaaatctcggagcaccagtgccaggcagggatctgctcttaggatgtgccgaccgggatgaatgcgttaggggttcgaggacagggctcccgtttccaagactgaggaaatctagactctgggctgggatttcggctttccggcccctcgtgggctgggcccttgattctgctgccccacgcctcctacctcccaccccgcaccgcaatccaccacgcacttacaagggtagtggccgcgctccgaatccagccaggcggcgcaggggtcgggctggggggcgcgtggttctggctcccgcctcggcaggtgttgcgcgtcctgctcgggtaaatctagaaggctgcgcacggtgaagctcaggcgtccagaggtggccatggccgaggaggggaaggaggcgggggcagggcaggctgggaacggaggggcggccgggacgccgctcctacggatgggcgtgggaggcgctcgccatgcgctggcagccgggatattagcgcatttacagcg

SEQ ID NO: 5357 - DNA, 1627 bp, Homo sapiens
tcgtggggccacggccacgctgccctgcgtcctgggcaccacgcctcccagctacaaggtgcgctggagcaaggtggagcctggggagctccgggaaacgctgatcctcatcaccaacggactgcacgcccgggggtatgggcccctgggagggcgcgccaggatgcggagggggcatcgactagacgcctccctggtcatcgcgggcgtgcgcctggaggacgagggccggtaccgctgcgagctcatcaacggcatcgaggacgagagcgtggcgctgaccttgagcttggagggtgaggcccttccgctcccgccccattcctgtgtagcagcgggtccgcctcgcctgggtctcccagggctccttcccagtatctcctccgcacccctggggaccccagctccctctcccaggccgcgccgcccttcctccccctccgctcccatccgctggccctccccaggatccccgccaccccctaggtgtggtgtttccgtaccaacccagccggggccggtaccagttcaattactacgaggcgaagcaggcgtgcgaggagcaggacggacgcctggccacctactcccagctctaccagggtgagcggccgaacccagcacttcccaagccccgcggagctgtctcaggggcccgagagagggcgccaggcgagctcagtctggctcctgcctatgacgcctcttatccccgacctccgccgtctcccgccagcttggaccgagggtctggactggtgtaacgcgggctggctgctcgagggctccgtgcgctaccctgtgctcaccgcacgcgccccgtgcggcggccgaggccggcccgggatccgcagctacggaccccgcgaccggatgcgcgaccgctacgacgccttctgcttcacctccgcgctggcgggtgaggcgcgggacgaaggcagggtcttggggaggggtctgaaaaatgtgggggacgaggagtggacctcagcttgagatcagggcagggtctccgggtccctccaaggcaccgcccccccatcagcccgcccgcccgcccaggctccagctcacctctccaaaccctccctgcacttttgcctcgatcccccaactcctcttacccaagctcgatccagcacctctgcggtcccgcaccccaactccgcctcctgggtgtcagccgcccctctccgcccaccctgccctcggtcggtgacccgctgtggtccccaggccaagtgttcttcgtgcccgggcggctgacgctgtctgaagcccacgcggcgtgccggcgacgcggcgccgtggtggccaaggttgggcacctctacgccgcctggaagttttcggggctagaccagtgcgacggcggctggctggctgacggcagtgtgcgcttcccaatcaccacgccgaggccgcgctgcggggggctcccggatcccggagtgcgcagtttcggcttccccaggccccaacaggcagcctatgggacctactgctacgccgagaattaggcgcccaccgtgtcccctccagcgcgcgcgaagaagcttgggagtcgtggcgggggtctctcgccacccctttccggagagcctcccctccctccagacccggagcg

SEQ ID NO: 5358 - DNA, 271 bp, Homo sapiens
ccgctcggtggctgccgcggcctcctccgcgctgctctccacgcctggcttattatgcacgaggcaggcaatttgccttcctccccggggacccatctcggagacaagaaggtagtttgttctctgtaatggcttctgctggagtgcggcggggcccaggcgcgagcgggggcacgggcggggagttggcagcgaaggatgcgcccggcgccccccggcggccgcccggagcccgaggtcggcgcgggaggagcgctgactccgcgggccg

SEQ ID NO: 5359 - DNA, 884 bp, Homo sapiens
acgccggttgtgaaacctactgaagtgagcggcggcgccaggattcctgggaccccgacctctttgcagctcgcacagctaagggcgagggcgcccttcggcagaagcagcaaaccgccggcaagcccagcgaggagggctgccggggtctgggcttgggaattggctggcacccagcggaaagggacgtgagctgagcggcgggggagaagagtgcgcaggtcagagggcggcgcgcagcggcgctccgcgaggtccccacgccgggcgatatggggtgcctgctgtttctgctgctctgggcgctcctccaggcttggggaagcgctgaaggtgggtggaacgagggcgcttgagtgcactcgcgggagggcggagagagggagctgggtagggacggggagggcaacgcctgatggggactggtgagacccgggacgcactggcgcgatctaggtagaaaactcgctgctccctggctccggggagaggcagcgcggcacagagttcgctggcatcagccgcctcctgaagctcatctcctcttgtttctttcttccttctctttatgctggctgctctcccggccacttgctacacgcctccaatcttcattctctcccagtcccgcaaaggcttttccccctccgctgcctccagatctcgtccttcgccaatagcagctggacgcgcaccgacggcttggcgtggctgggggagctgcagacgcacagctggagcaacgactcggacaccgtccgctctctgaagccttggtcccagggcacgttcagcgaccagcagtgggagacgctgcagcatatatttcgggtttatcgaagcagcttcaccagggacgtgaaggaattcgccaaaatgctacg

SEQ ID NO: 5360 - DNA, 1007 bp, Homo sapiens
gcgacggtgtccgtgcgtttcttcactagtgcatgtgcgaggagggctggaggcatgagcgaaagagggaaggcaatctcggtctccaaaaaatccaggggactctccctttcagcacaagcgctcacacgtgcgctcgcgcggacacacacacacacactcacactcacacacaaataaatccccagcacctgcctcggaaagccctctctcgcaggctggcccgaaggcgcggctccgccagcggagagcctttggatttaccgtggcattacttttaattaactctgcggcgcggcgcggggagcgcagggtgggccctaatcccgggcccgcctgacgtcacctgggaacgcgcggcggcgcggggcggcgcggacccgggacgacctcgccgcgacctggcctcgcctccgcccgcgcggggctttgctccgcgggaattaaaggaaggagaaatgttagtacacttttaattggaaaccgagttcttctttcagagcggcttgtttactcaggattgggcattagaactcaggggaggctctaattgaagtgacggctttggagattatggggaacatatggccctaccgccgggctctttatctgcattttctcataaaactgccgtccgtgtgtgtttctgcgcctggcctcttgcatttctaaggggcctttgaagacagggccgaatgcgcgcgggggcttcaggcactttgcgctccacggcgggtcccgcagcccggcccgagccggccctggaagcttcgccctggactagactggcaccgacgccgcccccagcctgagcgctgagagggaaaacgagagctagaaaggaaagaaatcggactggtgactgcctggcaggggtgtaattcaaactgttgtgagcagacggcaggagggagttgccaaggtaacgggtgattcccacccgccgccctttcgctaaggctggggagagggaagcctccgcgtgctgggttagggccaagcccgcg

SEQ ID NO: 5361 - DNA, 2191 bp, Homo sapiens
ccggacgcgaccgcccgtagcctgcggcccctggcggttgaggagccgcggcgatccttggtcttcaccgcagcagccaagcccggcgcgcaccaaccggcgctgctgaaagttggagagctcccagctcgccgatagaattcggcggtgggcgccaggggaatcccttccagtgccgcaattaggaaagttttaaaaagtaaggaccctagacagacaagagatccatcctttcctttagcataagaaacaccccgcgccgcgccagccgaacgctgctcgcacaaggctatccgcccttcttggccgggacgcactcggtgccttccagctccccaccagaactggtccagggggcgcggaaacagagaggcaactgtgtccggcttgtggttccagacggaaacgcctccgggctccctggcccgggggacaagggttcgaaacttcaacagtcgcgagggcaaggacagaactaccaactcccgctcggatgcccgggacctgctcttccaagcccgctccggtttctccaaaggacgcgcggcacagcccatgcgcccccggcactccactccactcctctatggtttcccccaaactcttcccggggagccccacaaagcacagacggcgccctgaaactcgccaggcactcgccagccatccccacctccgcctctcgaaccctccttgtcgcgttcttcccgccccgcacctttctcctcgcgtttctgggaagtcagaagcaaaccacgagaaaatgccttcgcaaggagcctccctacacccgccctgtcactgaaacaaaagcgtagggaggagggaggtgggagaggaggcgggaggaaggtttagaaagacgatggggacagcagtaggaaggagctggggaggggggtcaaggtggcaagcagagctgggggcccagagtccgctcccgtgccgcgcggcgagtcgcttacatgcccaggtcgctgtaggtgttgaagaactccatctgattgcacgcctgaatccagcccaccacccaggtctcgtggcgggggatggggggcatgaccacgcgggcggaggctttgaagtagggggtcttgtagcgcaggacgatgggcgaggtctcctcgatgcgcgtggggcactggtcgatggtggcgcacacatcgtacaccacgatgttctcgcgccggatccgcgccttgcaggtgatgctttggatacagcccatcctgcagcccggtgccggcacggcgcggcgtggggcagcgcgggggcccgcgcgggcagccgggggcgcccgtcacgccggcatggcgacgcgccgctcgctcccggtcagactcagctcgcacctaggagcggggagccgccgggcatccttggggaagccccctcctcttgcagccgcgcggggtccccgctgccccgacgtccgcccacgcccgccccctcgctccggcagggcgcgcggagggtgcactcctaggaggcggcgggtgccctcgccggctccagcgcccgggcggagggcagggaggggagcggcgctgcgaggaatggtgcccaccccgggccggagccccccgcccctcgccggagaggaggaggcggcagcggcggcggcatggagccgggggagggcggcggtggcagcgcccggtctgtctgcctccgcggcggcagcagcagcagccgccgccgccgccgccgctgcatgaacctctgcaccacggctgccccccgcgtgcagcgcacccagcggcgggcgagcgggcggcccaagaggcaggcggaggcagcagcggcggcggcggcgaccggagctcccgccggccccgccccgtagccggaccacaccgacactcctcggcccggctgcctcggcccggggggcgccaggaggctgtggcccggggtggagagccccaacggctggagcagcacaggacgtgctccgcggaggaaactggctgtacgccatgagttttgtccctattcggctgccgtccgggtggggggggggtaatgtgtaagggtgggggtgtttaaagggccgctagcgccggggtggggccccgcacgtggggctgaggcggggcggggccctggtaggtggtgccctggggtgggggtgggggactagggcgggcccaagcgccaccgggtgggtgaggccgagcagggcgcggcg

SEQ ID NO: 5362 - DNA, 859 bp, Homo sapiens
acgcagaggccgtggcatctggccgcagctgggctgcagtgcgtgcgcgcctggcctggtggtccgatgggaagcccggggcggggcagccgcggggcgggggcggggcgtcgcggagataggccacgcccctgcccgcccgcgcaggcgcgctgcgggtcgttagctgtcagagccaagcggcgggctggcggcgggctccgacgtctgcgccaggacctggctggctgagcccggcgcagcagcagcagccagggcagcgcggcccctactccctgtcaggtcgtagaggcgagcagggaccagctggtcgccggcccctcgggcaagatggggaaccgggagatggaggagctgatcccgctggtgaaccgtctgcaggacgcgttttcggcgctgggacagagctgcctgctggagctgccgcagatcgccgtggtgggcggccagagcgccggcaagagctcggtgctcgagaacttcgtgggcaggtaagcgcgcagggcgcggagtaaggatgcggcagtggggcgaccccgctgcgggccgttggaacgtggacgggcagcgggagccagagggtggatggaccaggcgctgcggtggaatggggggcagagtggaatggggggcagagtggcggtgtccgtggggcgggcggggtcctccagctctgggcatcctccgtcccctgccaccccccgcctggtggccctcctgcctgcctttcatcgtgcgatacaaagccatttcctccctgtcctccagtcggggagtcgggggaggggtccgccccgggctcgacccccaccccctcggtgcgcgccagccccgggcagcctccctgcgtagcgcgccg

SEQ ID NO: 5363 - DNA, 791 bp, Homo sapiens
ccggggcacccgtgtgcgcgcgaggatttcttttgcagagaatgaaaccaccgttcctttccgtccgtggtctactccggggtccccatcccacgtaagtgctgtggaaccccggggtgatgagccccgggggaagccagcatctcttgccctccagtgccggcgcccggcagagccccgggactcctagtttttgccgccgctgaggacgcggcgcgggctgctggccgcgtcgccgagggagggcccggacagccctgcagcgcgtctcagcggagccctgggggccgcgccgctcctccaaacatgattcagaaccgcccgtcagccttggctccagcgcctggcgcgagcgaaccgggcttggctgtctcggccccgtctgaaccctgcgggccgcgggccagggcgcgccgggatccgctgcgccaggaccctgcagacccggccgcggccgggccgagtgcctcccgccggggccttacgcccacggtccacgcttgcaacaccagggctgtacggcgggtccgcagctgggtctgcgcctgggactcggggctccctgcgctcctcgtgccgcaccccttgccttaaccccaagcggacgggtcctggggcttcaccggccaggccggagccccagccccacaactccccccctcccaccgcactgccccctctgcgctgtggcgggagttggggactggggccggagaaaggagacgcgccggtcctcaagtctcttgagccatttcggttccgggcgcgccccccagggctgcagtcgcgcg

SEQ ID NO: 5364 - DNA, 586 bp, Homo sapiens
gcgaagaggagggagttccgaaaggagggaaacgagccggcaaggggcgacaggagcgagccgggaagggagagcagcggagggctgcagagctgcgggcgcccggaccgtgccacacaccccccgcggggcacggagggcattgcggggggagacacacaaagacatgcgaagaggggctgaacgaggctcgcgcacaaagacgccggggcgcacggcagctggggctgcacccaccgcccccgcgccgcgccgtgccggggccgggccagcgagcagcccggggctgagcgcgtggcggcggcggcggcggcggcggcggcgggcaggcgcgggacccgggtcgcccgcgctctccgggtgacccgggcccggcagcaggcgcgcgcgggggcggcggcgcccaagcccaacttggcctccgcctcgccctctgcccagcccgccggtgtcccctccttcccgcgatttcgtttcttctcacgctcccccccccgccccctcccgcgtccagccccgctctccccaccttgtaaaacaaagccggggaaaatgcctgcccgtgcagctcggagcgcgcagcccg

SEQ ID NO: 5365 - DNA, 1678 bp, Homo sapiens
ccgataggcgaaactgcaagaaccgggaggggcggctgcggcgtttaggcgcgaggcacacaccatacccttccgcagcttcccacctcctccagacgcacgtgtttaaagagtccctgctccaaccggtcccgccccacctccgctcggcctccagccctgcttgtactgctggcttcaagtttcctccgagaggcgggcgtgcacagctgcagtggcggcggcagcggccaccaagcgcccggcggcgcttcgccacccacctttcctcagcccccggcgctgcagtctccgcccgccggggagggcgcgctcagcggaacaggagtcgagggtggggcgccgagaggagggaatcccgggtcgcaccgctacagttctcgcagtggcaaaggcggcggcggcggcggcggcagcggcagcagcaggtggagcgagctacagcgtttggcctgaaacccactgctgcagccacccgggctggagttggcccgttgggtggagccagtgctcgccccggtccgacccccggtttccgggacacttgggttgcggaggccggctggccggagtcacggttggggacgggcgcgcctcggagcgcacggctgcgctggaagccgcgtctggggcgcaggaccaacgggacctacctcctcccggctacctaaagactccttctctcgggaaagagcgctgcccggctctgggatttgggaggagctcggaggccgctcgggcacctcgctggacactatccgtttgcgccccggtggcgcgggagggtccggagcggagcgctcgtctctcctcagcggtttagtggagaaaagcagagagctcttcctggggcgaatgggacctcctccctcggtcctccgtggagtcgtcgcatcgcttgtcgtgttggtctcgaggggctcacagcttggcactaatttgcaggtgttcgctgctgatttggtttcttcttcgatttgcggacggttccctccagcgactctcgacacacgttttcctgtcttcgccggagggccgggtctggggtcgccggagcctgcgggaatccagcgcttattcgctgaccctcgagtcgcttcgctagctgtgcgccctcctgggcactagcctggagaggagcgtgcagacgcggctccttggagggagtgcggtcctctagggaggcatcgggctcctaggggcttcttggcgtgtgtggtgggattggggtccgccggccatggccttcactttcgctgcgttctgctacatgctgtctctggtgctgtgcgctgcgctcatcttcttcgccatctggcacgtgagtaacacgctttggtctctcttctttcgccccaatttcgctaaatttccccgatttcaccccactttttccaccttgcgggcgtgggcgaaccggaaggttggaccttctgccgctccactgtcccggggcaggaggcagttcgctgcatcccgccgggcgcgccttcggtgccctggctggaggcgaggggccgctggtgcccaggtaggacaccctctgcagggcccgactgggcgtcccgggtcccgggcgccggggagtggcggctacaaccacaactaaccccttcctctcccgccccgtcctctcctgccggcgggaggcgaaggagaagcgccgccgtcggtcccg

SEQ ID NO: 5366 - DNA, 1600 bp, Homo sapiens
ccgacgacattgtcactggaaaagtgctggccacggcctccgccttaccctctccacccacgggttcggagcccccaggagcagtcagaccgatcaccgctcctgcagcctcatttgtttccggagagacacccacaagccagcccacggagagtctggactcgcccgccccagcacccacgcctcccccgcgcccggttccagcgccgcccccgacatccacccgcgggcagccccttaccgccggtatcctcgaagcgcgggggcgggcggtcccgcagcgctgcgctccagcccgcgccggcctcgtcctcctccggctcctgtgcgtccggggcgcggggcggtggcggggcggcccctgggggtcccgggggctcgcgctcgtcgtccgaggaggcggccgaggaggagcgcgaggcggccgaggtgctgtagaaggggttcccgccgctgtccgggccggactcgccgaacacgtcgtccgagatgtgcaggctctcgtagcgcgcgcgggcagcctcgagcagcgccggcgccctcctccgcgcgcccccgccgccctcggccatggccccggccgccgcccgcgcgcccgcccccacagtgcctcccagccgcacacgccgggccctgggcccgcgccgcggcccgccgccccccaccagcgcagcccgcagcacagcgcccgccgccccgtgcccggccggcccgccgtcttggccgcctcgggcccagcgcccggggaagcgccctcggagctcgggcgccgcaggctgcgggccgcggcgggaggcgagccgcgcgcggggctggcaggggcgacccagagcgggcgggacgcagaggctgcggccgagaccaggcgccgccgccgccaccgccgccaccaccgccaccaccgccgccgctgcgtctcctcggcgcccgccgcctccctgcccgccctctccacggcctccggcgctcggctgccgaccttcccgggcgcgagccgccagaggcgggccctgccgcccctcacctcccgcccgccggccaatggggagcccggcccggacagccgcgggggagctgggcgggcccggcgcggggaacgcccccaccctcctccgcggggcggggcggggcgcgcggccggggctggcggttagggggagggccgccggcggcagtgccggtctcctcctacagggacgcgcagcccgggaccgccacgcgcagcgcgggagggggagggcgggaccggggaacaggaggggagggggacccgggtgcttccagcggtccgggcccgcggacggagtgcgggccgatcccgctcactgtccccttccgcagtccgcgtgcagctccagggagctgtccgccccggtggttctgaaccaggcgccgccgaaacgctccaggtaggcggcgggcccgaggtcaccacacccgcggcggcggctgctgccgaggtttcctgggggtcactgccagctgcgccgcatgctcccataaatacaggggctgtccagcttctgggaatctcgctctaattaggagcccgcctcgccggtccactgttggtcgctggtcagatgctaactccgtctcg

SEQ ID NO: 5367 - DNA, 2394 bp, Homo sapiens; identical to SEQ ID NO: 5356

SEQ ID NO: 5368 - DNA, 1160 bp, Homo sapiens
gcgcgtccggtgccccaaggcttccaggcggagcgcgggcgcgaggtgcgggctccggggcggagcgcacgcccgggaggcgggaagtgggcagcagcgcccccgcctggcccctgtgcgccccgacccgacgcctccccgcccgaccaggtgcctcgagagcgcacagctgggagggctctcccggtcgcggcgagactcacgcctgcggtgtgctagggcggcggcgacggtgacgggcgtggggcgcggcgctgcctcggctgccgggtcgttgcggcgagcgcgcgggccggcctggagtcaccgggctgaaccgccgcgcctgcatcgtgccgcacgccgcggaggcgctcgggtacagaccgcgcgggcgcgcacaaagcggcccggggcggccggcgcggcgcagaccctcggtgggcagcgcactccagtcttcccaggctagcggctgcagggagctccggcccgcggcccctccgcctcaagtctgggagctgccggtcccactctgtctttgcctatggggattcgagagtttcccagcggcgcacccaggggcaagagcattgccgtgtgagtagcgccccgggcgtgggtgagcgagccggcgggcgggaggccggagcgccggggtagccctttgcagctgggacactgggcagtctgaggctcggggaagggcggcgcgcgcggtggagctgctcgggaagtttcagtcattctttccctcgccactcgccccaacccgcactgccccgagacgcccaggatagggcactggggacagctgcccggggaagtgggtgagtggcggcgggaagggaggagcgcgggctctgccgcggcgctcgcccccggagggccccggccgcgctcttgctctcgccctgggatctgctcctcacgaatcccctcctctctgtccatgctccccctgcccacccacctgcccgtggcgcctgcgaccgcagtggcatgaggaggtcaccggacgtcagcccccggagactgtccgacatcagcccccagctccggcagctcaagtacttggtggtggacgaggcgattaaggaggatctgaaatggtcgcgctccgtggaggatctcaccagcgggccggtggggctcacgtccatcgaggagcggatcctgcg

SEQ ID NO: 5369 - DNA, 588 bp, Homo sapiens
gcggggctgggcgtcccggggaggagggcggagcaggtgagctgcggggtgggagcagggagtgcacttgtacgtgacgttggagtttgcagcaacctccaagtaggaggctgtgcgcgcgtgtgtgtggagtggctgcgcggccggggaggatgtgcgctgcagggcggccgccgcagtgagcaacgcggcaaccggagcccggcgggcagccggggaggccgggactgagaggggcgagccgctggtgctccccggcggcagagggccgcgtcggccacgggcccgggagagacgcgctccagccggccccaggatgtaggcgatcggcggcagcgctcctgcaggcggccggctcatcatgaagaagcactcggcccgggtggccccgctcagcgcctgcaacagtccggtcctgacccttaccaaagtggaaggtaatgcgcggccgcctcgccccgggggtccctgcaccctagccggggaatgctgccaccctgaggggggctgtctggctgcggggcgccggggctgggggtactgctcccccaggacgcggctccgcagtgcagagcgccgccgcctgcg

SEQ ID NO: 5370 - DNA, 878 bp, Homo sapiens
gcgacccgcgactgcagccgtttcttaaggccagtccttcgctcgcagtctgtcccgggcggcagtcgtgtcagccccccgctaggacccgcccagggggacgtgggtaccgggcaggacgcgcgctctgggcgctggggacgcccgggacactcggggccccgccttgcgtcccagccccgggtcgcggcaccccggctcccgccccgcgcctctggagggaggtaccgagggacgcgcagcgaaggggctttgctaattgccaaagcaggaagtgagctcgtggaagaagcgaaggaggagaagaagaagggaggggaaggcggaggagggcaggggcgcgcagagccacggtttgctccaggcgcgtcggaaccgcaggacttttcatccccgtggtcccacggtcctcccgcgccccggaggcctgccagccccgctcggacgctcgtttgcccctaacccgccgccatggcttcaccggacgaccctctgcgcgcaggtaaagggacacagcgccgcgcccgctcctggagcgagcaccgcggggcgggagctcgggaggcgctcgcagcagccgcagggctatcgaggccgggcctcggcgacccccgagggaggcccgggaaccacccccgacccaggcgccagacccggagtcgcacggggctcccagtccagccccgcgagcggctgctgaccgcccctcccgcgctcgccagggcccctgccccgcgtcagccaccgcgcgccttccccctgcccatgccgcagcccccgtggcttttgttctggactcgggatgccaggttgagacacgtcctgcaaacctctggcagaaatgggcgcaagggggtggatttcgttttcgcctcccg

SEQ ID NO: 5371 - DNA, 561 bp, Homo sapiens
gcgcgggtccacgctggtcgctagcggcgccaactttactcattcgttaatttgctagtttttggactgagtaaaacagcccccaaagacgcgggcaaacgccgctctaaagcccactaccatgcaacgccaggttgctcggagccacgctggtggcacttccccttcgtgctcactctgcacaggcacctccagaaccccgtgcaaatgaaccctaccgggagacgcaggtgggcaggtcgggtcggcagggaccaagagcctgaaagggaacctgccctcccctccccgcagcccggtcattaaggcaagaaactgcaggcagagaagcccccgaatccgacctaggacgtcggcgcctgccaggatcccctcgcctgccccccgcgccccgcgcgcgctcatgccaccaccacggggagggtgcatgcggcaggtgcctggccgaggcccccgggagcgagtcgcccttacgtgctccagcttgtctttcctccgaagccagacgctggcgctgtagtcctgctgcttgacgctgctgtagaagttcgcgcccactcg

SEQ ID NO: 5372 - DNA, 1235 bp, Homo sapiens
gcgatcgcagggcttcgcctatcccttcctccgggacagtttggatgggagtagctggcgcgagggctcgttcccccgtttttgggtaattcctttggcactgggagacgagatggcctccggagggtggaaggcagtgccagcccggccggccactggggactgcggggcccggagacgcgcggggtccccggggagctcctcgccgccctcgccccacttcgtccgggtccctcaaacatgtcgcagcgtggctgctcactgtcccctctgggcaagaggaggccccagacatttccacgggatctgaactcccgagcgccctgcacggagcagccatcccgccagcaccccaaagtgaagctgctcacaacggacaagcccggagaccccatgagaggccggggtggagaagccgggggtgaaggggggcaggggccggcgcgccacgcggtccttacctttccgcttggacctccgcctcctcctcctcttggacttgcatttgagttgactgctcagccctccagaccctctgccgctccccaggaccgaggccatggccgagacccaggcgcggagcccagagccgcctccctcctgcacctgcacctgcctccttcccggcagccgccgccgccgctgctgcgaagcttgaggttgcaaacccgggagcggctcacttttcaggactgagcaggaaagcgcgctccgtctctctgtctctcgaattgttctctatgacttgctcccactgggctgggggcctcggctgggcgcctggagcgagctgctccctggtcagggagggcggggaagggcgcgcggcgtcctgagtgctccgagcttcccgcgggctctgcctcctgctctgggctcccagcgcagggaggctacttttgcgcctctgctagttgtttggcaccagccactttgaagccaatcacgcagggagcttgtctatttgctgcagcagcgtctaattagatccaatcacaactgctttctggctctgacatcagcagcagcaccagccgcaccgccgcctggccgcttgcaaactcagctcccgtttggacggtgaagctcccaggaccggcggctggagggaggctgctcccggggaacaaggacgcggcgcgggtgcgtctgggagagaccgggggagcctccaggagggaccctgcccgggaggacgaggcctcctgccgcagcctcgcggacagctcagctcg

SEQ ID NO: 5373 - DNA, 5964 bp, Homo sapiens
gcggcaaccgagccagatccaagaggggtcggcctcgtctaaattggtttcccaccaatggcctcggatcagccgcggctgtgctgcgggagccctcaggacgcggctggggttggtgcgcggggccccggaaccccaaacccggctcggttcggcaaggttcagggagacaaggtagagaaggctggggtgagcgagaagtcgggcggccgatcgtcagggccacgagcctcgccttgccttcttggaatcccacccaactttaaaggcccaaagatcctgaaaattccgaaagcgaaactgcgagctggtctccagaagtttgagaacggtctcccaggctttccagcgtcgtcccgggattctcggacaccacaaacgccatcaaccacgagcaccggtgtccgtggctattgccccgaatggtccccatccgcgtccccgggaactccctcggcttttcgcgcatccaggtccccagccccagctactggtgcgccccgagcccctaggtgccagagcggtggtcggccgggctcctgcccagtctcggctcctccctcctccccaccagaaggaaaaacttgggcccttcgagaaccctgtggaatgttctttgtaatcaactgtacatccgcttccacggcacggcctcgtgcaaaatcgcgggtttcggggccttggagcaaattgcgcttgtcagcggcgacgtcaggaggacaaggggaggggttcgcggctgaaactgcagcttcgcagcacagagccattttaggctgctccccacctcgcggggcccatgggaaagccggccccgggagggcgcgcccaaacgcaggctggaggagccacggacgcgtcctggccggcgtgtcgccatcgttcagcctcgctgcccaggtgggaggggtcacctgccgcggggtctccaagccagtgccgcttgctcccggcccccacccactgacagcacggcgtccgagtgaccctgtctagcctcgttctgcgctcctgcaaaccacgttgctgcgctaactacaaacctggccaacatgtctttgtaaccctatcatttaaaaacgcttccaggcacctggccgctgccagatcaggttcgcgggcccggaggaggtcctcccacctgcccccgccagccccggggaccgtgcgcggcctccgtgtggcccccgcccacgaggtccctcgggcaggaaccgccgcgcgacctctgttcagcggccgcgtcctggccacgggcgacccctgtcgggaaccctgttcccggctaagctgcgttcccgcattccggtggctctcacccgagctcgcgtttgctggctttccctctggctcctctgcctgaccccgattttgtctccgaactccactcccagatcctccccgccctggaacgccgacctttcccccgcacttcgccgcccactcacatcccccggcgactgcccggcctccatgcccgccaagacaagaagatgcccctctccgatgcgccgagagggttcctaagccgagcaagggacaatttcttccccaaacgctgtccccatcccccaccttccctagagcgcgaaacccaaaagtaaggaaggcaacccctcgcctcgaccctacgtgcttgtctcccagagccgcgcgctcccgcccttctgccccaccccaccaccaccaccaccactttggtcttctccaagcttcggtcccggtcccccacctcccaccccagagcggcgtggaggaaagcaggagcccactattaagtgcagcgcgccccctgcacacacgaaatccggctggcgtctgcagcccgattgcacccaatacccgggacagttagtccttttaataagcacctcctcgccccacctactcggggatctacccgcgcaggatccagcacacacaaggcgagagctagctcgtctcctagaaagacaaaataaatcactccctctgccctcatgtactttacaccacgtgtccgcagtttgtcacgtcaaatcatggcagggtctggttccaagacgcacacacacattcggggtggttctctttgacacacacacccaaaaaaactgcgcacacgcaggcctgcacactaatccacaggcacacacgacagttgcgtttcggtgccctggtccgggccaggggcacttctccatccctttcccccctagcaatggacttgacacacagactctaaccacggaaaaaaaaaaccggacagcccattccttctttttttccccacttaattcgctaaagcgcttcctggggtagccaaagagagtcgaaactaaggggtggaaacttcagctgggttttttcccacctcaaaacctttattttcagtttttaaaagccaccttagcccgccatattgaaactggcacggtttctaaagactccttccccgcagttgtggcgcttccaagaaaacacgagtacggatcaggctctggatgagtgtccggccaccgagaatcagccacttcccaccctccaggatcccccagctccctccagccccttcccaccgcccctggtcaaaatcaataaatacatctcgcagttcctacagttgcattttggcggatttctgcaaaacatacacacacatacacatacccacgcacgcatattaaaaaataaactccagaaccagctcaagtcagcaattttgaaagggggtcgaataagaggagacaaccggaaagcccctaagtgacaggatattactttaaagagaaaataatgaacaaaaagaccatcctcgctggagcacgctccaaaactactactgccaattttatttcagttgctcaggcaaatgtttccaagggagcgattccgaatgtctgcacgatttttacccccatgccggtctccgattccccgtcctcaccatctttttctcccacccaaaccaaaagaaaggggagaccccagcgcggaggagacgcgggagcgcggggtaggtagcagcggcggctgcgtcgctaaaatgagtgcagaaacgaggaaggtgggcggcgggaggggacaggctgcgcccggggaaggaggacactttgcaactccggacggactcccgcacggctcggcttttccgagcccggagacgcaggcgaaggggacccgggaagcaaaaatgacaacctggagcgcacagaggagtttgaagcttcgctcaagtgcagtcgctttcttctcctgcccttctctttcgctcccctgcaccctccccagccttcccccacccgccacctccaaccccagctccctcaggcttccttcctttttttttttttccttttttttcctaggctggaaaaagcccctgaccagcgcactcaacctgcgggccgaagggctgctctccggccagcctgggcgccggggacagcagccggcgcggcgtcctacctggtgaagttcgtcctgccctcggcgtggacccaggccccggtcgccgcccgggagggcaccggcctcgctcgcttgctcgctcgcccgcccttgcccgctcgctccccgcccgccgcctccctcgcgcgcccgctccggtcctccggctcccactacagctcattccaatatggcatcctctctgtgcgcatgctcggcgctcttttttttttttttttttttttttttttaagattttgtgtgtgtgtgtatgtgtgtgcgtgcgcgtgcagcgaactccttcaacgaccttttccagcgcttgcaaaatttcttaagccaattagcctgcgggacgtgatcggctccttccccagccagctccgcgccattccctgcgcctaagcaggcgggcacccccaggaccctgggaccttccacgcccacgcggcctcctccccaccgcgctccccttcctcctttttgtgagctccctccatacatgatctgcagaaagttcccatcgcgggcgtttccgcacacccctccgcaaggacaactgggcaaactcccgtttccctggctgcggttcgtgagctgggtttccaatggctcagtcgaccgtgtgcacaaacttgcgctttatccgccggggatcgctgggagcggagataaattcaatccccagggcaatcttggccccgcccgccccaccccatcctgtgcttaaatagagcctttcttgaagctgcgaacatttccaggccccttgggcagggctggaggggccgaggagagctattcgagggaaaggtgccccgaggggcaggaaattaagttggggctgcccgggcgagctgccaggtagccgtgctcgccacggcgtctcatggggcacctagctagtggcgggcctcatagggcgggaaaagaatcgtcgctcacaccccagcaaaacgtggccctcgacggtccgttggagagccccggcggccgtgagccccgggcagggctggacgtctgcggagccctcgggcactttgtcccgggcgcctggggaggaacgcggagctcccagggccttaggtgcaacggctgcgcagagcccaaacgaaatgtccccagtgcggaaaagccggtgacgccctggtagcaagaccaagagcttccgaagaacgctgcgcccttaactagggggcctcgcagagatgcctgtgtgggcctgcattgtatatttctgcgaaatagcgaatggacacgtttgctcagggtttttatggttgccaaagggggtaaaattacccagtcccccaaatctgtgtcccatgaatccctctcatagtacccctctccagggggccaagaggtcctccaggtccccgtgggttcgcagctccacccgcccttcctcgccctgcatccctaaggagaggtgtccgctctgaagggctaggggccagccatggagtgaggggaccggggctgaccacgcgcggcacagacagaggtcctcaggcgggccctctcctggacggtggggccggagctgatctagaagaaatacggagggacgtgccgagaagccgctctccttcgccgcgaccctggagagcgcctctccacccaaaggatctgccgagctgagagatccagggcgggcgtccgcagccgtgaggccccctgcgccgccagtatgggaagatcctgcctccttacaccttggagaacgctgggcgacgactaaagcgccttccgccggcctgtcactccatgtgacacaggagccacgtgagacccagaagagtccagcgactcgccgcgcggcgcactttaaactctagcctgagtctgcgacccctccagctctccagtccccagctgttggggacatcaagccggagccctgggctctctgccctgtgggtcgctgaaagcagagactcctcaaaccaaccgaaccgggcgcattaaccctctcgcctgcaccccgctgcctcccggttgagccccgaggcggctccaggtagaacctgctggactgactgcggcgtccagaaatctggagtgtgggctccagacactctccacggtttggccccgggtctcaacacccaagtcgcctcttctggctccttcaccacacagcggggcctgtggaaagggaggggccgagagacccgtcggcgcaccactgtcctcgaggggtccccaccctgtgcactgctgaagcgcagggcgcgccgcggcaggaatggccccgagtgcggatcccctgccctgagcctcccactcttggcccgcgctgcgcctacccagtggccctggccccgcagggcgacagcggctgctccctcccatttgcgtcccagaccgcgcggcctcgcttagctcccgggagccgacaggcgcttgccctggtgccagcgcagggcttcccgggggcttggggtaggggtaggggtgcgggggggaaggggagaacgtaatttccttctgcaggagtcgtggagacgtgagctgcaaccagccaccgcg

SEQ ID NO: 5374 - DNA, 5964 bp, Homo sapiens; identical to SEQ ID NO: 5373

SEQ ID NO: 5375 - DNA, 5964 bp, Homo sapiens; identical to SEQ ID NO: 5373

SEQ ID NO: 5376 - DNA, 703 bp, Homo sapiens
acgcgaaataaacgactccaggcccccagtaaagaagcagcggcgcgtcccttttccccggcccagcgtgaaaacacggaaggcgaagggctgccgtcagtcgcctccctgccaccgcgaccgggaaacaaagacacattaccttttattttttgcgcttccaagggatccgaggaacttctggctgcaagcggctggtaccccggaacgggcgtcccattcgcccgggcgaaggcccttggcctactaggcggccttggcgcccgcagctggcgagcccccgccccgtccccgccgccgcccccgccgcgggccctcggcgtcagcccatagcccgctcgcgcctctcgcgccgagcctggcccggcgccagtgagccccgccgccggcccgcccctcgcccgcgcccggcccgccgcatggtgcgcccagcgcgccccgagccagtccccggcgcgctgctaggtcgggtgctaggcggccaccgcgcgccaccgccgccgccaccgcccgccgcccgatcctggacaacaatgcgcgcccccgcccccccagaaagccagggacgcccccagtcgccgccagagctggctcggcttcccagcccctctccgtggcacccgcaggcgagacaaagttcgctcccggtgaggctgcgcgcgtccaaagcgtgcgggatgcccagcacggaggtccccaagcg

SEQ ID NO: 5377 - DNA, 1315 bp, Homo sapiens
ccgcgccctcttcaaacacacgcacactcttacactcactcgcgccgtcccagcctgcctactcccaacgagtccaagccggtgcagccgcgccccatgcccggctcgcagctcccgagccccagtccgcccgcgctgggcgccgctgtacctgttagtggcgcgcggtaccgcggtcgccgggctccggagcgtcctcagcgctgcgggggtgccgtgggtggcctccctgctttcctccaccagaatcctgcacagccggggagaaaacttaagttgctacaccccgccgggagctgttggctgaaaggctgggagtcgcgctccttgcctggcagggagatctcgcactccccggctcccaggccaggtccccagccccagagttggaagagccttagggcgggaaggaagagacagcaaggaccagaatggggagcatgagatcctgatgcggaacccgacggcaggtcccgctccacagctgcctcgcccacagcgatgcgcgctagagcccccgcagccctgaccggtccctctgctccccagccgccgtccaccggtcggagggtcgcctccctgcgaccccctcccccactccactctcaggccgtcgccgcccgtgggctgctccccgccgcggccaaaagtctccgcgcccgaggggaagcgatgggcggcttgggggtccgggggcgccaggcggggcgcgcggcgcggggcgcggccggcgggtgggtgggttacctggcgcggccgggcgcgtctgccgggcaccagagcaggcgcagcagcagcagcagcagcaggctggcgagcagggcgagcagtgcgccccccggccgcatcctgagccacaggcgccgccgccaccgctgctgccggggcgaagcacagcccgggcggccccgactcgcggctcccgccgccgccgccaccgccgccgtggccgcagccccgcgcacccacagcgttcacaggcggcagcgaggggcgcccgcagcccacccggcagagtctccgcggcgggcggagaagaagccgcgttcgggctcgccccgggctcccggccccggcccgcggagcgccgcgatcggctggcagatgacgattcgccgagctcgccgcctgtcctcccggaggcgctcggagctgctgcgggctccggtcgccgctgccactgctgctgccgccgccgccgcgcggggtcacctgaaggttggggcgcggaagctcaactccgtgctgattgggctccaagttttctgcgccctcgcctcgtcccgagtgcccgcgaatcccccggacgcccacg

SEQ ID NO: 5378 - DNA, 1316 bp, Homo sapiens
gcggccgtcggtttctagccttgggatcattctggccccgacacggagtgacaggggatccccacgcgtccccgcatccagggcgcccctttagctgcggcggaggcacagagaggccttggcggcgctgtggcttcggtcggcaccgggtcccgcgcagccgggccctccaccctgagtggagctgccttctaagcacccagcccctgccaatcactgtgcccaacaccaagttcccggggcgccctgccctgcgccaccgcgcgctcgctcgcccgcccgcccaactcacctgctgaagaccaggcagcccaggtggttgatcttgtggtcggagcggtggcggctgtagtcctcccacaggtccctgaaggccgtgatggccaggatgaagagcaccggcgccagtgccaggccgggctggaaggcgttcaccgccggcacgaagttgagcagcgcgatgaagacaaagtacacgttggccgggcggtggaactgctcgaacaggttcttgggcaggaaggacagcagcgtgtacttggtagtcttgagccggttgtcggccaggtgctgggcacacccgcgccgccgtcgccgctcgcccttggccgcgccagccgcagggtcctcggcgcccgggggcggcagcaggttggagcgcaccgtgcgcgtcctgccctctcggcgcctccgccgtcccggaggcccgggctcctcggtccccgccggctcccgctccatggccgcgtgtcgccgcgcccggctcctccgccgctcacgcccgcccgcgccggcctcttaggttatcatcactcgcggcccgggcgcggcggtgcgagctccccgcctgcgggacgcacggagaccgcggtcagcgcgccgcctggccggcccagcgcgcccagcccgcgcccagccccgtccactcccgtccagccccgccgcccggccgcagtccccagggcgcaagctgggcgggtgccgcacagagcccccttgtcctcgccgcccgcccccggcccgggtcgtttccgccgcggtggccacggccccgccctcgttccgcgcccggactgggccacgccggatagcgggaaacaaaaaaagcccgagctggaaacttcagagaggtttagtttcgtttcccagaagcatcagttcggtcccaaaacgctgcaaacgcgcgctgcctgcagtaggagagaggaaaccgcgaagcgcgagaaaaggcgcccccgtccccaagcagcccgcgcgcccttccaggggccagacctgctccatcctggacggcgaaacgacctcgggagaccccg

SEQ ID NO: 5379 - DNA, 1110 bp, Homo sapiens
gcgccgggcctggcttctgtggcttcgcaaacttttcagcctgtgtgccacggcgacgcgcagcggctgagtcggagcccacgcggcgcgcgcctcccgcgaggaacttttcggcttgtaggctgcttgtcactctcgctttccgacgcgcctccccctggctcgcgctcccggagttccctcccctcctggcgaggacctttcccggcgcccgcggctccgatccccgccgcgctgcgcccgctctcccggccccggctgccccgctgagggctcccctctcccaggcaccgcagccgcgcccccgcgtcccgcctcccgagcggctcgcttcgcccgatgccccggccccgtcccgcgcactgagcgcctggcagcagggcgccgagtcccggggcgctgcggggcgctgcgccgagaacggccgggcctgagccctgggcggcccccagagccgatcagagcgcggggaggcgggggcgaggaggaggggacccgccgccgggggctggctgcttcgctccgagccgacttttcgccaatggtccaaagggacatgtccaagtcgcctcccacagcggcggcggcggtggcgcaggagatccagatggaactgctagagaacgtggctcccgcgggggcgctcggagccgccgcacaggtagcgagagcgcggcgccttctccttcctttgtgagccgccgggcagggcaccgacctcgggttctcccggcgcctccactgcagggatctctagcctcgcacctcctcccctcgtcgcctgcccaccctctgctcctctcctggcgccggggaccctgcccctttgcgccttttcctggctctgcctcggcttccatttttctctgcttccgaaaagccagtggggaagggcgggggagacctgccagtcctcccagacttctcccgggttgctccagctggccctcctcgccccttcccgggagaggcacatggagagacatgaatcaggggagtggactggacctgctgaagatcgtgagtccgggtgggcgggagggggcccgcttcccgcagcgctttctacgatgccgactctcctggccacgctccgagccggggtgggcg

SEQ ID NO: 5380 - DNA, 1655 bp, Homo sapiens
tcgctttcgcccccgctgacactttgcaaagccgcggcggcagcggcggggaccacgctgcggtgcaccaccttccgccaccctcccgcgctgggctggggtcgagggggcttcgcagagtcggtaaccgaaccggctctggtttgctttctccactccctagccactaccagaaccagcctccgcgaaggggcgagctgtggttaaccctttcgtgcccagggagaccccgccagggtcggggcggggcgcgatcgccccccgcagtcgggcgcgaaggcggcccgggagccaggtgggtgtggggcgcagttggcggagctgcccagggcgtgcgagcaggctgcgaggatggcgccccggcggcgcggaggtaccgccccgcgctcccccgatagctccccggcctgtcccctctccccgcgctctggggcagccggctgcctggggcgcacggggctggagtggccctctccctccccttcgctaggctcccccggcttaatctgttggccgcgactcctcagccagccccgaggaaagtgcagccattggacaggtctgtgcgggctgccggtttcagggaggaaggtgggagaagcctggaggagcgaaggggagggcggagggaggagggaggagggtgcggcggcagatctggcaaattgcgagctgccttccctcctcaaagtgtggagaaggagcgcgggggagcgtggcgacggcagcgcctcctccgccaccaaactcctggggctccgcgggggcttggggccacctcctcctgagcccggaggaaccctctcccgataggttccagcgtgactccctcccactccacccttttcctttcttcttcctcttttttttttttttttttaaacacatttttttcctggcttcggacctcagactgctgcagccctaaccttcccagggctcagctctttggagctgcccattcctccggctgcgagaaaggacgcgcgccctgcgtcgggcgaagaaaagaagcaaaacttgtcgggagggtttcgtcatcaacctccttcccgcaaacctaaacctcctgccggggccatccctagacagaggaaagttcctgcagagccgaccagccctagtggatctggggcaggcagcggcgctggctgtggaattagatctgttttgaacccagtggagcgcatcgctggggctcggaagtcaccgtccgcgggcaccgggttggcgctgcccgagtggaaccgacagtttgcgagcctcggctgcaagtggcctctcctccccgcggttgttgttcagtgtcgggtgagggctgcgagtgtggcaagttgcaaagagagcctcagaggtccgaagagcgctgcgctcctactcgcgttcgcttcttcctcttctcggttccctactgtgaaatcgcagcgacatttacaaaggcctccgggtcctaccgagaccgatccgcagcgtttggcccggtcgtgcctattgcatcgggagcccccgagcaccggcgaaggactggcgggtggggtagggaggtggcggcggcggcatggcgaggttcccgaaggccgacctggccgctgcaggagttatgttactttgccacttcttcacggaccagtttcagttcgccgatgggaaacccg

SEQ ID NO: 5381 - DNA, 1655 bp, Homo sapiens; identical to SEQ ID NO: 5380

SEQ ID NO: 5382 - DNA, 304 bp, Homo sapiens
gcgggcgctggaaggggggcggggtaaatgcggccggcgcagaggtggggagcaggtgggaaaggtggaggcgggctcgcctctggagacctacccctgctcccattgtcctccgcctgccagcttcacagacaggcctgaacgcgcagagagttccttggagtgccctgattttgtccccgagagggcccccaacctccgcatcctcttagtggctgtcctggcaggtgcgcgtcctgcggggagttgcgccccgggggctatcgccgagcgggagctgcctcctggaaccctgcccaccgcg

SEQ ID NO: 5383 - DNA, 1666 bp, Homo sapiens
gcgcaccccctcccgaccgctagcagcacaagtggcgacattcccatggagcggccgcgccgcagcttgccgcattcagcgcggacggcctggccgcgcgcttccccgcccggacgaccgggcgcgcctgacactaatagctcgcggctcaggtacgagcgggcgccgcatttgactcaattcaattcacaaccggccgcgcttgcaggtgtcgccttttgaaaccgccattcaggcggccgctgttcacttctcgctgcgccgcgggttctgtagaagcgcaagaatggggctgattattccggtgcccacatgccgcccccacacgcccccacccccgtccggcgcaagacttcccttggccaaaagaggcgtttaattagttctggggccgcggagagccagcgtggccgacaaagcccggctccccaggtaacccgggttccctgcggacccgggagggggcgcgcggggccggagcaccggccttgggctgcgcgctccctccggcgacactgccgtccccctggcctccggcccggtcccccgcaggccaaaggctcatctgccgggcttgggtggcccgggccagcgccgcctgcggtccccgagtgcggctggctctaaggccggcgccctctccccggctttcagtgctcagagccaggccagcgggaaagaaggcagcatggtccgcaaaagacaggtggcagtggcagtcttgcatgatacttgtccttcttccctgttccccattttggggaaacactggaaacacttttctctttatgcgcattcgcgtctcagcaccgagtgctccaagccctgcgcgcagcgccgggcttggaaggcggcgaatggctgcctagccgccgcccctactagtgacactcggccgccagcccccgcccaggatgtgcacatctgctggcagcactggcccgggtggcagtcaccgggccacccactccacaggtacaaccgcacccaatccaacctggaactcggagggctgtgcgcgccgagctgggatcgcgccccagcgagccgggcctttggctgcgccagggcccaggccgagtcatcccgccgctcgcgtcgccgcgaggcgggacaccgtgtgatacctttgccgtgggctgggcgtcggccgcggggcggagagcgggtgtcccacctcgcctcatcatttgatttccgccagcgtctgaggacggcgcacccaattcgttccactcgctgcgctctgtgaaccagcggcgggcagggcgggggaggccgggctgggggagggcagggtggtcccaatcccccgcccccgccccgccggcctcgcggagcacaagtgttgggattcccacgggcaggcgtgctctgcggctggaggcccgagcgcccagggcccaggagacgtggcggacacagaggggtttgtaggcacggtgacctccgtgctcctgctctgaaagggcctgaaaggagcggtttatggtgcattaccagtcaagggctcaggtaccagcgccttgtgtcgggaacccgggcggccgcccgtgctgcaggtgtctgctatacaaacgccccgggagggggagggcaggccgccggattgggggccggggaggggcctccggcctggcctgctcctgccactcgcgcggtttcg

SEQ ID NO: 5384 - DNA, 5030 bp, Homo sapiens
gcgccacgtggagagccacacgaactctaagcgttcccgctcttcagcccctcgcgggaaaacggatcagggtgttaatgggtcctgattacctgcactagcgtcatctgcgagccgagggccaagagtatcttctcggtcttggtggggtacgggttgtcacggtgcttgtaaagccactgcttgaggggtcgcgccatgtcttgcagggcctgccgcttgtgcctcaccttcccgccattctgccgggcgctgggacatggggagaggaggcggccctggtgagcgacgcgtttgcccgcccggacgctccacgccccggccaagcccgggccccgcatccaaactgcgcattcctgccttgcgcccctgctttgcgcgcgcccagagtgtttgggagaggcaggaagtgggagccacacagtttctggatggggagatcatttcgataggtttatcttgaatagggggataccttgaacccaataccccaaggttagaggtttagaagacgaaggtcaagtgatttgaagaatactgctattccagtcgcgtatctgggcagcggggctaactgctacccttccctcacccgctggcgccgcaccctcgagtggccctggcctggcaggcctggcagggtatgcggctggctctcgaaacttccctcggggatctcttgtctgctcccagaggctttccgtcgcttgtggtcaggggaaaggtcgccgactggacatagggaataaagcaaaggagcattgccgccccggctctctttaagctatttcctttgatcttttaggaaaagggggaaactttctaaaggagttggtggtttgtggaggaaagctgcagaacccaaaaacaccgtcgggccgtttcccgactaagggagggttaaaagtacggcaagctctgtcccatcatgtaaggtaaaaagacctcaggaaaagcacattcaaagggggaggaggcagaggcagccaggagcctggagcgtggcctggggcgctgcgctccctcacgggtccgggaggtgtcgcgcgcggccgccagcgagcccagccgctccccgaggcttgcgcgcctgcgccggagcctcctgggtttctgcctctttaaacactttgaaatgcaattccacccgaaacgactggtagtaacattttgacgaaaccgaatctctgttttactaagcagcgacgccgcagaacaagcagctgatgcaatcgttcaggtggaggcggctaggacggccgcccctccccggcggggcgcccggggagccgccggatcgggccaggcagagcctgccctccactcaccggcagtctgagcagctggcccacccgcaagctaccgccccccccagcatacccctcaccccgctaaactcaaacccggccccgcaggcccggggcctccccctccgggttcgccgcgggcccagccgagccgcgctcacgcccgggactccctggcgggaggcgaccttcccgactccttgggccaggcgagccgcggggctctggcgaggggctcgagtgaccgaagagaagtccgcggagcctgagcctggactccccgactgctcggcttcgcctgtttctctgcaccgagctcagtcctttttcctcgccctcagccgcgcaccggcacccacagtccggagaggggcaaataacccccaactccgaggtccaggcagcggagggccgaggggcagctcctggcgcccttagtctccaccaagctctttggagctgccccgacgaattgatccctcatgttttaagataggagccccttaacatgagaatgcgcgagccctggaggggcagacctgcactcccagggaactccgggccctttcccgtccacccgcccgcgttgccacgggaccccgtcacagctcaccacccccacccctccgggccgcaggcgggcagggcccccaggggagtgcgcatacccggtcctccggtgtctcaggccgaggttgtccttgaggggcgggccgtcgggaatgcccacctcggggcgggcgtgaggactgtccaggacaccgctgtagggccggccaccccgctcccgctccgaggcgcctccgtcctcaaacagcaccgcaccgctgagcttgttgaagacgatggtgttcatggtgtcggttggtagggacgcgcggcgcggccgcagagcctcggggctgggccgccgggagctccgcagcggggctcggcttctaggagaggaaggtgcatctcgttacttactggctgagagtgctcagacccctgcaggttcagggccttgaacttggccgggtcgccgggctgcggagccgaggggaggagcggcgccgccgcaactggcagggaccctgcggctctccccagttggctacacgcccccgcccctgcaggttccccggacaggtacctgccctcttccttgcctgggcgatcgatccccccaatcccttcactccccagaactacaaccgggaatcattcacccgcagaggcaaaggaaacgaattcccaaacgagcctctgggtttcagtttgaatctgggagaggcatactccggactgcggagcgcgaccggcgtgaggccgcgcgtggttcttcaatcacagcagaagactaaagcctctaggaaccccaactcggggcgtcaggaggggttggatggaagggaagatttggggtaatgtgccaaccgtatccacaagaccccccagctcatgagtcccaggccataccgggatttgggggattttcgtgttttctagatcgtggatggtttggttgaaacccccgcatcttctgtccgccaaggtcccccggggtgaggttgggttcaaggacaggaaaaagttaagtggcgtcaggacgaaagcaccacttctcccccttctctcccagaatcttcctatcatcccccaacgcgccccgggaagtgcatggtcctaaggtccaaggcgccaggacccaggtccccagagccctcaatcagtgccattctcttccgcagcgcgggtgtcagccgcgagctcgtagcccctcgacacccgcctctctctggggtctccggggaccctttcagaggctgtaaaggtgtcagaagcccaaggcaggaggcagcttggtcggcgcacctcccgggccactgctgccactgtcggggagagccagcagctcacctctggggtcgcggaggccctgagcctctgcctgccgcgcaccggcgtcaggagcaagtccgcgcggccgcggagccgcagagttacagccccaaggcgcgcggcggacttcgcccgccccatctcctcgcctcgcgcctcgggacagctcccgtttcctccgagcggcctcagcttcgctgccagcgccccctttgcccgtccagccgcggcatgggctgctactccactaacacacgcgcgcgcgcatacacacacacacacacacacacacacacacacaccctttgcctcgccaagcgcccacactcgccaacgcccccgccccgcccttcggccaccgcagcagaggccacgcgtgacatttaggaccacgcgtgaccaccgcgatcaaacgacggctacggtctgtgttcgtagggaagtgaagtcagacctctgctggatgtcgtgtgtcccctaggactgcgtcctcccgcgcagacaggtacgtgcctggggtgtgcacatagcctcggtgataagtgtcaaagagaattttcgtgcttgcagcccctgttctacagtcaagactcgcgttggtgttttcttttaaaatcatgcccttagggatgtgtgttcatgctgctttatttgtacaagacacccttccccggcccggccttctccgagccaccccagcgcgtcctcctagatgcgacgacgtgtttttcctagcgaagtcatcacgaggttagccacctcggacacttccccggcagccccaagcccacgcagagatcgcagacacagacacccggcgcgctgtaggtctgcaggcagcaggctcagaggcaagcgatggcaaaggtccgagcgctgtcctgtcgcaaggggtccgggggcgtgtgaaccacacttgctgaccctcccaggactcccgcgcgcggccacccgcgcctcttctcaaatcacttaccccgattcactccagactgtggccggggaggtcactccctgcagaagtgtccccctcccccaacgccggcgaataattttaaagcaaaggaggcgcggccaggtgggctcccaagctccgcgcagacccttgggccagccttggccgctacccgagcgcctctccaccagaccttggagggaagttgggggaagggcgggagagcaccggcgcccagggcgcaggggccagagcgagcctggcgttccgccgcagccggctgagactcggcgacgcgggggctgtacctgtggctgcggggccgacggccggctgcagggcggctggctctcccgcctcgagactaggcgcactcccatccccgccgcatgttctccacgcgggctccagcgcgctcaccaccgccaccgccgtcgtctcggctttatttacccagcccggcgcgcgccgcccgggaacaggaatagcgaggccttctcatgtttcctgactgccggtcccagccggcgaacatcctgcgggcgcggtatccacgttcccgggcgggtggagaggaagcgtccgcgcccgcccggccgcgggggctgctgttaacccctagcagaggagccgctgccggggagccccgggcccgccgagtcctccggagccgggcgcggctcccagatccgccggccttgcagtcgtggagcagacggggcttttcccttcgcactttaggagagaaattggagaagctgccgggagcgctcggctccggctccagaagctgagaggctgcggtgcaaatcccgtgtcttagctggcccgattgccggaaatttcactgcgcgtggctaggcgggagaggccactgtgacgcg

SEQ ID NO: 5385 - DNA, 2868 bp, Homo sapiens
acggttctacgcgaggaagagggcggggagcgcggaccgggtgtgggaggccgaggtgacagcaggtgagggccgggtgcggatggggaagtgagacaagcaccgtgtgggtattactcattccgctctactaaggaggctgctggcaagcggaacttctagcctctctttcaatccagctgaagttcaatctcattgaagtcacttcccatcccggttcgcttggggggaaaccaggcgtccctggaagggaagggaagggagtccgggctgcgcgggtcaggtagcctctctccggtcgccgcgtgtcctcgccgtccccaaacctgcccttcccctcatcaagggaactccccggggagtccagaccgcgatccctttccttggccccggggtgcggggggcggacacgcgaggcgtgggactgatggtagccctgcctccaggaagcaggcaggcggggacctctgggcgctcggaggggcagctccgagggcacagggtacagggagaatcagccagatccctccctgccccgggcagccgcggcgggtgtggccagcgcggaggcaggacgccgccgagcctccaactttacctttccaactccgacagcccgtcgcctttctgaccgcgtccctacggtttcccggcatccgcctccctctccccaccacacctgaggaaaacttttccctcgcccctcaattcaaattcagcagtgcccacggttgccgcaaaccgcccggtccctagcaacaaggttccggccgtagagcgagagcctctaggtgtaaggaaggtgatgtcgtaaagccgggagtgtcgtaaaccaggtgcggtggggaggggggaggggtggaggcggaggggtgggggggaagggggagggagggggaggaggtgactcgagcatttagacacaagcgagaggatcatggcggatggccccaggtgtaagcgcagaaagcaggcgaacccgcggcgcaataacggtgagtggcggaggggaccggggagcggcggagtcagggggagctgggcagccggggcgcccccgggggtgaggggggcgagccgggctgggggcagccggggcagggacggcaaagtggagtgggaaagtagaaagtagtgctctctgcccccctccgctgccgccgctgccggagccgcgccgcggccgctcgctctccctgaaccgttatgtctcttacctggtctctctccgcctagcggctcccgccgcccctgccgcctccctggaccgttagccggcgccgacgccgccgcatccccggcgcagggcgggcggccgggacgcactggccacttttctggtcccgggtggagcggctgttgcttctttccgcacttttccccactcttgtgcccttcggcgcctccctctccccctcctcctggccccctcagcgcgattctccctcagcgcccaggcccccgggagccgcggaacaaacttgtgcccggcgctgaccgtgcaaagtggcttccgcgcgccgcggccccggccggcgccgtcgctgtcgctcgggccccgcgactcgggccgggctgtgggcgcgcggcaggcgggctgcggcggcggcgggacggggcggccgcgggttgcgtggggtttgtgcgcgcgtgtgcgcgggcgccggctgtgcgcgccgcgggcggacagggttcggccggcggcggtaaagttgggacccgcgggccgggcgcgctcgcgtaacggggattagaggcgcgggggcgcgggtccctaagcgcccctcctccctggcgcctcccgctgcccggcccagagccccggcctggggactccgcggcgagccccgcgagtggggtccacgtttggcggggcgcggcggggcggcgcggggaacaaggcaggaaaggtacccacttaacgccgccgggagccgcgcggatgggggcgagctgggcggcgggtgtgtttgcggagttgttacctgggcttagagaccgggaagcaccacagacagatccccctcccggggcagacgaggtctctgcgccgggatgggccggtgtgcgtgcgcctcgcgcttttctctttcggtttttggggaagttgttacctgggccggacgcacggagcgctgaagccggataatggggcttggatggcgctctgggtctcgggtggaaggagggtgggggagggggcggacggaccgacggacgcgcggggctgctacttgcaccgcagctgcagtgtttattgatttgtgctgctgtgccaagggaaacacacacccctctgcctggcgtgagagttaaaaaaaaagagagacagcccgagggatcgagacctgaacatgtggtggtggttgcacagtcgccttttccagtttggagagacgttgtaagttgattgtatttctggttatctcggggcgatgctatgctttctctccctctcgtgcagcagcgaaatgtctgctgattgttattgtctggacagttcctgtggcgagaggggcgagacttgtccgcccgggggcggcgggagcgcagggagagcagcccccgcctgcgccgccccggtacctgtttgtataataatgggcggcaacggccctgccgccggccgcagcccaggctatataaggaattacacgtacatttcggaccgaggggctcgctttggttcctgcgttatttttaaaacgacttttaagagaggggcaataaatgcgtctataatgggaccgctgcagcgtcgagaaaacgaggaaatacgtgtttaggagaaaactctctcgtgctcccccagccccaccccccgcgcctgggctccctttctccctcccctctgggatgcgaaacgcg

SEQ ID NO: 5386 - DNA, 2678 bp, Homo sapiens
gcggctggacgcgcgcccaggtccgcgtcgctgcggaccgcggagctgtgcagaagcgcggcctggcgggtggcacaagcccgacagctgcgccgcgcagcccgcccgcgcctggccaagagccccgcgagggtgtggggagaggatcggcttcgcagggagcggaggctgcgcggctgcatcggacctcacagcctcaagtcgcggcatgaggcgaactttgcaaagcgcgctctcgccatgcaccgcccgacctccagcactgtgcgcagcaggacctcggagcccattcgcctgtggaaaccgagcccgcagcgggaaggcagtgggtggagggtgggcaggcaggggtctggggtccgcggctccccaccctcgcgccttcccgcgccagtcccgaacgctctcttggggcgttcctgcccagttgtcccggctgacctcgctctgcagccagcttgaggtcaggcggtcgctctctgcaggtcacaaaccctcggcgcaaaagtagggctttgaacgcgacaccgcaccagagcgcccagctaagcgagctgcctccacccccactgtgtcgggcggcgcaaactgcgggcgcaggcagaggagccgcggctctgcgccgggcgggagccgaagcccagagcctcgccagggcctccccgccgagcgcacttaccgtcgctgaggcagagcgcggtcagcacgaggaccagcacgaccacgaccttggcgttcatggcgcgggcgggcgggcgggcgggcggacgagcgcgggtcgggggccggacgccgagcgggcaatgcggctgacggagagtgaaagtgcggcggtgggaggcgcgcgccgggcgctttagaggggagagccaggcggggcggggcggggcgcgcggtgaggggcgggcccggagccgagtgctggccgtggccggggtctctgacgcgcgactccctcggcggcaccccccacccatccccttcgcccctcctccgctccctctgtgctcccgaggcgcagtgcgctccggcctttgaccttctcaggctccgctgggccccgcaccgctggcccggtctgcagtgaggtccgcagcctgagcgacgccggctggagggccgcttattgtccctgtgacagggccccactggagagactgaggaccttaggcgtaaagtggggcgcgcgtggaaagctgcgggacggggcctttcgatggcgggaactgaatgagaaccaatgaaaagcaaacaagttagtcccgggcggagggcctgctggcggtggcggcccaaggcagccgagggggtcctgctttctgtgcgtgggggctcaagctcgccacctgcccggcttgcggcgcagccgccggcagagctcgatctgcgggaatgagacccgtctttgcagtcagcgtggctcggactccaagcccacggcgccaccagccgagcctcagtttcctcgcctgtacaaacaaagcagaaggcgccggcggctctcagtaaaagcgaatgtagcctttgtacttccgacctctcaatggtgaaatgagctaatcacaggcccaccccgcggagtgggacgggagattcaatgagacccgccccacgccgcgaaattctctgcatcgtgtctgacaagcagacagtactcaataaatggtagctgtaagtaagtcctttaaacctaagtacttactgccttacccaagaaaagctccgtgcgacccaaagagctgagaactcccccaccccgacctccgactcctaggacagtactactggcgtctgccttctgggtccagaaaactcttcccacggagccgtccctcggcggtgcttagccctccggatacccccgagacatcccagatggccccagtccggtggcgaagggagggtgcaggtcggcacccaggagacgtgggggtgaggagagcgcccctttgggcctcgctttgtgaccgcaggctgccccagccacctctctgtgtccttcccagcacagcgtccagcgaagtggggtcagtcgccgcgtccatccaggggcctgccctggggacacgtccctgtccctggggagtcctggccgtcggggagtgggcggtcagcggctgcattaggcgggagcggtcaacaggaggctgcgagggctccggaactccgctggtgggagtaggtgtcttctgtgcattttttttccaaaaccactttggccgttagatggctgtgggccggcactccatccatccatccatccatccatccacccacccacccacccacccacccaccctgggcactgggcttggagccgggaaccccactgacttggccctgctcttaaagaactgaaggcagtgaggtccagtgaagaaggcagccgtcgggcgtccccaggcctttgctgggctgggccggggagcctggccgctcaccggccgcagcgctggggctccggcgccctctggtggcggcgcctccctccccgctcccagagctctggccagctccattcctgcgcagctgatgaaacccgggagggcgaaggggtccgcgggaaatctacacccgggtggaggggcgccctggagctcggagatccgaccctgcgggagccgcgcgcagcctcgcttgcccttaaatctggccaaagcaaacgccatcgcctctcg

SEQ ID NO: 5387 - DNA, 2756 bp, Homo sapiens
gcgggagggcggcagcggccaggctaatattcgcgaccccgactggggcgcggcaacttctgccctcagtccccacaagctcccggccgcgattcgcggccgagaaattctgcggaggggccggtgggtcagagccaggccaggcagttgctgagccttcccctcccctcctggcgggagtgtgtgtgcaaggggccagggggcggagtcggagaaagggttgggggtgtccgtgtccagcgctcctccggacgcggctccacaatccagctgcgagaacagatggacgcagcggcggctcacctcgggggcttcctgctcgctgtgcgccgaggtccaggctgaagcggagatcgcaagcctctggctcccgcctctcccaaggggcctcgaggaaccggctgccgcgcccccttccccaagaggagaagagcgggcgctgaccccgcgagtcctagaaccgcgggcggggggcaggcagggggcggggggcagagggccagctaccggcgcggaacgcccatcccaggggctggttcaagacttccacaccgagagcccttcctgggcctccagccctggagcatctggagagcggacccctgcccggccacgccccgcccccggcccccgccccgccgacgtcgcattagcatgagcgacgtaagtggcccgggcaccactcgggggctgggactcgccgcgtcacagccccgagtggaagggaaaaaaaaagaggaggcggcggaggaggcaagagccgacgcgaggggaggggagcgcagcggcggggctaacgggcgggcaagcgggcgggcggcaacagcatgtccctcggccagcgcgggcggcctcttagcgcggcgggggctgctctgggcgcgccccgggcgaagtgcgcccagtctccggccccggcccctcggcgcgcccgacttcccggccgcccctgagcccagcagccgcgggtcccgggatcggctaagagtagctgcaacgcctcgccggacggagtcctttcctttcccgggacgctgggccatgagctccgcggccacctgaggcacaggggagtctgctcggccaggacagcctccccgaagtcccgtgccctcgcctctgcactgcgggacgccagcgctcggccctggcggaggcgtcctcggaagagcatcggggtgggggcatggaatccgcggaacctgcgggccaggcccgggcggcggccaccaagctgtcggaggctgtgggcgcggcgctgcaggagccccggcggcagaggcgcctggtgcttgttatcgtgtgcgtggcgctgttactggacaacatgctgtacatggtcatcgtgcccatagtgcccgactacatcgcccacatgcgcgggggcggcgagggccccacccggactcccgaggtgtgggagcccaccctgccgctgcccactccggccaatgccagcgcctacacggccaacacctcggcgtccccgacagctgcgtggccagcgggctcagcccttcggccccgctaccctacggagagcgaagacgtgaagatcggggtgctgtttgcttccaaggctatcctgcagctgctagtgaaccccttgagcgggcccttcatcgaccgcatgagctacgacgtgccgctgctgatcggcctgggcgtcatgttcgcctctacagtcctgttcgccttcgccgaggactacgccacgctgttcgcggcgcgcagcctgcagggcctgggctcagccttcgccgacacgtctggcatagccatgatcgccgataagtacccggaggagccggagcgcagtcgtgcactgggcgtggcgctggccttcattagcttcggaagcctagtggccccgcccttcgggggcatcctctatgagttcgccggcaagcgcgtgcccttcttggtgctagctgccgtgtcgctctttgacgcgctgttgctgctggcagtggccaaacccttctcggcggctgcacgggctcgggccaacctgccagtgggcactcccatccaccgcctcatgctagacccctacattgccgtggtggccggcgcgctcaccacctgtaacattcccctcgccttcctcgaacccaccattgccacgtggatgaagcatacgatggcggcttccgagtgggagatgggcatggcctggctgccggccttcgtgcctcatgtgctgggcgtctacctcaccgtgcgcctggcggcgcgctacccacacctgcagtggctgtacggcgcgcttgggctggctgtgatcggcgccagctcgtgcatcgtgcccgcctgccgctccttcgcgccgctagtggtctcactatgcggcctctgttttggcatagccctagtcgacacagcactgctgcccacgctcgccttcctggtggacgtgcgccatgtctcagtctatggcagcgtctacgccatcgccgacatctcctattcggtggcctacgcgctcgggcccatagtggcaggccacattgtgcactcgctgggctttgagcagctcagccttggcatgggactggccaacctgctctatgctcccgtcttgctgctgctccgcaacgtgggcctcctgacgcgctcccgttccgagcgcgatgtgctgcttgatgagccaccgcaaggtctgtacgatgcggtgcgcctgcgtgagcgtcctgtgtctggccaggacggcgagcctcgcagcccgcctggcccttttgatgcgtgcgaggacg

SEQ ID NO: 5388 - DNA, 990 bp, Homo sapiens; identical to SEQ ID NO: 5158

SEQ ID NO: 5389 - DNA, 829 bp, Homo sapiens
gcggtgcgacgaggtcaggcccgcgcccgccaagccctagggccgctgccgccgacggccatggaggacgagcagcccgacagcctggagggctgggcgccgctccgggagggcctcttcgccgatccccagaggcaccggttgcgcttcctggtggcttggaacggcgcggagggcaagtttgctgtgacttgtcacgaccgcaccgcgcagcagccgcagcggcgcgagggggcccggctggggctggagcacaagcccgaggccgccgtgtccccgcccagctgggccggccggctctcggccgcggggttccgcggcgcgcgccggcagccagcggcgctgtggccgcctctggaacactgcttcccacggctgccgccggagctggacgtgggcggcggcggggcctgaggtctggggctcgggcggtgggcgctgctctggccggcgcgcgtgggccccggcgaggcggcgctgcaggagctttgcgggcagctggagcgctacctgggcgcggcggcccacggctgtggcggcgccaccgtgcgcgacgctctcttcgcggctaagggccgcgcggccgactgcgagagcccgcgcgagtttcgggagcgggccctgcgcgcctgatgggtcgaggcggacgcgcggctgcgtcaggtaagcgaggccgggccgccggcgtttgaccgcgcttgggtggcctgggaccctgtgggaggcttccccggcgccgagagccctggctgacggctgatggggaggagccggcgggcggagaaggccacgggctccccagtaccctcacctgcgcgggatcgctgcg

SEQ ID NO: 5390 - DNA, 4119 bp, Homo sapiens
ccgtgatggtgccaaaccgagaggagagcccgagaagggggtgggtgatttcccggctgctccccatccccggcgccttgtgcctttttctccctccctctcccgctgcgcttcagccgagggctgctggagcgaatgggggatgtagaggaaggagtccgtaggtttccgtgccctcccaatcttctccgcctttcccgacagccgcgcgtccccgcctcagcccaaggccagtggcccggcctcgaggaaggcgcgggggccgcgagagacgactttccacagcatcgccaaggaaaccggcgtcgccggtgcccccgcgggcctccctcggcagtccgggggctgcttcccgccgttgcgcgccctcctccaccacccactcgctgcctccgccggccggagcccccgccttactaaccccctcaacttcgcgggcggcgggcaggtgggggcgcgcctccaggccgcaagaagggagcgctccgagattttcccggggtcggctctgcccaggagggagctaccgacgctttcccctggcgcttctccgccgctcggctctccaggcgcgcagctctccccgagagccccgaactttaccgtcactttgcccctgccccgggagaggggaggtcgaagtgctgccggccagagggcctacgcaagcctcgaaacccggggggacgcctcttccacccccatccctgcgctcgcccggggctgggcgcgccggggcgcacgcacgccggtttgctggcgacctggcgcatctgcccgcgcgccctggtctcagctgtcgcaggttcctcctgcacccacttccagtcttcaaagccagtgcagtcagcaccgtccacctggagccccaatcctctcctgcgattcccgcacacccactgcaccccatccaccacctccgggccgcgcaggtccgggcctgcgaagacacgcggcttacctccggccactccgttcatctggtcaaaggggcctcccagttcggcattgggaaagatggtcaccgacgtggcggcgaggtcctccaccgggtagatgttgtcagacagctggtgcacaaaaccactgagagttactgggattttgtctacggccttggcggtcatcatttgctcctcgcacaacctggagacccaactccctcgctacctggagtgtcagaaaagccgttttggagaggggttggactgagcctgggatggtatctccttttgccctccacacttaaaaacaaccaccacacacaccaagaaaaaaaaatcaacagaaataaaagtagcaaacaagttgctgttttttaagaaataagaaaaatgtctatttgccactgactctctcctgtctgtgttccggctgctgggaagccaggagttgctggtgtagtgttattataacagtcagtgagtcccctcgccgagctattaatcaattgctcctcgctcagttagacggaaagtgttgctctaagtatttatgggcaggtcttcaatacccgtgacgtcgctgcccatatatggactgaggaacagggctgggccaggcggcttttgccgtcacatggctgatttgcatacacgggctcggccgcgcggactccgccgggctcgcgacttccagctcgcaggcggcggggatcgctggggtcccgggcgcgcggccctagctgcagcctgggtccggggcgcagggatcgcgggggagagggcgcgccatggacccagtcacagccacagcaggagagcgagctgctccaggctgcggctcagcctcccggggcggggaggaattccggttctctgggactttccaaaaaaggcgaagatccggtgccggcggctccgcctccctagcccttgtttgggagccattccggaaaattaaacttcggaaagaaaccgagcggagccgagacactacagtcaaacccctactcactttcttggcagctcaaaaccgcaagcaaaaggaggcagcgaagaaaaaaaaagctacatgcattcacggaagctgactgcttttttctgaattacttggtggaaagaagtggctggtgataagagtgaatgcgtattgcttttttggaaagtctgttctatttatacaggagcgaaaacggaacaggtttgggttgtttgtttgtttaagtattttgggcaccttgggactgggagggtaaaccctaggaggagcagaattactgtggggagcttcgagagaaatcctcagccggagacaccctccttcctctgcccgcgcgctccccgccccccttcagctgctgcgcggagcgggcgcccttcccggcgcgtctgggcggtcggctgcgtgggggcgtccagatggaagcttggacactcaccctgcccctccagacacacatacacacacactcacactcgctccacttccgctacacactcccgcccccgctgccctcttcacacacccgctcacacaccttacactacacacctccctgttgactgcgtccgcgcgccgtcgttgccagcagtgtcccggcggcagagcgggctccgggctcgctggacaggaggttctatgaagacactggcctaaccttcactaccggtccctgcagccacagaatccccctgacccccatagcccaggatccaggaccgcgccctgcccgcacccgagccagaatacacgtactagaataaatattttctctccctccccaaaaaacacctcggtgagcccagcgcggtcctcagtgacggccgaaagcatctctaatcactttcaagacgccatccccatcccccaacccactcgttttactttgcgagaccccggtagaaacccttctgtttcgttcccaaagcaatttttaaaaacttttccaaagtccaaatagcagcaggttctggcttgctgggcgcaaagcttctacctcccagtgcgccccagcccgcaatggatagccgggcctgtccggggccccacaggaggctggtcccgggtgcccaagtccagcgcaccgccgcctgcatgactcattcatggtcgtttgtgcaggttgcgaactgccccagagccctttcccgctccaaagccgcggaggccagggataacgcgcagggtcagcctcgcaggcctgtcctgtccctttttcaccccgggcccggagcggccctagcttagtgtgggccggggcgggcgggagccacggcgccacgccgtggaggaagcgcggcgctgcaggcgggtcttcagccgctcacctgcctcgaccgctgcagccgtgcgccagctctcgccgggcccagcgcaccgcggtcagggccctgaggctgccgggagcggtctctccctctgctcttccactgaagcgctgcttctccccctccctccaaaacagccggtatccagcggccggccatctctctgacttaagtcacccagagcacatttgggaaagtttctcgctcgcgctgtgcgcttttttccaattggggatgaaaaggacatggaaagaaatcgcagcaaggttagcaccctagtagataccccaccccagcaaaaatgtgcaaagtcctatttctcaagaaagaaagaaagaaaagaaaagcaagaaaagatagctgcgttcttaccacgtgcgccagcccactccgcctgcgctctggcgggtcccgcggcccccgcgctgaccatgggcaagacgacgcctcggaagggagtccgactcgcatctcgggccctgagtccgaaagaacgggggaaagccgaattatgcaaatgcggatccctgcgatggggctcgggttacggcccccgccggccccttaggtgaggcacccaccggcagcaagcgcgggcgaggcgactgctcgcgcttcgctcctctctgcgcacgtgggcggaccggcaggcgggcgagttgcccgggccgccccgcgactggcgctgctgccaaacccgccggcggtcgccgcgcgccaccccgagggggagctcctggacgcccgagtgcccggccagcagggcgcggagggcaggaccggggctgggggcggggcggggtgcctgagcgagggaaaaccgcgaggtcttcggctgccacctttcccg

SEQ ID NO: 5391 - DNA, 1575 bp, Homo sapiens
acgcgtccatggaaggtggtgcccgcctcaccgcctccgtggaaggccaaacgagccctcggtgtgaatccggagaaagagagggaagtgcagcgccagctccactccacacccccttcctgcctataaataaccccaagtgtcacttcaaagaggacggggagcgcggcagaggggctcccgggccggcgggctggggccgccggacctgctcaccacgccccccaccctgggcgagtttgcataaataaacaaatccaagccgtcggccccgcgggaggtggaggaggagtgacgaggaggaggaggaggagggaggggggagggagagattagtttgggaagtagcacggattgctcatccgatccgtgccgccgcagggagtgtgtcaagttacagaggcgccggaatcggcccctgcgctcctcgccagccgccacgacccacctctgcccatggggccctccgtgtgcgccccttcgcccggggactgaaactgactggcccgggagacacgaggcgcccagaaggactgacagcgcggcaccaactgctctgcagacacttgaagggaaagactgggcggagagaaggagagccggtcagattcccctaactttcctggacttggaacgttcttcgaaataacttttttctcacctaggtgtaccccaattaccgctggttgtgctttttcggcacttcctctcctactgctaatttttccgtcctctttgccgggagcagcggaaagggacgttttccagcgatacaagccctttccccctgccccgcagtttggatagagccttttggcagcggctgtcgcctttatttattctatttatttatttattggttctcaagacgcgagaggatggtagcggagcgcacccacaaagcggcagccaccggtgcccgcggccctggggagttgggcgcgcccgggacggtggctctggtggcggcgcgggcggagcgcggcgcacggctgccgagtccagggtcgtgcgggctgctgacgctggccctctgctcgctggcactcagcctgctcgcccactttcggacggccgagctgcaggcccgggtgctgcgcctggaagcggagcgcggggagcagcaaatggagacggctattttgggacgagtcaatcaactgctggacgaggtctgtgctctttgttgctggcttttatccctccccgcggcgccccctcgcgcagcctccagactgttcagccggtgtccgcgggcgctcgctctctgcgagccccaggttcgcgcgagttgcctgcgggaggggtcggggacacggacagacgctgccctaccagggattcggaggacctggtgggcaagagcatgacccagcgactcccgcctcgggcaagcgcccccggcttccagcgctgggagcgccctgggcacgccgggcaggtggaggaaggctgggcgcgcggaggctcgcggaggcgggcaagctccactcctccctttcgggacccggccagggtggtgtgacagccgccccgcgcccgcgcagcggcaagcgcgcccagaggcccaggccg

SEQ ID NO: 5392 - DNA, 2401 bp, Homo sapiens; identical to SEQ ID NO: 5168

SEQ ID NO: 5393 - DNA, 1579 bp, Homo sapiens
ccgaagtcggggagcgggagcgtacgtgcgcgtgttcaccctgtcctgggcccctcgctcggggaatcccgggggtgccagggcacccagggtcagggaagtaagatgccgggccgcctaccttctccaccccgtagcccgttccgaaaatcctttaaaccgagatttaatctggatgcctagccccgccctcccctcccctcccctcccctccccccggccgaggccccctccagttcagctccctcctccaccccctccccgccgtggaccctcattagcatgcccacttgggaggattcgctggggggcgggagacacccgaagtcatccaccgccagcgccttcccggcggcctcctcgggcgacagcgctccgggagccccactcgcacaagtgttgcttccaattaattgcctgggcgggggaaggaaaggggcctcgtcgccgcccccgcccggaggctggagtgctgctcgtcgggtcgtgcgttcgctcggcagcggcgtgcaccagcaccacccctgcgtgcaagtttgaaatgtgagctgcctccgattcatactcgctcgcgctccctcgcagcgaagtggctgggctgacggtctgcgcgcgcgagtgagtgcgggcggcgggctggggggcggggtgcggacggcgaggctcgcggggcggggagggcgcgcgcgagccggggctccctggagacgccaaggcaggtctgctcgcctttcatcttcctcccgcgctcctcctcctcctccctcccctccccccgccgcggctggcctggcctcccccggagcccccagccccacgcgggcacacgcagggtgggtggtcacgcccgcagggtccgcgagcgcggcgcagagcgcgggccgtgggaagtttctccggcgcgccccgtgcgcccccgccccccgcgcgcccccggcccatccccgtccctggagagctgtcgcttgcgcccgggcgcgcggctggctgcctcctcggcggcggcggcggcggccccattagcggagcctccgcctatgattggcttcgcccgggaagctggagacgggcgatgaataattgatgtgtgcggtgcggtagccggacggcggcggcggtggcgggcagcagcgagcgggagcgcgggagccggagcgccctcggagcgggcagcgcggagcgagcgggcgccggacccgcccgggcccccgcgccgccgccgccgccggggcgcggagcggggatgcaggcggcgcccgctgcctgcgcgcagcctttgttcggcgctggctgaatcctacccggagtcgctcgccgcggccgccgccggccgggccccaagcccccgagggcgccagggcgggatcgcgaccggtgcaacttctaggtaagtgcggggtcggaggggtcggcgcctgggcgcccacgggccgggccctgggctccctccgggcgcgggggtgagtgtgcgtgcctgtgtgtgacagaggagggccggtgcattgtgggtagcgccgtgtgctgcatggtgtcagccccaggcttggccgcgagagtggcaccggcgtgcaccgggccg

SEQ ID NO: 5394 - DNA, 919 bp, Homo sapiens
ccggggcgctcagtgtggttttcccacccgggagtctggaagggtctcccgcagcccgcaggagacgcagcgctccccgctcagggggagcaggaggacagctggccgctttcgggagccccaggcgcgaagcggcctctctccgcctcaggtgagtcctgctcgacgcccaaggcccaacggtcagaaccgcctctgcccgccggacccagcgaagctaggggaacaaatcccaaaaacagttcgggcctttccggtgcgctcacccctacacacgcgcctgctcgccacccaggagcggcgtcccgttgccaggcaacgagagctcgcgcctcaggagccagtgtaggcgccgcaaagcggaaggggcgcgcggataggtgagcagagggcacgcggtgggcagcgaagggggaacgcgcagcagagaggagagggcgtgcaggagtaggagcaggcggcagagtagagggggcgcggcagagtagagggggcgcggcagagtggagggggcgtgcaggagtaggagcccgccgcagagtagagggggcgcggcagagaggagggggcgtgcaggcgcggggcgcccggcagagagaaggggtcgtgcggaagggggcgcgcgccaggggagggggccagagaggagggggcgttcaggagtcgggcctgcggcagagatgaggcggtgtgcaggagggagagcgcgcacgagggggcaacgggcagagaggagagggaatgaaagaaggggagcgtggcagagagaagcgggcgcgctccagggggcggggtccagggaggagggggagcgtaggatcggggcgggaggcagagaggagcgggcacgcgggacgggcgtgtgctcgtgaggggtcgaggaaaggcgtatgtggaggcgcgcggggtgggtgagccg

SEQ ID NO: 5395 - DNA, 944 bp, Homo sapiens
ccgtcggagcgcgcggggacggcggcggcggcgctacctggaggcgcggtggcgggcaggtgcccgaactgcacggcgatgcagaggtcgttgtccagggggaacttgtggcagtgcagcatctcaggccaggggaagccgtaggcctccatgagcggcgcgcagccggcgcgcacggcctcgcacagcgagcggcacgggtagatgggccggtcgagacagacgggcgcaaagagcgagcacaggaagacctgcgtatccgagtggcagcgcttggccagcagcggcagccagctgctcgcctgctgcttcacttcggccaggctctcgtgctccagcaggttgggcagccgcatgcgcttgtagcccaccgtgtggcagagcggcaggtcggcagggatgtcaaggcactgcggcggcttggagtaggagcggccgtgcagcggctcggcctgccagccatagtagtcgtactcctcgcagcgcgccggcgcccagtgcagcgcccccagcagcagcgccagcgcggccgtccgcacgcccccccccgccgccgccgcccgcatggctgcgccctctccaggtgcgcgccgcgcagccccccgacgctcggtgcccggcggcccaggtgttccggcgtgcgcccccggccctgactctacccagccgccgccgccgccgccgcggaggtcgcccaggtgggtggcagcctgcgctgcgggcgccccgactgatcctggcgcctcccacctcggggctccagcccgggcctcgccgtgcgccccagccaatctccggccgcctggccccagctccaaggcggggaggcagtgggggcggccctcagcccctcccgcaccctgcccgagcgtcccgcccagcgccaggtcttgcgcccctctcccggctcggctcccctgccgcagccctggcctcgcccagcg

SEQ ID NO: 5396 - DNA, 1096 bp, Homo sapiens
tcggccacgcgctgggtccggggaagaggcgcggccgcggccgaggcggggacagggaggcggcagcccctcctgcgcagcgacggcgcgggcgggcggaggccggggcgccccagccccccgcccccgctccctccggccgtgacgtcagagccggacggggtaaactgagcggcggcggcggggcgctggggcggagactgcgacccggagccgcccggactgacggagcccactgcggtgcgggcgttggcgcgggcacggaggacccgggcaggcatcgcaagcgaccccgaggtaacacggccccggttccctgctcgcagggcgcggtgccggaggggagcgggcccgggggaggcagggaggcagggaggcccccagagctacgcgggcggggctgcggggaccccggggcagccggggcgcagggcgcagggcgcaaggtgcacggggccgagcgtgcagtttgggaggtggcacagttgggggcggcggggatcagggcagcgtcctgggggttctaggttgggtctccagattgggtccccgacggcgctcgcgggcgctctttccagggagcgcgggctctcgtggggacgcgctcgaggcaggtgagccgaggctggggcgcccgggggtgtccccggatgccggtgcgcgcggctccctgacccgcccttccgcggcctgggggacgggagaatggggggtccacggccgccttgggtcctcaccgcgcaccgcgcccgcagcggagccccggagccatggccctgagcgagctggcgctggtccgctggctgcaggagagccgccgctcgcggaagctcatcctgttcatcgtgttcctggcgctgctgctggacaacatgctgctcactgtcgtgggtacgtgcggacagggcacccctgccccggcaccccagccccagcgccccttccccggcactccacttacccctgcgcggtcccggagctccgccaaggcccgggaaagttggagaactcgctttgcaaaaaagacatcccctccaggctgccgcgccggggctaggaggagccgcgttgtgtggcttcgctttcctgatgctcg

SEQ ID NO: 5397 - DNA, 4048 bp, Homo sapiens
acgctagagaccgtggggcgagagagggagagagttggaagcccactgctccggcggggtcggcagctcccggtctcaactcgcaaacgaacgagccgggtcaagaatcgcgaacgcaccgaccctgggacctcgaggctaagcgtggttgatggggtgggaggaccccgtacccctcactccaggatccctcctggcctaggaaaccgctgggagttttgctaagtgtggggattggtataaccgaacggcgcctttagcccgggaaccagcccctgcccgcttaccctcgcggtgctcttggggcgatcccagttctcccgacgcggggccgcgtaaggcagcagcggcggagcgctaggctagaggaatctgtctgtccttctgtcctaccagcttgggcgaggcaggctcgggattcagggggccgcagcggaggcggcgccggccagggactctgcagggaccggggtgccccggagggagtggtgctggtggaggaggaggcggtggctgagggggagtaggtggggaaagaggaggaggaagaagaggaggaggaggaagaagaggaggaggaggagaagaagaaactggaggaagaggaggaggcgaaggaggaggagaagccgcagcgggcgccgcaggagcgagtgagctgggagcgaggggcgaaggcgcggagaagcccggccgcccggtgggcggcagaaggctcagccgaggcggcggcgccgactccgttccactctcggcccggatccaggcctccgggttcccaggcgctcacctccctctgacgcactttaaagagtctccccccttccacctcagggcgagtaatagcgaccaatcatcaagccatttaccaggcttcggaggaagctgtttatgtgatccccgcactaattaggctcatgaactaacaaatcgtttgcacaacttgtgaagaagcgaacacttccatggattgtccttggacttagggcgccctgcccgccttttgcagaggagaaaaaacttttttttttttttgcctcccccgagaactttccccccttctcctccctgcctctaactccgatccccccacgccatctcgccaaaaaaaaaaaaaaaaaaaaaaaagaaaaaaaaagaaaaaaaaagaaaaaaaattaccccaatccacgcctgcaaattcttctggaaggattttcccccctctcttcaggttgggcgcgtttggtgcaagattctcgggatcctcggctttgcctctccctctccctcccccctcctttcctttttcctttcctttcctttctttcttcctttccttccccccacccccacccccaccccaaacaaacgagtccccaattctcgtccgtcctcgccgcgggcagcgggcggcggaggcagcgtgcggcggtcgccaggagctgggagcccagggcgcccgctcctcggcgcagcatgttccagccggcgcccaagcgctgcttcaccatcgagtcgctggtggccaaggacagtcccctgcccgcctcgcgctccgaggaccccatccgtcccgcggcactcagctacgctaactccagccccataaatccgttcctcaacggcttccactcggccgccgccgccgccgccggtaggggcgtctactccaacccggacttggtgttcgccgaggcggtctcgcacccgcccaaccccgccgtgccagtgcacccggtgccgccgccgcacgccctggccgcccaccccctaccctcctcgcactcgccacaccccctattcgcctcgcagcagcgggatccgtccaccttctacccctggctcatccaccgctaccgatatctgggtcatcgcttccaaggtacgtgccacgtcgcggaactgcagcgcgccgctcccgccgcatccttcactgcccccggcctgctccgggtgggcgcttggcaaggcctgggcggaggttcctccggctcgcgggccagcgcgccctgttgggaaactaggcggcgcggggccgggcgtggtgtcgatccccagtctccgaagctacgactggtttggagtgatggcctgcgggccgcttgaccctttgggaaggggtgcgaacggagaagttgtcccccagtgcgctcgaatcagagcaggctgggctgtgcgtgcccggcgccgcggagcccagagcccgcgggatccccaggctcctggtaccctcggcaatgcccccaaccgtcctggctccgaggggcgcggacaggactcggccgccaggcttgctttcgactgcgttcgaccctgttcaccacccactttgcgccccttcagtccagacccgcggcttcttagtcttccaccctcttctggaggcgagaggatcctcgcgccccgggagaaaagtatgggatttgttttttctttcctgcttttcggaggcctggggaggggcgggaacccgtgcgggaggaaagctccagggcttggcgctctcgccgcgacctgcttaattggggcgccgagcagccacagcgggaaggcaggttcggtctggtttttgtttttctttctttctttaaaaaaaaaaaaaaagaacctggtcaggaaactgtcttagagggaaatatctgttcgtgtgttttcatttcttgcgatattttttatttgtttgtttttctctgggtacggggtgggaggaggagagttaaaacttcagaaaaaggagtaattagtttacggattggagtcagtaaaagacctacctccggcggcagccgatcaatactccgcggcttgtccattcattaacccattgcgttcctgccggagcctagaatcgggtagatgtcacccccctccccatattttaaaaaatcaaaccaaaggaaaaaaaacccaaaaagccttttacccttaatcccgaactggatttgcctgcatcctgcctggactgtcggcttgtttttctttgtttgggttttcggtgaatcgatttcctatgctaatgagtgaacccaaaactctgaggctttgcttgaaaagtttagggctgcccttcctcattcgctatcagtcatgcttatggtcccctcaccagacccggagccgctgggatcttcctgcgttacagactgtcctggcggtgtctgcaagtcggtaaccccccgggtttcgatcccttcgctcgcgtttctcttctagttctcgggagccgggagccccggagcccagttcgcgagaggcagcagcggctgtagccaagcacacccgccggccagatttctgtcccgatcgggcttcaacgactcgccccgcctctatacttttccggaggggcaataaaacaaataatttaaaaataaatctccatgaaaactctggagagcagcccgccgcctttccaccgtgggtcaaagttccccgagaggttagaaagaagagaaagtagtttcttcgggttgtgggcgccaatcccctggccaggctctgcggctccctcccctgcctccagcgcccggcgaggaggtggcgaggcccgcggcgccagggcggctgcggagccggccgaggtcaggagcctggggactggctcctctgcgacagcggctggttgggtgccgcaccggtggagacccggcgttccgggccgggcagctgagcaggcgttcccttcgtgagcccttgggaggaccaccggcccccgcaggtcgagcggcgcggctatgcgaaggccctgagcacggtgccgggccagcccggctcgggagaagtgcgcggctccggtcagagcagccccccctaatgggatttctgctgtgctccccgcagggaacgacactagccccgagagtttccttttgcacaacgcgctggcccgaaagcccaagcggatccgaaccgccttctccccgtcccagcttctaaggctggaacacgcctttgagaagaatcactacgtggtgggcgccgaaaggaagcagctggcacacagcctcagcctcacggaaactcaggtgactgcggcccgggcgcgaggaacccatctaggcgtgcg

SEQ ID NO: 5398 - DNA, 3292 bp, Homo sapiens
tcgctgccgtcgagacgcgcagcggatgccgctgcttgccgcggcggaggaagctacgccgctgcgccttcggttcaccttgcccccattaaagcgttagttagacagctccaaacgccagctggccggagagacttcctgggagaaagtgctgtcgtcggggtcacagactcggagttgatccgcgagccttgggcaccggcggccagagcagaggggtgcccttccgagagcagccgtcggtgccgagaagctgttgccccagcagccccaccgagtgacgcgcgggttttggccgggtcagcgcgcatacgcacacaggcacacccactcctggtcccgggggaaggctcactcttcggttttccagggctaaaggccaaggccacgcggatttctgagtccgaagacgcagtgcgaggacttacacctggattcccttactatcggctggatggtgggtggggaacccaaatccctctcttcttggcctcgcccttcctagcaggctttaggaaaaataccgaggtcgccggaccccaaagggtaggaaaatgatgagttctccgagggccgaggtcacgtcctgcctcttgggccggcgctgcgtggctctccagctgcgtgggggcggcgggcccctgtccagccccagggggcgggggagcggcagctgcgagcgcagataaccccgaggtgacccgggagggcctggtccgcccctcccccctcccgcaggcctggcggcgggaagcgggtccctgcgccgcaggggggagaggcaggcgcggtctccgggctcgcggccgttagtgcgcttcggccaagggcgccgcctgctccgcgtccctcgctcgcctcctgcgctcgcaggagcgctccgagtgcctctttagcgggagccaatatccttttgtgctaataggcttgtcctcatttgctgcctaattggactatataaagccaataacgggcgggctcttatagcccgaagccaaagcgccaaaatccgagggaaggcgaggagggggcggtggcggaggcggctgcggggccggggctcggctgagccttcgcctgcctaatcccatttgccattgtacgcgcccaatcgccgtatactccccgcatttaacttggatgacattttgatttcatcattagcatccggcgccggattgacgcagcctcgagccggggactgctcttgctgcctcctccgcgggagccgcagccgcagccgagccgcctcgatccctcggtgccgcggcagggccgctccccgcccctccgcacccctccctcatgcgagcccgcccgtctgggtcctcactccgccctcccgccgttggatttgcgcccggggcggcccccgactttgcgccccgtagttgagttccgtttatggtctgatttccggcctctcgcctgctcgccccgccgcccgcctgtcccgctccctccctcccggggacccggaggagaggggaccatgccggaacccgggccggacgctgccggcaccgccagcgcacagccccaaccgccgccgccccccccacccgctcccaaggagtccccgttctccatcaagaacctgctcaacggagaccaccaccggccgccccctaagcctcagccgcccccacggacgctcttcgcgccagcctcggctgccgccgccgccgccgctgccgctgccgcggcggccaagggggccctggagggcgccgcgggcttcgcgctctcgcaggtgggcgacctggctttccctcgctttgagatcccggcgcagaggtttgccctgcccgcgcactacctggagcgctccccagcctggtggtacccctacaccctgacccccgccggcggccacctcccgcgacctgaaggtaccgacctctctttgaactttcgttgtccccctgcgcgcccgccccgtccccgccccgcgctgcttccctccgcagttctgggaccccagcacccgcaaaccctctgctcggtcagtttttttcggcccctagcctgccctcgcgctgggttgcgctgcccgttaatccaatcccacttggtgagaaaagaagtggaattggagccccgggcacggtgcttcccgggaaaagtggcctcgggcgtgaatagggaggcttcggacggccggggcttgggacacggcctggaaggagggggtgattccaatgcgcctaagccgaaagggaaccgttctgccggcccctggcgaggaagctgagggaatggaaggaggtggccgcgctaccaccatctgcttgcctgtcctcgggaggagggggatcccaggactcggcgtcccttctctggcccagccgagaaggaggcagcccgcgggaatggtgaggcctcatggcctgggacctggaggccggcgcgggttgagcctgccgtccccaggcgccgggcctcgctcaaggctgtgtcggtgtgcatgtgtgtgcgtccgtctgtctgtctccccagcctcggagaaggccttgctgagagactcctcccccgcctccggcacagaccgcgactctccggagccactgctcaaggccgaccccgatcacaaggagctggactccaagagcccggacgagatcattctggaggagagcgactccgaggaaagcaaaaaggaaggcgaagcggcgccaggcgcggccggggcgagcgtaggggcggcggcggccactccgggcgcagaagactggaagaagggcgctgaaagtccagagaagaagccggcgtgccgcaagaagaagacgcgcacagtcttctcgcgcagccaggtcttccagctcgagtccaccttcgacatgaagcgctatctgagcagctcggagcgagccggcctggccgcgtccctgcacctcaccgagacgcaggtcaagatctggttccagaaccgccgcaacaagtggaagcggcagctggcggcggagctggaggcggccaacctgagccatgccgcggcgcagcgcatcgtgcgggtgcccatcctctaccacgagaactcggcggccgagggcgcggcggctgcagccgcgggggccccggtgccagtcagccagccgctgctcaccttcccgcaccccgtctactactcgcacccggtggtctcttccgtgccgctgctacggccggtctgaggccccagaggggtgggggagggagcgcccggcctccttgtccggaccccggaggagactgggccgggccgagggcgccgagaagtccagcggccttcaggaactggggcttgggcgcg

SEQ ID NO: 5399 - DNA, 3753 bp, Homo sapiens
gcgcggagacccgtcgcctgcggaggcgtcgagccactccagctccgagtcccgcaccgcccctgcctctggagagaagggtccaaggggtccaaggagtcggagttgccgcagccgccaggaacccgggctagaatctgcagctgctttcagccctggctgcccctggttagacgccgctgatgcccgccaggccctcggcgcgctctgggggcgcaccggtgctgtgtgcctggccggagcgttttgaaattttccggggccgctcggcggcgctgcgattggccgcgttcgggtaacctctatgcaaatgaggccgcgccgcctccgcgccgccggagacccggcgagttggcgggcgaggaaggggcatttgcaccggggctgggcgggcgcacccagagccaggcgggcaggaacccctgcgcagccatccggtgcctgcatgtccctggcgcggaagggacgcctcaccagcctcggcgccccctccccctagatttcctccccgcccctccccactgcctgcctgctgcaccaccttccacccagatcacccagatcgtctctaaagggagttcttggtttccttcgatttcttatgaacccaggatgggcagcaaagaagatgcgggcaaggggtgtccggcggccggtggcgtctccagcttcaccatccagtccatcctgggcgggggcccctcggaggcaccgcgggagcccgtcggctggccagccaggaagcgcagcctgtccgtgtcctcggaggaggaggagccggacgacggctggaaggcgcccgcctgcttctgcccagaccagcacggccctaaggagcagggccccaagcaccatccccccatcccttttccttgcctgggtaaggatcgcacgtcgccagtgtggcagcgagcgagcgcgaggggagggaggctgagcgccccgccaagactcccgcgccgggccccctctggccagagctgcggcagccgggggttcgggaccgcggggagaggggcgcgcactgtggtgcctcctccgcccggtgggcccctgggagcaggcgaacacagacccgtgccggcttgggcttcctggggaaggttgagttgttgagagagtggaccacagcgagagggacacgcggccggccttacacccggctgtcctcaatcactgcacatctggtactttctttccggacacgaggtggagatctgcaagtcgggtctgggcagtctgtctccaccgtaatctctttctgagtcttcttcctcactcgctccgtatctctgcctttctctctctctcctccttggaatgattagcactccaagatgattgacaatggtgcatttcagagacggttcctctttacaacatttgacgaaggggagtcctgcgttagtccttagcgtgatttccaaacaaacggcctgtgaaatgatgccaccctataaagctcgaggaactcttccagctcaattaccaccaagcaaattcgccttttaaaaccatgctaatgtttccccctccagacctcctctccctgttgcccctggcccattcataaaggtgggagcacagagaccccatactccaagtagctgggtccctctcttgtcgcttttaaaggacggggtgctgggtttggggggccagtgagagggataagaggaggggattggtaaggtgggaccaaggctgcaggcgcttgccaaccgcttggtcccagggagagctggcggtctccgaggctccccaaccaactccatggcctttctgtctgttctcgctcctcaggtacccccaagggcagcggaggctcgggcccgggcggcttggagcgcacgcctttcctctctccttcgcactcggactttaaagaagagaaagagaggctcctgcccgcgggctcgccctcgccggggtccgagcggccgcgggacggcggcgctgagcggcaggccggcgcggccaagaagaagacgcgcaccgtcttttcgcgcagccaggtgtaccagctcgagtccaccttcgacatgaagcgctacctgagcagctcggagcgcgcctgcctcgcctccagcctgcagctcacggagacccaggtaaagacttggttccagaaccgccgcaacaagtggaagcggcagctctcggctgagctggaggcggccaacatggcgcacgcgtcggcgcagactctggtgagcatgccgctggtgttccgggacagttcgctgctgcgcgtgccggtgccgcgctcgctcgcctttcccgcgccgctctactacccgggaagcaacctctcggccttacctctctacaacctatacaacaagctcgactactgaccggcccgccgccccgcgccgcccccagctgcccgcagagccgggcgcgtactgtactgtaagcagggctccggagcaaggcggcgtgtttccagaaatatgaagaaatacaccatgtgtattcattagctcttatttatggtctctgccctactttttgttttgattgtttcgggtatttattggcattccctaagtcagagagcctgcttcctacctagaccgaaccagtacgctttgaaaaccattcggagtgagatgttctcgggtggtggtgggaaagggagttttggccagacaggctgtggttggtagggaaaaaaatcaggaaaacacctacaaaaccaggtacactcctcccccatatatacacctgtatatatgtacatgcatacacgctcggccaagccaggccctcagaggctttggacaattactaaattgcttcttttcgtttccctcatcccgaggatggtagggacgaaaaggggagagttcagatctgtaaatatttttaaaaagaaaaaaaaataaaacattttaaacatctttgctaactttggtgggcttggttacccggcatgataacgcacggaaggttttcaggtttttcggtggaaagacttgcatgcgtctgtctgtggaagtttggctcgctccacgtggagggtgggaccggggtcaggggttaaaggtcgggaccttggcgccgcccagactgcacgtggctggagctgcccgcccactctccctcctaacgcccagaatcgtcgcgcgggctggggcgcaccccggctggaatccagctcaagagtccgcgcggagaaagacaaagactgggaggcaggcctcgccatttaagcgattgccttctgggaacaagcgagctgggtgcccagcggcatattcccggcactgggctcgccttgagcttggccacagcagctcccgctatgacatgccctgtgccgcgcacttcctctccaggggtataaagcaggcgatggcgctgcttgtacctagtaaagcctccactttgctcgccgcgagcttggcgcgaccagcttgtcgctgcgcccagctacccggccggtggcagagttatgtgtctcgcgcggagagggaactgggcgcggtgaggcagttctgcggctcaggagagatccgaggcccgggaccaggcaaagaaggtgagggaggcaaaggcgcttccctacactcttttgttgttaatagtttgcattggttcagcgtgtggctggatcaccggctagcacgcggccgcttgctctgaatggaaccttgacgcgcggcgggggcgcccacggacttcctcgccctgacacctgcggccgcgcaggggctgggagggcgctgcaccgagagaatagccgcg

SEQ ID NO: 5400 - DNA, 829 bp, Homo sapiens; identical to SEQ ID NO: 5389

SEQ ID NO: 5401 - DNA, 1328 bp, Homo sapiens
gcggggccgctgcgcgcccccctaagtgtgttagcgggggaggcggggctggaaaggaaacctggtgaagggctggcccggagcctggggtggggatattcactgcgggatagggccagcaagaggacccgacacgcatcgtcccgagtgacacgtgtaaatgtcaagatacagagacatctgcaaatgtcacccaagagggtgaggacgggggagcggtcccgaggctgtgccctccggggcaggtactggctcctgtggggctgcgggccaagtgtcgcccttccccaaggaattggcacctggggggggggggtcggtctcgccgcgctggaagcgcaagccccggggctccggagatgcgccggggcgcgtcgcccctcggggcagccctggacctcggcgcgcccaggcgcagcgtgcggtgccctcggcggggcgggcagcgagccgccctagttcggcgacttacctcgggcctcgcagggcgcgagcagagcaccggccagggcgagcaggagggcgcgggcgggggacacgggcagcgggcgcgctgccatcgtcgccggccttcagtgcagcagctctcgggcccggcggcgagcgctgcaccatcccacgcgggcgccgagccggggccgggcgtcgcgaccggagggatttcctgcctcggcgagtcagctccggagccctcgcgcagcgcccgcgccgccgctgagctcttctagcctttcatttttaaaaaagtttccccccgtgtgtgtgcgtgcgtgcgcgcgcgcgcgccgttctggcacaagccagccttgaccgttgcaataaatgagcaaactgtccgagttggcccggggactaggaagagcgttagtgagagaaggcaggcctgtgaaatggatccacggccagcagtcaccgttcttattaccgcggaacaaattattgtctcccccgcacccccgccagttggcggcgtcccgcgggtcctagagaccgctcgggtccccccgccagggtcccgccccgagccgcggctcgctcacccccgagggtgggcggctcagacgtggctcagtggcgtccgggcgcccggagcgcacacgtccccgccccaggatgatgtggccgcagggcccggggcgcccggctgccaagcgcacatgcggcggcacggtccagcttttcaggctgaagctggaaacgatgactctgctactcgctccccggctctctgggaaccctcggagtgcgggtcaggtctccaccgcggcccacagcccggcgcgcgaccccgcccggccctaagcgcccaaaggggcatctctcgcccg

SEQ ID NO: 5402 - DNA, 2957 bp, Homo sapiens
tcgcctctttcgcacaggtgcccgactcggagtccgggaggcgggccctctttccaggtacccagcccagcgtcagcctgggtccatcctccgccaccccacagcgcggggagcaggggaggccgaaagccgggcagcttggggggccgggataacccgggctgcagcaaccccgggcggcagcaggactggagagctggtgtcggacgcactgcagagacgtccctgttttcggcgcgtcctccgacacccagcagagagcttggcgctctccgctctgcgcgcccgaggtcacagcgcggagaaacctggcggggccccggactccccggcttgggaaaagcgatgactgccctgaactgctggggcgttcgaaatttccagggtcccgaccctccgtggggtacgcgcgacttcggcgcagatgtcagtccgctgccttccgggttgagggagcgaggactccagacgaccccagggccgctgtccaggcccagccccgcgttctccacctcgccacctcgctctgcggctccagcctggagatctacggacttcattgcgatctcttgcgcagtgtagtcgccctctatccctagccccgagtcccgggtaacccaggggccccggcgaggcgagtttctttggggcgagatgtcccgagccgagcaaaggggccgcgcattggacggggctcccaagccacagccctgggggccttgaggagtcgtggtacggtccagggcagtcggggctgcggggcccgtgaagccagacgaggctacggacttagggtccctgcaaccaagaccgcgagcgactgtggactcgggacggatcgcacaaaggaggaagggggaatcagaggggcgtccggtccaggacgtgtcaggcctgggcggggcggaaaactgacaccagggcgaggacaaggatttcgctcctccagggctgccaggggaggggctcgccaccgtcactctccatgggctctggccccgacggtgtttaaagggcggagggctgggccgggctggtcgcacccgggcgctgctggcggccaagctggatgggtcgccagtgagtttcggtgcggcaccgctggcccaggcccgggcgcggctggacatggccacctactgcgacgacctgggcccctcctcggccccgcccggccaggcccaggccaccgcgcaccccccgggctatgagccaggggatctgggcgcggtgggcgggggccccctcctgtgggtgaacgcgccagcgctcagccccaagtcctacgcttcgggtcccgggcctgcgccgccctacgcggccccgagctacggggctcccggcccgctcctcggcgccccgggcggcctggcgggcgccgacctcgcctggctgagcctctccggccagcaggagctgctgaggctggtgcggccgccctactcctactcggcgctcatcgccatggccatccagagcgcgccgctgcggaagctgacgctcagccagatctaccagtacgtggctggtaacttccctttctacaagcgcagcaaggcgggctggcagaactccatccgccacaacctgtcgctcaacgactgcttcaagaaggtgccccgcgacgaggacgacccaggtaacagcggcgcgccggctcgctccgtccaggactccccatcttcccgccgggccgcgggcactccgggggtgggagcaccttagacaacctaatttctccctgcgcggttggggatacccggggaggagggagaaggggaagaagtgcttgggcatggacaggttctcagacagcggctgagcccaccacaggcccgcgtttacagtgcggcggtcccggggctctcaatctctgtgcgctccttcggaggaagaagcgggagagccagcaagctgggtgaccttgggagtgactcaacttccctgggcctcagtgccctacctggtaaaatggggaagacagcgcctaccccaaggatgggcaaaacaaataggatgcccgtttggaaagctctggagcctacctgggggcctggcgtggtctgcgctgtccttggcagagcggctggcggagtcccaccattagcatctcgcaggccttccttcaccttaacggggctcggcctttcccagggctcccttcctcctcctttctggattgtcactttcttcccagtcctgctgtggaggcccatcgggtacagagtgcccgtcaagggtggaatgggggcgaggactcagaccctctgtaagggccagcaggggatctttctgaagctgacctcctcgctggctcacaccacggcccgtcaaagctcgaaccttctgaactgggctgtttcttcttctgcaggtaaaggcaattactggaccctggaccccaactgcgagaagatgtttgacaacgggaacttccgaaggaagaggaagaggagagctgaagccagcgcggccgtgcgctcgggagccaggagcgtgggaggggccgaggcgccagcgctggagcccccgagcgcggcttgcctggacctgcaggcctcgccctctccatccgcacccgaggccgccacctgcttctccggtttcgcttctgctatgagcgctctggctggcggccttggcaccttccccgggggcctggcgggcgacttttctttcgggaggcggccaccgacagtcgccacccacgctccccagacccttaacccctcccctggcttcgcccctggccaccagaccgcggccgccggcttccgcctcagtcacctcctctacagccgggaagggaccgaagtttgaagggaggctggaggctagccgggtgcgggtccagaggtgctgagctcaggcctccggtttcccctggtgacagccccacgtgttggcgttgaaggccttggtgccctgggaggaagcgcagagccgggggcggctcg

SEQ ID NO: 5403 - DNA, 1860 bp, Homo sapiens; identical to SEQ ID NO: 5175

SEQ ID NO: 5404 - DNA, 1422 bp, Homo sapiens
tcgtgcagtccgcccggcggcgttttcgggcgagggtctggtgctggggagcgagcgcggagcgaggtgtctctttaaatacgctctgcagtgtgacggcggccgcccggctggaagagccatccccaccctgcggcaggagcccgcccgccgccatcgcccgccccggtccccatggttacgcgcctgcctccggccccgggtccccgctgtcgccgcgggaggtgcgcgcagaggcggcggcgctgctggccgggctgggccgctcgtgcgcggggctgtgactcaccggccggcgccgcagccccgcaatctgttgataactcggtcccagctcggccgctgccctcgcgaatggagagcgggtccccggcggggggagcgcagcgcgtctgtctccgggagcgcggcccggccgccccggcagccgcttcggccacagcaggtgggaaggacgcgcgggtctgggcggcgggagggacgcgcggggccgcggctcggcagaaaagctcgcgccccgaggtgacactggccgcgaggaaagcagctccgagtaactttcggctccgctggggcgggaggcgccacggataatccagggcccccgccccgcgcgcccggcccggagctcgagccacatccaggcagagcaggcgccgcggccgggctggggcgggcgggtcactcggtgccggttcccggtgcaaaccccccggcgcgcctctggctttgtgcagcccgagatggttgagtttggctccggagccgggagtggggcgcagattgatttttaaatatggagaaggagacgcatctgccgctggcgcgttcggtccgagccccccaccggtccccaccggcaccgcctccgccagccccaggcgcagcccccaggccgcccgcggaggggagggagcgacaggggccgcggctgctccctggcggggtcggggctgcgagctgccctccgcggggaccctccgcccgccccgctgaccgccgctgtcttcacagatgggagcagctcccggactgcgcccgccccgccgcggtcaccctgaggccaggggcccgggagcgcgacctcctggccgccgtctgggactttgaccttccagaggccatggaggctggcggggagcagggcgccacctgatcgcctccccctggacgcctcctccagcggcgctcacgcttccgcaactttgcagcgctcatggtgagtacgggggtcccgggggtcctgcagctgggggctaggccgctgcgggggggcggccacccgtatggggactcccaggctggaaaagttgtggaatggcgagctggtgaccgggcttccgggctcagtgccggggtgggaggctctgtggagtgggggccggggacaggccgcgtgtctgggcacctctgctccccgcg

SEQ ID NO: 5405 - DNA, 1479 bp, Homo sapiens
gcggctctttccaagttcgaagcagggactcggttctgcgcatctggcgggtgtgcccagattgtaaccttcgcactaggcatccaagaacgtgctttggacacactcggcggtgggagcgggtgcttggtttgcatcagggatgaggggtggagtagcgaaagcgcccggagcgcgcactcactcacactccccaagccagggcgcggccgctctgggcgcgaggtcccaagccaagtctcgcgctcggccaggagccggggagtaccccaggtccccggtctggggccgccgctatcctaccctgcggcgcgcactcctgacctggccccgccccccggcggccgcgagtagcgggcggagcgcaagcagagaggcgctctgggctgtgcggcaccgcctctcctcggtgtctggggagggacggagggaccgggcgggagagagagaaagcctgaccgaccggctggcgaagagctgcatgcaaccggtgggaggccgggccggctgggtctggggctcgggctcaggctcgcaccgtttctcggcaggtccctggcggtgagcgcggacggcccggaggcggcggctctgagctggcaggcggagggctgtctcctgcgcccgcctgcccggcgcggtccgaggatgcgggggggcgatgcccggggccagggacgcgctctgtcaccaggcgctgcagctgctggccgagctctgtgcccgtggggccctggagcacgacagctgccaggatttcatttaccacctgcgggaccgtgccagaccccggctccgcgacccaggtgagtgccgccaccgccgcctggagggacctaagggccctgggctgggacttggggccgcaccggggcctgaggcagaacagcgacgcggactgggagagggcggggggcggccaccgagccaggagagtgatcaagaaccagcgcactgtggcctgatgctgtaaccaggcggggacccgggcggtggctactgcacggaggccgactccgggtcggctagggcagggttggagggaccacgcccgccacctgcgctcccatcgccaaggctcctgggggcggctccctagctccgagctacgctctccacttcccgggctatctgcactcagagcgaggggaggccgcggcggcctcggagccgtgggaagggggacgaggccgaaggaaactctgggaagttgggagttggggacggccccgggttggggccgaatcccaccgggtgctgctcatcctttctcccaagcgtctagttcctttccttggtatggggtgagaagggcgggacgcgatccggcgttgggccggggacagggtgcttctggccttgggcagacgggcctgaacccgttcccggcgggtcgcacggcatggaggtggcctgggcctgggcgctaggctcgaccagcgactaccgccggccacgatggggttcgtagactcgtcg

SEQ ID NO: 5406 - DNA, 446 bp, Homo sapiens
ccgccacccgctgataacaacggaaccgtgggcattggcccttcaacgccgtctcgcccgccctctccagtcagtttggtggatatttcggtgaaggctgcagactctcagagtcacccctccctcaagcagcgttctccgtactcttcggcgccgggaagctcagagggagctggcctgctcttaccttcaggtgtcggcggcggctcctgccgcttcccgcgggacaggaaggccttgggcagcagcagcgacagagccaggacaagcccagaagccagagcgactctctgcactgtggagtacgccatgactgctcacggtggtcgcaggtgcagacgccagccggaaccggaaccggaaccggagcacgggctgccgctcccgaccgaaccgcgggcggcgcggacggcgtcgcgcgagggacaaggtgcgcgaggcgcacg

SEQ ID NO: 5407 - DNA, 2991 bp, Homo sapiens
gcgcgcgcagccagcgtttcccgcggatacagcagtcgggtgttggagaggtttggaaagggcgtgccggagagccaagtgcagccgcctagggctgccggtcgctccctccctccctgcccggtaggggacctagcgcgcacgccagtgtggaggggcgggctggctggccagtctgcgggcccctgcggccaccccggggacccccccaagccccgccccgcagtgttcctattggcctcggactccccctcccccagctgcccgcctgggctccggggcgtttaggctactacggataaatagcccagggcgcctggcgagaagctaggggtgaggaagccctggggcgctgccgccgctttccttaaccacaaatcaggccggacaggagagggaggggtgggggacagtgggtgggcattcagactgccagcactttgctatctacagccggggctcccgagcggcagaaagttccggccactctctgccgcttgggttgggcgaagccaggaccgtgccgcgccaccgccaggatatggagctactgtcgccaccgctccgcgacgtagacctgacggcccccgacggctctctctgctcctttgccacaacggacgacttctatgacgacccgtgtttcgactccccggacctgcgcttcttcgaagacctggacccgcgcctgatgcacgtgggcgcgctcctgaaacccgaagagcactcgcacttccccgcggcggtgcacccggccccgggcgcacgtgaggacgagcatgtgcgcgcgcccagcgggcaccaccaggcgggccgctgcctactgtgggcctgcaaggcgtgcaagcgcaagaccaccaacgccgaccgccgcaaggccgccaccatgcgcgagcggcgccgcctgagcaaagtaaatgaggcctttgagacactcaagcgctgcacgtcgagcaatccaaaccagcggttgcccaaggtggagatcctgcgcaacgccatccgctatatcgagggcctgcaggctctgctgcgcgaccaggacgccgcgccccctggcgccgcagccgccttctatgcgccgggcccgctgcccccgggccgcggcggcgagcactacagcggcgactccgacgcgtccagcccgcgctccaactgctccgacggcatggtaaggccgggaccccaggaagtgaggaagttagggcggcgctcgggatatcagggacgcgtttccgagggcggggagctggccttgcgggaggtttgggccaggatccttcccgagagagaggacccccttgtcctgggcagctgtcactggggtagcctgttttggaagtgtgcgggcaagcgttcgagctgccccattgggggcgctattagaacactgcagcgcgaacgtgaagatctttttctctacttatccctacttccaaaatgtaaatttgcgccccttggtgactgtccgcccttggtttggccctgcatgttgcagacctcatctcctacccacccgtaattacccccccaaccaggacaggtctgggcccggaactagagccttaggctagagttagggagggggcggctacaggaattggtgttcgggcctcgagccgtcccgcgggcctgactcagtcgcccttgctgtttgcagatggactacagcggccccccgagcggcgcccggcggcggaactgctacgaaggcgcctactacaacgaggcgcccagcggtgggtattccgggcctctccctgctcgctcctcctccttcatggagctgtcctggcctctatctaggacgctcccacccccactcacacacgcctatgtcctgggaagtggtgcaggagatgaaatactaagcaagtagctccctgtcttttggattgtcccggactctaactaaagtcctcagtttccaatctgtctcaaagtactgggcccgggggtgggaggcttgtcgcggccccacccctgcttactaaccgagccctccccgcgcagaacccaggcccgggaagagtgcggcggtgtcgagcctagactgcctgtccagcatcgtggagcgcatctccaccgagagccctgcggcgcccgccctcctgctggcggacgtgccttctgagtcgcctccgcgcaggcaagaggctgccgcccccagcgagggagagagcagcggcgaccccacccagtcaccggacgccgccccgcagtgccctgcgggtgcgaaccccaacccgatataccaggtgctctgaggggatggtggccgcccacccgcccgagggatggtgcccctagggtccctcgcgcccaaaagattgaacttaaatgcccccctcccaacagcgctttaaaagcgacctctcttgaggtaggagaggcgggagaactgaagtttccgcccccgccccacagggcaaggacacagcgcggttttttccacgcagcacccttctcggagacccattgcgatggccgctccgtgttcctcggtgggccagagctgaaccttgaggggctaggttcagctttctcgcgccctcccccatgggggtgagaccctcgcagacctaagccctgccccgggatgcaccggttatttgggggggcgtgagacccagtgcactccggtcccaaatgtagcaggtgtaaccgtaacccacccccaacccgtttcccggttcaggaccactttttgtaatacttttgtaatctattcctgtaaataagagttgctttgccagagcaggagcccctggggctgtatttatctctgaggcatggtgtgtggtgctacagggaatttgtacgtttataccgcaggcgggcgagccgcgggcgctcgctcaggtgatcaaaataaaggcgctaatttataccgccgtggctccggctttccctggacatgggtgtgggatccggaggaaaatccgcaaactgggccagctgtccctcagcgacgcctgtaggcggcaggcg

SEQ ID NO: 5408 - DNA, 928 bp, Homo sapiens
gcgggggcgagggggcgagggctggccgcccgtgaaaggaaaaataaatcctaaggaagcaagaaatcggacgaaaggatcttactttaagtgatctccttgaacgcgtcttttcaaactccgcgatagcccaaggagctgcgcggcgcggcggctgcggctaagacctgtgactaatgccatttgacctgagcccatggggttttgtgcgtcctgccattcactgttatgtcgttatcttcaagtttatttcggagaaatcactcgcgttctttgtctcaaggctgagctttctgtctatttctctttcaagagaaaagaagacgggaggggaaaagagagaatcggagtccctggtttggggtttaaggtccttgcctacgctgcgggggaggccgcagcagatccggctggggctccccgggcctaggtggccaaagctgccgaaacctgccttggatagtagaaagagcgtgtcggaacgcactctgggggtttcgttccccccgcgcaggggagagcgagcatgttcctgccccgggcgccgtgcggtcgcagcagcagcgcggccctctccagtgcgagccgtgcctggaatgtctcgggtaagcgaagggccagcaagcgaggcgaaacggacactataaagcagagagtggtgtgagcttccccgccctctgaaaagatggcaagtctccgtttcgggaaggctgcaacgctaaggtcaccctttgcaggcttcggacccccagtcctccatgctccctgccggagcagccaacagagtgagagcgcattttggaaagattggccggatgccgggcggcgacagggaaaagcgcccgacgcctggctttggggtggggggtgtggggagggggggcagggagctaacgggcgaggcgaaggaggagggctgcgaggctcg

SEQ ID NO: 5409 - DNA, 1267 bp, Homo sapiens
gcgaatcccgagtaattgttttccgagggggtccgtgcgcgctcggtggcgccgcctcggtctgggttcccccgaggaaaaatacccacccgcgagggctcggcggcttttcgactcggcggggatgaactgtggcaacttcggcagcccccaccgcggtgcggaagtaaagagggcaacattggcgactgcggctcggaggggctggagcgcgtgaagccgtgggggcgccgtgcgcctcccgctctctcgtttcggccgcaggtcctgggactccgacttcggtgctccgggtgatagcggctgcggcgcctgcagtccagatcctcgcagttctgcgggcgaaggaggcgaacggaatcggcccccagtggggagcgcaacaagccacagtagccaaaccccgcgctcctgcccgggctcccagacgaacgcagccgcagcggggggccgggccccgagccccacgccgccgccgccgcgccagcggtggggggcgggctgggggcggggcggccggggctgccttcccgggcgcatatgcgagcgcagcacccggcgctgccgagccacctcccccgccgcccgctagcaagtttggcggctccaagccaggcgcgcctcaggatccaggctcatttgcttccacctagcttcggtgccccctgctaggcggggaccctcgagagcgatgccgatggatttgattttagttgtgtggttctgtgtgtgcactgccaggacaggtaagcatgactgtggcggttagagggatccgggaaatgggggtgcccacagaccacggcggcgtggggagacctggagccgagctttgcgctggtctggggaacggcggtagcgtggaccggttcctgggatctctttgccctgctcggagtgacagggtgaaaatagggactcacgggcttgaagatgtccccgttgagtgccccttctcaggggacccggcctcaggggcgcaggagtgaggggcgcggccgagtaggcgcaccctcttgctgctagtaaccggctttccgtcccagggagtcgaaacccgcagcagggcgggcccgcgtgccccgagttcccgaacttgtaaggtgctgtggaaaccactctcgccgacccccgccaggctgggaaggggtagctgcgggagtcgcacccgcagagggagcgcttccggctggcgggcgcggccggggcccgggagggcgcggtgcggcgagggcagagagctgcgggagaaccctgggatcccgcg

SEQ ID NO: 5410 - DNA, 1225 bp, Homo sapiens
gcggaagtcgctccggatcatgcatggaaggctaattgaaaagatcagtcggggcgcttgtggcagccttgtcactttgtgacagtgctccgctccgggaaattgcatcgtcacgacaaacgggaccgtgataaaacgaccctttccgtccttatttgtagatcactcagacgagattgaactgcacttgtttccccttcgaggggagccgcgttttcagggtagccgaaggcttggggctgagggggggccctcaccaaggcgcgggtgggggccggagcctcaactcgatgagaagtgacaggcgtttgggggatctgggctccggccgggaccagcgcaagcagggactttgcggggacaccgcttctccaacagagcaaggcctggcccacgtttccggtttctcctaacttccttttattgccttcctttgcttcgcaagttccatctacccctccagctacagagccccacctctaggcacaggaagcttcccggaaaaagaaaggctgtcccagaaagagaccgagagagactttccaaacttcgggcatagccacggcaattcccagtctgctaatgccaaggcgggcgcgtaaggccgcctaaatctagacctccctcctcactcatttcaaaaaataacaacgtgccagccacctccgcagataccgccggctggtgcttgcccaggagacgccagggccagagcgccactcccagcatcgaaatggcagagagaaagcgcagctccaaattccccttcagaggttaagcctcaatcattgtgtcccttccctagggactgctggcgctctcgcccactggcgatgattatgcgcctagaactcgaccgcgaagcaactaataggaaaacatatggtgtcaatttggatgctccgcgcctcgcgcacacccgggaacgagcggcacaaagccctgccggccggcccgcgaccccgcgcccctcggggcctgccagccgggccgcagcgacaaacgctcagggctgcgcgccctggctggggcccgcccgagagacagcctgcggctggggagtctgagctccaaggggagagcccagccgccgaaggcgagcctaccggccaagccctggggtccggcaggttctgcacaactactcccgcaaagctcgccacctttgtgccctttcctcagctacgcgcttaccagccccggaagcaccagggggcgaccggcg

SEQ ID NO: 5411 - DNA, 1627 bp, Homo sapiens
gcgcagcagagcgccggagaggagggacgcggaggccaccgaggggtcagcagggccgcggcgccagggtgggggcctccaggcggcgctggccacggttcacccgcgagggcgagcgcgcccggccggccgcgcctcctgccgtccgtgcccgggggtgggacccgcgccgggagctgccgagtgcgtggagggagccaggctccggctcgcctgatggattgacttggagatggatcgaattacaccatttgccgtgcatcggtttgttttgctcctgctctgtcccgctgctgctgctgctgctgcaaggggtggtggcgagtttcaggattctatcaaggaagccaagacctaaggagacagagggatatctatttttacaatatttttctttattttctttcttccttgcgcgtggcaagcttttttttttctttttcttttttcttaccagcctccccccaatgaggtaagaccgttttcaacaatttgctaatgctcttgtggcgcccggtgggggtcggaacctgagatcccgaatcgctgtgtgtgtgtgtgtgtgtgtgtgtgtgcgcgcggtgggggtcggaacctgagatcccgaatcgctgtgtgtgtgtgtgtgtgtgtgtgtgtgtgtgtgtgtgtgtgtgtgttgccactggacagttgatttattttccaagctgctctctctgcctgccgtgcaagggacgcgcaaagggctagagaggtttggcggacgcgtcaaaactggcaaagctggcggcttagggggaggggcaagtggacttggaggccctcctccactgtgcacccccttggaaaaaaagcggagggggcatcaagtaaaagtttcttgccaggcagagccagctcggcgtcccccgcacatagctggggttagcaggggttgcttctctgccgggcacagcgtctccaggagccagccggggagagctgagccaaggccgaaggagccgcctgcgggcttagccgccccctcccgcccgttggccccagagcggacgctgggacgcccggggtctggcagctctgcgcccggctaggagcgggcgggcgagcattagcctgcgtcctggagaaggggcgcagcgccgcagttgaggccggagcagcccctcgcgggcgtaggatacctgtcagtgagcgcccggattgcacggcccccgggtagtgcctgccggcgaggggcgggagctcgggtgacttggccatccccatccccggcccaggcccggagggcggccgcttcccaccgtccctctccccttactggcagagcgcgctgcgggcggactcccgggcccggagcagcccaccggccaccccaccgcccacccggctcccggtgtctcctcccggccgctctacccagcaactttccgtgctttgttccccgactggaaatgctttacggaagcgtcttggacagggtctccgccaggcgacaagagctcggtgctgagatgtgttacgttctcatctccccatcaattatggatggaaacaaataaggaagagtcaattttgctgagccccttctccggcaacgagaggcgttctgcagccgggagggagccgccgctcgcgccggcagccg

SEQ ID NO: 5412 - DNA, 1857 bp, Homo sapiens
ccgcgctgcctaggcaaagggacccggcgaccaagacacccccgcgagggcccagggcgcgtccctcccgccaggccccagactccggctctgcgccaccccctcctacgccccggcgcgggcgcagccagtccggcttcctccaggcccccaagtcccggaccgagtgtggggccgcctctccctctcggaaggagccatcgccgctttaagtggaagaggagaggaagggggcgggggagcggggggcggggagcggaggcggaggagggggagggggatccccctggctcccacgtggtccgggcgcctgtgaatcgcgcccaccggagggtctcacagcgaaatacaaaagcagctgggaagcggcggggactcgagttcccagcgccgggcggagcgccggacagagccccgcagcgccccgcggccgcgatggggccgaagcgcccgaagccccggagcccacaaactgccgggcccgcctcgccgccgggacccgggtgcctgggctcggcttgaagcggcggcggcgcaccggcacagccgcgggagcatgggcaggaggatgcggggcgccgccgccaccgcggggctctggctgctggcgctgggctcgctgctggcgctgtggggagggctcctgccgccgcggaccgagctgcccgcctcccggccgcccgaagaccgactcccacggcgcccggcccggagcggcggccccgcgcccgcgcctcgcttccctctgcccccgcccctggcgtgggacgcccgcggcggctccctgaaaactttccgggcgctgctcaccctggcggccggcgcggacggcccgccccggcagtcccggagcgagcccaggtggcacgtgtcagccaggcagccccggccggaggagagcgccgcggtgcacgggggcgtcttctggagccgcggcctggaggagcaggtgcccccgggcttttcggaggcccaggcggcggcgtggctggaggcggctcgcggcgcccggatggtggccctggagcgcgggggttgcgggcgcagctccaaccgactggcccgttttgccgacggcacccgcgcctgcgtgcgctacggcatcaacccggagcagattcagggcgaggccctgtcttactatctggcgcgcctgctgggcctccagcgccacgtgccgccgctggcactggctcgggtggaggctcggggcgcgcagtgggcgcaggtgcaggaggagctgcgcgctgcgcactggaccgagggcagcgtggtgagcctgacacgctggctgcccaacctcacggacgtggtggtgcccgcgccctggcgctcggaggacggccgtctgcgccccctccgggatgccgggggtgagctggccaacctcagccaggcggagctggtggacctagtacaatggaccgacttaatccttttcgactacctgacggccaacttcgaccggctcgtaagcaacctcttcagcctgcagtgggacccgcgcgtcatgcagcgtgccaccagcaacctgcaccgcggtccgggcggggcgctggtctttctggacaatgaggcgggcttggtgcacggctaccgggtagcaggcatgtgggacaagtataacgagccgctgttgcagtcagtgtgcgtgttccgcgagcggaccgcgcggcgcgtcctggagctgcaccgcggacaggacgccgcggcccggctgctgcgcctctaccggcgccacgagcctcgcttccccgagctggccgcccttgcagacccccacgctcagctgctacagcgccgcctcgacttcctcgccaagcacattttgcactgtaaggccaagtacggccgccg

SEQ ID NO: 5413 - DNA, 2423 bp, Homo sapiens
gcgcgcgcgcgcctgcggaggggggtggcaaggatccagaaggggagcccaccccttcttccgagctcagctctggggagccgggcgctcaggctcgccaggctgcaaagagagctgagagctgcctcgcgccccgcgcagaaccggcggtggaataaccagcgcctcaagtgtgtgcatctgggaccagggggcgggggagggggacctgcggccccgcggccaacccggttggtgcagacttggggatcccagaagggacagtgcccgcccagtcgcggcgattgagggtccctgtccgggcgcagctcgggccagccgcgtgctccggggccgcggcttctcccggaacccccgcgggcggggcctgccttccggagccggttggcggggggcgggcggcgccggggaaggggccgttactttcccagagcggcggggcgacgtcaggcggaagggcgcggggcgcgcacgctttaaatggcattcgctgtcatccgagctcagagccgtgtgggcagccgcgggctatataagccgcgagcctggccgccgcggggcagacggcgacagcagcggcggcgagcgcctcggagcgcggcggaacagcgccccccgagccccgtgccccccgacgggtccgcccgcccgcccgccctcccgaggagcgccggcccgggcccgcgagggccgccgccaccccgcagcagatttggatcccccgcccggcgagcccccggctgctgcctcccggggggccccggcgcagcggccgccctcggagagccccggcgccccgccgcccggccccgcagacgccggaggcgccatggccgccaagcccggcgagctgatgggcatctgctccagttaccaggcggtgatgccgcacttcgtgtgcctggccgacgagttcccgcagcccgtgcggcccgccaagctgcccaagggccggggccggctgcggcggccgcgccagtctcgcttcaagacgcagccggtgaccttcgacgagatccaggaggtggaggaggagggggtgtcccccatggaggaggagaaggccaagaagtcgttcctgcagagcctggagtgcctgcgccgcagcacgcagagcctgtcgctgcagcgggagcagctcagcagctgcaaactgaggaacagcctggactccagcgactccgactcggccctgtaaggggcgccgcccgcgggggggacgcgcgcgtccgcggtccgcgcggggaccggcgtgtgaaccccgagagtgcccgcgccctgctcccgggggacccgcaaggacccgggaccgccgctcctcgcgcgctcggactcccgccccgctgcgaaccggtcggtgcgcccctcgccgcgctcgccctggcccgggagcgccgggagcggggccgctttcctcgtccttgtaaatgtttattttttaactcttcccagtgcgaactctgctgtgagtgtgtgcggggaggcgcgcccgcgctgagtcggcggcgggtagccactccatgcccttgtccgatggtttgcaactccgattttgcacaccgctccaccgtgccccccagcgcacacccattcacactcacgccaacactctcgctgaacacttttataattgttaggcgtggccgttgggactttgggcgcagcgcggctgctactgcgtctggaggattgatatttatttttgcattgcgatggctgaaggcatttatttaacgatctttttacctggatatgtctgtgaggctcctgaaaggagacaaataaagtcaatatatttgcacagtgcagttttccaggctcttgactttttgcaccttcggggtccaggctcccaagactcggggaggtgggggaggaggtggcagggggatgtcggaccagggagccgggagtggagctacctccacaagcttcggtcaccggaacgaggttgcgccaccggtgcgcgggtcggttgcctgcctccccaagtggatccacccccggtccagtgtgctcctgcgtccctggtctattccccatcgccggcatccgggctgaagtgaagccgcaggaggggcggaggcagagctgacgatggagagctctctcctccgtacagttcacttcccagagctggggtcagggtcctcgccccgcacccgccacagaagacgcatctccctctgcgctgattcctggcggcgggtggggagatgtcggagccagcaatgcgagatgtttgggcgttgggacccgagagtgggctggaggccagcctgggttggtcgagagtgtgggtgcgcgctcgctgtcgcgggcaggtgactccctgaccgcagttgacccagcgcagtgcctggcgctcctgcgctgcggggaaaaccgcggccgctatgtctccagccgttctctgcgctccg

SEQ ID NO: 5414 - DNA, 1146 bp, Homo sapiens
tcgccgcaggactcacgctgaccacgcccaagccggccccgcccactcgccccgcccaccgccaaccccacgcgccctcgcccggacacgcgtccccgcagccctggagcgctcgcacccactcacaagccctcgtgcccagcccccgtgcctcaggagcccacacacactccgacccccacgaagcgccccaggccctcacccccgcgcccaggcaccgggcggccgctccccggggctcaccttcgctgcagaacttgccgccgaagcccgtgtggctgcagtcgcagcccacctcgccgggggccagcacggtgcagaggccgccgttggcgcaggggttgcgcgcgggcgcgcacagcgggtcggcggtggcgccgcgcaggccctggctgcccagcagcgcggggggccgctcgcccagcttcaggttggccaagaggccgcggaagggcggctcgtacttgacggtgctcagcgtaagcgccgagaggcgcacgtcgggcgggatgccgcccacgaacaggtcgctggccacctgcatctcgcgccgcttggagcgcacctcggcggcgcgggcctcgccgtccaccgccagcgccgtgcggcgcgcgtcgcgggtcagcagcaccatgtgccagcggtcgtcggccaccggcgtgtccagctgcagcgtggccggctcggcgcacgaaagcgtgaagcgcagccgcaggcggccgtccaccagcagcagctccaggaagtcgcagtcgccgccgtcgtccaggtagagcagcagcgcgcgcgtggcgttggtgcgcaggctgaagctgagctcgccgctgctcgccgcgcccgcccagcgcgcgtagcgagcccactgcccggggccgccgccgaactccaggccgtccgcgcgcgccgccagcgccagcagcagcagcaacagcagcggcggcggtgtcggccgccaccggctcccggacgccatgcctacggcggccccggccccgcccggcccccggcccccgctcaggcttcagagccgcgggcgcatggggcgggagggggccgggcgctccccgcgctgagcggggctcccttgcaggctcacagtgccatgggcccggccgcggggcgaggcgcgcagaggcccagatgccg

SEQ ID NO: 5415 - DNA, 577 bp, Homo sapiens
gcgggcacagtcggcccttgacggcgcccaaggccccgcccgtgcggcgctgcccattccccatcaccagagatcggttcgtccagcgggcaggccccatcccaatgttaggtcaaagctcctatcccttggacccgggcctggcgcccccgcccccggcgcgtcctcacccggcggacgcggccgcgcacaaggcccagcacggcccgcgtccccgcagcccggccgcggttgaacatctccagcgcgaagcgggtgggcgccagcagctccggggacggcggcccccaggcctgaaagctggcggctcggggctgggcgggggcggccactgcgcccgggagcagccccagcagcgacaggagctgcagccagggcgccatggcgagggcgaagccggcggcccggacccaacagacgctccaccgacccaccgggtaccgagcccgcggccagcggggcctgagtcctccctccagcggggcgacggcacgccgaccaatgggcgctggtttgcggcgcctgcgcgttctcttgtttacaggaggcacgtggggcgcgcagggtagggagagcg

SEQ ID NO: 5416 - DNA, 1721 bp, Homo sapiens
acgaagaaccggctggccacgccgaagatgctcaccacgccccgctccacgggcgagagctccagcaggcctgggggcggggcgcaggtcattgcggggcaggtgatccctggcccactccgcccctcggcttgttcgcctccggggaccctatttctggggtggggttggggataaagggccagggttcccggcgcagccgcccccaagggcctccagagcccaagctgccctctagggcctccggagcccaagcctgcgctagctcagattagcttgcctgtgtaggggacccccggcggccgcacccagtcccggaccttcagacgcgagcccgaccccagcggttccccagcctgggccaggccggggcgcgtgtctcgggccccctgtggctgcaccgcgcgccctgtgcccacgggcgaaggcgctggaattcggcgctcggagcccgagtttctgaaggcgggaggcggcgcccgacctcaggggttgcgctgggctgccggagccaagagtgtctgcgtccccagccccgcgtcagaagggaccggagcccgagtccgccccggttcccggggcccccgagcaggtgcccgccgagggtctcagagtgtgactgagcgggttggcccggcggccgttgccccccgcccccgccccttcgcgcctggccgcgccactcactgtcgcgggtgtccgcgtgcgcgccgccgatgcggccgtcggggagcgcctggaggtggaagccgatgcccacgttgcagtagagccgccgcagccgcttgatgcccagcaggtagtcgccggcgccgctctggacggccgcctccttgggctgcgctgccaccggcaggcgcgccaacgagagcgccaccaggctctcccagcggcgctccagctcggcctccagcgtgccgttgggtgcagtgggtgcggcggcgccccctcggcccgcccagggcgccagcaaggccagcaggaccgccgggagcagcgctaccgcggccgtcccgggccccgacatcccggcccgagggccgtgcgtcggtcaggcggtcagtgcgcccgggaagctggggggcagagctgcgcctgtggcgtcccgcgggagcgcacggccgacctcgggcaggagtgcgcaaccgaggaggtgcgggaggcaagcgacggggcccccgggcgccgggctctaccccggctgcatggagcggcgagccgggcggaaagcgcgcggctggagctgggactctgaggagcagtgcgcgcctccctgagcgccaggcccgcccgaggccgagccgctatatatatagcccggcgccccctcctactcgcccgctcccgcggggggccgttcgcgttctcctgggcgcccggggcgctgtggcgttcgcggctggtcgcaggccgcctgccaatcagggccgggggaagggaggaggctggggactagcgccgcgagtgccacctggagggaccccggcccccacccttggctccgcccggcccacggacctgttcgtcccgccccttggcggctcctacacttctgcttttcagccagttttgcctcttgcactttgtccctgcctgtccccgtccccgtctccctctctgctccggccgccttggcgcagccctaactcgggcatccgaagctcctagtgggcgcagaagccagcggctgctgcctgcccttcgcctttcggaggctcacg

SEQ ID NO: 5417 - DNA, 1721 bp, Homo sapiens; identical to SEQ ID NO: 5416

SEQ ID NO: 5418 - DNA, 615 bp, Homo sapiens
ccggcgtctgccgagcgcgcagcgccgggcgaggcgcgcgggaccagcgggtgttgcgggcgcgcgggctagaggcggccggcgccccctgctcggtgggctcggggtcgggccgcgggggcctggggcccggcggggcggcggtcccagcagcggcggcggcgcggcggccgcggagggaggctgagcgcgggccggctgtgctcgccaagggcttcaggcgccgcgctcgggcgcatttgtactttgccgcgggaagcaggcagcccggcctggcgctggcctagcgctggcgcctcctctggggcaccgcgggctcggtggattggccacccgagaaacaggcccactttttcccctcctctcttgtgcgggtctccgggacggacgctccaggcgcggcgccgagtggaggcgagggggctgcggagggggaaggggccacgcgggccacggggtttaacccctgactccccgcgacgccaagaatgcaggagggcagagttgagggagacctcaggtggaactttcaggtggggaaggctgagctgtcggggctgcgggtaccgggaaggctcagggtaaggcgctcggcggtgcgtgcccggaactccg

SEQ ID NO: 5419 - DNA, 1542 bp, Homo sapiens
acggaggcgcggcgctctccacagccgtctctaatgaagggaagcgtgcctcgaagtcagtcccggtgcgccccctcctcccccggcgccccttcccaaaccccgtcggatctccaaaggctggaataggcggtgcggctgtagcccgcgctgtaatcgtaggacacctgatggggcggcggcggcgggggcagggcgcagtctggaaagaagggggcgaaagaggccaaatggccccgcccgtcctccccgccgggagaatccgcagcggcggggtacagggggctcaagggctcgttcaaggtcaagccgccgcggggggcagtcagggggctctttttggtcggggagcagcccgggacgctccagggctcggggtacagtaggtttcccaccactgccggcggcggctcaaagaggccgggctccagctccgggggtccccgcagtacggaggctccggcggggaacacgtcgagaggctcggcggcaagcaagactgccgcctccgtgccggcgccgtagtcgggccccagcagctcaaagaactccacggcctccgcgcccttctccaggtcgcccaagctcacgtccggccccgacgggccacacccgccgccgcctgcccgggacggctccgtgaagaaggacggaggcagattgcgtgcccgcagcgggaccttcctggcccctgggatcgccgtggcccccgcggggcctgccacgtcccctcccgcgcccccagtgcccgcacctcctagcccggccgccggcgcagccacctcaccccccgccggctcggcacccccggggacgtggcgcagcgagtcgaagagcgcggccagacttcggctttgcaagctggcggccgcggcggcctgcgacgcctcccgccggggggcagccttgccgtgggccggggccgcgactgtcggggcgctaggggcggccagcggccgtttggctggcgtgtcggcggcgctcggggagggcgggccggggggcgcggcgcccatgaggccgctgcagcgcttgatctgcttctgcaggtacttgcggtggttcaccttccgcttcgacttgcccggcttgtccagcgccagcttgatgttgctggacgccgagtcaatgaagctgagtagatcgcgggtggcctcgcgcacgtcccctccttcggctcccgacagcagcgcacccgccggagccccggtctcatcgtcctcgaaacagcagcccttgtccagggctccgaaggcgccccctagcccgtccggggagcccccgaagccgaagggcacgaaagggtgcgtgctgaggagcgccgcctgcaccgccatcgccgcggctcccgggctgtccgcagcgctgcccgtgcgcccccgccagctcctgcccgccgcccagacccagctcccgccccggcgcggcgcgcgcggcgcagcctactagttccgggcctggctcgctgcgctgcctcccgggggagctcattaggtcttgtaagcaaggggcggagggagggagcgcgcggcgaccgtcccg

SEQ ID NO: 5420 - DNA, 1542 bp, Homo sapiens; identical to SEQ ID NO: 5419

SEQ ID NO: 5421 - DNA, 1768 bp, Homo sapiens
gcgcgtcgtgtcctccaccgcctcttctcttggcccgactggctctggtttccttcacgttcccagcctccaaattggcgtccgccccatggctcgtgtaggacgctaaaagcacggtaaatcccagggcgatctccagcagacgccctcgacgcatgatgccgagccgccaccggctcccgccgcctcttgccgcgcccggggctcggtctgcggccgccgctgcgccctgaagcgcaccgcgccgccggggtcccgctatcccgccgcccgtcccccgggccgggctcctcccgccttctccaggcgctgctcccacttcaggcggcccctgccagctgcaacacagagacaaatccccgaggcggggagactttcagggcatcgggatgctgaagcctcgcggtccccattcccaagcccaacccgtgcgccgcctgcgcgtggcgcagttaatttgggtaagggaagaccgtttggtccacagctggctggaaagcccaggcccccggcggcagcagccccggccgatccctcggcctcccgggccccgccagaagagcgcggcgcaaagtacccatatccccagcggtcctaagccccgggcgagctctctgggtttattttttttagcggcacgaattgcgcgcgatgcgcgctctgaacgccccactcctcagcctgccctctccgccaggctggaagccagccgcgccgtccccgccgactccgggcgatgccaccgccccccgaacatctgacgcggagcccggcaccaagagccccgggccaggaagctgtcaggcaggggagggccagcgccagctgtggacgttccgggacagcccctcaccccagtccctgtccctgccctcggcgcggcgcaaacgcaaaagcctccgtggccgcagctccagccccggtggccgcccgacccccgtcgggaccccggctgcacccactggagaagcggcggctccgactcccgaggaggcggcggcggctgctcccagtcgtggccgctacagccactgctcggctccgctcgcagctgtcccagctgtggctcctgtccgcttgtggcacccacagtctctgccgcggctcccgcagccccctcctttccccacctcttcaagtatcgtccgcgcagcggtttctcgcgagagaaatactttttttaaaaaaagaaagaaaaagaaaatgacaccccctccttcgtcgccctcatcaccaccccaccccccggccccatccatcctccctttccactcccctttgccagcctccgcctcggtgcggggcctctcgctcgcaggattagcgcagtgggaggaggcagaggtgatcaggtcctgcccggcctgggactttttgtcttgaggtggggaggggagaaatgggaagaggtggagtagcggttttagcccgctctgcggctgcgaggtttagatccgagattaacctctcccgcgataggtgaagccctaccggagcagaaagctgttccacctgcaccaagaatgcgcgctggagacggttgccccggaggccctggcccgagagaaaaccagtccccgctgcccgcgcctcccggtagcgcgctccctgcgcctctcccgccggacactcagcagacgccggaggccgggaggctaagactgggcgcgtcgcaggccgggaccgcggcagaggctgctgtgccgaccgaggagagggctctgccgcccccacttgccctgggtgtcgagagcccactccagacgcg

SEQ ID NO: 5422 - DNA, 2656 bp, Homo sapiens
acgctctccccgcggcaggaaagtacgttggtgtcatcctagagccccagagggctgagggaagactcgagctctaaaattagccgcttccaggcccggcgccgggaatgccctccagttcgccgcgcctcctccgccgccccctcccgcgcgccccctctcccctgcgccacgctcctagatcgctagtcatccccgccgccgaggctcctctccccctcgcccttttcgctcgcggtttgggaggaggagactgcgagagacaagcgcgagggggagactggagaggggcttggccgtgcgtcggcgtcggctgtgatggggagcccggagcagccaggcggcgagcagtagcggcggcggctgcagctcggagcagacaggagagccggcgctcctccccgcaggctgcgctgtgaactggcctgcggattgggatctcgcgcctcccgtccctctcctcccgctgctgttctcttcatctcggctcccctcctccgcttgcgaacccccggcggcggcggcggcggcgtcccgagcgcagagcgcttctgctcgcggcctcagtcccggctagcgcgcggtgggcgctgcggcggcagcagccgggggaccggctcgcccggagcaagagcgccgagcaccgggtgaagaagaccacgggggaggcgcctcgtagagccgtggatcgccagcggaggcaagggtgcgtggggatttgtagcgtgatgatttggctgcctggtgcaccgactggagcgcgcctgccggagcacagcctcagctgctgggtgcaaatgggctgcgaggtgggctggggaggcgagagccgacgaagcgcgtgggggaaacttttcaccttgtaaagttccaacctccgcgcagccccgagccgccgttgctaccgctgcaaacaggagaagagggtggcttggccccgcggcgggagccgggaggtttacacggagagttggccaagtttggggctgaggatctggggaggggttgcgaggggggttgcggatcagtgcacccatccccggctcccagccgcccctgcaggtggatgagaaggttcaggtggcgagcctgcttggcagccggtgcctctcgggcgcagtgggggatgttcagatgccgatggatgatgcacttaggggaccccgaggtgcaagttgggtcatcgctaggcgaggcgcggcgcagagagggagcccagcctccactttcgctaggaaagggaaagggttaccagtctgcgggtccgttccccacgcctgactcgggcttgcggggcttgtggtcagggtgagatgtagtgaacggcggcggcggctcttcgactggggacgacatcctttacggagtggttggggacagagactgtccctgctatcttgacaaggagagggaaccggaatgctttgcgagagtgcatgatttttggcgggcgtgtgggaaggctgcttgtctttgaaaagaaagcagcgcgggtctgaccatccccaggagtgcggaggagctgtctccggattgggggcgagaacgccaggggcaccagctccgagctcaggccccactcccgggcggttcgggacgaatcccctctacaggccagtgtgtgtgcagggcaagtgtagggggctgaggggcgctggcggggaggcagtagaggtggcctggaccatcttggcgcggcgcgcggtgagcgcgaggattccgccagtgggagtcgctgagctaaagtgcatctggccccccggcttgcatgatggcgagcccggatatttttagctgtgctgtgatctgaattccctcctctcctctctcgttgacttttgtcacatgtgctttccgagatggtttaacattgaacatgattgggctttgcggaaagcaacttttattcactttccaccgttctcctcttgtgggcggggggtggcgggggcgtgcttggggcaaggatgcaggggtggccggagtttggctgcgagctaagagagccgcttgggttgctcgggatgagaggaacaggggtgctcccggggtgtgggtgtgctggcggtgacatcctgaggctgcagctcgctggaataatgggctcaaaccaggcggtggagaggggtccccggaatggacgtcgggggcggggaggctgcggagaccctgcgaggtctccgtgaaggactaggaggggctcccgggagggagtggcgcctgcggcccggagcgtgggcggccggtggctctggcacgcggaatctggtggactcctagcgcctcggccgggagctccagctccatcccgccgccgccgcgcgcccaatgggactcagcttcgggtttgggcgaacctgcagcagccgcggcgggagggagggacgctgggaccgcggtaatgattgaagtctttttcccccctctcccctcctcccgctcctctccgcccccagactctggcgcgtttgttttccaagttggatcccacttccatttacaagtgtcagacaaacccgcgagaacctcccccaacccgccccggccccagccagactagggagggcgcccagggggagggggcgagctgtctgggcagtgcctggggaggtgcgacgcgcccacccggggcttgagcggctggggttcctgtgcg

SEQ ID NO: 5423 - DNA, 623 bp, Homo sapiens
gcgccgtagcgcctcctgcccacaaagttctgccagtcggagaaggtgtagttgttccaagagaagaagtgcgaggcattgggcacggccagggccgcctccgcgctctgctcgtcggcccggccctcgtggggctcggtggctcgcaccaaggggaggagacagagcagcaagaggtgagggaccattttgcaggagccacccctcccctgggagcctgcgggccgggcgtcccctcccgctgggatcggagcgcgcagccggggtgcggggcgcacagcatacaaggccgtcccgaggagccagggagcccggacgcgcggagcaccgcgccgcccgccaccagcccgcggtcggcacgccagctccgggtttgttggagcacttttatatctctgctcccaccaggctgctagggagcgcctctgcctattgggcagcgcggcgtctctcgcggcgacggtgacgcgctctggctctgacaagcctggctccccccaccctaccgggtggcgccgttgctgaccccacgcccagccgttcccactcccgcctgaaactcctccgacagggcttcgcttcgggggctcagtccccagcgcgtacacactcgcgtggtgtcg

SEQ ID NO: 5424 - DNA, 1967 bp, Homo sapiens
gcgcgtcgcccttgctgcccagccgaaccccgctccctccagggctgcgctgcacggggctgcctccccgagccgccagcgcccggcgcccctccggcgcgtccgcccttcccactttgtgcgcccgcggcggtgggagcagagccggccggctcctggggactcagcggccgcgctggtgatgggcagcgctccttccccaaaggcgggcggcggggcgggggaggtcgcggctcgggtggtgccgccgcacgggctcggattccgagggggaagtggcttgtcagccccggctccgggaagagtgaacaataaggctagggcagccgccccagatcgttatattcctgggtctaataaagtcaggatcgctgctttgcttcccccgccccagaagaataacggtttgcaaaatggggcaaaatgggcagaatcgcacggccgttgttgttggtgtgaccgttgttgcaccccagtcgacatgacgttagtttttcatttgccaaattgctggttagttgcaaagcctaccctcggccgcgagcactgaaggatgggagggtcgagcgccgcgttttgacaggaggaagtgcggaggggcggagggcgaggagggcgtgattggggctgcctggtgtgtgcgcgcgcgtgtgcgcgcgtgtgtctttacacgcgccgcgtgcccagtgttgcacggggcgggagaagaatggcaggtagccgcccgaaacacctcgccctgtctcctttctttgggcgaggttcccgatcctggcaaagtgtgaacaatagggagctgggaggaagacagtagtgatgctgccgcgggtggcgggggttgcgccgccgcccagagaacctcggcagtgtgcagggaggtgcatttcattttggctatttccatcccggcctccctggaaaattcttctgtgcgtgcccaccctcccctccagctgtcatccccccacctccacccaaggatttgcgctttggctctgatggacgggagggaaggaagaaaagcaggggccgcagagagctgggtgggttgggcggacattctgggcggggggcgtgtgctgggaagcgatcgaggaaagccgggcggaggggctgtgtgtcgcggtcgcagctccaggtaccgttgtacctgccctggacggccgacccccggttggggagcgcacggggcgggccagggagcacccagtgcgccccctccgcgggcggcacaagagcagcgctcggccgccgcctccagccaactcgggtccctcccacggcgaccaatcagtgcgaagctggctgggcgggaagccgcgagaggcttttattgcggcgcgggtggcggccaggagctgccaggacagtctcccggtgcttcagcctaacggtctcgctcactcaccgccaagagaaaccccgccctgcggccggtcccccgcctgcccggcagtttccgaggaaataaaatggagactaggtggtcaccgggagtgctcctggtccggccgcccgtgctcgcccactctcgcctctttcacgccgacttggagcatcccaccgcccccgccagcgctcactctcgcgccgcggaatccgggcctgagcgcgtcgccggggagggcatcctggcaggcacacctacgcgcgtgcgctgaccggccgaccgcgggccgggggctctactgacggcggggcggggccgtggcagggcccggagaggaggggtggggaccaagcctagtccgcctggccctgggtctccgctgccacctgggcgggggccaccccggttatgcccctttccgcggtgcccgtgggtgccgcgacgcgacctgtccacatggggcgggggaaggggggtgtttttgagacatcctcgcccccgggtgggagcgtgacaatggagcccggatatttggtgggccttttgggggatcgcctggcggtcctttccatcatcg

SEQ ID NO: 5425 - DNA, 2558 bp, Homo sapiens
tcgcgacagctaaaaacgggtgtctcgcttcgacaatagatccccgcggaccttctggcacctggttcactagcgcccgcgaactctgcctcgggagacttattgaaatccggatgctcaagccgggaggcgcgcagtaaccaggaggatgagagggccgggtttgggctaggaaagcggccttttaaaacagatgtcagggggactgcagccccgagccatgagaaaaaagttaaaggcgagatgacacgcactgaattggggcaaacattggaagaggagacaaaactgcgtgcttgagcaccggggtgcggggagggggggacaaaacccgtatccagtgcaaattaaaatcttgggagtaggtgggggctgctgcgcgcccttcaccctcagttcccctattaaggattctgagtccccatgcactcctgtcctctggctccttccttcctctccgctcggccggtgagaggcggccgccggcgccccagcagcagctagatgtcaggcgaagcccggagcgcggagcgcggggaagggaggggaagggaggggaggggaaaggaggggtggggcggggagcgcgcgcgggctcggccagtgcggggtggtgggcgggctgagcccggggacggcgcgggaggggggagggaaggggggcagctgtgggcagggagccgggctcggccgccagcactaaagatggagaggcgccggggccttgcaggggagggggctcggcgttgacgtgggacgcggcggaggcgcagcagccggtggtgatttgctaacctcgcagcagagaggagttgagggcgatgagagcgggtactgcgaactgccgggcgatgctgtcgctgccgccgtgatacggagagcaacagttccccagcaacacccctccccgacacaggcacacaccccccgacaggcacgcacacccaccccacagtgcccggctcggctgcggtgagtgaggggccgggaagaggcgcaccgcccagcgagcgccgcgcgccggggcttcccggggctggagaggtctggggggcgcgcgctcgcttcggccactcggccgctgggcttgtgccttttttatttggcgtgttcccttcctgccgctgcagccgtcgccgccaccggttgggggtcggctagaagggggagccccggctgtcagcctgggcgcagctgcctccccagcccttcctcttcagggcacggtcggggtgagaggtggggggcgtagcggtgtgcgggggctgagggcgtgagcagaggggtcggggatccggaggctttgtaccgccaggggctggcggagcaacagagcccgtgggtgctcttatgtatgcggaccggtgcgcgggcgcaagataaggttgtggtttatttatttgtgtgtttattcgccggccggctgggaagctagaatcggaggagctgacgagtagatctgggggcggaggggagcaggactgggactgcttacgttttgtttctctttgagaaaacgtggtgggctttttcttgattggacttgatccccaccccccttttgcaggggagggagggaagctccagagggtctgcagcgctgcgggccctcctcggctctcggcgggaccggcggtgacaccggagctcgccgtgcgctcccggccgctctcggtgggtgccggtctctgcacctgatgcgttcgggatgcctttcccaccctggcgcgcccgccgctagctcgcacagcgcctcgcacactcccgcacgcgcttgaaatgcgcacggtcccgccggcccgcggaaccacccggacgcacggagcgctccgcaccgactcgctcgccgcctccccgagacgctcgcaccgtgcttgggccgggcgcgctggccgctggcgccgctggccagaggcctgggacccagccggtcgctcccagggggtcacggccctgggtcggagagggagggcgggcagaccccttctcgcctttcctcccacaactcgctgcggggcttttgtgcttccccttcgccgcggggcgggtccgcctcccctgccgctctcgccgcggagtccagcccgcccggactgtcgccgttcctccccgtctctttcgctttccctcgtccctagctcagctctccttctttcaggagtctagctcctcgggaaaagttgcttccccaagtttgctgaagtcgtctccaagtctcggtgggggtcgctgggaactgggggggtgtgagagcgcggtcgatccccggagctcgggcgggttatcgccggctcttccccgcgccgcctggctggacgctgcagccagcgccagccggatcgcgggcgccgagcggcgggtgggggagacggctgcccgtgggcgcccagatttccctcaggacccaaaaggcttgtttcagggcgccaagcttccattcttttggctgttccctcctagttctcagaaaccccgatgtctgcgggaaagcacgcggtggctcggctcggctgaatgctcatcccaaccttgacggcctccgtccccaccccggggcg

SEQ ID NO: 5426 - DNA, 2558 bp, Homo sapiens; identical to SEQ ID NO: 5425

SEQ ID NO: 5427 - DNA, 1508 bp, Homo sapiens
ccgccccggggcgagaaggagaaaagttagagggctgaacaggtgacgctgagcttgttggagcgtgtgtgctccaccacgcaagggcgcggagttcggccgcctcatctcccgccatctgcgcgcccgggggcacgtcctctgcgatagcctggaacccagactacctgcgcctgcctggtcccgactcagtgcccaggtggcttcagtcggaaatgtctgccctcttccaacctcccgatcccggctgcctcgcggatcaggtacgcagcgccccagccgcaggtctggacatgccggacacctggacccacccctagcaaccccctctctccgggaagagggacacgccccccagcctgaagacttgtccccaggtccaactggccaggcgcggaagcggagaatctcgcatcttggggcgcgctgcccgaggtggccacggtggcgcaccaagccggggctaaagccggggcagaggggtggggtagggccgggggagggtgacctctgggtttggagaacaaacttgctatccgagggacctccagctctcgggactctcactatccccaccctgcctccagccaatgcgcggataagcgccatgcggtgcgccaacattcgcgccagggctggggtccgcggcgggagagggacgcacggacatagcggaggaatcagccgccgagtccgaggcctgaataagcaaggactcctaggtcaagagtcacggcctgaggacccctcgactcggagggcactccggggtcccagtgccaccaagccgcaggaagagggcaaggggctgggggaggggtccagggcagaactgccgccgtgcagggagcagggagatgaggggctcctttgccaccacccctacgggcgcgccccaaaacggcagacgcgggtggctggcggagcggtcgggggctgactctcactcggcccctgtcagggtgcctgcccctccccgctgcgccccacccggggccttgcaccccggtcggttcccccacgcacctggagcccgccgggcaccccgcctcgccgccagccgcgccaccctggccccgccgcctccgccgcccagccgcccgcgcaggtctcacctttgtgtaaagagtccaggagcaggaggaaagttaccagccacatgccataaagaggccctattctccggggaggtggtcctgtggccggccgtgcggcagcgcctctcccccgctcagcgcgctcccagccgcccgcactcggcgccccgctctctctgctcctcagcccagcgctcggctgcggcggcggctcctccctcctcggctccccggctcctgtcatccgcggggctgggctaggcggccgctctccccgcccccccgcggcaccccgggtggtgagcgccgcgcgagcccggagcccagacggaccccagccccacaagcccaggaacaggagcggcggcccgggccagaccgccccgacccggctccgctgtctgagaggcg

SEQ ID NO: 5428 - DNA, 1119 bp, Homo sapiens
ccgggcgcgcaggcggcggctagcgctggagccccagccagctccctctccccacgtgcgcgctaggccttggttactctggcaactcgccccgctcagacggcaccaggcagctgaatccagccccttgttacgggggaaaatgctctcattgaagcgccggagcgcagcttctgccttttattgcaagcggcgccaccggattccatttgtaaacttattagtgtgcgctcgcggggagggggctcgggaatccgggcccgggcaaccggcgccgcatgctaatcagggggcgcccgcccccgctttgcccgtggccctcctttcccgattccccgacgtttcgggaggagtggggtcggagcgcagggctgggaagggtcttaggacccaggaaggagacgggtgcctcccagagaggaccccatcccctccgaggtccgggcggctcccggcctctccctggggtgccgtagcccccctcgacccgccttcccgcagccgcagtcgttcgggcctggaggtggccgggcatcggtgccgacgccgcgagggcagcgcccgcggcgggaatactaatgcaccctaaagggcacggccgccgccgcagcaggtaattagctggaccgcggcggagcgcgcggaggtggctgctggctgcaaggactgcgcccagcctccgcctcgcccctcgaggctcccgcgtgggccggcgggcagtgcgtgggccacaggaagcgggctgactggacccggctcaggacttcgcacaagggcagctctttgtttacagctcctctcccagctccccgctttcctttcgcccaccgcctcccttttccggcgatcggctccgccggctgcgggggggtggggggggtggggtgtcctgtgtagccgcccacctcctgtcccggcctcgtgctcccgctggggactgtttgcggtgagtctgtcgcacgcacgtcagggccgaggcagtgatgcggggcagcgtgggaggacgggctgcggagcccgcgtcatcctgcctgtggggagcgctgtgcctgctctcctgccagcgcgcccagctgtcccggccgccgccacgcgggactgcctgccatgtcgccaccg

SEQ ID NO: 5429 - DNA, 1119 bp, Homo sapiens; identical to SEQ ID NO: 5428

SEQ ID NO: 5430 - DNA, 653 bp, Homo sapiens
gcggagaagccaggagcgatgaggggcggggcggctcccggcgccctcttttccagccccgctcccgcgctgccgccggagagggactcggggcgcagccgccccgcctctgccggggccccaggaggaatctaagaaaagagagatggagggaggaaatggcatcgcttcaggaaggggcaggacctccaggaccgaaggcgttttctttctctttcctttcagcgacactgggaaacaaagctccgcggctgaaaagaacaccacgcgcggccaggacccgagcagggccctggggcgctaagggcggggaaaatagggcatccggagtgcaggagattcctcagggccgcccccttctccgggggtgccctgaggaaccgcggcggggactcgccgctggcagcctgcgggtcctggtgccagcgcgcatgggcgggctgtgcggacgtggctggtcctccaaaggtttcagatcccgtccgggccgctcagtcccttaaagctgtgtcccaaagcctaggggagacagcgaggctggggacgccgggaagtttctctgaggtgtggggctcctgagcagaaacgcgcgggggattgccagggctgcagaaactttggctcgaggcggtggctggcccgccttacttccg

SEQ ID NO: 5431 - DNA, 1768 bp, Homo sapiens; identical to SEQ ID NO: 5421

SEQ ID NO: 5432 - DNA, 1101 bp, Homo sapiens
gcgccaagccggctccccaacctggtctgctgaacgcaaaccgctgagagtttgctgcaccgccccctggggcccctggctgccgagtcccgctaaggcaaagacgccagcaagcgaggaagcgcagcggaagaaaaacaagcgggcgcgcgaggggagccccaggagggctgccgagtggctggcaggcggctcccgcccctcccgggtggcctcgccggcggctgacggcccggaggacgcgcgctccgaaaagttagactccgggcggcggcgcgctacgccgcgtcccctcgcgtcccttcctcgctgcgctccgggaaaggaacttgttccttcggccccaggattggggagtgtgccgcggggccgagggtggggaacagccagagggagacgcgaaccaggccgctggcggagggctcagggggagcgcagaggcgacggcccccatgccggcggccaacatgatggagaaccggccgctgcccgccctgcaggtgcccgagccgcagggtgcgcccgagggcagcccggtctggtccagttcgtcgacccccacgcttcgccgccggcgcttcaagatgcgccgcatgaagaacgtacaggagcagagcctggaggccgggctggcccgggacctgcccgccgtcttggcccccggcaaggagttcctgcagctgccgtccatcgagatcacgccctccagcgacgaggacaccccgtggtccaactgctccacacccagcgcgtccccgcgccgaaaacgcttcctcctccgcaagtggctgagggtgagggagcggaaggagtgcagtgaaagcaggtacgtccccgttccgcccgtctccttcccttccctcccgtcctctccagagccgtccagggccccggggcattctgggggaaacgtcctgggggagaacaggagcccgtcaccagaggcgcttctggagggcgctgcgcctggtcccagggatggtggcattcagcttccacgcgtgccacccgctccccaactcagggtgaggggcttcatgttgcacgacacgtttacgtggggctttacgctgcattccatctcccttgatcctcgcagcg

SEQ ID NO: 5433 - DNA, 1101 bp, Homo sapiens; identical to SEQ ID NO: 5432

SEQ ID NO: 5434 - DNA, 2341 bp, Homo sapiens
gcgtggtccggagagcgtggacaaggtaacctgttttggatgtccgggagaagggagtccggccgaaagggcccagcccctcgaggctgctccaactggggcgcgcggcggcccaggagggaggcggggaggtctccgggttgggccggggaacgccggcctccaggctgggtagggaggacggtccagagcgcgggcctccgggtctcaccccgggaaaagtctgggtctgctctgcgctgttgcgtgctgcgctcctgggacctgctgactgtcctagagggaacgtcccgcggtagtgtcagttccctggggaccaggaagggcgactcttgcctgggagtcagtgcttgggccgtcgggtccgggtaagcgctgggggtttggctcgagaagatgcggataggtggcctagggcgccgcggatctccgccctctgcgggcaccgggagcccagggtcgaggcgcgccgccccgaggggccccttctcctaacaatgcgcccggaatggagtccgcgccctgacagcgcgggtcagcccgaaaccgcccagaatccgcttcgatgagtgggtgagccgctctgggagtctgccgcgtctcggcagcggagggcctgagtggaaaaattcttattggatgcactttttaatggttggtttgcctcggttttcgtccgagtcttccccggcagtaggcgctgggttacccgcagccctagccaactctccctccataccccccctaccccacccccaaaaagtttgtctccggctggaaaaagcattaatgaacgtatctgtgggaagaaacggaaagtgaatgagtcaggagggccaccttcggccaaccgcctcaggaaaagcaaagaagccaaaggtctttggctttggattttgggggaaggtgatggggggaggttcagacttcgggaatcagggcgcggacgctgggcgtggaccccgtcattgttcccggctagctcttatctcccaggagcaagtatcctgtgtgcgcagcgcatgaatgtgtctgggcatctccgcgtatatttatatagtgtgtgatgcgaaaagcaggaccagcaggggaggaagagggggtgtggggggggagggaagacgagggagagcagaggggagagaagagagaggagagctcgaggcgagagagagagagagagagagagagagagagagagagagagagagagagagataggacttcctccccgattcgcaaagtgaagtcacttcccaaaattagctgaaaaaaaagtttcatccggttaactgtctctttcgctccgctacaacaacaaacgtgcacaggggagtgagggcagggcgctcgcagggggcacgcagggagggcccagggcgccagggaggccgcgccgggctaatccgaaggggctgcgaggtcaggctgtaaccgggtcaatgtgtggaatattggggggctcggctgcagacttggccaaatggacgggactattaaggtaagcggcggggcaacggacgcgggcggcggggaccggccggggaggcgaagcggcgggcgggtaggtgcggggcccgcgtcccggaagacgtggcctctctcccttccctccgcgccccggcttcgcgccggctcctccggcgctcgggtggcgagtcctactcgcgggccagccggccaggcgcccgcattgagggcgaccctcccccgaaatcccagcccccaaagtggagccccggcccccctcccacctcgctgcccgccggggctgcaggaggggacggcgggaaaccgggggaccccagggtacggaacggagtcaagggcgagagacctcggggtccaccactcccaccgacacccggggctcccgtggccccagcgctaggcactgggcttcctctccgcagaggcggaacacggcgggggcgggggctgcagtcgcccgggctcgggtccctgcctggtgggccctggggtgggtaagtggcctcgttgcacgagggtaggggtgcaagtgagtgtgtcgggggatctatctgagcgggctcctccagatggaagcccctgtttacatgtcagcgctttcccttcctctcggcactcagtcgcccggctctaggcgctggagagccgccggctccgcgggactcctgggccggcctcgccgcctctccggcggggaaccttccccagcccccgtccgcacagatccctagcgccccgagcccccgcccttcgcgcctaggcgtgcgccggctccaggaccagggctcctggagctgtcgcctccgaaagggtcctgcgtccttcggagccgcctccgttgcaggggccg

SEQ ID NO: 5435 - DNA, 3857 bp, Homo sapiens
gcgaggggcggggggcggggagggaggcgggtcgcggcgctggctccggggtccgcggcacggcctcctctgccgcgctgcccagggcccggaccctgcccggcgctgcgcccaccgcgagggtgccagacccgccgcgccgccgccgcgctctcccagccgcggccccctcccccgccgcttcctcttgctctcccagccccttcccccacgtgtggatgacgtcaaaattccgcgaaaaagccgcgtggtggctccccgagcggaggcgcgattccgccgcccagcggccccctcccgggggcgcctggagggggagaagggcggaggcggccggttccttctcctcccgggaggcaggaccccccgacgccgaccgccggacgccccccgccccaaagcttattggaaaattcacttttgtaaagcaaatgtatttccagagctattttcggccgcgtgaggcgtgtcctaagctgaatcagacaggaagagggggaagttcgggtcttttaattttttttttttccgaagggaggggagtgagatgctaggtgggtgacagacggcaggcgctcgccttcttaactcacgcctgtcgcatctgccgcctcagtaatccagccccgtccaagccgaaattcgccgaagggagtgcggatgcacaggcctggcggactctgcccccctccagaacgcagcggcccagcgccccggcgggcgcggctgcgaccagagggtcccggaagcgagtgaacacctgcaatcgcactgcccgtccccacccaccctgctcccccgtgctctccgcttcccgacgttttcctcttctccttgtccgcatttttctactttgcctgcactccctccttcctcttgatgtgcctcctatgtgtcccctcggatttatgtgtcccctcgcattttgccagtcgggttttcggttttgattgaccgtccatccctccacggagaaacacaaacacagctccactctttgggggagccgaggggaaggcagtggctcccatttctgagcctgaactcagtcactacccgctccccacctggcctaggcgcccctgcgcggagaaggcgggactcgaactcgcgctgctcccgggccttgagccgaccgcggaatcacctggctgggaggcatcctccaggtaagcttgggagtatgtgtgcttagtgctgcaggctcctgcagaaaagtgcctataaacacccaacaccctgctgcaccctccacctccaggctttgtacactttccaaccgaaactccaaaacgctagcgtagagggtggggagccggccggaaaaagaataaaagtccaataaaactggcgttcgctaaagtttatcaccagtcctacatgggatatatatatatgtatttttttttccgtgaagggtgaaaaggagataaggaagaaccaacaatctaccccctcccgccgccccccacccccgcgccacggtgatcagtttggacttcaaagccagagcacaggctcttgcgctttttcttgaaaccgaagtctacactgaaagaaagtgtgcacttttgcctagaaggcaacatgcgttttcccgcgtgctaggtggagtgcattttaacaagacattagggttttaacacatggctggagtggcgaccaaaagggaaaactcagtttccagtccaagcctcctagagacattcctgccaacctccgcaccctctcacgccccaccccacgtgtgagagtctgcaaaaccaccggggattggattcgatggcgagcttcacgctcgggaacagtcagtaatcggaaggggaagtggacaggggaacttcaagaggcgagcctgccacgcgggaagcgcccgaacttgcgggtctccatgaatgcagagggcgccgggaagggggggcatccggccgcgaccctctctgcccctcccattcgctgcccccctccccgctggaatttctctgtaaagcaagacggagtagggggagggggagagggaaggggcgagagggccctcggctcactcccgagacgtgaggactcgccacccaggcattctcctcggggtgggctgggccccgggacgaccacccgcttcttcctcgcccccgctgcccccacttcgggagacccagagctctggatgcctttccccggagaagggggggtgtgcggagtcggggtggaagagaccttgctcgcagagctatatcaagtgatgtccagaggctgggagccccggcggcctctgtcccttgcctgtcgggttagatttatactttaaaaatacctcccgccctccctccttctctcgcctctccccgctgcaactttctttgatccgctcaaaggtggcttaggtgaaattggagtaattcccttatgggggtcttaaaatgtaagtgaatgtccttatccggggtgactcaaaagcttaagtcgggaagcccaacgtgactaaaaccaataggtgattgttcggggccgactgtgtgcgggtgtacacggtattcggcccgggtgtcatccgcggcgctggactgtttcattttgagtttgcaacttgggtttttcagcgagctttttttcttcctgaaagctaatggcttccacagcaattagacattttcctcgcccgccccttccctcccctttctttacatataggagatgggatactcattcccgctgctattgataaggtcggaggcggccgggcctctccccagctttcgcccgccccagcgcccgctctccctccgccctcccttggcttccttttgatgtagtggggaacgcgtcctactaaaaaaaaaaaaaaaaaaaaaaaaaaaaagtaatctgcccggtaacaatcagcgcgcagtagcaggagccccagagctattggctatgcaaatagagggaggggagacggcgccccaaactcttcctcacccttttaaagcgatatcccctcctttcccccccaccaccccttccgccccaccctcgtttaaagaggctggctccggggcctgagttaatcgcttgcacctctagtttattcgctcccctcctccgccttgcagggaacctagtgtacggctcacccagcccgcgccccaccccgccttgctggctctccgcgcccctgcccgggccccctctctcggtgagggaggcactcagtcggcctcggtgtgcccagagagctcgagccacgccatgcccgctgcacgtgccagcttggccagcacatcagggcgctggtctctccccttcctcctggagtgaaatacaccaaagggcgcggtgggggtggggggtgacgggaggaaggaggtgaagaaacgccaccagatcgtatctcctgtaaagacagccttgactcaagcatgcgttagagcacgtgtcagggccgaccgtgctggcggcgacttcaccgcagtcggctcccagggagaaagcctggcgagtgaggcgcgaaaccggaggggtcggcgaggatgcgggcgaaggaccgagcgtggaggcctcatgcctccggggaaaggaaggggtggtggtgtttgcgcagggggagcgagggggagccggacctaatccctcactcgccccctccccctcccgggccatttcctagaaagctgcatcggtgtggccacgctcagcgcagacacctcgggcggcttgtcagcagatgcaggggcgaggaagcgggtttttcctgcgtggccgctggccgcgggggaaccgctgggagccctgcccccggcctgcggcggccctagacgctgcaccgcgtcgccccacggcgcccgaagagcccccagaaacacgatggtttctgctcg

SEQ ID NO: 5436 - DNA, 1439 bp, Homo sapiens
tcgccaccaccgccacccctccggaaccctctgggtccgcgctagtcccacttggtcacgatccggcaggcgaaggggtgcggaggcggtttcaccagcccgctcccagccctgcctcgagagagaagcccgctgagagggcagacagttgagaaactcgatcccaactccccagccggcgcctcccgaaccgccccgagagcccagattagccgggcagtggatcccggagcaaagtgccatgcacatcctggagaggagggaggcgtggagggaaagggcggcaaaaatgaaatgcccccaagtcagtcccgcaacttctcccggtccgagggacgggcggagggtagaggaggcagcggcggctagcgcgaggtgagggactcacttgaaggtgaggacgcagagcggccggtaggacttgtggctggtgttctcggccatgcccttgccccagaagtcgttggtgaagatgccccagcggagcggggcgccgggccgcacgtcggggttgttcacgatcgcccacacgtcgtcgtgcacgaactcgccctgcagggagcggccgtagcacaggcagcttgccccggccagcagcgccgcggccccggccggcgctagcccgcagccccgccgccgggagggtgtgcggtccccgccgccgcctcgggcagaggtggtcaccaccatcgcgccgccgccgccgctgctgccctggcctctcccgggcgtctggcatcctcccctaccggggccccggcggcgcgcggcgtctgcccggaggggggctcgggcatggtgctgcggcagctggacccgccgcgagctccccgcgctccgccgccgcctgcgccgcggagttggcccagctgcaaataaacagcagtccccccgcctcccccggccatcgccacctcctccgccccactgcgcatgcccgctcgctctctcttccaccgccccccaatcccgggacgcgggccggttcccccgcacagcccggcgccctctgcccccggcccgccttgcttgcaggtggaccggggttcgcggcgcgcggctgcccgggagctgcggggaaggacaccccaggttcccacttgcggtgtccggctgtgctcacccccacgcccccgcccccatccttctcccccgaatggggctgggaaggggcacatctggcggacccctcccgggggacccaggagggtttagcaggtgcgcagtctggaacccccacacccaccttccagggagaaaagtgccgctgcttcccgggaagttcccggcttttcagcacccgggacaacagcagcggcgcccggagagacgctctccacccgccccgcgctcgcgtccagtcgccggctctgtgctctcctgcccgggctttctctcacccgcccggcgcggcgtcccgcttggcggaggaacccgcg

SEQ ID NO: 5437 - DNA, 1288 bp, Homo sapiens
ccgacaggttgcagccgcgggttacctcggaggccaaggcagccacctctgcaagggagttctgcgtccaagcatggcttgtccgtcccgcctggcccccatcaacaaggccgggaccagcggccggtggaacgagcgagagcagccctagtcccacaggtgagccgcccccacaagcagccaagccgcgagccgtcccggcgccgtcaccgcccgcactcacttctccactccgggagggagatgggaggcgtgggagaacgcggagaggcgcggcgaggctgggagcgggagacggcgccgggaggcgggaagcggaccagagaatgggagaagcccggcaggtggacaggaggaaacaaaacccaaacgccccaccctcgaagtcgtcaggagctgagcgaaggaaggagcgaggtaggaaagcgtggcgccccaaatatgccgcgggagcggcgcgggaggcgcagaaccccggagcttgcagcctagcgcgcggggtcccagcggagcgcgaggacgcgagcggagccctcccggttacctgtgctgcttccgccctggctgcccctgtcccgagggaagatgcccgagcacttctcccactccacctggccggcgaagcacagctcggtgacgatgtgcagagccttctggcacagactgttcactccgtcctccttgtggaaactcatcgtttggcttttctttcgttttctctttttttcccagttagccgtcttttcctcttcccgtacctctaacccctctggcgccctaagccatagtccgcccgcggtgactttggctggagattgcgccgctgagagccggcaactcttaggagccccacgttggccccatggcgggagcggagggcgtaggggaaggagaggcgcgcgaggaggctgcggctgccgcgaggtttgcgccaactctcccgccgcgcgagcgagccgaggcgcgctggaactagagacccggcatggagtgctgaggggaggggggagccgtaaaaaagccaaagcaagccctcgactcgcaagcacgcccccctcctctccccagcgcactggtgtttctggcgggtgcctggcggcgacgcgtccaatcgcagcccggcgcgggcgctaggtgacaggcggcggagcgcgcagacccggctccccgcgtcctctgaagaagggactcgcgagggagggagggagggagggcgggcggcccggcgcccctgccgaggccggggatgctcatcgttgcccagagttggcccgaggagccctctccg

SEQ ID NO: 5438 - DNA, 1006 bp, Homo sapiens
gcgcgtgaagaacttagaccctccaatgcgcacatcattcccacacgcagggccgaggcggcagcgcggcccggagggggcccggagggaggggtcggactcgccccggcgcggctccgtcggggaattagctcccgagccgaataaaagcagccaaagactcgcacacccggtagaaggggggcggccccaagaaagcccgggctggggcggccccgcacccccccgtcttccccgccgcccgaacctgttgtaaaggcagagacaatggagaaagctccgggagacgcgcggagagactgctcctccggggagggaggggcgggccgggggaggcggggtaaggaggagggaggggccgccgagggcgaggccggcgctcagcgtcggtctcccgcacggtctcctggatgccaaacccggtctagggagcccaggagccgttgcagcctcagctcttctccctccctctctcgatgacccgggcaatgccaacctcctttcgggattgaaagctctaaatccaaggtgctaagttgatgggcggtctttgctctcacccctcgatttcgggcgcgtgtcttgaaagacaggagagaaaaaagaccacccagctgcaggaggcaaggctggagcgagtagcgctcgcctgccctttaagcaaaggagggaagcccatgtgcactcgtgcactgggctccggagcagccccggggtgcagggcactccccctccagggcgtgcggaggaaggccaccaaaacacgctgcactgccgaggtggagctgggcaaagtaggtagagactggtggggacggatggcgagcctgggaagccccgggtgtcctggtggagaggttccctgccgggggcggggcgctggagagcttccccggcgcggagagcttcccgggcgcggagagcgcagagaacttggccaggaggtgctggacagctccggaacccgcgcgccccctgccaaataaagcgtggagacccggactcg

SEQ ID NO: 5439 - DNA, 1185 bp, Homo sapiens
ccggctctccctgggcgcagtgcgcaccgccggcgctcccagatccctggaccacccggcctgggggcgcgggcgcggctggggagggaggggagagctggctcacctggcgctgaaggctggaaggtacagtctcggtcccccggagcccggcccggcagcctcgcactgtccgcagagggactgagcacttgaaaagcccaccgcgttccgtagggcgccccggcggggctaacttgttcggctgcggggcacagctttaggggaactgggctagcaggcaggggccggagctgcgcgcccgcggtggccagggcggtcgccgggtcgtggggcgcgggcggctgcagcctgggcgttggggcgcccccgacccgcagcaaattctcgatcaggaaactcttgcccaggttgccaaagccgggcgcagcggggaggttgaggagcgcggaggaagccacaacgtcccagtacgcaccggcgtgggctgcgaccgcgctggggagcatagtgcggcgccaaccggtctgctgcgcgcccgccttgcgcccgcctgtcgcccgggcgccccgcaccgcacccagagccgcagcttctcgccgccgcctcccgcagggctggagcgcgcggagccaggcagggaggaaaggccacccgggacggcggcggacttggaacgatattatttatttgcgttgggcgtttttttaagggatgggaggagtgagtgtgggagggggaagctgtgagtttctctggccgacagcgtaggctctgggagcgcaggggggagtctttccccctctctatgcagatctggacgggttttttttttgttttttgtttttttctggacggacggaaggtgtgtccagcccatccattcatgtcaccagccccacaaagtgacagacgcggccaacaataagggtagtgctgtggcaaggggaggggactcgtagtgggaggaggtgggcgtggaggcgacgtgaatcgggcgcgctcgccacctccccgctgccgtgcagagccgtggcactctcgctagagcccaagcagtcccccaggcgtggggtctggtggacgctggcctggagcgcccggagggcggggtgggggtgggggggacgcgctgtcgtctggggtgtctccgcgtactcctgttgggcgaaccctggctctccg

SEQ ID NO: 5440 - DNA, 409 bp, Homo sapiens
ccgtctctcggggaaggggtccctgaggcccgggtggccgcttgggtaaccgcagcctgcctgcgtctcttccttcctccgcgtgggttctagcaacatccactgcagccgggccaggcgagccggcgcgtaccatcggcgcggggggaggagagggccgggcctgggaagatgctgcggaggacgctgcggattcgcgagcccggggtaaggcggcggcgcaccgccccctcccgccgcttcccccccaccccgccccccaccgccgcccttagccctcccccgggatgagagagagtcgcgctgcggagcaaccccagtggatgggtccgcgggggctgagcgggcggaggacgcgggaactccgtgacaccgaccagctgacgctgcccgcgtgaaaccagagccg

SEQ ID NO: 5441 - DNA, 1813 bp, Homo sapiens
gcgggcggcggaggagggctggcggttagatacagtatcgctggagctcagagagccgggcagaggctggcggagagccgaggctggcccagccttcaggagaccggcgagctggggtgtgtgggagcgggatgcttctaaggcgaaaagaagcgccagcctcgtaagcggcctctatctgggctgcccaggccggatgctcaggagcccacagcaggggggatggagcgaaggaccgaggggctgggaggcgaggccgcagcgcactgacgcaggccagcgaggccgctggccccgacgcagggcgcccggcaaggtgtctggcaccacgagagtcaatccttgcgcgccatctccggaggccagtgcgcccagggcgcgccggcccggcaggagggtgggtgccagcctttcttcccatctctcgagcctcctccccggcgcccacgtgggcggagcagcgcgagggtgtgcgtggcaggggccgcggcggcgtgtgccgtgcgtggggtggggtgcgggctgggcggcctcgccttcgggccccgcgccgccggggcgcggcccccagctccatcttctttgccacctgggcggagatctgggggactgtgacctaccctgcggaagacacggaggggacgggccggccacaccccccgcgccactccggcaggcaccgggtgggtccccctcccgctccttggcttgagggcggaatccggagaagagtggaaataggggtggcgtgaaggagagctgggggctgggggcgggaccgggagggggtgttgggggaagcgacgcagcggctgggagattttgcaagggggtctgaagaggagtgggggatgggtatggaagggtgggggaccactgaggtgggatgcgagagtggaagggggacccagagggggcgcgatggccggaggagggggagatggacgatggggcggggcggcaccggtcgccgcgtcccttgccgccaggtccgcccctcggtcgccgggtccacgggttccctctggccagcgctcgcctcccgccccccggcgcacctgtacccacctgctcggcgctcaggcccgagccgggcagcagcagcggacgtagcgagcgcagccccgcgccgcatcctccggccgccccctccccgctgcgagcttacgccgctgtcgccgccgccaccgccttaaaaaggacaaaacggaacagaaaatgaatgcatgcacaaaaaaaatcgtaaaaagcaattgaggaggatggcagtcgcgcgcgcggctcggcggggcgggagtcgagaggccgcggcactggtggccgcgatccgggcaggcggccggcgcgtgccgcacgcgggtggctgcagctccctcggtcgcccgcgcccggctcaggcacggcaccgcccctccccccggggagcccctccgattggtctgtcttcctgccagtcaggcaggagggcgcggcgcccgccccgccccgcccccgcccccgccccgggcagatgccgggagctctcctgccgccgtgggagggggagctgagctgccggagcgtgcgcactgggccagcgggcggccggggcagggctggggtcccggcgctgagcgcccccagccgcgccgggcagcctggcgcctcgctgagtcggagcaacccccggcaggagctttcaggctctggtcaagcctcgggacccgggaagctatccctgccctcgggggctcgagcctggagtggggcttgcaggtaaagcggggctggggccgtcctggccgtcagtggtcaggaagacgcagcgaccccg

SEQ ID NO: 5442 - DNA, 1294 bp, Homo sapiens
acgctccctccggatgcgcgtggagcgccccacaggaccgccgccctctgcgcgttggcgcgcacacgccccccgccagcctgggcgccgggctccgaacccccggtctgcaaacttgcgcatctcccctcgccgcgcccgccagacaacttggcgaacagctcgcccgcccgcaccccgcttccttcggcccttccttcaaatcccaaacgcaccgccgtgctccaaagaaggtgtccacgtcgcccccagaccccggagcgccccctctccacccccgggacttcccaggtcgctcactcctcccgccccccgcccagatctgagagggaccgaaaacacacccccgactcgggcagccagggccgaaactgtcaagaggagaaaaggtaaagcggaaggagggtggccataaacagatttttttgccccttcttaaaaggacactgccgctttaaaagtttctttcccgggcccccactccccgcatctccgtattttgggggagcgtatttaattgaggcaacgcagctttcctccagtgtttgcagaaaaatcaaagccaggggggtgagcccgccggctgtcaaccttcccgccgcctcccccgccccactctgctcccgcaagccgagaacgggctgcaaaagtttgcaacatttctggggggcggaggggggaggggaggggggtcctccgggctcggggcgccgccgcaggctcgcgcgcggccgccggaccccgcgccccgggcgcccgctcccggccgccccccgctccgcgcccgggctcccgccgccccctccccagcccctctccagcctcctacctctgctggtgctggaatagctctgtctgcgcaccggggcaggcggctcgctcttgcgggcggattcctggttcagcggggtctccctggagccggcggccgcgtccgcgccgctgctgcctggctcgctggcggcggggtcgggggctgccggagctgactccatgttttttcccaatgtagagatcgctggagatggcgagctccgagactccctctatcttctgttttcagagcaactctatggtaccaaaaaaaaaaaaaaaaaaaaaaaaaaaaaaaaaaaaaaaaaaagaaggagaaggcgaccggcgaaagcaggagggaaaaagcaggcggcggcgggcgggcaagcaaaagcgcgagggagcgcgcggagtgtctgggtggacgtgtgtgtgcgcccgaaaggggacaagaggcgggtctggccacaggcagcgctagcgagagcttctccagccg

SEQ ID NO: 5443 - DNA, 939 bp, Homo sapiens
ccgatgccgagagtggttctgctggagaaccgccgcgcctgcagttcctgcaccttttcccggagctgcgccagggaattacggacgaactggaaggggccgagaagaaaggtcttggccaccacctctagctccaagccttttcgctctttcagactttggatcctccccggggaggacctccaggagccccttggcagtttcccgccgcctagggccgacttttccatctcctcctctacctccggctcccgggcgagggaggccccgcgccgccccttagactggctgcggccggaagattgcagccgctttgagcttactccttgttttctcataatcaaggagtatggtggagctgggtcaatttcaggcacagcccagccgagtcaggcgaggtccagagagacctgactcgcctggcagcctcaacggacttgtccccgcagccgttgcggacctcccggtcgtcatggcgactgtgaaatgtggggtggggcgcatgcgttggaagccattcgcgcgggcagtccctgagtgtcccctcacgtgctccccagcgcgagcagcacccccgcctctgcgcttcccagagcgtgcagcttccggtgagggcagccccacgcacagccccccacaccctccccagcgcctgcagcctccggtgcgcgcaggccccaagcccacatgcgcagtcctcaccttgcgcgcagccccatgtacagccccggacgggctcccagccccactggcgcagaacccatcaccgcttgcccttcacgcgcttcattgggagtgcagcccccaccccgagcgcgcagctccacgcagcctctccacactctccccagcgcctgcagcacccccagtgcgcacagctctgccagtcgcttccccgggcgccgcccctgcaccacttcggcccataaccttgcggcg

SEQ ID NO: 5444 - DNA, 939 bp, Homo sapiens; identical to SEQ ID NO: 5443

SEQ ID NO: 5445 - DNA, 899 bp, Homo sapiens
ccgaacgcagttacgcgcccactggctccctgtctctggcgcttctgggcacgggggagctggggcggccccgcctgcgcacggcggtgccgggattgggggcgggcacgccgcctccgtctcccacgcgctcgctcgctcgctcgctcccgccctccccgcctcgagcgatctcctgcctcagccttgcaggctccgcactgcagatgcctgctggcttccctgcgctcggcggctcccgcggtgccccgtaagtccccgtgaccctccagcaccagccggctgtgcgctccctgctcccacgggccggtcagccgcagacactcacccagctccgcgagctcagccgctcagcgagtggggtagcggggaccgagacggacggtagccgtgccagagcccggggcgctctcggatgcggcaggacaagctgaccgggtctctgaggcgcggggggagatgcctgaagcggcagggcggcggcgtgggcaccatcctgagcaatgtgctcaagaagcgcagctgcatttcccggaccgcgccccggctgctgtgcaccctggagccgggtgaggaccccagggctgcagatggggcgctgtaaagtagcgccggggctgcccgcgcttctgccttagcctgactccgtctaggccggggagctctggggaaagtccgcgtgccacctggtgcggggcaccgcgttggcacctgcagggagcgattggtctggaagggtagagggcagacgggggcctgggtggggcagcggccaccccaggcgcggagaacccgctgcttccaccctctccccgcggacccccaccctgcggcctgtgtgctcggctttctccgcgtggcggggaagtgcgggtggctgcccgggccctcagaggccg

SEQ ID NO: 5446 - DNA, 899 bp, Homo sapiens; identical to SEQ ID NO: 5445

SEQ ID NO: 5447 - DNA, 547 bp, Homo sapiens
acggtagacctcggagggggtgcccaggacagtgacggctgacatgaagctagcggtgagggacagcgccacgggcactgcggtcattctgcggccgcccatcaggaagtccttggaggtctgctggccgcccccagcgaaggcgtagtagatgccgatggcggccgagatgaccagcatgcccgcgaacaccacgtagtcccacaccacgaaggtgccgatgccccgtggcgtgtccatggccgcacggtcgcctgagccctgcgcgcaaactggtggccccgcggcgcgcagccggagcccggcgcgcacttcttatcccggatccctggcgcgcaggcgtggcgtcccgcggggactggaggcgtcctccaggtgtcggcctccgaacgcaccccgaggcggggtgagggctggcagtcgcccctgcacccgccgctgcgagccgcgcccctcaaacccaggtatgggacctcggaaaatcgacccgctgccctgagtgctcaccacgtgaggaactggagtggccgagttcgccaaggcgccg

SEQ ID NO: 5448 - DNA, 2505 bp, Homo sapiens
tcgagttaacgcgccctagtggcaggtggcgaatggccggagatccggcctcccagtggtgtccaccgccacgggcctccgctcgacaggcttatttccctccatgctggagcaaaccccggctgaaagagggccgcactaattggtttgcgtacccgaagtgggaatagagagggaggaaaaccatgtttcaggtgttacggggggaaaaaagtgaaatgcgaaccgcaggggagagagcgaccgtcaggcagacaccttgtgaaccgcggtggagagcacacctaggtggggaggtcaccggcccaacccaccaccctccgggagaatgcgggcagggacagcagcagggggcagcatccacgtctctacgcttgcaagggttccccaagtccctggccactgctccccacttcctgcagcctcggtgtccgccgggggcgtgtgtgaggggcggggccgcatggggaggagggatttaaaaaaaaaaaaaaaaagcgaggtaattagcattctccgattccactggctctccgccgcccctgctttgcatacgcccgtcccactggctgcccggggtttgctggggttcggcaaggtttgcagccgccacggccgctgctgcgctccggtgcagggcaggctggcgccgagcgaaccagggccgggaactgggagccgggagccgggagccagctgcccgcggagctgcggcggcggcggcatctggggtggtctcagtcccacgaacaccgtggccggcgcccggtggctactgcgcccagcggggctcagggaagagcggtctagacactttttattttggaagaaaggggcaagccccggcgggagcttccttcccggcctggctcgctccccattgcgcccagctccggcccggactctggaagatgactccagggtctgctctgtatattccagcggcggcagttccgggaggcagccgaaagtactaacagttggtagcagcggctagtggaaaagtgagccaaggcggcgcggactcggctctccccgcgccccgcggcactcgctgctcctcgccgctccttccctttggctcccaggcggctgcagcatgaagtggcgcagcgatggccaggagaggtaagaagcccgtggtgagaacgctggaggatctgacgctggactcgggttatggtggcgcggcggactcggtgcgctcctccaacttgtctttgtgctgttccgactcgcacccggcgtccccgtatggcgggagctgctggccgcctctagctgactccatgcacagccggcacaacagctttgacactgtcaacactgccctggtggaagactccgaggggctggactgcgccggccagcactgctcgcggctgctgccggacctagacgaggtcccctggactctccaggagctggaggcgctgctgctgcgttcgcgggatccccgggcaggcccggcggtccccggcggcctgcccaaggacgcgctggccaagctgtcgacgctggtgagccgggcgctggtgcgcatagccaaagaggcgcagcgcctgagcctgcgcttcgccaagtgcaccaagtacgagatccagagcgccatggagatcgtgctgtcctggggcctggccgcgcactgtacggcggctgcgctggccgcactgtccctctacaacatgagcagcgccggcggcgaccgcctgggccgcggcaagtcggcccgctgcggcctcaccttctccgtgggccgcgtgtatcgctggatggtggacagccgcgtggcgctgcgcatccacgagcacgccgccatctacctgacagcctgcatggagagcctcttccgggacatctactcgcgggtcgtggcctccggggtgccccggagctgcagtggccctgggtcaggctcgggctccggcccaggcccgagctcgggccctggtgcggcccccgcggcggataaagagcgggaggcgcccgggggaggagcggcgagcggcggcgcctgcagcgcagccagcagcgccagcgggggcagcagctgttgcgccccgccggccgccgcggccgccgcagtcccgccggcagccgccgccaaccaccaccatcaccaccaccatgcgctccacgaggcgcccaagttcaccgtggagaccctggagcacacggtcaacaacgactcggagatctggggtctcctgcagccctaccagcacctgatctgcgggaagaacgccagcggtaagtgtctgcgcgggtgccactccctctcacctaacctggccaactcttggcgcaagtttgcctcgcgtccccctcccgcgtcttcccagccacgcgctgctgtcccaagccgctgaggaggcggccgggctggaggtagccagaacaagaggttgcctgtttgctcctgcactcgggtgcgcgtatttcacgctgctggtgctgtcccaggtccgggagcgcgaggttccgcccccggtgcggggcggggcg

SEQ ID NO: 5449 - DNA, 1587 bp, Homo sapiens
gcgcgtctcgatagcccccaagatggccgccaatgtgggatcgatgtttcaatattggaagcgatttgatctacggcgactccaggttagtgcgggcagcgccggccgcgcggccgtgaggagcccccgggcgcgccctgggcgcattggggaggtccccgggcgggcaggcggacgccctggggcggcgggcggcggctgccggggctcgccggggctcggccgcccgctgcccatcgataggtattaggaattgatctcgccgctgctctttgttcggttcagtcatcgattagctgccgcgaccatggagaagcgctagtgagccctcggtcggcggagcggccgagcggccaggcggccgggcgaggagcggggaaggcaggggctacggcctcgggcagggggctgctggcgggaacccccggcggtcccccctgagccgcactttgcgcgcctcccaacttcgcggcgcccggggaggccgcggagcgcgccgcttgccagtccgcacccggctggggctccggcgagggagggagggagctggcgggcagggaggaggaggaggagaggaggaggaggaggagagaggaggagggagccggggttggcgaggaggcggctccgcgccccgccgctcgccggcacctcagccttcgccgcccgcctggctgcgcagcccggacgcgccgccacccgggggccgccgccgccgccgccagagccgccgccgccggactggccgcaagcgccggcagacctcttctcctcgggccggggtcttggggttcgtcttgcttcttgcctttacccccccgccccttccatccccttcccaagtctagatgcagacgggcggtggaggtgggcccgggcgctcgcaagtttgcgctcctgcctccagggcggtggagagccgggagcggcgcagagcaggtgactcccagccctcgggcccaagggaacttttaaatgagagatttccttgcttgttctgcctcctgcgtttctccccgctgctcccctcgtctcctctctcccgtctctgcttttcttctgtttctttcctctcttccctgctctttctctctccttccctagggcgactcttcgaaaccccatcactttctccccatcctccctttgtgggagtctgtgtgcctcccctagatttggaggtgttctctgcggaccccgtaggagccggggctgggaggtggaatctcagagaacgcaccgtggaggcgcggctccggcctctgttctttcccggagtgccccggacgcgcctggcaaggccccccagccttggagtctcgcaaagtctcggcgggtgcggcggggatcaggggcgggaaaatggtgcggataacagggcggttagagcatcctgccttgaccgtgacattcgcggaagacgcgagatcatcagtctggagataaaaagggacccacttttttttttttttttaatccgccggcaaatctcgttaagtttcttctgataagtggttccagcacccgcgccttctccccgtcctggccgcttcccagtccccgtccttccgaacgccccactcctcg

SEQ ID NO: 5450 - DNA, 5693 bp, Homo sapiens
tcgcggttgctgggagagtactggcggtgggctgaggctcctggagagcccgcggggtggagatgggggtcggccccccctcggcgcccagccgaggagcagctgccagttgagtgcggacccgagagagaacccccgagggacacccacgtctcccaccgcgtctgcgtcgggcgttttggtttcaggaggctgcttcggggcggggcccccgggggccgagcgcggggggcggcccggcggccttaccacacggcggcttcgttgagctcggggttgggatgcgacaggggtccgctgtagccgctggtgccgctcattgggaagggcgggctgggcccgccgctgaatacctcgccgggcatggggtgcagcgtgcccggcaggcctggctcggggctcggtgtgtccgggtgcgagatcatgtcggtgaacctggggttgtccgcggcgtgcgggccggcgagcggcggttccagcgctcccagcggcgtcgagccggggccagaggccgccaggaagctggagtcggccggggactgcgcctgcgaaggcgggccgtgcgcgaagaagtcgtagttgcttcccggcgcgtagtagtcgccttggtagtctgcggagggggagcgggaaggagacagggcgcggtgagagaaggcgaagtaggcgggggacccgggacccggggaggggacccgggcgggcgagagaggggagcgcgcgacaccgacccaaggttagagagacctgcggaggccggcgccccttgagacggtggacgtcgcaggctcacggggagggttggggagagagacaatgagagatctcgaaagggcaagagactcagactgccagagaccacacacagagacgggagagactccgagaccgtgggggacacacgcggcaaaaactcggagacttcagtcacaggttccctgacacctagagatggagagagacagaggcggccagagacgcagagacagacaatgattcctaagtgtcttagggtcggtgagagacacagagatgcgggacagcgagagacagacggagagatcggcagaggggcagagagaaaggcggaaaagagacccagagacgcggagtccgcggctgagacccgaaagcccgagacatcggagggtcgcggaggagtcgaggagacgcagagagaggaaagacggccgcggttagagacacgcgtggaaacccccgggggcggcagcgagggagtcaggagtgagcccgaagatggagagaagtcgatgcgcccagagaacgcaagacggtggatcagagatgagtcccaggaacctccagagaagcggaggctgacaggcccggggagaggaaccgggcagggacaaaccagcggacagagcagagcgcgaaatggttgagaccgggaagcgacctggccgggggaaactggatccgggccgcggcaggagcgactggtgggttgggccgggcggggcggccttggcgccctaaactcggtccctgcgccctaccaacccagtccaagtccttcgcctcgccaagtacggccgccgcgtcgatcccggtgagaccatttgtaccggcctagcctagcctgagaaagagaaaactgagctccagcgacttgggagagggggaggaggacacgaagattctctgggtcatggccagagctccgcgggctccttggggtagaagctcggtcctccagccttgccccgggttggttttgccagcacccccaggttctgaagcatctgaggacattgagatcttttgagaagctggtgatagctatgggctctctctcaaggaaaatgcaaggatgagaattttgcccataaattcaggaggtgtagggactccggattgcaaacccattctgcctcaacaaatctgtatcaactctctgaccgccccacatagccccttttccagaaccttcgggatatcctgccttcccccaccaggtggggccctgaaggactgacgtgggggacgtcacgaaaggaccaccttgtaccaggcacccgctttgtacggcgggaaaaccagcgagtccagaagcctgagtctcttctgcaaatccactccccctgctgagtcctgggatctcagtcaaggggcgaattcctgatgccccctgccaccctcttccctctccaaaccctgaaatctgtccaaatggggggtgtctggaggcgtggcttggaggcagtttaagcaacagctaaaacggttgccaattactttttaaaaccattaatttaattctccccgaaagtgaaggggaagatggggagcggcaaatttggagccccaaagggacagggatgggagacggccgcggcccgcggcgagccggaaaaccagcgaaggccgctgcccccgcgccgtgcgcgccgcctccgcccatatggcggccgggccggaggtaattggaacaaacgccgtctgaaaagggcacaaaagccgcagctggggctttgtccgcgctcccacggggagccgccggccccgccgcccggcccctttctcgcccgctgccggtcgccaccgccgggatctcccagcgcggattaggcggggctgcctcgctgggggctggggagtcttccccaccattacggggaacgaggggcccccagtatccagctccccacctcatccagcgcgcagggagaggaggcggtgggataggtcggggcgggggcgaagtggtcctcggggaaaccttggttaattatccaggcggggaaaaattccgggccggtaccgcccccactacctcgctgctccgggcccagattttgtagggaaagaggcaaatttaggtggagagagtcggtgagtggagactccggaagacacgcccaccatccgggctctccagggttgggggtctgtccggggttgggggtctgtccagggttggggggctgtccagggttgggcggctggggcgctccagcctgagccctgccactgcctggggtctctgccctgaaaagcacagcctggcattttgcccacaatttctaggggccccggtccggtctcaaggtctaatcccccctcaggcttccggatgtgctgaggttagtgatggggttatcttcccttcccttctgcgtctacctgggtgcctagctcctgccttgctaacactgccactgaacccactttctaagagaaattgcctcttcctaacctgcgttacaactcagaagtgcagatgcctctcagacatagacagtcctggggtctctccaaattcagaagcttcagaatagaagaggagaggtgctttcttgagccctcagccctgggaagaacaggacagtgagcttggtgagctcaagcaatgcggctcagggtaaggagctgaaaaaatcggatagggggagttgggatggctcaccaatccagtgtgagggaagtgagaggaggaaaagctgaggtggcaaggggacagctcaccccaggcccaagcctggtaccaccatctgaagccctttgtaaactggggctcctcgctctctgcagccccaaagacggtggaaatctggggttggcccaacacttgtgcccccagtctgtaggaaccccaggggtctcggggctggagggtggactacagtcctgcccagagcaactgccggcatttgggctaacactgccagatgctgtgcgcacacaccccgccacatggaacaggagttgctgccttcgatgctagtgagcaggcggcttggaatgaatccagacccccatcccctcccctcacactaccctccagcgctcggaatccacctcatgccaagtacaccaggcacagggcggcaggaaggctgtgcgtctgtccgtgggggccgcatgcatgtggatttgccagtactggcctcagtgtgactggtgggagtgtgcgcgtctgtggagttgtgtctccgtgagtgtacctgtgtgtgagagggtggaatttacctatacgtgatcgtgcgatcgtgtctagacgtgtgtccctggagtctctgaacgcaagtgtgagtgcaccttgtgccctgcgtgggtgaatgtgtcactgtatctcgtgtgtgcttctgtgtgcatcactgtatgggtgagaccatgtatctgattttgtgtccaggacatgtgggtgagtgtacatgtgtctgtgatcgtgtgtccagcgagtgggcgatgttctggagcggcggaaagcgtgctggccgggacccttcgccctcagctcccggaataggacaggtgcggaacagcgaatcccggggcgccccttacctccgtagtaggtgtacggggtggaccccaacatctcagactcgtccaagcggccgcccagcggacgcatgcgccgcggactccggaagaaggcgtgcctccgggcgcctagggcgctcagctgtttcatccggcgttctttggaccgtcggttctgaaaccacacctgggacagaggagggggctgtgaacccaggatcaggagtgtcctctccccccctcttctcccttccctgactgggctgcccctgctgggtccttgcgcctcttccgcaccaggactcccccgaggcggggccgggccggattaggccgggaggggtggagagaggcttcggcgaaccagccaagggtgaaggatttcgcggacccgtggggcgactcataaagacttgggcttcctggtccccggctcgcccgcggcctgacggctctataaaggcctccctcccggcacggctctcgcctcggcccctcggctccggagccagcctctggccgtttgtctgcccgcgcttcggcgcagggagggagggggcatcgcctgtttctctgctcgaaaggtggaggtaaagagggatcccggaccccagagaggcttacaaccttccataagcaaggcggggggcggaattcagagaggtaaagtgacccgcccccaaatcgcaataccaggaggacagcagggctagatggaatctttcggttcacagtccccgacctcgggcaagtgccccactcgggcgcacggtctgctcccagaccagaaccaggcgcgctcgtagccaaggaagcttggcgggagactcctccgaggctcccggctcccaggccagcggggctaaggagctgtgcccgccccgggccgcacctggatgacgcgcatgttgaggccggtctcctgcgccagctgctcgcggatgtggcgcgtgggcttgggcgtggcggcgaaggcagccttgagcgtctccagctgcttggccttgatggtggtgcgggggccgcgccgcttggtgcccgagttctgctcctcgttctcgttgttggccgtctccttgtccgacgaggtcgagttgtccgtctctttggggtcgtcctgcagtgcgtcctggaggtccggggacaaactgcggtccgtacaggatgacactgcgggcggacggatcgggaaggggacagcggcgtcagcgacggccagacgcctcttcagtccagtggcgggttcccgccggcccaagctacggcctgcccaggctacggccagccccgctggattccctcccaaacctgcgacagcccctcccccagggacccggtgcccgcccactctctccaggcggggctgggcctttggaggggcgctcttaagccctctccgcgcg

SEQ ID NO: 5451 - DNA, 589 bp, Homo sapiens
tcgcctcgttctcggggcttcagggaggcggcgactggagccccgctgcctactcacaacaaaagaaagcagggctggcgcccctacacgcgctcccattcactgccggccgcggggagaatcctaccccgcgccctcgccagggtcccggggagctctgggctggcggaggcgaacaagatgcggtttgacagaaccaggccgtgcttctgcaaacctcaatgccgctccgccagccgcggcggcctcccagactccatttgccggggagctccgagccgcgcaaaatctctgcaagctgtgctctgcagaatgcaaagccgggctggaatccgccattcccgccgccccagccgactcggccgacgagctccctcctgagcctcccgggccatctgccgggacggttacctcgttcggtgaagccggtgcattcaccacatcctctgctgctcctagcagggaagccggcggtgaggcgggggagcaggcatggtggctccggggtttatgcggggtttactgcttacccagaatagcggctactgctgcctactagggcgcacctaccgctggagcctccgcggcg

SEQ ID NO: 5452 - DNA, 1294 bp, Homo sapiens; identical to SEQ ID NO: 5442

SEQ ID NO: 5453 - DNA, 1373 bp, Homo sapiens
gcgagcgtctggcgtcctctggggcgcagtcccgagagagccccttccgggacctcggacgcaaggcccctgagtggccctggaagttggatcccccggggaccctgctccgaaccctggccacctggaagcaacctcatcgagcgctccttccactgcccagccccgaaccgtggcggaacgcgcccctcggcctccctagagcctcctttgcgggagaagcacaactttcccaggttttggagacggcgctcttacaccccaatctcgcccagacggaagaagtgagaggtgcgggcggccccgccatgaccgcgggaggagagcgcaaggaggctcctcgcaaagttggaggccaggccggagcgatgttccgggagcggagccctcccagcctcgggcccccagccgcggacagctggcagtgccaaagactccgccattacctgcggctcgcagttgcgattcggccgcagagtcgggcaccgaggaaggcgtaaagttgagcttgggcaggtacaacggtccccagggactggcatcccccagcccgggctgcccgcgggagggtagcgagctgtgccaagggctccgccattaccgccagcgcacagctcggagccaagcgcgcggctgaggaacgactagggtcttgcaaagttggagcctgggcgcgtagacccccggaccggagcccccggcctgaggccgcccgctaggaggaaaatgaggccgcccgaaccaagttgggacgcgcagcaaagcccgagccttccgcgcacaccaggggctcgggcgggagcggggagccctggggacggagaaggggcgcgggacgcctggatcaggaactcacctgacgccgagccgggcagcgccgaggctgcctcttcgcgctgcgcacccgcccgcccgcctcgtactcctcctcttcctcccgggcgcccgcggccgccgcgctccgggttctgaatcctccgagtccgccgccccgcgcggctggagggcgccggttgcacccactcgcctcctggtaggagccgcgcgcgtccctccccttcccctccgctttgtgcctccaagatccctccccaccccctctcccctagcccccactcctcccttctcttcttccctccccttgcgtcccctccctcagcctcagcgaacccaagttcgggacggaggctgcgggcttccccggcgcagtgctgggcgccccgcgcgcgcccctggctcaccccgtccgctcggccgctgctcgctgcccggccgcccctcggaggagccgcggcgctaagtagctcctcacccagcggctggaaacgcggcataaatatgtagggactgagccgtgagctcagcgagggtcg

SEQ ID NO: 5454 - DNA, 1524 bp, Homo sapiens
gcggctctgcggaccccaggcctaagggggcatcgtcccaaacacccgacgcgcccccatcaccagttcctcactggcaggccccaagcgggaacgggattgggaaggcttcgggcctggggggccttaccccgatgccccaggggcgccctgaacccagttccagccaggcggcggcacctcaggcagcgcagggagcgcgaccggctcggggagggggaggacgcggcgctcccgccctccctcggtccgcctgtccatctccaggtccctctgtccgccggccccctggctctgcccaccctggggctggtggtgggcgcgggccgggcctaggcccatgcccggccccccttactgcctgccctcctccctcaccaccccaccccacccccccagtgctcggcctcgtttcgtcaccggatcccctggaatgggggacgcgggcgcgaaatacgaacccagccaccggcagctccctccccacgtgcgctcggcccgcagcgcagagggcggcccggggtgggggcgcctcacctttgccctccatggcgtgcacgaagtccccctggtacagctggctgcgaagcttctcctccaggctgaagccgcggacgctgacgatctcctccacgtccgacaagtcctcgttctcgtcgtatcgctggcggtcaatcgggcgctgcgaggacccaaaccagagagcccgggacattattgtgggggctggaggtcgcctctcaacctgggcccagcactaacaggtgcagcagccgagcgccccctgcaccccaccattgcaacccaagcaactttgcgcaattgccaaagatgctgaaaagcaggacaaggagaggggcccgcaccccgagggtccagctgcgctctacgcggggtactcccctccggtgtcttcggaagcactgaagggacatctggggaccctcccctgccccccgcccccgaaatgtgctgggcttcgcccactcggccgggagcctggttatgtaacccgcgaagggggctccggacacgggctggcggggcaaatgtaggccccaggaggagccgctgcggcgcccggctcggcggtaacagcagccccagcggccgcggcggcagagccgggaagccggaaccgggggccggcggcatttctaaagctggagccgcccccgagctaccggggaagctggaaagctgaaatggaagggctgagaccccagccgcccccgccgcccgcccgccagtgcaagaagaggaggtggggggaggagaatcggggcttggaagggggagaggcagacggcccgccacaaagctcggatcggagaccccaaaacgcaccagcagctgcctcatctccccacaagcgcgcgcgcacactcacttcctaaggagactcccccaccactccccgcatccccctgcctcctccctccaccgcccagcgcccggcccctcagccccccagattccgggcgaaccccgagcccgctcagcccccctccacgcctttccccg

SEQ ID NO: 5455 - DNA, 1009 bp, Homo sapiens
gcgtctgcagcgaaggactcgcgtgggagcgagaaatgtccctgcccagtgccccgcgcgctggatcgcgggggcgagtctgagggtggagaggccgccgggtggaggcgcgcaggggtgcgtgggtgggtgcggaaggagtgcagggtatggaggggaatcttggggcggcgcgaaggaggagcgcttggaaaggcgcggtgtttggtcacagaggggctcggagtgggagtgcaggggtgcggggagggagtgcagggacgcggggagggagtggaggggtggggacgtgctggaggggcgcgcctcgatagaactggagaaactggaaaagtggaggggcggggcagtggctggaggaacctctgaagcgacgcggggaatatgtgaaggagtgctatgttggaacttggaggggaggggggatgctggagaggcacacggtgatggacatggaaggacccgggaggtgtggagtggtgggcccggcccgtcgcgggaaggacacagagggacataggctgccctggagaggcgctttcggacatctggaggggcgcatagtgctgggacttggcggcgcctggggcggaggggcgcgccggatccagccgggcgcgctcgggggccgggcgcagtgggagttgacgggcgtccagccggcggcgccctgggctcggctaggcgcaggacggccctggcagcggtgcagcagcccaggctagttcctggggggtccctggtccccgcctccccgcgcgccccggccagcaccgcccggagtccgggcggggaagtgggcgcccgcggcttgggaagctgctcccccgccctggagcagagtcgtcgctgcggtcgctgaggaaggacggagcagaggcccgcgctgtctggggagaagactgtggtgtcatcccgtcgggaatgaagggaaatgcagcggctgtttgcgccccgggactccaagaagtacagcaggtaaagagaatagccacggcccgccacttcg

SEQ ID NO: 5456 - DNA, 961 bp, Homo sapiens
tcgccttccccgacacctaaaagccccggtcctgcgtaatattgcggatccctcccagcctcccgtccgctcctcctcccgcggggctccgctcagggccggtcccccgcccccacgccgcagcccgggccagcggggcccgccgcggtggcgttcgcggatgctgccgcattggccgctgcggcacggacggcgcagcctcgggcgcggcccggcacaggcgccggcggtccccgccagctagcagcccggcgaggcgctggcccacccatggtcctcgggcggcggcccctgcgcccagccctgcgcgtagcctccgtctctcgcccggggccgccgagcccccgacacgggcgagatgctgaacggcgcaggcctggacaaagctcttaagatgtccctgccgcggaggtcgaggatccgctcgtccgtgggtgagctgggaggggcgcggcgagggagggtgggcccggggcgggggcggcgcggggcgcgcctgcggttatgcgacactgccccgcccgcgccccgctcccctccctgggctccctgggctctctgggctgcaggatccgccgacgcggcgcgctggccgcacgggggctgggcgtcgctgcacctgcggggccaaaaggctccaggccggggcgaggtgagcggcgggcgtcagagacccccggctcgtccctgtacagatgtgtgtgtgtgtgtgcggcctccctgtgcgcgtgcccgtgcgcccctacgcgcggatgcggctcagggatgcgacctaggcggcagtcaccgcgatggtgggcacggtttggcggcgcagagaagatgcagccttccctgccggcggccggcaccgctgtgctgcagagctcaaaagcagagggggaaaaaggcatccgaagggtccctcgagtgattctcaccacttggagccccgggtcctcgcgcgctcacagcggcgacg

SEQ ID NO: 5457 - DNA, 961 bp, Homo sapiens; identical to SEQ ID NO: 5456

SEQ ID NO: 5458 - DNA, 980 bp, Homo sapiens
gcgtgagcgaggcaggcacacacggactcgcggcggtctgtttgcaacagcgctgggaatgcacattggaaaatcacatcttgcatgctgaaaacgaacaactgtttgacatctgggctgctgccgagaaaaccacgcggcagcggcaggtctcgagccaggggccgccatcctcgatggaatatttaaatcgcctatttccatcgaactcccaccctccaaacgcatcccccgcgcgcgtgcacatcctcaaacgcacccccgaccggaacaaagaggggctccagactccccccgtgcgcacggggcagtcgggagggccacgagagggaggtgtgtgcaatggaagtaccgagacagacagacagacagatgcccatgcactgctgccgattccctggcggcggggacgggagtcggacgcgagggggacagacagggtgcggggacaggcggcccgcgggggcgggggggtcatcgagggggtcaccttggctcgcccaggccgagggggctcctccggtgcttccgaagcgcgtgggctactcgtgtcgcatgtcggcgcagttgcccgctgtggcaaggggggggcggccgggctccggagcgggccgggagggcgcggggcgcgcactccgcggcaggtgagcggcgcggctgcaggtgagcagcagcctcggctcgcgcgcccagctttccccgccgcgcccgcccggcccacacgctccccgcgcgcgcgccgcccccgccccgcgcgcgcccggccgcccgcccgcccgcgggatccccgcgaggccgcgcgcccccacgggtcagggctgctctagggtgcgggcaggcgagggcggcccaggggcgcggggcgaggggcgaaggagccaggaggctgagaactgcatggtagccctgcctgcctgccgcgctgcgcgccccaccccagccggcggccccgggcttgcaccgggcggggcaggggagcg

SEQ ID NO: 5459 - DNA, 408 bp, Homo sapiens
ccgtaccccctgaagctcgctgggcgcgccctgggctgtccttccctgagcagccgggcctagagtcaaggcgcgatgattgccgcgcaagctagggtccacgcggccggggctcctctcccgcctcgggcgcaccagaggccagaaagcggaaagcggctctgccaggccaaggccgacagaaaccgagagcatgtcgctatttgccggagagaactgccctgccaggctgccacaggtgacttgcccgcgcgagccacggcctctgcgcagagctcctcccgaaggggagagtcagagccacccgcgggtttggtcggggctcttcccagcccggcgtccacgccccgcgtcctgcgctcgcccttgcggctgcttatgctcaggtgtttcggaagaggcgccgcg

SEQ ID NO: 5460 - DNA, 2190 bp, Homo sapiens
gcgctccgaaatctggctctctgcgcccaggggaacgaggcacaaatctccgccactcagccccactgagcagagactgcgagtccgaaccctcaagttcctcggggctttgacccctcaatggcggcggtctaactgctggtaaaacccccggcccctgactgttccaccgcccgtctcccaaacgcccagcgaaggctgacttaggtggcgggcggacctcatcgattcctcaaaccacatcgtttggtcaaaatcgcccgccctctcttcgctcggattttaaaggctaggcttgtaagtcagtaagttaacggtatttgggccctgggctgcccttgtgggtcagggtcactgatgtccgcgacacggactggaccgcgcaccacgcctgctcccggcagaggccccacccgggtggctgagcgcagcgcactggggccccgcggtccgagagcggcggggaggagcgggcgctcgccgagcgttccccgggacagtccggcttggggactcaagcgggtcatgggatgccggcgctggccctctcctgagatcctcctgctcccccgcaggcacgagtcccctccaaatcggctcccctcctacactctcgtgacgcgaggtcgcggccagtgcccaatatcaccaaagtcccggcctcagcccagccccgggcagcctggcaggctttcaggagcctctgctcccggctccgggggaccctgcgtacctgccccaggtcctctgggaatgggctctgggtgccaggcaggtcccggtgcgtgctgctcctagtgcccagggcctcggcagtgagaccccaacccgacagctggataagggatcagcgatcctgtcgcaaacggacagccccagcgcggacccggtctgagcgctgatgctcgcgggtccaggccagccactcctcgaggcgctccctcggagaaagggcgcagcggccccaagcgtgcccgctgcaactagtgtcccaggttctcgccgtagccagcttctccgggctacagcctcgtctccccgcgtgcaccccgccctggcctcggaggctctgccctccggccgccccatcgcagcccgcctcaggccccggcccccagccgcgcctcacctgtgagaagcagacagctgagcagcgcgcacagcaggaccccggtgtcccagtagctgaccatggtgagcgcgacgcggcctgctcgcccggtgcccgcgctccccgcggccaacgacccggccgccagagtccgtcctctcgttcgccgccgccggccccgcgccctgagcgcccgtctcgcggctccagccaggagacaaccacttccccgggtaatcctcgccgccaggcgcccgctggccgctgcacccgagccccggagcccgctccgagccgccgccgctgccggggaggagccgagaggagtgtccgcctggcgcgctccgagcctcccgcggacctcgatgaagagcagccgagggcgggggcgatttataacctttccccagcccacttcctaccccggcacctccttctggtgacgtcaaggggtcccccacccctcatccgcctccccacctaccctcttcttcctcccaggctcgcttccctgcggctacggagaggggcgggggccgacgagggcgggtggcccggggccgagcgcgcgtggggaggtgctggcgacgcgggcccgggagcgcggccccggcaggttcagggtctttgctccgcgccctcttgcccttgcccctcctcctgcccatcgcgctcaggaaatccttgcagactccctccacccggcttactcagctctgggggccgcccgaaactggggaagggacaaggctgaagctccgccgcctggccctaggggcggaaagtccgatccaagggaagctggccgcgcctccgcgacggtgttcttggcacggaggactgaggcgcagtccggctgtctccccttgcctgctcttcccgcgctgtcccgccgctcctgaccccttcagactgtcccgagaagtctaggaaggcaccggagaccctcggcacaaggcactgaacctggagcgcctgaggggaactgacgcttgcttggcacctttgggaagactgcgaaccagctcaggtcccaggggagcgtgtccgtgtctttttcggccgcattgatgcacccg

SEQ ID NO: 5461 - DNA, 2190 bp, Homo sapiens; identical to SEQ ID NO: 5460

SEQ ID NO: 5462 - DNA, 679 bp, Homo sapiens
ccgagtggagagcagcggccgcagcgcggcgccaggctcgggctgggctggccggcgcgaacccccgggggcgtctgggcggccaggccgggtggcggctgcgcacgtaggagtaccccctgagcccagccgctcggccggcctgacccgcgggtgaccggatacgagtaacgcgtgcgccccgatctgtgccctgcgcggggtcgggcggggaccggccgggggcgccgcgcgcccggtcgggttgactgtcgggggcgatttccgcggggcaaggcgggggcgcgggagcagcgcgcagctgcggggccattccacctgagcgccctgaggtcagggccggggcctgaggacacggcgctgggctccgggggacgcgggttcacgccggcgcccgagcgccacctccccgccctccgccggctcacgtagtcccggggttcggtacgtgaagtgccggcgcgaggctgctcaggccaccgcatgggccgggcgataaacaatcgcacaggatacacaacaccctggactgtcacaagcccctcgcaggaaaagataaataacatctgaggcgctgcggcgcggcttccccgggctgaacaaaaactaggaggtggggggcggtggggcgaagtaaacaacagaaccgaagaattgccgcacggagcctgggccggcg

SEQ ID NO: 5463 - DNA, 2013 bp, Homo sapiens
ccggcagacctggagacgcccccggcctcttgggagctcctgagggtccaggtcgggtggggcgcgccttgcggcaagttcccttcttccagccaccgtcctgaggagcagaaggcgcggggacacacacatacacgcccgggcacgtcgccgcactcccccaactgaaccttggtgtcttcctcctgcctgcaaagacatcccaggccctgggcctgggagctgtccccgcgcggtcctgcctgaccctagcggggtcatagtagtctggcgcccggagcggctccagcgcggcgccgcgggcctaggtgggtgtcccagagagcgggcggctgcgcgactgaggagctggaggcgcacccctccgcccgccagacggcccggcccgcgcccccgccccactcccctcgcgttctcttctctggaaaggaaggccggagttgcaccctcaaagcgcctccgtccccacccctcccggcccgccgcgccccaggggctccacaaacttgctgcaagtcgtcggggctgcagctgcaggtaagggtgaggcggggccgcggcctgggctgccgagcacgccccctcccagccccaagcgtgcacgccccccacggacgcgcacccagcaccccacccccgccgctgcccccgaggctcccgcccaatcagaggccgcgcgcgccgcgccgccggcgggcagacacaccggctccccggcctgcgcccctgcggccctggccccgctgcagcgtcccggcccggccacactcaccgtcccgggcgcgccgtccgcgcgcggctccgctccgggccggcatcccccggctcggctgcctccggtccccgctccggcctcggttcccgctccgcagggctcggctccgcgatggtggccgcggcggcgagcgcggcagggagggcgtgtgtatgcgcgtgagagcgcgcagcgtgtgcatgtgcgtgtgcgcgggagggtcccggctcccctgcgcgtcccgctcctgcctcctgctcgccacgatgcgatgccggcagaatctctaccgcgcgcccccactgcccggcgcccacactcgcgcacacacgcgcacacccaggcgcgcacacccggctccgcactcccgactcgccctcctggagcgctcacaaagaccccctgccgggacggccggagcctgcggagcgcggccctgggcccctccgggacccgccggccttaggtgccccgctgctccccgtagggaccccgcgggcggcccggctcccgcaccctgcctggccgggccgcggccgcgctcccagcccgaacctgggcccaggtgccgactcgggcttctcgcactcccgcgggaagcgccggccccctccgcggcgccgccgcccttctcccccccttccagtccggcctctccggcgcctccctgccttgtcccacctgcccagcccggtcctcgttctccccgctgctctccgtctgtctcgccgccgccctctcccgcgccccttcctccccaccgccctgcgctgcctctcacattctccgcattacagcgggtgccgcccgccgctcgcggggcccagggttcgagcgcgcagtgggcggcgaggggacccgccacgcccggccccgccgccccctccgctctccgcggctccgcggctgctagctccggcctggcgctagggtggcgacgtcccgcgctagcctcggctgccgctgacagctctcatctcgcccgggcttaaagggatagcgcacccggctcgaccggccccacccgggggccccggggaagggacctcgctgcgcgggaacagtccggggcggtggcacagccggggccgtgcgggcgacgccctctccgccgccgtggagcccggccctcggggctggaggtgagtcaaggagaaggacggtcagaccacgccatccagggggcgctcagcggccaagcctctgggccgacaatgggtgtgcggcggtgtaggctgagcgccctggactgcgtggcg

SEQ ID NO: 5464 - DNA, 1501 bp, Homo sapiens
tcgaaagaggggcgcgggtgggcgcgtctccccgcgagcatctcacctaagggggaatccctttcagcgcacggcgaagttccccctcggctgtcccacctggcagtccctctaggatttcggccagtccctaattggctccagcaatgtccagccggagcttctttgggcctccgagtgggagaaaagtgagagcaggtgcttccccagcggcgcgctccgctagggcccggcaggatcccgcccccaagtcggggaaagttggtcggcgccttttctccccgacgaagccgctccagggctgctctcagaggacgcgcggcaggcaaagagaatgaacctgagcgtccacgaaacgtcctgcacggctcccgggagctgggagaaacaggtgcctttctccgacgtccgcgggcgacgcctgccgcaccttgcccgctgccgcgcccctcccgggcacccctcgccctcggcgcccctgcccccgcccccagtgccagggcggaggcagtcccggctcgcaggtaattattgccagcggagcccgccggggagcgggggtgggcgcgccggcggtgggcgggcgggcgcggcggggcgcgggcataaaggggcgcggcgcggggccccggagcctggctcccgcgcagcatgcccgccagcgccccgccgcgccgcccgcggccgccgccgccgtcgctgtcgctgctgctggtgctgctgggcctgggcggccgccgcctgcgtgcggagccgggcgacggcgcgcagacctgggcccgtttctcgcggcctcctgcccccgaggccgcgggcctcttccagggcaccttccccgacggcttcctctgggccgtgggcagcgccgcctaccagaccgagggcggctggcagcagcacggcaagggtgcgtccatctgggatacgttcacccaccaccccctggcacccccgggagactcccggaacgccagtctgccgttgggcgccccgtcgccgctgcagcccgccaccggggacgtagccagcgacagctacaacaacgtcttccgcgacacggaggcgctgcgcgagctcggggtcactcactaccgcttctccatctcgtgggcgcgagtgctccccaatggcagcgcgggcgtccccaaccgcgaggggctgcgctactaccggcgcctgctggagcggctgcgggagctgggcgtgcagcccgtggtcaccctgtaccactgggacctgccccagcgcctgcaggacgcctacggcggctgggccaaccgcgccctggccgaccacttcagggattacgcggagctctgcttccgccacttcggcggtcaggtcaagtactggatcaccatcgacaacccctacgtggtggcctggcacggctacgccaccgggcgcctggcccccggcatccggggcagcccgcggctcgggtacctggtggcgcacaacctcctcctggtgagtgcgaggggccaggcggagggccacg

SEQ ID NO: 5465 - DNA, 668 bp, Homo sapiens
ccggggccgcccgcacgcaacgcccccgggtcgggccaggctggccagggcagggcggccgcctttcgaggaactgcgggcggggcggcggggccaagctgagcgcccgccctgccctcggcgccccgcggctgcgggcggagcgggctctgcggagtcccccggccgccctccccgcagctcccgtccccagggaaggcaaaccacgcaccggtccgcggagagacgccgccgggggtctttgtggccgcgctgggggccgcctcctggtgctgtcctcgccgggctgggcgcggccggggctgcggggctgcagggctggggggcggcggcggggccgggctgggcggcagcagctgctggagcgcggcgcctcggttgcggccactagtgcagggatgtgcctcggcccgtcctcattgaaatgcggcgcttcgcacagcctcactccagcctctctctccagaggagggcggcggcggcggcggcggcgggcgcgctcccttttcttgtctcactcgctcacacgccctcccgtctccctcctcctcctcctcctccgcgtgcgcgccccgtcgcccccgcccttcttggcagggcgcacccaccacggctgcgccccaggtcctcctccctcccagcgccctcttcccaccgcagcaacctcg

SEQ ID NO: 5466 - DNA, 1006 bp, Homo sapiens
ccgggcgccctgcccgctcgcccgcgcgccccaggacccaaagccgggctccaagtcggcgccccacgtcgaggctccgccgcagcctccggagttggccgcagacaagaaggggagggagcgggagagggaggagagctccgaagcgagagggccgagcgccatgcgccgcgccagcagagactacaccaagtacctgcgtggctcggaggagatgggcggcggccccggagccccgcacgagggccccctgcacgccccgccgccgcctgcgccgcaccagccccctgccgcctcccgctccatgttcgtggccctcctggggctggggctgggccaggttgtctgcagcgtcgccctgttcttctatttcagagcgcaggtgagtggccaccttcccaggggatcgcggctgagagcgcccatctccttcccccgcacttggaaactgagtctggcggcagggctgggccacccagagcttgcatattccggaagggaaagtgactccagaagggagagaggaagtgttgagtttggggacaacctggcgcagggctgtcgggcgcaccctgctctctctccgcccacgcaccccagcttctcggtgctctgggggcggactcccctggccggacgatgggtttgaatctcaccccgtcccttcgctgggaaacaacactggcctctcaccttttctggtagtgattgcatactttttctccctgtcatttctcacttgaagttaagaatcaacttctgttcacgtaggaaaaaagatgagcgccttcacttgggcatctacctttcccttcccgcccaccacccggcgggtttcggttcctgcgcctggctgctctgcaggtgtgctggggccacggtgctggagggctgcgcggagcgggaggtcgcggtgctcgtgcccaggtcgcccaatgggtgggcagaatgacacggcgcgaccagagaggcgcgggctcgggatgggggctctgcggctgtggcg

SEQ ID NO: 5467 - DNA, 867 bp, Homo sapiens
gcgcggaacaaggcgctgactgtctcccagcctcccctcctccgcgccccctcggcagcagcgaaaacccggaaatctgatcctggccccaggagagccgggttccatgaggtgcactgagcatgctctgcagggtccggcgtgggagggacgcgctggcgctccccaggcccgggcggaagcggcgctcgcaggcgctgaaagcgagcgaccctctgagcccgggtggtccggcgggcaagggcggcgcgggagacccgcagggcgcgggcgcggatccggggaaccagggccaccgctgcgggcggatgggggtcaccgaggcggctcgtctccaggcgcacacttcgcacatctctttgctaagtgaaggggccaaaatgcacagatgggggagtctacccaggaacagaggcgcgagacgtatagccacccctgggttgggagcacgagccagcagatccccggagcgcgttaaacggacaacatgcccggtgctgcaaatagaggcttttgctggcagggacattggaaagaagggcggagagggagtacagcgaaaggtggggaccgcagaatttggaatctctgcggagaccggaaagaaaattaatcggagcacttcctacatgcagagccacggaaactgccttggaaagagaaagtggcagcgtctgggtcccctcggtcagcccgggccagtcggctgcgcgtgcgaagtctcctctagcggagcgggaccggccgcggcggtggatcgtggcggtccctgcacttctgctccagccgcgcctggaaacctgagcccggactcgcggctgctgcaaaacccgcttccagcccacctcactgcgaactttgcttccg

SEQ ID NO: 5468 - DNA, 1072 bp, Homo sapiens
ccggttgcgccgccctagcccagggacgccttcgccctcggctgccatctatcggccaccgagcgcccgcttcgccccgggcccatcatgtctgctgcagcttggctcgcaccagaggcgcgacaataaacaagtgcactggactgggccctgcacccgctccggagcagctgtctcagagacccggtgttgcttaccgcgttgccacctcctcggcgcccgggaggaagacgcaactttctcggagttttttttagagccaccgggctgccaggacaagccacaggcatagaacgacgcggttgctgcccgccccccccttcccccagaaaccccaaaggatgtcggtgatagagagttccaactaatgacgattgtgcgccgcatctggggaagggatacagaaaaaaaccctgcaaacaccgtgaggatgaaactgccaaagggatgcaagagcctctcaaatactaattaggggccgcggcggcggcgggctcggcgcggagacagcgtcggcgggatcccagcgcggtggtcgccgctgcgctggggggcggaggacagcgcaggagctgcagccgccgccttcgctggagcagccgaggggccggtgccacctttgctcgccccctcactaccatgtacagtgtgcgctgcaagaagaaggcgggagatgcatgcacacccccgcgacccgctccctctggctcgtcccccggcgtgcgccactgaccaggggggaatgtggtgaagacggcgaggaggagagccgaggggggaggggagggccggccggcgcgaacccaggccggagggtgcgaggagccagaggaggctggagggggcggcggccacagctgggtcggagaaagttgccccctatgcagatggcaactgtgagtacccctgtgggggggagggtgcagcgaaggctgccagggaccccgcgatcgcgccttaacacgtattggagcgagtgtgcgagtgatcatgagtgtgagcgggtgcgagcgctcggcggggctgaccgtcacgttggcggggccggcggggccaggcagtcttctccgcg

SEQ ID NO: 5469 - DNA, 1633 bp, Homo sapiens
acgcgcgcatacacactcgctctcgcttgtccatctccctcccgggggagccggcgcgcgctcccacctttgccgcacactccggcgagccgagcccgcagcgctccaggattctgcggctcggaactcggattgcagctctgaacccccatggtggttttttaaacacttcttttccttctcttcctcgttttgattgcaccgtttccatctgggggctagaggagcaaggcagcagccttcccagccagcccttgttggcttgccatcgtccatctggcttataaaagtttgctgagcgcagtccagagggctgcgctgctcgtcccctcggctggcagaagggggtgacgctgggcagcggcgaggagcgcgccgctgcctctggcgggctttcggcttgaggggcaaggtgaagagcgcaccggccgtggggtttaccgagctggatttgtatgttgcaccatgccttcttggatcggggctgtgattcttcccctcttggggctgctgctctccctccccgccggggcggatgtgaaggctcggagctgcggagaggtccgccaggcgtacggtgccaagggattcagcctggcggacatcccctaccaggagatcgcaggtaagcgcgggcgcgctgcaggggcaggctgcagccctcggctgccgcacgtcccactggccgcccggcgtccccttccttccccctgttgctgagttggtgctcactttctgccaccgctatgggactccgcgtctccgtgttgggcggcggatgctcctgcggcttcttcggcgggggaaggtgtgcgtctccgccgcctcattgtgtgcacacgcgggagcaccctggctcccgcctcccgctgctctcgcgcccttctaccccttagttgatggctcaggcccggctggccagggagcccgggtcactccggggcggctgcaaggcgcagacggagagccgagccgggcgctcactccgcgttctggttcgggcaaacttggaagaactgcgaccgcagtttgcccagcgccacagtctgagtggcgccttctccactcccgcccttgcgccggcaggggcggtggagagacgcggagggctcccccagcccctctctcccctatccgtccttcgggcgacagagcgcccggcgctcgggccgggggcgggcaaggctgggagggaccctcgccggggacctggcctctggacgccggcgtttcaaggctggtttggggacttcacgggctgcctgtttcagatgtggggcgggctttcccgttagggttcctcagtgcttccccagttgctgttggccactcagggcccggggacaccctgccacccggtctggagccggcctcgtctgccagcgaacagccaactttagcgggtggctcagctggggattcgggtccgggttcgggggccccgtgtcccccgcatgcccggccactggcattgctccaccaagagcttgagagcgcccaccctttctctcggcgccagtgtgtgtagcacttggtctccgacaacttgcgcggcagtctgggtgcttgttttccggctcttagctccaaccgaatccgagcttctctggggctctgtgaatgaaacgtgtcg

SEQ ID NO: 5470 - DNA, 1143 bp, Homo sapiens
ccgcggagcccccgcggagacctgctggagccaggctgcccacccccacctccccacccgcgcgttggcccagaggtttacccaggcagcggccctggtgccgagggggcaggtgcagcgctgtagtgatgcccagtggcctcgtcctcagccacctgccccccaacacctgctagatgcccaggcggggcaggcccgaggtgtcgccggccctgggcttcccaagccagcccaggggcatcccgcggcaggcgcccccgacacccacgcgcaggaatagggagggcgcatcgcggctcccgcgccccggccaggccggcaaggaccccaccgccccgctctcgggtggaggcgcccctccccacccctcccccgcgcggggcccccgcccgcagcccctctagcagcccctctcgcagccccagcgcccctgagccgtcctggcccggaccggccaaggaactaacgagcgcgcatcgcgggcctcgggcgcagggcacggagccggccgcgccgcagcctcccgggcaccggcggcggtgaccaacctgtaaccccagcgctcagagctgtcatggtgcccgcgggcggcggcggcggcgacagtgggcgaccggcaggatcagtgccaggcgcggcgcccagggcgggcggggacgcgggcccctcacctacggcggctcagctcaggcagcgcgctcggcccggctggggccgcggctcacgctcgccgtgtcactcactgagcgccgccgccgccgggcaggctgggggaggggtgggagccggagttttcgggcctttaaaaaattattattttatttaaatttttaaagttagctttgctacagggactgcagtgatgccgaagggcgggcaccgcagaggaggctgcgccgcagttggtggggagcgccagggtcggtactggcagttccttcttgccggctgccacccgcagtcagtctcacagcaacagctaggctctcatctgcgagctcctctcgggggtctttcgtactcaacagcacggcggcggtgtgcacgggagtccgccgggcacacgcggggtacacttaagtgcactgccaggaggccgggagcccagcgtgcgagcgtgaggtcagactgtgcacggtaccg

SEQ ID NO: 5471 - DNA, 1143 bp, Homo sapiens; identical to SEQ ID NO: 5470

SEQ ID NO: 5472 - DNA, 1371 bp, Homo sapiens
tcggttgagagcgtatggcgttctgagtagtgcaggcctcggcaccgagggcggaaagcgctctgagctcacagccgcacgacagaccgccggcctgggccctccaggaattccctgcagccttgcccggtccccgactctcgctacccaccagccctcccaggcacccaagagcctcccagcggcgggccagggccggcttcccccagcaggctcctctggagagcgggaggaagacaggaggcgctctcccggtggagggtccctcagcgacgcagccaggagcgctaggaggctacaaccggaggagaggctggcgctccagctccagccccagtcccgaagcgactcccctcttcccgaggtggccttggccaagtcttcagccatctccgtcaaatgaggaggtgggcgggatgcagacggtggagcgggaggcttgggcgcgccagtttgggagccagtgcgcggggcagggcgacgggcagcgcggggacgcgaatccccaactcctgcgcccaagacgaaggacccggtctcgacctccccatcacccggcgcgtaccagcgcccgctcagtgactcccaggtttggtggtggctaggggtgggaggtgagccgaaagggaaaaagccaccccacccaagtcgccgccgggctggagccagtctgcgcgggttccgagtccccggcgacggcgccagccctctccgctcgcccgcgcggtgttctcgccggcagcccctccggaccccgcgccccttctcgggcgcccgtccctccggagccctaacgcctgtgcgcgtacctggcagcagagacagcagcagcagcagcagcagccgcggcggcgacagcgccaggggcagcgagagcgggccagagcccatggctggtggccgggctggccgcggacccggacggtcgggagcgggcgcggcggtcgcagagacggcctctccccgcgcggctccagcgcagaccccagacctggagccgtgcgggcggagacgcgcggggctcctctccgcttcgccgccgctgggtttccagcgccctcggacccgcgggaggacaggaaccatccggagtgaagctgcgccaggcgcgggcgggcgggcgggcgtgcgcggggcggggcgtacgtgcggtaggggaaggggctccaggtcccagtccccagcgccgggcgagctccttctccgccgggctgggtgctccggccggcggcgtccgaccagatctgagcaggtgctgtcaccaccaccaggaaggagagggactcagtttctgtcccaggtttccggggcgtgtgcagctcccgcagggggttgggaccaccgggctaggcgggcgccgtaggagagacg

SEQ ID NO: 5473 - DNA, 1545 bp, Homo sapiens
acgcgaaccccgcgggtggctccgggtggtgggctccctccagcgcgcagcttccgctcgctttcccctcggcgctgcagccgcgacctgggaccgaacggacaccgccttcccggggctccggcggcgctctgactcccactttcctccgccgcagcctctggcagggcacccccttggcgcgacgccgcgcccctccccgggaccgccccctcggtcccccagggtgcgctcagttgctgcccgtgcgccccgccagcttgagcgccccgggcgggcggcggtggagaagcccagcccagctctccccagccgcgttcccggcccgcgctgctcccagcctgcaagcccatgacgtggcgacgccgaccgagacacaaagaccgaggctgagaccgccaggggttgagggtgaggccgcgtcccggggccgctggagcgcgggcgtcatgcgagactgtcccggctgcgcgccgccccagaggagtccgagcgcccccttcagccgcggcgcgctggccctggccgggactgcagccaggtgggcgccgcgcgtgtgagcgccgcgcgtgtgagcgcagacctggactcgggcggcggaggcgaaagtcgctccatccgcggggtgcaaccctgggcgcggaatccgggctgccgggtgacagtgaccagctgactctggagcctaccggaggcgcggcatcggaggccgtgcggaccactgccgaacagccgctggagacccgcagagaagggcgggccctgcgcccggggcgcctcggaggtaagttcggagagcccgggccgggcggagggcgggagcgcacgagtgtgtgtgtgtgtgtgtgtgttcgcggtgtgcccgcggctcggtgcacacgcgcgcgggttgtaaagtcaggagctgcgggagcgcctccctgcctcggcttggccccggagcattgcgggccgcggaggtgtgggggcccttgtcgctgcgctcagggcagcggcggaaaaggtgtgtgcggatgcggggcggggccgcacctggtggacagagcagggattcgggaagagaagccacggaagatgatcatgcagtttggggcaagttttcctggttgagcatcgcttcaggaaacggtgttttgagggttaaatatgtgagctatctgtgcaaaaagcctgacacatcagaggcgcgaagtaagatggaaagctggacaagccccaggtggaccgaccggtgcatccaattcttaaattgagatttccagtcacgttgatgtggaatgggatcgttgttcttcccgagggtttgataaggatgctcaacttcacctgtcagaaagcacgggagctgggcctggcccgcggggagcgtaagctcgctcacacgcggtccaactcaggcaaatgcagcatgcccgacctgctctgccgccatccctccgaaagcgataatttccttgggctaccgaatccatcagagtagtcatttgtcccctcgccggcggtgcggggagcgtaacatttgagtagcctaactctcacagcgcg

SEQ ID NO: 5474 - DNA, 1545 bp, Homo sapiens; identical to SEQ ID NO: 5473

SEQ ID NO: 5475 - DNA, 1027 bp, Homo sapiens
ccggccccggtcccagccccgacaacgcctccagtgcccgcagaagcggccctcggacagcgaggacagcccgccgtcgcaggctcacccggcgcttgatggacatggtggccacgttctggagcacaacgtactgcacctcactgcggagaggacgggtcagagcaccccgggcccctcggttggggcaagggtcagcggatgaggggaaaaggtggggcaagtcgttgcggggagaggaccagtgcggagggcaggactacggtcagtgtggagcgggtgggcagaggtggaagcggctggtgggcgtgagggggcggagccgggcagcccgtggggcggggcaggaggcgagggagggggcggggctgggggcggagcgcacctgtggctgcgcagcaggcgcaccagcgccttggcgatgacgcccacttccgccttgggcgccaggtggaagtagagctgcgccaccgccatcaccaccgcggcgctgcggctctgcagcaggggtttggtgttgcgcagcagcagccggtggtcggggtccatgacatagggctttcgggagggggcggccgcggcggccgtctcctcagaccccgcgcccttggcctcgtcctcctctgagccgtagaaggctttttccgcgttctcctctagtagggattcctggacggggagaccgacgggtctgtgggcgcctccccgggacacacttcggcccgctctgcctgggctgggcccacttacgttctgggtggggctcaggaactgcgtgcgggcgtagcgggtgagcatgctgatgatgaccacctggccccactcctccacgtcgatcagcaggttacagagtttccggtagtttttgtgaatcaggtcgatgcgctccgggcagacctcctcaaaggccatcaccacactgcccgccaccagctggggaaagaacaaagacgagagggtgaacgcgaagggtggaaggccggctgccggtcaccacccctcccggagcgcccctatacacgcaccg

SEQ ID NO: 5476 - DNA, 693 bp, Homo sapiens
acgaacaaacgttttatccccgggtagccggcgggtgcggagcgagtattcgtggggcgggataagtgcggaagtcgctgcgccctcgtcccttcatctccgggggacggccactctcagggttcccgaggagcccgctccgtgcacctaggccctaggtcggctcccaagccctggcccgccgctacaccagcggtttcttacccgcaagtacaaatgtgacacagacaccagctcctcgtgctcttggctcccagggtttctttcaccgcgcctcagcacctgcagcttctccactcttacagcgcccgccgtcgtcaaggcaacagagggatgcccggtgacagactcggcgccggcttccggcgccgtaagagaagcgtccgcgcgggcgttctggacccgcagagttctcggcgtttccgaagctcttggtgtggccgggacccgggagaaggagcagggctggtggggctgctgcagccggtgagtgtgtgctggcgctgggggctggaacctcctaggccagtctctgggcggtgccgcaggaccctgctcgctgcggctctgaggcggaaacaggggctggggccgagcgcgggctggaagctttggtccctggagtgtcgcttccagtctggggccgaggcggtcgcctgtgtagacccgggatcctcaaatagaacgaatccg

SEQ ID NO: 5477 - DNA, 1496 bp, Homo sapiens
acgccgagcgatcagatgcaaaatccttcagcgtctgaaaccatcgcggacgccgccgccgccgccgccgccgccgggtgggagccgcgaggagcgcctagtggcgcggtctgccgggcatggtggccggctcggcgatcgctgactcgccgggtccgggggctctggaagcgaggcgcgctctccgactccgagactttgcagggttgcaacagacggtggggaggcaaaaaaaaaaaaggaaaaggaaaaaatggtgctaaagtcaccaagtcccacctactgggcagaattaaaacggacacaccacgcacctgcaaaacacacacactcactctcacacatacacacacccggagcccgaggaaaggaagagaaggaagatgcagtaggagctgcagcagccgccgcgaatggctcgccgcgcggctgcagaaatgtacaagtgctccgagccttacgaaacgcacgggttatcggagcgtcttcctcggctccctccctcccttcctccctccctcctcccctccctcgtcgcggcctcctccccccgccccccgcccgggctgggagcggcaggagagcggaatctccccctccctcccctccccacacccgtctctctccccgcctgtcctctccctcctccccacccacccacccacccactcgccggctcgcggctgtagccggcaccgccacccgcagcctcgcggcagcccgcccgctccacgcctcgcagcgcggcgcccgctagccgcagcccgggggaaaccgagaccgaagggaaaaagttgcatttgagattgcgagggtcggggctggggagggagagttggcgagctggctgcacgacacggaaaggcgctctcctttccactttttggccctcgcgctacccggttttgctgcaatccggaccgcggtaggaagtgaaatgaacgtggcggaggtgattggggagtgctcccaagccttgggtggggggcgctcccaagcctgggtgggtggggggcgcaggctcacggacggcgacggggggtgccggagcgcacagacaccccagagaagcacccagagccggggaccgggaccgcagacgcgcagtccttggtctgaatgacactcatttccgtaatctagagtctggggctctggtcttggctgggaggggactgcgggacatggcacgctaggtgccccccgtgcccgctgcgctttcttggaggtgggttttgcattcggccttgagcaggcatggatcggggaaggaagaaacaggggtcgaaagggctgcgctggagagccgaggtggccccgggcgagctgtgcgtgcaagagaaatggccgggggaaattgagatgcaaggggcatattttggcaagcgccacgccagcaccgtcagaggccggcttctcgggctcagctctcgggtgagctgagctggctgccgggtgagggggcgggcgggctgctttctccggattcgggggcg

SEQ ID NO: 5478 - DNA, 5820 bp, Homo sapiens; identical to SEQ ID NO: 5231

SEQ ID NO: 5479 - DNA, 699 bp, Homo sapiens
ccgtggtgggcgaggcatccggggcttccttttctctggtccacgaactcccaactccgaacgctgtgggactgcatgggcctctgcccgggccaatgaaatgcgctgccgagaggaggctgcggcgcggcctgaggccggatctccacaggccggagagttctctgccggccgcggccggacctcccgggaaatgggaccagagcgcggagggagcctggccaggaggcctcctaggactcagccgcgacgctgaaaagcatgaagggtcggaattaggcactcatttagcgagcgttactaatccgaagttacagcgctaattccctgatccggccgctcccacacgcagcgccgggattagaggcgcggccgccgcccgccccgccctcataccccaaacgcgcccgccccgcgccctcgaggctgcgggctcagggctaatccgccgcgccgcgctcgcctggcccgagcgcgcggcgggtcgggctcggccagctggggcgagccggcctgttcgctggctcgggcgcccggttccgggctgggcaaggagcgcttggccatgagccgcgggacagcccaggcgggacggatgcgccctccagggcccaggcgaggccgcgcggtgcagaaccgccgggatttctccaacccgggtatgcgcacccacagcagcggcctttggaggccgcggcg

SEQ ID NO: 5480 - DNA, 1845 bp, Homo sapiens
ccgccttctcgccgcgcgctgggggctgtccccaggtgttggtctttgtgtcgagaaaactttgcgaggaggcgagggagctggacaaagagcgggcgagggagggcgtttgccagcctgaggggtgcgccgggcggtgcgcgcacttccctgggctcagctccgtacccggtcgctcgcggtggccagagcccagtctctctaggccaggagtggcgtccggctgcatccccgcgccctcgggagctgaataaagccaggcgggagaagcaaaggctagcgcctggacgctggagttggtgggaggaggcgagcagaggcgcggagcaaagctgtcaaactgcgcgcggagccgggcgcggggcgggggaagggagaggagggagggaggggcaggcgggagccgggagggagcgagcgggctcgccgcgcctgagcaacccctgcctgtcgctgccgctgccgctgccgctgccgccgccggcccggactcgtccggagcgcagggtgtctgcccagctgcgcgcggcgcgcggaggctccggcgtccgccgctgcgccctccggcccctgctcctcgcgccggcccgcgtgggtcccggcgggcgcgaacccaccatgcagctgcagttccggagctggatgctggccgcgctcacgctgctcgtggtcttcctcatcttcgcagacatctcagagatcgaagaagaaatcgggtaaatagctgctcccaggcccgtgccacgagccctggcgggatctctccctccttctgtactctccaccctccgaccccctttgtgtgcgccgcgccccgctgtagctccgctggagagatggggacggtttggcagaaggtggcggcgacaggggcccgggacggtttggggagaggagggtgggggcgcggctgctgtggggtgtccccgggcggggttcacgggaagcccccagctggcccgcgtcgggaagcggactcgcccaccctgcccccctgcctggcgtgtccaagcgcagtgtcgccggggtcgagggagggcgccggggagtgtctcgggcgggcggaggggccgagagtggagggaggcaggagtttctttgtctccagcacggccgctttctcgccttggcaaagtgggcagggggcgcgcagggatctctgagctgggggaggggttcctggggccggagcggagggcggggttctgcatgggctactgggaagcggaatgtcccctgcacacacagacaggcacacgcgcctcccgccggcccgggagcccggcgtaggagctggcaccactagagaagggctcgcatagctggactgagaccccccgccctcgcctggctttggacgttcagccaagccacggcaaccccggcgaccctgggttcctgtgcgctcgcagcgcggagacggagacatttcgggaaagtctgtaccgccgcccggtgggcttctgggccctcaggcgggcgatctggcgctttttttctcccgacctcgccagaggtagggtgggaccgcgagcccggatcctcccggctccggacttcctggagtgcgcacttgaggcgcgggacgcaccggctgtgtgtcccaggggctgagactcgcgccccgccccgcagccttcggctcgccgggccgggcccctctccggaacctccaaagggcggtagacgacaggtggggaggcagccggggttctgaggaggcccgaggagagcttcctggccctgggcaaggggaaggtgaggtctcaaagagggcagaaggtctcttcttctgtgggatttgtgctctgccaggcgctcttctcgagtcccgcgccgcgtgcg

SEQ ID NO: 5481 - DNA, 1844 bp, Homo sapiens
tcggcgaccctctggtaccctggacagctccccggggagcagtctaccgctaggcggcggctgctaagagaggaaccctcctgacgcggagtctgccgctccggggctcgctctccggcaggcccggggagaggtggggtgacaatgggttggggtgcgcgcgtgcctcataggtgcgagacagagcgagccgccggggtgtgagtcagcgcgctgggggctaagaagctgggtgaatagtcacggaatctcactcacgctcggctcctccacccatcccgtctacagcgcgtgtcccagtccagggcgtgcgtgcgctcggtgtccgattccgggctgtgtgtgtccatttggcgagatgtcgagagcggggggagtgtccttgtcggtgtatctgggcccaggttaggggacttctcctccccacccccgcgtgggtgtgggggtgtgtccgggctagggcgcgtgtgcttctgtgcctgtgcgtgcgtgtgcgggtcagggtggtgggaccgcgcatcagggcagggtgcctgcgtctgcgtctgggtctgtctggtctgcatgtcggcgcgatctcgacctggattcgtgtccctggatgtcgagaggccagcgtggtgggggtgtccagcctcccggaggagtactatgccttgacaccttcgtttcaccgccccaaagctggcctggggctccgtagggagtggcctgcatggggagggcccgcgtgctgtgtttctgggaggggtaagagagtgggggcgcagggggcgggccaggtccctgggcgcggcgcgggctcgggggacccgcgcggctgacgtcaggccactccttaaatagagccggcagcgcgctccgctcggcatttcccgaagagccagatcgcggccggcgccagcgccaccgtccggtccacccgccagcccgcacagccgcgccgccgccgagcgtttcgtgagcggcgctccgaggatcaggaatggggcttcgggcgctgggcgcgctccgaacccggcgcacgtaagagcctgggagcgcccgagccgcccggctgcccggagccccatcgcctaggaccgggagatgctggaaatgcaaccgcctgttccccgaggagccgctgcccccgggaccccctggcactgtgcgcaccctggtcagcagcccccggagaagacggcgcccccaacgcccgacccgcgtggccgtggcagcgccacgcgagccctctaggcgaccgcagggccacagcagctcagccgccggtgccccctcggaaaccatgacccccggcgcgggcccatggagccatggcctatagggtcctgggccgcgcggggccacctcagccgcggagggcgcgcaggctgctcttcgccttcacgctctcgctctcctgcacttacctgtgttacagcttcctgtgctgctgcgacgacctgggtcggagccgcctcctcggcgcgcctcgctgcctccgcggccccagcgcgggcggccagaaacttctccagaagtcccgcccctgtgatccctccgggccgacgcccagcgagcccagcgctcccagcgcgcccgccgccgccgtgcccgcccctcgcctctccggttccaaccactccggctcacccaagctgggtaccaagcggttgccccaagccctcattgtgggcgtgaagaaggggggcacccgggccgtgctggagtttatccgagtacacccggacgtgcgggccttgggcacggaaccccacttctttgacaggaactacggccgcgggctggattggtacaggtaaggaccaggagctccgctccgtgcgccgggtctctgatcg

SEQ ID NO: 5482 - DNA, 1480 bp, Homo sapiens
gcgggtgcggctttccgggagcccgcgggactcccccactccccactcccgtctgggaggttcggcgtgggttggcgatgggggtggaaggctcccgggtctgtggatctgcggcaggaggggcggctggtagcaggagtccctgcatcacccccacccccaggggcgttccggggtgggtgggggcatctagtgccccgcgaaaggaagaggaggagggggcgagcgtggagatgagttcaggagcggaaagcagcgcgcgcccctccgaccggcagcgggggtgggcgccttcccggggcgcgggagcgtccccaaagccgcggggcgtccgcagcgggtaggagctctgccttgcacctctccacggcggggcgtcccgcacgtccccccatgctggtccccggccccggaacggcgcgcgccccctgccccggaacgtcgcccctagccaggcggagcgctgggagctgggcccaggcggcgggaggagggcgaacgggtccggggctcgggcctcgatggccgcgccgccccgggggagccggagccgagctggccgccgcccgcgcgcactcaccaagcccgctgagctcctcctcgcacgagtaccagatgccggtgtggaaattcctgaagaggaagcggtcgtcgccggtctcccagctgtagagcgcgccgccaggggggccgttccccgaggcggtggcggcggcggcggcggcggcgggggcggcggtgccgttggccgtggcgttggcgcccgagttggggcagttggcgcgcccgccctggccgcagcccggcttggggacccgctgcgtgccctggcaccagtgcgtggtgaggaaagcggtggtggcgaacagcagcgccagcaggttcagggccacggccaggagcgctcggccgcggcggctagtcttcatgccgcccgcgccgccgggacgggactgcaccgccggggagctccgcgcgcgaagttggcagctggcgccccgcgtcagcggccgctgcccgccgcgccccggggctcgggtgcctgagatcggcggcggcggacgcggcgcgggcccatgccccccccaaccccggggtgggggcgcggcgcggggggcgtgcggggcgggctggcggggcgggcggcggtggaggagcggctacggcgcgcccggagcccggagcgcgagtgcacctcggctaggagccgctggcgcctggcagcggccacggcgcagggacgcgcgcccctccgtggggagacacctgcaggcggccggcgacactgttccggagcccgcccgcacggggagagggggccgccacgccgggcgcgggcgggggcctgggagtggagggacgcccccgaaagaaatccgagccagggtgagggtctgagacgcaaggagaatcccaggcaaggcgctcctgagaaaagatccccacggcggacgtggggcaacaaaacccgccgggagcg

SEQ ID NO: 5483 - DNA, 5065 bp, Homo sapiens
acgagccggggacctgggggcccgggcggccgcagcttagtgggctgaggtgccgatcagggtcacgcttcggagctctgtcggggcccagctccctccttcacaccccaaaatgccgcctagggcgtgggcatcccgagtggcatccggagccgctgagaccccgccgagattgctccttgtgcgtcctcccacagccgagaggccagcatcgtgccgggacgacccggggacccgagtccgggcgccgctacaccgcctcgggcgctaggcctgggagctttgaggccggtaccgtgaaacacctttaggagcaaggagggattccaggtgtcctccctttgtaccccaactccctgcccggatctcttccactctctgccatagcccccacacacaaactttgttctggacttgttcagccccttcgggacccacagttgtcgcctccatcggagaaaacaagtgcccctgtttcaggggggattccactctggctggccacccgcaaacctggaaaactattctatgacttcttccctgacccccctggaagtagggagcaccacgatccgcagagggcgcataccgaccagaaagattttggggggcagagggtgcaagtgttgtgggaagagatgcggagataaattttgcgagccagaccccgacactttccccgtccgtttgcaccgtctccggaacaactggcggccagcagcactctccaccccggccgcaaccccagcgggtcaggcgctggcgccccgacaccagtccccatcttcttgcagctctgaacctccaaagacacccggttctgcctcgcaggccgagggggagtgtgcgtgggggcaggggggcgcagcgaactcccccacgctcggagttcagcccagcgcccgaagtaaacttccttaccgctggcagcaaggccgggcggcggaggccgggccgggtgccctggggccggcgccgggagcgctaggggccccgtgcggtcaggccggggcgacctccacccgcacccacgcctcatggggctcccgggtcttggccgcggctgggatccccggaaaagcagggacggagaagccaggccggcatgcccgccctccttcccccgggaggacccaacaactccggaaagatcctgccgggagatgtgctcgctttccccggggcagcgggggaaagcccagcaaaggcacattgaaaattaaaaagaaaaaaaaaattacgccgagtggaagaagcaatcggggccgcggcggcggtgaggtagggggcgcgggggccagccgcgtgtgagtgggtccgagtgtgcgtgagtgtgagtgcgtgtgtgtgtgtccacggcgcgggccggagcactcaccatctcgccgggggagcgaggccacttcggggtcggattggaaatgttgaggcttcgcttgcttcctccgcgacatgctggctcaaacatcagctggggcagaataaaaaattactaaaaaaaaatcttctcaaaattacggaaatcgagcggcggcggcggcggcggctccccccgcccgccggcccgcccgccccctccccggctccccggccccgggcgcagcgcgcatgtgtcctgctataattatgattatcaataatgcattgcgattaatcatagaggggctctttgaaaggcgattggcaccgggccagcgctattcaaacccgctcgccttaatcaattagttcgtgatttgctgcagacccctgtctctccgcgcgctggcccaataagccggccgcggggctggctctgcgcgccgcgccgcccgacactgggttaaccctctttgcgaccgcccgggactccgcggcccggccgccgggggccggcctcctctccactgcgggcccggcgccccggcaggcgccccccgctctctccctctcccctccctcttccctccctccttcgcccccccccacaatcccgggctgggccgacccaaattagcatgccctccccggaattgagccgccccgggtggggggtggggccgggcggcgagggctggggacccgggctgccggcgcgctgcgaacttcccaactcgggggcgaggcgcgccggcccgcggggggagggagtcccgcggcgggatcaggggggagggcgtcccgtttcgtgagtgtttcttcgtttctttaagagctaccagaaagcagcccacccccacccccattaaaaaaaaaaataagcgagtggggaagagccagccccacgccggtccgcctcccgcccacggctcggcctccctcccgcctggctcggcgctcctccgccccgagttctccatcccctggatcccgggctcgcgggggcgcggagaagaggatccaggaaaggtttgggaacctgatgggtttgtggctggggggaggggcagttctcccgccaccccatcccctccccgccaggggcactgatcctccagcttcttgcttgctccctcgctccctttctctacctcggacattcccaggacaattagggctgaagttttcgggagaagcagccccgagcccgtgggataagggggcggcccggctccgcccaggacccctcccggacctcccccccggctgccccggttggctgcagggcgcgtcactccgcggggaggcggcggcagcggtggcgccgcagagccccgggcgggcggagagcggggaccggcctgggctccgagttcagctccggccggggggaggggaggggctgcggctcacactgagcgcagcagcgagcaccggcctagggagacacagcccgggcggacccggcactggactgggccagtccctgggacccctgggcaccccgccctggggagggggccgcgccccagccttccgggacgaggtggcggcgcagagccggaaagcggggtggggggagggcggtggggaggtgttctgtccgaggctgcctggcggcgccgaagctcgcctccactttttgggcacttgccgagcgcggcgcccgaacttttcgctctatcaccatctccctcaagctgagatgcaacctccctaccctcgccccagagcccagagccaggagcccgatccctctgccgggctcaggcgcccgcgaacctgagactcggtacgcggctcagcctagctctttcccctcgcgcctcggggtctcctcgctccaaggttctcgaagtcttgcgcccgaaggactaaactaaactaaacttcggctgagtaatgggggaggaggggggtgcagatacacaatccctgccctatctcacgatcaggaaaggagagggctcataaggacgccccaattcgcgagcgcccttgagtctggccggtgccacggtcggttcgcgcgaagtgggcaccggtctcccgagccgacttcgtgtactccggacctgtactgcgctccggtagaggacccttccctttctcttagcttcttaaatcttttcttttaaggtgtaaatgtgtgtgtgtgccgatgaatgtttctgtttttcatctgctgactttatttttttttattggtataacttctcccttctctctccctgctcgtccgttttccaccttttctcttacttatcttctgccctcgctcactccctaacacacacattcacaccctctccgcctcgctctcccgttctcgccaggtcctgatgggtacagtagattttgataaaaagacaaacgaagctatcagtggggctgatgttgaagaatgaagataataatgtttccataggtggtgcttcaaatgccattatttctcactgaatatttaaagagatccctcggcaaagatggatctgcgcactcctggggtgtgagcggctcgcatctcccagaccccggggaacgtgtacgggagcacgtgtaaatcccgcacccgcctccatctcacaaacaggggtcctcgcacacccaccaatccacactgtcccaggtacacgaacgcgtttgtgtgcacttgcacactcctttcccggaatgtgcccgtgtttggagccgcccgcatccttctctaacaatcttggcttcttgaaagtccgggcctcccgggcaccgcatgcagccaggaacctagcggagctggcggtcccgcaaagcttttctcctggtgcgcgccgcgtgcgcagcaggaagctcccgggaataacttcacacgtgtttgttacttggtctacgtgtgatttaagattaagtgtaggaaaaaaaaaaattccccccccccaaaaaaacaccacaacaaacaaccaaacgaaatgaacatgcgaaaagcagctacgcgatgcttaattaaaaatgggcgagcagagacgaataaattgggggatccaaactttaataacttttttcgtttttttgcgtcctcgacggcgtagaggcgggcgtttcgatctgcgcttggcgtcccccgctaatttcttgtttgttttctttccctcggtggccccgggaaaggagatgggaggtggaggagggggggatgggaggagggggatggtcggaatggcggggagaggagaattggtctttattgttgatggcaatacatcaattacgggccattgtctcggtcccaagttccgtggttcgctggtgcgggcgctgcagtgtcagggcgctggcgaggctccgcgtgccgcgatgcaaagaaatacatcaataaaaacagaagcagagtgggggttattctttatttttgtgcgggtcgaaagtaggcggcgagcgggagtgaggtgccactcctggagtccctccacgcgccctgctcaccccagagacctgcgcgctctacgtgcggtagcaccctcctaactctgggtggaggtggggtgggggggggactactggggaatccgggtagcgaagtttggacttgcaggttccgccagagggcctggtacttaggggctgatccgcaatagcgaatggggatagcccgaagtgaggcggcagctgcgccggggtcgcgacctcactggcggagaggaaccgcacccgggggaggcgcttggcg

SEQ ID NO: 5484 - DNA, 2372 bp, Homo sapiens
ccgcgactgcgcaaactccggtcctgacactctagtctcaggtcccaactccggaagggttcaggcccaagcctgcacgtcgcgttgccatggcgaccgctggctgccctctccgctctgtcttttgagcacgtggcaccaggaccccgcgttctctccagctcgagagccaggtctggcccagagccgggctcatcagtattccgcctgcggcgtctccccgaccctccgccgtgcctcaccaggtccgcctatccagcagcgacagactcccgccgtccgcgcgaccccaccgcccccatcccagtccctccccgagggttcgcagcccgccctgccctcgagcgtgcctagcggccctgggcactggcgcggctctacccagctatgcagtgctttcccacacactggccgcggccactggctgcagacccgccgcggaaagggggcgccctgagtcccgctcgcaggcagcgcgccccgagagacccgctctaaggcatccccgcaacaactctgtgggggcattcaactcccccgtgcgccggttaagattcccccatgcctcctgcaatgcaccagaccagggaggtaaacatcgaaggcacctgcattgcgcccccactgggatgcgctgtgcgcaagagacggggaccgtctgctgcaaaaccggatgatcggagacgcagggagttaggagtgggttttcttaggactcaccttatgtagtttccacatggcccccagagccttgacttcgtggctggagtgtttgccctcctccaagcactggtagcacacgggcatcttgcattgcacgcagtacatgctgtggttctccagctcgtggtctgtgcaggtggagaccttgcgtgggctcagcctccggctcacacgaccctgggccgggggcaccaggcggtgcttggctaggggcccccggggcgggtggcagcgcaggcggcacggatcgcagtagaagacatcgcactgttcgcacatgacggtggcttccttgggcgccttctcgcagagctggcacttgagggccgcggctttgctctgctggtagcggtcaattaccccttccagtacgcgattcttggggaagccgcggagcccccggtcatccaggatgaggctgcggtgacactgggggcaggtgatacaggagttgcggggcaccggggccagggccggtgacaagtgggtggccggtggcggcatagccgggggaaacacgcggacgccgttgggggacttctggcacggggtagtgggggcgctggcgaaccccccgtaggagccatagccgctgtccgcctcgctgtataggctcatcttgtccaggtccagatagtcatagtcggagaccccggagcccgcggcccgatggctctggggggattcagactctggggtctgcaccaggatgttgcgggcgcacgcctgacacaaattgtgagagcagggcaggatgatgggctcccgatagaaggagccgcacacggggcatttcaactcctcttccatctcctccatggggaccggtctgggaggagacagcgacggctgcagcgggtgcctgagctggcgaggtggccgacgggcccgtcttgtccagcaccctggccagcggcggcggctgtggtggtggtgccttcccgcgcagcactggcacggacacccagagaggcgctagctctgtgagccgcagccgcgtagccgccgcgccgcgcgccagcccggaccgcccctacctgccctcctagtcccgccccggcccatgagcagcggcccattgggcggggggcaagagatcgaagctctcattggccaccagacccgtccgtctcctcgtctccgcaggccacagggggttcggtagagtctgaggatagggcagtcttcgctcgcggctgcaagatctctgaagggggccggcgtgcggaggctaggggaccgggaaggaggagttaggcgggatgattcatcctcgcccggcttacttccgacctccggtgcagtctcccaggagctgggggcgtgagaaacccctccccgcagcgagtgggctgccggagggggctggggcttctcgccagcgtttgcgtttggctcccagctctgagctccgcgcccacctaccgcgggcgagtgctgcgcagcacggaggacgccccttctcttccgctgctggcagccttcgcaggcgtctcacccgggcctaggcttctgcacggcagtggggcttttctccttctccgtgaatccgctgacgccgtgccctggagctcccccatcccgggagtctgacggcgctggcgcaagccctggcgacactcttggcttctttcatcctgcgtccctcg

SEQ ID NO: 5485 - DNA, 2372 bp, Homo sapiens; identical to SEQ ID NO: 5484

SEQ ID NO: 5486 - DNA, 2372 bp, Homo sapiens; identical to SEQ ID NO: 5484

SEQ ID NO: 5487 - DNA, 2142 bp, Homo sapiens
ccgagggcagcgccccgcgcttgacctcctcgtaagcgcctacctgctcccaggtggccaggaaggcgtgggtgggggtaaagcgcgcagagcgcgggaagccagcgcgcacatagcgggcggccaggcccagcactgcgggggaggtgtcctctcggtacaggactcggcctctgccgtggctcgtgtcgatgtccgccagaaaaggggcgatggccgggaagtcggtggggaaatcatagtccacatactgcgtttccctggggaagtcctgagtggagatgatgccgttggtgcccacctgggagaggagagggacaaaaaggtgacagtcgctcaagcccaaggacgctaccctttcgcgcagggagggaagggaactgacttaggcaaaaagcctctctctccttccccactggccagggagtctggattcagggaaacaagcgcaacttttgcgactgtcccagctccgcgctgcagtaggtccaggggccctaaaactcgttcacctatcttctcactcccctcacaaccccggagccccatgtcctcggagaggaagcctccaggtctgaagagggaacaccccagctccgcagacgggcacagccttctcgcggtcctaactgcaaagcccgctggccgccctagcaacgccaccttttctgcctgggacgcgtacgtggctgcgaacaattcttgctctcccctccaggtcattcttgctcccctacagcagcggggcaggcagcggcatcgctctctggccgggtaccaccgcaagggtgctggggggctccaggagtggggtctgtttcctcccctctggaggcagggtttccgtgagaccgaccccagggaagaagctgcgggaaaagtgccaggagggggctgaacttacgtagaggttgctgaatcgggcttcgtagaagtgcaggggattcgccagcttcaccacggctgagctttcgtcgtcgccttcctgcaggagctggtccccccacgactccccgtgtgggaagagctcgtctgggtgcagcgccgcggcccgcaacattagcaacggcagcagcagtagcactggtaacgacgacagcaccggccgcccggccacccggtccccctccatgctcgctcggccgtgcgcttacccgctgcacaacgcgtcccgccccggcctccagcccactctccgcgccgcgccagcctcgaacctggatctccgcgggcgcctgggcggggcgggactccaggcccacccagcaagctaattggctgaggccctcggctggggaccaatcaccggctctgagaaagttcggcagtggccaccacatctggttctcgttaacttttctaaggcagcggccgctggagcagcggggctggcggggtaaaagctcctggccagggctgcctggagctgccccttccactccgcccccagggagctcccgggtcatcctctcatccgggctgccccgcggcccccaaggagccccacccccgggaccaaatggcccgcaaggtttggggcagcggcgttgcaggagatgagctcagcgcaaagggaaccccgcagcggcgagtgcggctgctggcctgcgcgctgtggccccaacaggctggcagggcgcgggcgggtggcggggttgcggtatgagctttgctccctgccctggggtcccgggcgctcctggctctggaggcctggccatcggtccgaaaagcaaagggacattgtcgtggtcccctcggccgcttcgctccacccagagacgccctgaggagaagcgagcctttgtacgaaggcagagggctgactcctaagttctgtccccctcccgaaggccggccgctagggaagacttggccaccctctggaagtaccttcccccgggaaaaccgcagcaggaaagaccatgaaatactactgtgtgtgatccgctccgtttggggagtaggatgaggcatcccgcttggttaccaggcagaaaggggcgagtcgcggggatgggaagaccctgatctcttgcccattgctgcggccgtcggagatgccctcccccgcggccacggaggcggtaacctgagctgctccgcaggactggaaaccgcacaacctcgaaaccagctgcg

SEQ ID NO: 5488 - DNA, 544 bp, Homo sapiens
ccgaacctgggcggccgtcgggcagccccctcgtccgaccatggcgactgacagtgagtgcgctccggccgcggaggccaggggtggggggaggccgcggtgcccagggtgggaagttcgatttcagacgctgcctttgtgctggctcgcggcagcagcggccgggtccctctccgctcctcacccttggctgcctggcggggcttgaaagggcaggtggccctggcggcgcgccccgcgagggatgtggcagaagggcgtgcgcctggcgccgaggcggagggaccctcgatgccgtgtggcagcggggcctgccatcgcagcccttcgcgggcactgcccccaggcccagagccagccttcagcgagccgggcaaacgaaggcactgcgcgtttttggcgctgtgagttcaaggttcgcctcgagttctgggtcgggtttgtgcgtctgccttttggggatcagggtggcttgcatggctcggctgcccggtggcccacgggctgtattcgcagcgggcagcacaaggccggctggagaccg

SEQ ID NO: 5489 - DNA, 2002 bp, Homo sapiens
ccggaggctgtgccggggctcgtcaaaggctacaaacaaaccggacgggtgggaagcacgtttcagcggcgactggatttttaaaaatctgctggtagagtgaaaacaaaaattgtcctccaagttggcaaaatcggcgtcccagacggtgcgcaggagggccctgcgaggcctgtccccggagccccgcgccagtcctgtaggcccggctgggtccgcagcccggtgttccactcgtgggtcgggcccggctgcggggtctttccgcagccgggacacccaggacagcagcggctggggagccggggccaggggcttccttgcaattccaatgatttttattattatcactcgcaaaggacaaacgcggccaaggccgggcctcacagtggctgtgctggtcatcgcgtggaggagtgtgcgctaacccaggggcgaggggggcgcgcccggtgtcccggggagagcttagaaggaagacgccccaccgtggtccctacagtcagggacagtctgggtgctagaaattcccagagagaactcgaggggctgatgtcctgggtcaccagtccctggtgcctgtggggcttcctgcgcgcccacccccatccccctcccccctctcaggttcgacggattctcccggaggcttaggacagtgatttacagtaagtggtgacagtggaataacgtgacagtccgctgcatttgccagctggctcctgggcaggcctacccgccgggcccgaccccagagtcgagtcctcggagccgccgggtaaagccccctcccccgccccggtgcagccccgcgttccccgcgcccggcgctgccggggaaaagtggcacaacaggaaagcctcgccagagggcccttcccagtcggcttcctcgccataaaaagccagactccagccgaggtcctgaccccttccaaatatacgttcccttgcccgcggcccgccactcccgcccgggcctcgggctgtgcagcttcctcctaggcctgcccgggcccatgcctcccccgaagcggcgggagtcggtgcagcctcaacttctactgcgtgtcccaggtcgccaaccagctttgctcgcgtgccgttggcccggaggctgccgcgccagtctctgcgtgcgcctgagcgcgctggagcatttgcgaggccagggctgccgacggcgagaggatactttgaggaacacggtgcttcagtcccgcccccgctctccgcccgagctggaggttggggcgcgctgagccgcagcgcctggacaagtgcgcgggccggagccgcccaggcctgcacccgggggctcgcggccgacgcatgcgcacgcgcggtggcgggtctgcaggcccgaaggcccggcccctccctcaaacccggagcggggaagcccaggggctgagagcctcggcccgggtcgcaggagctggggagcggggacgcgggcaggctaggtcttcccacctgccgtcggggctcctccccgcagcagcaaaggggtcccagtgcccgtggcagtgcatgccccagcggacacgctggctcccaaattcagagatcagaggggcggctgagaacggggcgtccgctgtgtgtgacccctgaccgtggaggaagggcgggagccgggagtaggcggtggggcccggggtcaggccgcggtcgtcggctcccggcaaaggcgctctggccggggaagggggcgagggtgggcggccggcctctgccgtcgtagtcatacctgggacgttgaaatgggctttggggatagagctcactcccagcgcgccccacaggagaagcccgcagctcaggcctgggccgtgcagaccgctgggcgggctcggggcccgaggagagcaacacggcgcgaggtccagtcgcgagtaataaccccgacagcacggcccctcgaagacgtgttccgggcaccggggttgtgagcgggggagcctcgggccttgggcccgcttggcacggggcgggggcg

SEQ ID NO: 5490 - DNA, 983 bp, Homo sapiens
ccgtttcctctcggcctcccgagcggagtgggcaagggaggggggtgaggaaggtacgcgatgcccccgccgcccggcgcctcaccggtcgcagcggctcatcgcccccgcgggctgcccgccggccgcagccgcgtccggggcatgtcagtccgccgccgccgccctcccgccggggttcgtgggctcgcagctgtcagggagctgcggggcagcgcatctggagcgcggggtctgggagggagggtgtctggggccagggcgaggggccccgggaggggtccttccgcacggatttcagaaagagggaaaccccgacccagagcggtgactggaatctacgcccgggagaggcccggagtcccggccgcgggcggcgggggattcctgcaggaaggggcaggaaggcaagcagcccggcgcgccctggcggctccgagggacctgggctcgggcttgcggtcgcgtcgcctgggctttccctgggctgggagcgcgccgggtctccgccttgcacgctgtcaccgcgggagacgtctcggcctcgccgcgcgcagaggggacgcgcggagaggctggtttctgggcgagcggagagctttgcccattaagctgccggaagaagccaaatcaaaaagccaatctccaagcctccaaacggaacgtcaccctatcagctgggagacagcgccgcactgactgacaagccgcgcatatttatcctcgcgcgcggaggggagactctcagaacgctcctcgaccagcagcgaggaagtcgagcccgcatcccgcatcccgcatcccgcatccagagcccccgagggacgaattcagatccaacccctgccccgcggccacccaccctagtcgttggagcctggcgcccgcgcctcccggccggcagcacgtcaaaacggcggcgcgtcctgacctggattccgccgagttgggagctccaggcagcaggcgggcgcgcggcaccg

SEQ ID NO: 5491 - DNA, 947 bp, Homo sapiens
gcggagcgcgccagagcgcgagggacggagggagaggaggagcgcgggagctgcggaggcgatcccgcgaattcattactgtaaacatatccgggggtgtcaggaggggtaggggtgggggccgcggcgcctacattagcccggccgcgtcggattgaggcagtagtgtggtctgagcagcctccagacccacgccgggcgggcgcagcacttggagcgagccctgcgcccgcccccgcgcagcgccgcacgcccggctccgagctgtccgcacacacgcgtcggaggagagcccgcctagctctcccgccgagtcccgggatcctccaaatccgaggagctccggcgccgcggggcagctttctgccgccttccccgctcgctgtacttcttttggggttcgttggcttggcgaagcggagagggggaggcggaggaggagagaaggcgggggtcgcggcggccgaagccaagagaaagtggcatgcccgaaccctggaggcggtggtggcggaggacgggggaagacgatgccgcagctccgtaggggacgtaggcgagagcaagcgaggcgagctgggcgccccggccccggcccgctgcggggaggcgcgcgccgctctgaggctccggcctccgcacccccgcgccccgacgctgcgggcgacagggcttggctccagcagccgccgccgtcgccgccgccgccacccggaggacccagcaaaagtttggatctgggggagggcgcggcgctgagcgggattaccaccagggctggaaggagacctcgagaacctttgcaggtaacgcgcgcccccaaccctcttcttccatgccccgccgctgcgctcccgcttcctcccagagcccttcctggccctcgcgggtctggcagaaagtaagagggaggcgaagttcaagatcccggggatgagcaccgagcg

SEQ ID NO: 5492 - DNA, 1362 bp, Homo sapiens
gcgcctctttcacccgcgtccccaggtccccatgtacgccacgtgggtgggagcgtgtcccacacacccgcgcgcccaaagccacattcgccacgctcccgccggggcgggctcaccgcgcgcctctgggtgccgagcctccacaggccacatagccgccacctgctgctgcatccccactgcggggacaggggcactcagtgcctccctccgtcccccccgccccgcgaaggcctcccatcctccagggccaggcggaggccacgtctttcccgggccccctccccaacgcggagagggaagcggagggaggagcttggcccgcagccgccggccctccccgcactggagctccccctcccctccctccccgcccctcggctgccgcagcccggctcgcagcgcgcgtcagcgggggctccccggagcgagtcgctaggtaacggggctggctccgcagacgcggggccggggaagcccgcgcgcgtcatcagcagcggcgccgcggggcggggggcgcagagaccctccccaatcccggcctgccaccacctggctcgcgcgcagccccggcccagaatgccttaacctgcgccgattgctgccgccgaggtgcccctcccctgtagggaccccgacgccgccagccccttcctcctttcccgcaggtgcgcactgctgtgcttgcggccgggtgggcgccccgccgctgcggtcgcggtcgccgctggtaagctgcgctctggggcttggggcaggaagcagtggggggcgctcgaagagcagggcagctacggccaccgtggccgccggaccggccatgtgctaaagtttctggggctcggcgccccgctgggcgcgcagcgcggggagcagacgcgccgtgggtggggcagcgcggtgctgctggcgcccggcccccgcggggtgcagctctgcgcgttctcatgctgtctctctctctttccctccgcgctgcctctccgaggtcctcccgccgagccccggcgcggggcatgaggagcccccgggtgccgcccagagaccagcaggctgcgcgcacacctagccagcggcagacggggacatgagcagcgcgcacggggtcccgcgcccggcggccagccctatccggcggcggccagcgggtcaacgctgcccgggagaatgaggcaggagccggcggcagcctcctttttttccttctcctcgccttcctgcggctccggcgctccgggtccgggccgggctgcggctctgctgcgtgccccgcgcgcccctcaaccgcctccggatgcgcttctcggtaagccaggccctccgcctcgcgaacaaagctcccttcgcagggcccggaggccg

SEQ ID NO: 5493 - DNA, 1092 bp, Homo sapiens
ccggactctgggaggagcgttggcgtggaaagccaggtcactccgatcttggtcctcaggctcgggataacgtgtcagccccaagagagcgctgcccacagccccgggtgggttgggttcaactgcacggggcggggcgccaacagctcaggacttgggttgcaggctggttcttgcaccaaccagcggggcggcctcgggcctcagtttccccatcccgcccacgaagggaggcgattgcgagcgcttggggtttctgacggaccccgccccgggggtggggcggggagtggtcacgtggaggggcgccccgtccgccgagccccgccccaccccgccccgcccgcccccgcgctcggggccctccgcctagtagagatctggagccagaagcccagagacagccgagtgcgccgtgcggtctccggacgctcgctgctcagcccgatccccgccaactgtgcaggcggctgacccgcagcggcagcggcagcagcgaggactcgagcgctggctgcagcgacaccatggatctctcctttatggccgcgcaggtaacggggcgtcccccccacgcgccccgggccgccaagtttggggaggttcggggccacggtctcgccctccacgctggggctgggcagtggcgcccgcccgcgatccgcgtcccggtcctttgtcccgagccggacacccccacttggtgcacgcgtcgggggcggcgatcgcggctctcccggggtggggcgggctgcgcgccccgcacccccgcggctcgagctgttcccgcccgggcccctctcgttggcaggaaggctgcgaggagcctgggcagcccgagtcgcccccttctgcccatcccccactgctgtcccccttctggggtcccggagccctccaaggccgggccagctcagacccgcgcgaacgtggatgggcacacagtctcgcccttccccactctgttttcccgaggcgccagtaatctgtctcttgccggtgacctcgggcgccccctttgccgccgcctgaggaaggctctgagacccgctttgtgaccgtgacccgccaagcgtcgacgcgccgcggtcg

SEQ ID NO: 5494 - DNA, 1092 bp, Homo sapiens; identical to SEQ ID NO: 5493

SEQ ID NO: 5495 - DNA, 1092 bp, Homo sapiens; identical to SEQ ID NO: 5493

SEQ ID NO: 5496 - DNA, 580 bp, Homo sapiens
ccgcccgggcccgcggattgccgggtcggttctcagtcaccgcacaggtgccctggagagtgcgaccaccccctgccctccgccccgcgccggccctcggctcagtgccccgcccttcctggagcacggcctgcgcatgcgcgcgccccagggcccagccctgttcctgctccggctcctgcggggatggatgcttcacgcagtaagcgagtaagcgagccctggagaccggggccctgggtgtgcggtcggctcagtgccacgcggtgagataggcatggttatcaacccacgccaaggcggttgtgtacctggcatagaaaacactgctgttgaatgttgtttccatagtcattcgccagcgtccactgatgagaggtgccaccacggacacccggccttgctccgtcgaagctttggtccattaggaccaaagtcaggccccagcgggcctccctgccattcctggacggcctcgcgtcctcccagagcctgaccttctcttatctctgcagcctaagtcgcggaagcgtagacacccggcttttcccgcgtgctctatcgggctcccctggacacg

SEQ ID NO: 5497 - DNA, 888 bp, Homo sapiens
ccgtgggaggtcagagcgggcgctgcccggcgtcacccctgcagcgtccggatcgctccgcataggcaggggtggtgccccctccccggggcacagaaacgccacatcccgggggcgccgcccagaggctgtctctgtttctgtgtcccttcatgaggctctgtcccacaaaggcagcctgagccaggaccctaaagaggcctggtcatcgggaccggagggagttccgcttcccaggccggctctgcaaacgcgagcctgcgccaaggcgccctgcgggtttgctggtggcatcgaggggcagcgcggggccagcgctgggagctccgaacccacacgctccggccagctgcccgggaagcgcccaagcacacgtcccgagtcccagattggattaagttgcccaactacctactttttctctctttaaggagaagcctaattggagaagattcggttttcttcgccatggcaggtccctttctcctgacccgcagttgcaggggctgagggtaggcgcaggtccgccctggggtcgaagccaccatcgggcctcgaggttgcccccctaacatccggcctgcacgcctggcgggggcgcaacagtgtctcacggctcgggagctcgtttttggcttctgagcaaggtatttttttcatctgccgtgtgtttagctgaattcagtatatttttctcgcacttctcgcttttttttttttctttctgaatctgctcttctgctttgcgggcccctaatctctcccgaatctcgggcgcccggcccggcccaggcgagcgctcgcggttggggacgcgggtggggacgcggcggtctgggcgctgcaggatgcgcctggccgcggaggagacgaccagggagcgggtcg

SEQ ID NO: 5498 - DNA, 1483 bp, Homo sapiens
tcgaatactgatatcgccccaaagctgcaactctccggccccgccacggctccttatgtacaaagagagggaatcagtcgccggtgacctcgacggccctcggatcagggatgccccgagtccgagcgggcagggtgctcagcagggccaggtgatgggaatcatggggccatcgagcacggaccctggctcccccggtggcctctgtgagctctggggtcaggcggggactggaggagcgtccgcgccgggagggagcgcaccgcgccacgtgcccgcccggcgccccgcccccaccccggccacgcccctcgcgcttccctcaaagccccgcccctcagccccgccactctcgtccgccccgcccctcgcagcctcaagctcagcgctcccggaggcgcggacggtggggccccgcgccttttgtgtcgggctttgaccgccgcgcgcgctcattcacctcagcggccgcgggcggaggggcgcacgcgcgcgcagtcccctcggagggcggtggggcgaacagcaacgcgcgtaccctagctcttggctgctgtgctgagactagcccgcgcgcccgcgcgcctctccctcgaggactcggagccgcccgcgcactcgccaggggccgccgccccgagtctcaggcggacgcgcacgcgttcccgccgcccggaccccagccggctcgccccccgcccccccatcccccggcggcggcccccaggcacgcgcccgcgcacacgccggcccgggcacgcgcccgccaagatggcaggggccggggcccagctgtcagtcgccgccgccgcggcccttccccgcagctagcggccccgacgcccacccggagaagatgagcccccgctgccccccgcagcccagtcagacgcggagccgccgcgcccggggccggctcccccgctagcgcccgcgtcccgcgccccgccgccgccgccgccgccgccgggtcgcccctggcccggcgcgcccgtccccggcagcgacaatgaggtgagtcggggccggcgcctcgtgggaggtggcagcggccagcgtcggaggggctgggctgggggcccgcggtgcccccgagggcgggaggggggctccacgggcgcgggggcttccagagaaccgcgggggctctgcagagattcgggggcattcagagcgcgggaatggcttcgcgagagccgtgggggcgtctggagagccgggagggtctgcagggcttgtggggggcagtgttctgcaaggggcaggcggcgctggctttggctgcttgtggggtcctcttaggctccggggggcctgcggcggcctgggaggcagacccccgcgggcaggtgtggccgtgtcccgaccgcgcgaggaccgaagttggcggaagcccctgtgcggtgccttccagcccggaggaggctggcctgaagcccccaggcgttgccgaagcctccccctgccagcgcccagagccgcg

SEQ ID NO: 5499 - DNA, 3714 bp, Homo sapiens
gcgcgcgaggctggggcagcccacaggaggagcgcgggacccgggcttgagtttgcacccaggcagagcgcccacccccgcccctagcttcggaccctgaaagtaaagtcgtcgtgcccggcagccagcccgaatcttccagccctcagggagtcggggtcggggcagggaaggccacgggtggcggcacaatcgggatcctggagtggaggcgcagactgcgggtcccgctgcgcacgctccgtggtccggttggggtgggccttggaggtccataggccaaggttgaacgggggctctggagcgtgggcggggtggagtgcacaggtcactgggctctgagcgtttccatgggccaggaccccaacgcgccgtgtcctcaggacagattggagggggaaggggctgcgattatgccccagtcggaagggttttacagcagccgcgctgccctctccctgccggatacccggcagtagacaccgacgtctgggggctagcgaggcaggtgggcgcggaccgcgacccgattctggcttccaacctccgcccagtggcgcgcggggccgtcgccccacacctccagtccgcgtggctggtgtctggctcgccgccggggcggaaggggcgctgtcggcgcaggcgggcggggccggagcgcgggggcgcgcggcgcggagcgagcgcagggctcgggggcgcggggcgcggaggaccgggggcttgacgggcggccctgcgcggtgcggggcgcggcggcggcgggcgcgcggccagtgaacgcgcgggcggggcggcggtggcgggaggcactaggggccgctccccgcgcttccctcttccatggcgctgccccagccgcccgagccgccccgcggcgcgccccgcaaggctcccagcctgctggagatgggggcgctctgcctggactcggagatcatcctgggcttcaccagccacctcctgcggcgacgaggcaaggtgagggctgtcgggaggggggcgggcggcgtaggcgccgtcccgttactttgccgcgcggctcgcgcggccgggggtgctgcgccgggaaggagacggcaggtccggagccgcgtcccgcagcccgggctgggactcgctgccgcactttcccccattagcgttgtccaagtctccctctgccttcaaggctgtgtcccaaccggacccacccggaggctgtggctagggcggagagcgcagcgcagggattctcgggctcaccttgcgccttgctaggatgggcgaagtagggggtcggggcccctgactgatcgtgagcccccgaggtgactccagccttgtgcaccccgtgttctgcggatatgggatgtgagcttgtgcttcccgaagcgccgcggcggtagaagcgctgaagttgcgggtgtggctggccaggggcgcaggaccggtgctcccgaccgctgcgtgcttctgtgttgcgtgtgtgggtggggggacgggatatagagagtgtgtgtcccggagcagtggagcggcgggaggcggtgctgtctgccggcagtgcggggtggggtttgggtgttgtcctcagtacccagatccagatgtgggctgacgcccgttttcattctccaggctgcgaagagacgggtaggggaagcgcttccggccccccaggctgggtggaaagcgactgcaggcttacggatctcagaaagagtggagagcccctgccactttattccatacccccttgcgttttcgaacccctaaggtcatcaacgacccggaaagccgggaggggatcacccaccccactttctggggagtgcgtgcgtgggcggggaggcttatccaagtaaaagggggtgggcaaaacggaaagggtcactttgacgtactgagtctctgcgaaggcctcaccgtatgtgccggcagccgcgtgtcctggtctccgccgggtcacgaccttcggagtttccgagtgcgcctcaggcctgggacgcgcggcgctgtctccccagtctcggagccgtgtgcgcagcggccggcagggggcactcgcgtcacggggagcccgcccgccgcgcccgcctggcttgacccgggctttggggctgacccggagcctggcccggagctgcctgcggccgcggatgccggcgacatttggggcccggctaggcacagagcaactggtcgccagggaagggcgggggggcggcctcccagccggagacaaacaagcaattaattccggagctgagttcccatctgccaggcctgctgacaacaggtccggcgcacgcccgcaggacctcccgcttcccgggcggcacggcgcgcacacccacttgcgggcacacgcgcggctgtaaagacacgtgccgttcgcagacgcgccgaggcacagatacgccggcgcggtcgctgcccggctcgaggcgcacaccgcggcgacactaacccacgcgcgacagttagacctaaagtggcccgcgacacgcagagtacgctgggcttgctggaaaggcgcctgggagtctcggggccggggtcccgccccttcctcggcccacctcgccgtgggccttgggcaagagcgtcccctccgcagcctcagttttcccgcctgtagagggaggggcgtcggcgcctcctgggagacgcgcagccctggtgtcccgggagaggggcgggaggcgcatgcgcgcgcgcaactagatcctcgccgccgcccccagcgcccctccccggggcagggactcacctaacaggttggggtccttggagtgcgcggggccgcgtggggaagcggggaccctaccccccccacgcgccgcccagcactgggcaagggcggggcactctctgggctcccgcccctcgccgcccgccccgggagcccgagccccgcccttccccggccccgccctcgcctcccgagcgcgcccaccggagccaccgcgctcctcgcgacactcgcaggctctgcgaacttccgagcggctgggccgggccatgggggcgcctcggggccggatcacgtagccgcggcgcccccggagagccagcgtggccgggagcgcctgccgggctcttcccgcgccccggccatggtcggccgcggcgtccctctgtgcgctgcgcagcccgcggtacgcgcggcccggcctggagagggaggcgggcggcgggggcccgggacggcgaagatactcgcggtgtgcgctggatccctgggggccgggcctcctgctgagggtagcggacccgcaggcgggacctccggggatggagggagtgggtgagcgccagggtcgtgcccagggctcctaactttggcaagagcgtcacgctggggcagggcgcgcaggggtctggatccgacggacgtcccaggctcactgtccgcttccgcccccacaccctgcaggtggccgagggcggcccggcccgcgagccgccgccgctgctggaggtgtccccccgaaagaggctacccgccgggcccgaccaggacccatgcggcagccgccctgctcccgaaggcgccggggccggcccagagcagggccactcggccggcggaggcggctggtgccgccactgccacacgaagctggtggagctcaagcgacaggcgtggaagctggtcagcgggcccgggaccaccctccgggtaagtgacacttccttaggccgacccctccgagcagggccacgccg

SEQ ID NO: 5500 - DNA, 1266 bp, Homo sapiens
gcggcgaggagggctgtaggtgaagcgcggggagagggaggtcgcccgctccggcctctcccccaggggccctgcggctggccagcgctccggctgcacctcctggtgcgcgccgcggcggcgccacaggcccctcgaccctttgaccaccgccctcgggccgcgcgtccggcagccgggaccggtgatggcgcgggactgacggccgtctcctcccagacccctctgtcccgcctggggctcgctggggctgcggcgccgccccgagctgcatgtggggcgggcgcgcccgagcccagagcgagcggccctcggcgcccccgaggcggtgccccgccgcgccagagtacgaggaggagcggcgggccgggccaggctccccacgcgccgcagcctcggagcacgggctccccggaggggacttggggcgtcccagcccaggaggaaggacccggaagcagaagcggagccgcgagtcgagccgagccactgcccccgctgcccgcgggcgccgggtgggggtcccggcggctggatgggcagcggcggcgcgggccgcgggcggcgatgggcgaggagcagagcacggtgagcggcggcggcgggccccaggagtcgcagaccctggccagtggcactgcgggccaccctgagcccccgaggcctcagggggacagcgcccgggcgcccccgctgcgcgccgcctccgcggagccgagcggcggtggctgcggaagcgactggggctgcgcggacaccagcgccccagagcccgcgaggagcctggggcccccgggctggagtaagagccgagcaccggcgcagcctgcgggactggcactcaccgggcctctcaatccccagaccttgccactgcagttggagctggaggaggaagaggaggaagctggggatcgaaaagagggaggggatgaacagcaggaggcgccccccggcgaagagctggagcccaggacccgcgtgggggccgccgacggactggtcctggacgtgctgggtcagcggcgcccgtccctcgccaagagacaagtcttctgctccgtgtactgcgtggagagcgacctgcccgaggcccccgcctcggagcagctctcgccgcccgcgtcgccacctggggctccgccagtgttgaaccctcccagcacccgctcttccttccccagcccccgactgtccctcccaacggattccctctcccccgacggcggcagcatcgagctggagttctacctggcgcccgagccg

SEQ ID NO: 5501 - DNA, 1316 bp, Homo sapiens; identical to SEQ ID NO: 5378

SEQ ID NO: 5502 - DNA, 10783 bp, Homo sapiens
tcgcggagacatctcgagtcccgcaggtgtctgagctgcgctgcgcgccccagccgggaagccttttcttatccaaccgcgccgccccgcggaaagcctgggtactgcagacgccctcaccggcccaccgacagctggttttgaagcgggggcttagaaaagtaaaggggacagtgtttggagccacgatgcctttgatgtgaggcggttccacccaacaatcaacgaatcaagctggaactgcaggccctacttttgttggggggaggaccttaaggaatgtcacccccttgtcccctaccctctgccccacgcccagcctctcagaaggcaccaggcgtgagtagagtgcgaggcgtccacaccctcgtgtcccttccattcccggacacctttgcaccctagccgaggcctcagcacggagtgagggttgcctggggtgccctgctgtgtgtggggcgttcttgcctcccgggccctgaccccacggtctgggtcggcgaggcgtctctccctggcgtctggactgtgcgcctgccccgcttccaggcgacgaacggcaggagccgggggtccggcgggacccggatccagggcgggcggaaggcgagggtctctccttcccggaacccccgccccggaaacctgcaaccaaaccgggtccctcctccgcatcgctcccgcgctcccgggccgcctccccacgcgggcacccactctccgggccctcgcagcaccgccctctccgcgtccacccgcgcggccgacgccgccaggggccctgagatcgcggagacagcgcgccctggcgcctggtggggccctcccagtggccagagcgctcctggaccagtcggctgtggtctgtgcccaaacacgatggaaaccggggctgggacgggcggtggtacgcacgtggaggagaagaggcatggcgggaaaaccacagccgaacacaggtcgactcgcacctcccaggcacccgccgccgtctgactcgcggctctccccaaggttccgactcgccgccacctcttggcaccactcaccgggctccgacccgggccgcgagtccgctgatgcgcagctgcctccggcggctcccgggctctgcccggacccgcgcgcagagacgctcgggaacgctgggctcgggcgcctcctggcggcggcagcacgcggcacacgctcggttctccggcccgagggggcgcgtggagcgtacgcgggatccgcgcgcgggcctgggctgctggcccacatttccccgcttgctcggatggcggcgctgaggcctattcgcctctttattaataacgatgcctcgggagggaaaaaatagagcctttaaaaatcagagtgcgagagaggagtgtgtgtgtgtgtgtgtgtgtgtgtgtgtgtgtgtgtctcggggcgttggtgaaagcaataaaactcagatcgcttccttggcgagatagcggcggctataatgcgccggggggatcaggggtttatttgcagatcctggataaaagatgatatatcgacacggtttagagtgtcactgcgcttggcctctcagggagccacaagtacatatttcctgaaataccgcccagcacagtatctaatccgcccgccacttaacaccgggaggggaacttcagcagcgcacaagcgcgctcccggtttcctggttctgggtggggagagcccaaatgagaaggatctggtatgcctagacgccccctcccctggcctttgtcttcagtccaagtaatcacttagcgatgggccttaataaatacgtctgagaactgtccttatgctcggtaaatattggattagcttttcaatgaccaggctcttgaaaaggctcgagaaatacacaccaggtctcaactaagcccaacagtcaataggtaaggaaataagttatttccccatctgaggtggggaatgttgggaagggggacttccactcttaccaaattatctgattctactaaatatgaccgttgtactaaataggaaagggggcgcatccaagtttcccattagtcggaatttccaccagctcagttctgctcattaagggccgagtgactttgtggggaacatatctgggttccagtttttatttccacagagctcagcataaactatttttgtttagtacatatggtttatttggggactgcttatgggagttttgacctggcaattgcaggggagaaggcatgacccaaattatttccgactgcctcgcgccaatttggaccgcttagaggaggcaaaaaatgggcaaattccttggaagccctgctgtgtctccctggtactgaattttgtaagcacgcgatacaggagacattgaaaattaaagaggaagtatctccctcctccaacatggggagagacgctgttggaagaagtttctgaagtggtttcccatcgcaccaagaggccagtgggatggatccccgcgcataattcaaaggaacgcgcgcgtctttagctcttcggggttggtaaccaagtggtccggccgggcgcaagtcgccttggaaccggctgcagcccaagtctagctgggcccgggactgagcggcacccttggcctctcagaacctttctcgcggtgagtggaagggcggctccgcgcgcgggcgcttcggggccggtcggttgcgaaatcagggggtggattttcatctacccaggagccgctaagcccgtaggggaccgagcatcacccaggccctgggtaccctgagttgcctcctgagccccaggacggtccgatggtgcagagctcccaggcagaagttagtttcctgatacacacacagcagtgagcaaagtgcgcacaagtgagccaaaccctgaagacgcaggttcgcggactcccatcccagcgttagagtcaaggagacagaagagaggaaggagagaagtgaggaagggagagagattatgagaaaaagagattatgaaagtagagaaagagattatgagagcgagattatgagaagagagaaaaagagagattttgagagagagagacagaatgagagagatccaactttcagtgtcacggggcctaggcggggcaagcgccctccgaagccatcaaagacaggggtggctttttctcccctcctccagcctcctccccaatagatatagcacgaatttttaatgcgtcttcctttcacagacaacaatacagggtttgaaagccggacacaatttaggttttgtgcgggtccctcctcgcgctccctcggcccagctggccatatggaatccagcatggagcccgtggatgacaaagggacccagtgacaggcccaacaaaaccccaaggagacttctgcctgactccgggattcactgccggcgataagcgcgctgaatggtgcggggtggggcggggggtggggggcgggccccttctccttcttcccctctctctgtccccgcgatcctttctctgtccctttttaatatgcacgcctctaacatctccggctcccagctttcccattgtgcggttttgtaccgcccgctgtagattgggcgaagatagactgctgaagcggaccccgcgccgggtgcgctcccagggcgctggggttagggccacacagggctccgcaggcgcttttattgactccatggggacccgaggacagagagaggcgggcgccgggtccacctcccgggctcccggccggccacaggagcgcacacccagattgcaggcccgcggtcctggccacagctccaaatttgtcctcaatgagcaagtggtggaagcctgccagggtgaggaccttccacgcttcccccttcctctctggaaacctgagggtctcttgtgatcattctcaccctggaagccctggggcctggaaaagtcaaaatggcctcaggccttctgacagctccgctccaagagacttgaaaccctcacctttcctcccaagaggattttgggattaggggaagttgcaagtggatgttgagtggttagtaccagggcaggttgggcgttcaattattgcacaacaaactatttgggagaaattcgttggcctttaaaaacagtaagacataagcccccaaacattgccaagctagtgtggagaacaaagggagaccttttagcatttagaaaaactgccctttccccgaggatgagcccggagatgggaaaggacctttactggggtattagaaagacttccgagccctcaattatccaggggcggtgtggaacgcgggaataaagtgtcatcgcgtccctgggctgctgcgcagagtgctatcgacgcacagatttggtcgcacggataatcatgtttgctttagatattgaattaaacctgatcatcaactacagggagcgagaaagtcagctgggaccgctccttttgcccggcctcctcactgccacccaaccccccagccttgatggtgcagcttcggagagaacagagatacaatttccaaatgcgccgacgttcagtccctcagcgtctgcagcacccgctgggctctgagctagagtcccaagtatttttagaaacccgcgagatagaggagaaaggctcatcctccagttggccaggcttcctaagacgctcccccgcgtggccaagtgtgcgccagcatctgccaaggagatcttcctccagcaacaagggtgggacggaatccgttccccgccggaaagatggatgcgcccttcccgggcgtgcccggggctgtgtgcccacttcccatccggggagctcaccccacccccaaacctctacttcctagcaatccacccagttccacgctcaagggctgacctggggggaccgcacaccctggttcggaccgccgaacgctggagggaaggaggcccgggatccagtccccggagagaggcctggaagcccggaaaggatgggagcgtaagggaagggagaggcatggtttgctgggattgccaaagattctcgctccctggcttcctggggccaaagatcctagggagggctgcagtatcccctccctcccccgagcccagaaccccgcgtacttcccccaagccccctaagccaaagcctcgcgcgccctgaccgttcccacccccagccttagcggtctcctaggtcagcaccagcccgcagattttgaaaaggagtggggagtggggagaaggcagccagtcttaacctcagacccccacccacccactttcttagcgtgaggtaagtcaaatgtaacaaagtgaaagtcatcgagtgtagtggcttcaacagcttctcaggctgaaggagccactcatagatttgggccagcgaggggggtttgctctcctcgcctttgcggctcccgaagtcacttttcctcccgtagccggacgctgccgcccggggttcagacagcgcgcgagaccaggggagatgcgggggagggtgggcggccctgggcttccggccgaccgctcgcaggccggaggccgagcgttctcctccccgccccaatcctaggcgcggggtgcagcctgtggtcggaggggcctgcaccgggagccccgcccgccccagggccccggtacccccggcctccccgcccgagaggaaccgcctgtgggagccccgcgggcggccgggcccggctcccaggcccaggcctccggcccggcgcagtaggacaaacgggagggcagggattttttctttttttcttttttaaacacaggatttttattaaaattcttatttaaaaaatcgaaagctttctgcgcccggcgctgttggggaaccgcgccgaatagctgagctccaagttcggggctgaaggcccggaggacagggcagagggctccctgcctacagggttttcttttccatatttgagaaatgtttgcacaataaaataaaaagagaaaggaagaaagcaggggaaaacgcaaaaacaaaaacaaaacaaaaaacaaacccaaacaagccacaaagaaaggagttggacccagacgggaaacaggccggtcctgaaggtcattttggcaacaatcaccaccgatatttacaacgaaaagcgaaatctgccaccagttgtcagaacgtttacatggccataaatatttagcattttcttatttttttttaaaaaaaggaagaaattctctgtatttttaaagtgttctccacttgctttagaagacggctgacaatatcgctactcacacaaacatattttacaaaatgcacgaaagcaggggtggggggtcggtctttttctcgttttcaagtgacgacattaacgctgggacggtttggtccccccggggagaggcaaagaagcgaagctgcgcaaacattctgtaaacacggcgtagagttcagccctctcccaaggttcagaaggagaggcatgggcagagctgggtgggtggaatctgccactccaaggagacgcaggcaacctcccggcgcctccctagtggagccgagagtcaactcgactccataataataattataataataataataaccaccataaggaccgaggcctcctcgccgccaccgccgccggggtggggcctgggcctggggccgcgagtctcgttggggcggcgctcaccaagtccactgctgggcctggaccagggggtgtgctgtcgggtactggggggtgctggccgagctgtactgggcgttgtactgcatgtgctgcagcgactgcgcgctgtaggcagaaaagggaatgcccgcctggaaggtggcggctgccaggtcctgggctttgagcgcgtgacatggtttgccgtccctgaccaagacgggcacggccacccggcgcggcgagggcaggggcgtcacctccatacctttctcggcccgggcgcgcttcatcttgtagcggtggttctggaaccagatcttgacctgcgtgggcgtgaggcggatgaggctggccaggtgttcgcgctcgggcgccgacaggtaccgctgctgccgaaagcgccgctccagctcgtaggtctgcgccttggagaaaagcactcgccgctttcgcttcttgccggcgtcccccccgccgcccggggtctccttgtcattgtccggtgactcgtcggccgagggctccggggacttggagcttgagtcctgagggggcgccccggcagccagaccgtgcactggggggagggggagagagaagcgcgtcaggcgtctggaggccgcgcgcagcctgcaccagactcggagcaccctggatcctccgtgcgaccctggacctccgcgcctggcagcccagccccgctgcctttgccatgacccctgccttcctctacgcctgacgaagacgtcgggacctcccagggtaaagagggaaatccgtaggagtgggggctaggggctcgcctttcaaggggctcacatagtgtgggtgagaatttggggggggaagtggcactgaagatcatcgcgggttaagggctccggcgcccttaagcggtttcctctccggcgagacgtgggcagatttttaaaagaaataccccacaatcccagcattgatcggctcggccatttaaggcaggtttttgggggctttcgtttctgctttcgggccttctagacaccccctgcactgcacaaagcgtcctctatgatcgcgcagggggcagggtgagctatttatacccgggccacccgaagcctccccaccctccacccgtacccggacgaggctcgctggctacctccagggcgccaggccagtccctcccagcggccggagtccgggggctgcggctggagccatcggtccgggttgacatcatataccagcccctgggaggtatagcccttctccctctttctccttaacttctcgcattgaaaaaaattttggagaccaagttctttcccggaactaaggaggcttgaagaggagggcagaggacatcctatacaggtgttaaaaatctttctacggatccgagtgagggggtccgggcttacatggccccttcccctttcactcccagcgtccaacccgggctgcggctgcaggaatggaggggaccacggcctcggcagccaagttttgctacttacgggagtactgaaggccctcggtgctggccagccagcgcgtgtacgggttgtcgctgctgtcgtagaaggggttcttcaggggcaggctctgcaccgcgtccagggcgccctgccccagcggcccggccctcttggctggctcgggcccctcgttctcttcctccggaccttcggccacagagccctcctcatcgttggtgtccggcaggtctaagatgtccttgaccgaaaaccccgtctttgtgttggtcagcgacatggttcgagaccccaaaatttatgtcgcaaagttgtagcttcacttggtcaattcgtggcgctcccctgccccggcgggcgggggaggggggagttggggggagggactgggggaggggaggggggaattggctttaattattgggataattattatttttaaaaagagaaagaaactggggatggggaggaaaaaaatgaagcccaacccagtgcctctctctgtcttctttgaaagcacgcggaaatggacgcaggaagccgggcggcctgcgcgccgagcgccgcgggccccggccttagtttctaactccaggaggggtgccaaggcggcgtcagctcgggctccggcggccgctcggcgcgcggtggcggctggtggcgaggaaaaaatgggccattgcccgagcgatcagtccatataaggctgggctccactcacgaacctggggaggcggggagagggggagaaagagagggagggagggaaagaaagagggagggagggggagcgagagagggagcgggagaagggtggaaaaaagggggaagagacattaaaaacgcaaaggttggccacgtgtgggcgggtcttgggagtcaagtggatgaagacagtatttgcagatgtgaaattgtgggttttggggagctccgcgctcccagccaacggccctctagagcaagatgagaggtgtaacgtgtcaattaattgcaaagacggggcgagcctttttttttttaaacccagtatttacatacaaagggccaccgcgtcgctcgcgagtccacacacttgaaagggccgttttaacaaattgcatcttaaaaaaggtgggggtggggaggaggaggggagaaaacaaaacagaaaccaggaggagggaaaaaatcctctttaacattcaccggttcctacctccccgcccccgcgcgcccacccccggcaagccggaaaattggcgatttgtggcgcctttggaaaagggggagggggcgaaggccgagctgcggaaatctctcctttccatcgttggtggttgcctaaacaagatccggttcaaatggcaagagcccaacttctgtaagcctcctaggtcaatattttggttgaggcttaaggatgagtgctagaaatgacaaggcaagtaattgattccagttaaccgcgagagagcccaaaacccaggagagagctccgctccgggccggccagagccaccaccaagcgacccgcccccttccagccgccctttatttgctaaagactcatttatttccttcactccgcctccccccacctcccacccccaaccccccgcctccacctctctgcggccaaggaggacgcgcagttcactttctgctttgcgggcggtcccggggagggcggggtaagagtgaggagctccaacttcgtctggggtcggaccctggccctgctgcctctgggctctgcgggcctctttccccgggtggaggaaagggcagacggccctgctctttcctgccctctattatccctccctctccggccccctccctctccagcctctggctagaggtggagcagcgggaaggcggcggggcgggattgcgggggtgggggtgggggttgtgtctccagcctgggtgaagacccagaaagctgcgggggaggggggtcgctgggtggcccgacgatgcctcgttttctccccagttttcttctcccacgcgagttctttagtgtggtctctttttggacgccttgggtgcgttcggagtacgcgctccacgtttccaggttaagtcaggttagtgtgaagtttccagccactctcggctctgggaactgaactttcccgggacttgcacttcctcctcggcgctggggttggaaaagaccacgccgcatttgccaccccttcttctagttaaaacttttttggggggggggtgcaggggtgtagattggctacctgatgctcgttcgccccagaggagtgtcaggaaggagctttgtctgggggcggggaggggcacagaaggccacccctgcggggtccaggtctagtcttcccacaacctgggctcctccgcgcgggccaagctgagcgcgcgggcaccgggtcctcctcgcgcgcagctgcagcggacgccgccgcgccccagctgcccccgggttgccagcgctgggtgagggcacctctccccgagccgctcggcggctttctgcagccctagctgcctcgcccccagtatgtgacgtgggtgacaatggcccaggttagagcaagcccctcgtcggcgcgtcctgggtggtcggacccgggcaaacacaaatacaaaccgattgctaagctgcggacaatgagcgaaatgtagacaaatgtcccgctcccgttggaagcctttgtcccggctcg

SEQ ID NO: 5503 - DNA, 810 bp, Homo sapiens
gcgcacgggtcggggagggggctaccggacctggatcccgggacaccccgggggtctggggggcgggccgcgcgcttacctgcgtcctcgtcgtcgaaggagttcatgcacgggaagtagatggcgagcgcctcgaaggaggcggacagactgaggcggctctgcgagcgctccatgcccgcgccggcgccgggcgcctcggccgcggcggcggcggcggcggcgggcggcttgggcagcttggccgccccattcttgacgcggagtacggcgcgcggcgtggtggcggcggcccggggccgggccgaggctccgctgcggggctggcgggcgcggcggggccggcgggcgggccaggagctggcggcgcgcggagcccgaggcgcgctgtgctgctggcggcggcggcggcggcggcggtggcggcggcggtggcggcgcagcgcgctctggtccgcggcgccccccgccggcagcgcgaggcgggcttggagcggcgccgcagccaatccgtgccgccgggggagggggcgccgctgcggggcgtgggagcccggagggcgcgggctgcggcctcttctagcagcccccgggcccggcaggtgcgcgcggggaggcaggcgccgggcgaggttgtctgggccctggtccgagggctgttcccgaccccgcctcggcccccaccctcagccggccgacttgcggagaggccggcgtccagtccctcacccagacaggcctctcccagagacactggcgcgctcggaggggatgcgctcaaagggtcccgcccaggcgggtcggcactcg

SEQ ID NO: 5504 - DNA, 1142 bp, Homo sapiens
tcgggggagaaacctcggcccacagccgggatgcgcccccgccggggtcaccgcggcggcgaacgtcccggacttcgcatcccggtgaccccttgggatgaaccgaagccggacccgcaccttggccgtaacaagcgcgctccacgccgccacgcaccagcggtgactcccgagtcctctgtcgccctggcctccccgcaggcgggtttcgaggcccccgcagggagttcagggccacggccacgtgcagccgcccccgagcccgagtttgcaggctcggggtccggttcgcgctttggtggcgcccggcgaggctgcagcgcgcaaagttcccacctcaagttcccgtcgcggcgtccccgcctcggagttggcccggccgcggcttccgttccccccggctgcccacgggtccggggcgaggacgcgagaggggcctggaagtcgcccggggagcccgctctgcctcccggagccgccgccaaacttcggtcccggggcccggctcagctcccgccctcggagccacggccgccccgtctctgcctcccggtccccgccgggctccgagtgcgccgggagcgcggcgcagcagccgccgagggagggagcgaggcaggaggcgggacggagggaggggactgagcgcggggcggggagaaggggcgggcagccgaaagcgcagcgcctggcctcgcctcgcttcgggacagtggcagcggcgccaccgtcacggggcgtccaggcgcccaatcgggaccccgcaccttggatccgggggccctggcgcgcctgctggattgcgctcctcgcggccagttcctgagcccgcgtccgggactgctcgcgctacgccctccctcccgttgccttcttccccgtctgctctcccaggagcgaccaccctgcggccccttcgcctgcacgcgacagccttcaaggtccccgcgctccgctgccctggagcttcacgcaccaggcggcgcggcagcctcctagggtcgcgcgccctgtcagctttccccgcggtgcaagtgctccggtggtcccgggtccgcgcccctagcagcaccgccccagggtctacatgtgctagatattaaaaccccactctccgctgccccggggccgcgctccacgcg

SEQ ID NO: 5505 - DNA, 2885 bp, Homo sapiens
acgctgtagacaggcgcgttgcagggcggcggccctctccccttggcattaccgacagccgaggaaattgggttaataaagccggatactgcggcggggccgcggggcgcaaaccggcgcggacagatgggtccccgggggcaccctgcccggctccctggatcccggatggtggcagagctgggagctgcgcaggacgggcactgcgcagcgcatctccgttcacacccggcggggcacggggcccgcagcagcttactcacccgtagcccggcctcctccctcggaagggagaggggatcggtggggagggggtttgctggacaccagggctagacggggccctcccctgaccgtcagggttaagtagggcgcgggctgtgaggaccctcctccacgcagccccccgaggcagagggcccgcaaagcggtctccatccaactccaccccgcggacgtcccaggcagcggatggcggcgggggggggaggccaggggacatttaggggacaaattcctcagacttcgaggcagccggcgacggcgtccaattcccaaataaatagaacaaactcctacttggaaaaggccttccccggggtcttcctgcgcccgcggtccagctcctctgcagacggccatcgtgggctctccgcagggctgcggagtctcggagtcaccgaggtgggaggtgccggccacgcgcgtcctcaggaacagagcactgccctgcagtttagcacgaagggccggctggagcgggagcgcgaggcccactgcaagaggatcaggagccagtaagtccggcttttcttcgtctccacctttcgtgcgcccggggccaggaccgcctgtccggaatctgaccagtgcccgtcctcgccgtggccctgggaccccgcggtggtcttcttttggggacgaacggcagtgcccgaaggatgctctacccacccccgttcctagacttgctgggtcccgacaatacccagtgggtgccgcgagttcccgggcgcagagtccagcgtccggctctcgagctcaatcccgcgccccgacggccttggcgcttcccgctgcgctaaactgtccaccgcgcacaggctggaagcgaagtcgggccccctcctcctggtctgcagggtccctccaggcctttcctgtccgggcagagagacagtcacaggggcgatcggaggacgcgtgcgggagggccgggggcccgcgcggtcacggcttctcgtgacagtgtttgcaaagcgcggagggcgtcccggagaaggcggcgcacttgtcagggcagggccccagggcggcgcctgcggagaaggggcacacagtggcctggccgaagggcgtcaagggcgcggcgtttacgggcgcggccaggccctggccctggttgaggaaggccaccaggcgccgcatctcgtccagggcctgcgcctgcatgaggatatagttcttggcgagcagcagcgtggcgatcttggagagcttgcgcaccgacgggctgtgcgcgtaggggatgacggctcgcagcccgtccagcgcgtcgtttaggtcgtgcatgcgccgccgctcgcgcgcgttgatgctgagccgcagagaccgctgctctcgcggccgccgccgcccgtccgccgcgctccctggcccgcgccgccgccgccgctgctcgaaggcgtcgtcctcgtccccgctctgttcgccgctgctctccgccgcctgagctggggcgcgaggtgcaggcgccgcggggaggtcgccgcccgggcccggagtgccgtagccgcgggccgcttcgggttctcgcgccgccccgtaggcgagacccgcagccgccgccgcgtagccgtggcttagtgccaggtacgcgtcccccgacagcgacttgagctcggccatggccgcgccgcctgggctcgggggctcgccgggtgggcggatgctcatgtgggtgagcagcccccgaggccggcccgagcccgccgctgccgctgccgctgcgatgaggctcccggctctgcgcgtcggtctggcttgcctgcgggtcccagagcctcggcgcccgctgcctcctccgcctcttccttctctcccacctcctctccctcccagccgcgacgcgcagggggcgggctctacctccccctcgcccccgcttcggttttaagccgcggaggcgcccggtgggacctcgctgctgtccaatcaggggggaccgggtgagctcctcttcctggagccgggctccaccagcgccgcaggctcacaggccgggggtgggggctctggaccgaggggcggcgcggggcggcgcggggcggcgcgcgcggtcctggagcgctagtacttgcttctcgactccccggccgccgcctccggccgccccggggattccgccaccaaacgcacgcgtcccaggtgggcacccgcctcggtccgtctttgagtctgaccctagcgcaagagtccctggcgacacgcaggggccagagcgggggggcgcgccgcaatagcagcagcgccagcgccaacaccctgtcccgctgaggggccgcttcgggtcggggtcagggtcgtgggcgctctggtgcagccgcggcgcagcgtgtacccggagcccgcacactccctgctcggggcgccctgtggccaggcttgaggggcagagtgagagggagtttctagaacctgttgaaaaacgccacgagcgttgcaggccggggagggcgggaaggtggagggcagcgcggcctggggctccccgggggtgggaggggagctctgtgagctgcaggaccgcctcttccctgccagccgcttcctgggcatctatcagcgaaacgcgtgaggcttggtgggctttcccggagcctccg

SEQ ID NO: 5506 - DNA, 1460 bp, Homo sapiens
acgcgtatgagagagcagagcggcagcgacgcggtcggatcggtcgcgggggctgcgggaggaagcgctgcagggacccgggcggcgccggcggcctagccggagatgcacgcgctgtaatagaccgcgctgctggcgtccgacagcgcggagatcaggctgctctcctctgggcaggacatggcgcgcgggcccagtttggccagtgccacgtggtacgggagcccgggggcgtcgggccgagtccggctgcagttgaggtactggtcgaactcggtgaggtccacgtcggcccacagatcggcggcgggccccagcggctcggcgctctccagcggcggggcctcgggcggcggcgacagcgggccggggtacgggccgggcgtgcccagggtgccgtagtacaggccagcgagcggcgccgcggggggcgcggtcctgagcgcctccgccaggggagccccgtagcaaccgccggggtcccgcgacaactcggtgggcgcgtagggcgcgcggaagggccgcagcgcgcagtcctcgggcgccgcgggcggtgggaagaaggcagcctcgccgggctccaggccgtccagaggcgagcgctcgggcgtgggcagccccaggccgtcgaactcggcgcccagcgggggcagctcgcggaaggcgcgagccgagccagacgccgcggggaaaggctcgggcggtggctgcgggggcgctaatcccgggagcaggaggccgggctccagccgccgggccttgcgcgcctgcttcttgcggcgcggccggtacttgtagttggggtggtcgcgcaagtgctgcacgcgcagccgttcggcttcctccacgaagggccgcttctccgccgcgttcagctccttccacgctttgcctgcgggccgtgggcgccagtgagtggaacgccgtcgggcgggtgggcgccgagccctccgtgcgcccgggacgccccgcgagggtttggcgcagcccccgcaccccgcggcccgggacccctgccccccccgccccaccccggcccgagccccccccgccctctcccccttctctgccgccctcccgccgctcacccagcatcttgctgagcaccgcgttgtgcaggtccgggttctgctgagccagccgcttgcgctcgtcctttgcccacaccatgaaggcgttcatgggccgccggatgcgcgactcgtctgccgcctggcgttccccgcggccggccgggctgaggccatagcgccccggctcggggctgcgcgggggactgcgctgcgggctgggcggcgaggcgggcgcggcgggcgcggcgagggcggcggggccggcggcgaggccgcgcgtgtcagcggcggccccgtgtcccggggcccatgcacagtcgcggcgggcgggcgggtcgtcctgtgcgccgtagccgggcggcgatctctgcattccagctgggcgcg

SEQ ID NO: 5507 - DNA, 1560 bp, Homo sapiens
acgccttgcagtgccgggtcctgcggcgaccactgagccccttcgtcctcgccctcagtcccttcgtcctcgtcttcggtctccgctttcccagtcggccggggctcgtcgtccacgaccccgcacgtgccgccgacgtcgccctgccgattccgccgcaggaggtggaactgtagtggtgccggcggcttctcccctggggcggcggtggcgaggcgctcgctggcggcgggcagcggctggatgaaatacgcctcccccagcaggtagaaggcgccgcgcacgccctcgcagaggctgagggcggcagccgagctgggatcgccattcacggtgccggagtagaagcagtgcgccaggtcggtttccggaagcggcgtctcggacccggatttgcgccccacgttctggagcgtgaagccgggcgccaaaaagctgctgtcgggccgcagctccagatccagctgctggtcaaaggcgtgcaggcggaggcgcgtggtcccgtgtcccggggcgcgctccagctccggcaccactagctcctcgtcctcctcggaggggcgcccgagtgcgtccgacacggccagtagcgccgcggcgagcagcagcagcgtgggtactggcccaaagctccgagaccccggagcccgctccgcgttccccatgtcgctgcccagcttgcgccttccgaacccctcgggcacagctcgctgcattggagccccaggagacaccgctcgtagcagcgcacggagcgagggacctttagttcgggtcgggagagcaaagcctcgttggcctgctctggattgttaaaattaacaatttctattattcgttggaagggcgcgcagagccggctacagccgaagctcccggagtcactaaaaggaggcgctgcagttctgccggcgcgcgggaagtttttcttccagcgcaaagttggagacactgagaggcaggcgcaggcagagtggctctgctgggacaagaagcgctctggggcgcctccggggctgaggcaacgcggagattggtgcctggcgcccctcttcggcctccgccttggctgcgatgttgctcactctgctcagggctctcccctctccgtccggtagcgcaccctggctttgcaatagcccctggctcggagccgctttccagcgagtgcaagaaccgggcagccgagcggtccttttatagtggaccagtgaaacccccacccccaccccactcctcccctttggcccttttccatcccaaagacgccgcccccggctccgttggtgctaaaccgcgctccgcgctgcgggctcgggagggggagggggcagcctccgcgctggctccacgccactgctcgtcaatctaggggcggaaggggcgctgtgaccagcactttgtactgctggggccgctccagggagaagactctcccttccaccgcttttctccctcgccggtttcctggaccacccttcctccccaccgcccggttgcggtaactcagttaccgcgctgggctgcggttcccaggagggagggttcggttggagaacg

SEQ ID NO: 5508 - DNA, 5118 bp, Homo sapiens
ccggtgccgggagccttgcctcccgccgccacccctggtcagctctgcgcaagaacgtcgttctgtttggcagccaggccgagacgcagcctgaatgtgagcaggaactcggagaagggaagggagagaatcagaaagaaggcccgggagggacccgggaagcagtgggaggtctgcgccctggagccccgcgagagcccgccggtttggcacgggctcctcccgggccgcccggcggtccaacaaaggccggccccgacacgcacccggtcttttgtgggagagaaacacaaagaagagggaaaaacacggaggaggccaacagcaccaggacgcgggggccaaccaggaactcccggagccggggcccattagcctctgcaaatgagcactccattccccaggaaggggccccagctgcgcgcgctggtgggaaccgcagtgcctgggacccgcccaggtcgcccaccccgggcgccgggcgcaggacccggacaagtcctggggacgcctccaggacgcaccagggcaagcttgggcaccgggatctaatttctagttattcctgggacggggtggggaggcataggagacacaccgagaggtactcagcatccgattggcaccagggccaagggagcccaggggcgacacagacctccccgacctcccaagctactccggcgacgggaggatgttgagggaagcctgccaggtgaagaaggggccagcagcagcacagagcttccgactttgccttccaggctctagactcgcgccatgccaagacgggcccctcgactttcacccctgactcccaactccagccactggaccgagcgcgcaaagaacctgagaccgcttgctctcaccgccgcaagtcggtcgcaggacagacaccagtgggcagcaacaaaaaaagaaaccgggttccgggacacgtgccggcggctggactaacctcagcggctgcaaccaaggagcgcgcacgttgcgcctgctggtgtttattagctacactggcaggcgcacaactccgcgccccgactggtggccccacagcgcgcaccacacatggcctcgctgctgttggcggggtaggcccgaaggaggcatctacaaatgcccgagccctttctgatccccacccccccgctccctgcgtcgtccgagtgacagattctactaattgaacggttatgggtcatccttgtaaccgttggacgacataacaccacgcttcagttcttcatgttttaaatacatatttaacggatggctgcagagccagctgggaaacacgcggattgaaaaataatgctccagaaggcacgagactggggcgaaggcgagagcgggctgggcttctagcggagaccgcagagggagacatatctcagaactaggggcaataacgtgggtttctctttgtatttgtttattttgtaactttgctacttgaagaccaattatttactatgctaatttgtttgcttgtttttaaaaccgtacttgcacagtaaaagttccccaacaacggaagtaacccgacgttcctcacactccctaggagactgtgtgcgtgtgtgcccgcgcgtgcgctcacagtgtcaagtgctagcatccgagatctgcagaaacaaatgtctgaattcgaaatgtatgggtgtgagaaattcagctcggggaagagattagggactgggggagacaggtggctgcctgtactataaggaaccgccaacgccagcatctgtagtccaagcagggctgctctgtaaaggcttagcaattttttctgtaggcttgctgcacacggtctctggcttttcccatctgtaaaatgggtgaatgcatccgtacctcagctacctccgtgaggtgcttctccagttcgggcttaattcctcatcgtcaagagttttcaggtttcagagccagcctgcaatcggtaaaacatgtcccaacgcggtcgcgagtggttccatctcgctgtctggcccacagcgtggagaagccttgcccaggcctgaaacttctctttgcagttccagaaagcaggcgactgggacggaaggctctttgctaaccttttacagcggagccctgcttggactacagatgccagcgttgcccctgccccaaggcgtgtggtgatcacaaagacgacactgaaaatacttactatcatccggctcccctgctaataaatggaggggtgtttaactacaggcacgaccctgcccttgtgctagcgcggttaccgtgcggaaataactcgtccctgtacccacaccatcctcaacctaaaggagagttgtgaattctttcaaaacactcttctggagtccgtcccctccctccttgcccgccctctacccctcaagtccctgcccccagctgggggcgctaccggctgccgtcggagctgcagccacggccatctcctagacgcgcgagtagagcaccaagatagtggggactttgtgcctgggcatcgtttacatttggggcgccaaatgcccacgtgttgatgaaaccagtgagatgggaacaggcggcgggaaaccagacagaggaagagctagggaggagaccccagccccggatcctgggtcgccagggttttccgcgcgcatcccaaaaggtgcggctgcgtggggcatcaggttagtttgttagactctgcagagtctccaaaccatcccatcccccaacctgactctgtggtggccgtattttttacagaaatttgaccacgttccctttctcccttggtcccaagcgcgctcagccctccctccatcccccttgagccgcccttctcctccccctcgcctcctcgggtccctcctccagtccctccccaagaatctcccggccacgggcgcccattggttgtgcgcagggaggaggcgtgtgcccggcctggcgagtttcattgagcggaattagcccggatgacatcagcttcccagccccccggcgggcccagctcattggcgaggcagcccctccaggacacgcacattgttccccgcccccgcccccgccaccgctgccgccgtcgccgctgccaccgggctataaaaaccggccgagcccctaaaggtgcggatgcttattatagatcgacgcgacaccagcgcccggtgccaggttctcccctgaggcttttcggagcgagctcctcaaatcgcatccagagtaagtgtccccgccccacagcagccgcagcctagatcccagggacagactctcctcaactcggctgtgacccagaatgctccgatacagggggtctggatccctactctgcgggccatttctccagagcgactttgctcttctgtcctccccacactcaccgctgcatctccctcaccaaaagcgagaagtcggagcgacaacagctctttctgcccaagccccagtcagctggtgagctccccgtggtctccagatgcagcacatggactctgggccccgcgccggctctgggtgcatgtgcgtgtgcgtgtgtttgctgcgtggtgtcgatggagataaggtggatccgtttgaggaaccaaatcattagttctctatctagatctccattctccccaaagaaaggccctcacttcccactcgtttattccagcccgggggctcagttttcccacacctaactgaaagcccgaagcctctagaatgccacccgcaccccgagggtcaccaacgctccctgaaataacctgttgcatgagagcagaggggagatagagagagcttaattataggtacccgcgtgcagctaaaaggagggccagagatagtagcgagggggacgaggagccacgggccacctgtgccgggaccccgcgctgtggtactgcggtgcaggcgggagcagcttttctgtctctcactgactcactctctctctctctccctctctctctctctcattctctctcttttctcctcctctcctggaagttttcgggtccgagggaaggaggaccctgcgaaagctgcgacgactatcttcccctggggccatggactcggacgccagcctggtgtccagccgcccgtcgtcgccagagcccgatgacctttttctgccggcccggagtaagggcagcagcggcagcgccttcactgggggcaccgtgtcctcgtccaccccgagtgactgcccgccggagctgagcgccgagctgcgcggcgctatgggctctgcgggcgcgcatcctggggacaagctaggaggcagtggcttcaagtcatcctcgtccagcacctcgtcgtctacgtcgtcggcggctgcgtcgtccaccaagaaggacaagaagcaaatgacagagccggagctgcagcagctgcgtctcaagatcaacagccgcgagcgcaagcgcatgcacgacctcaacatcgccatggatggcctccgcgaggtcatgccgtacgcacacggcccttcggtgcgcaagctttccaagatcgccacgctgctgctggcgcgcaactacatcctcatgctcaccaactcgctggaggagatgaagcgactggtgagcgagatctacgggggccaccacgctggcttccacccgtcggcctgcggcggcctggcgcactccgcgcccctgcccgccgccaccgcgcacccggcagcagcagcgcacgccgcacatcaccccgcggtgcaccaccccatcctgccgcccgccgccgcagcggctgctgccgccgctgcagccgcggctgtgtccagcgcctctctgcccggatccgggctgccgtcggtcggctccatccgtccaccgcacggcctactcaagtctccgtctgctgccgcggccgccccgctggggggcgggggcggcggcagtggggcgagcgggggcttccagcactggggcggcatgccctgcccctgcagcatgtgccaggtgccgccgccgcaccaccacgtgtcggctatgggcgccggcagcctgccgcgcctcacctccgacgccaagtgagccgactggcgccggcgcgttctggcgacaggggagccaggggccgcggggaagcgaggactggcctgcgctgggctcgggagctctgtcgcgaggaggggcg

SEQ ID NO: 5509 - DNA, 1423 bp, Homo sapiens
ccgcacccgactgcacgcgcctccctgggaccccgcactggcgagccgtccctcccggcgctggacgccccacctgtcccggcgccgtcggaagagccctgcagagtgagcccctagggccaccccgctgccttcctccccgtccccgcagccgctgtagccagcgtgggagccgggcaggtcgcgtggggcgctggacttaccgagaggttagcgccgccgtcgggggagggcgtgtcccgcacgtgtgtgtccgcgcgtgtccgcgcccgcgtgtgccagcgcgcgtgccttggccgtgcgcgccgagccgggtcgcactaactccctcggcgccgacgggctcagcccatggtgtgggcgccgggttcagggaggctccggctcccgccaatcgcggagcagggcggccgccccgacgcgcgacttgcgaacccggagtgcgcgccgggggcggggcagggacgcgtgggcgggaatgcacgcgcgtggccaggtgcgcgtgggtgcgagcgcgcgggagtcttcgagtgcgcgcgtgtccgtgtgcgcgtgggtgtgggtgtgctcgcgtgtccgtgcgcgcgccctcggggccaagagcgcgggccgcgcgggcaggtttggacactacgcgccctgctcgggtttaggacgcggctggcggctccgggaggaagaggaggaggaagaggaggaggcggaggaggaggaagaggaggagggaggcggaggagcagaggctgggacggccggaggagagagtccggccccagcaggaaaggaacccagcacgcgactactggaggggcgaggagcaagggaaggaccagaggggaggagagggggtcaggggagggaaagtgtgggagggggagccgcgggggtgcgcgctcctcctaactcggggtcgcttttagcgagaagtgatatttttccagcctcattgaaaaccgttgcaaacattgaaaatagtaaaagtgaaaacggttgcgacactaagacgtttataaaatgaccgcggactgccctcgatgctgatgagaactgggacgacgtcgcgcagagcgtccggagggagaggcgcggtgcccgggacctcggtcgtggggaggagccggatacagccgccgggacgcggggatgccgagggcaccgcggcctggtctgaccgacgcacgcggtgacagccgcccttgggagacgacggcgtctgcaaccagcagcctccaaagggtgcagccaggaggctcagcttgtccgcctccggggctcggggctaagccccttccagaagttttcgtttctacgcgaattccgaccgcaaaatccagcttacctgagcgccgctcctcttctctcatgtccctcgggggccgtcacgaccgtcccggagcgatctctaggaacctgtcccgcagcg

SEQ ID NO: 5510 - DNA, 1384 bp, Homo sapiens
gcgccgcgcacagaaaaggaaacttcattccgtctgttaagggcagggccgggctagtggcaggagaaggtcagctgcgggcgcaggcaggagcggatccaggagccgcgtcggggcgcagagccggacgttccgaggagcctgcgcgccgcgctacccggcggaagccgcggtccatgcggggctccccaggcttatccaacgcctcgcaggcgtggctggcaggaggggcccggccgtgcccagcgccctcagacgtagttcttcttgtcgtagtcgccggtggccgtgggccgccgcggcgctgagtacttcacggggaagctgaggtcgggacggccggtgcagacccaggcgccgcagcacaagaggcagccgcctaccatgagcagcgcggtggccgcccagccgatgtacagcgctgcgcccagctcgtacttctgcgacacgggcacagacgggtcgtaaaactcgcggacgacaatgttggcgaaccagcagagtggcacgagcgccagcagcccgcaaaacaggtagagcacgcctcccgtgagggccacacgcgccttggccgggcccggggccacgcaggtggtgcactgcgcgcccgccagggtcacgaagagcgcaacgaacgccagcagcacggcgctcacggtgagcgcccgcgccgcctgcacctcggtgctcagagccagcaccgagtcgtacactttgcactgcatgtgcccggtgctctgcaccacgcacgacatccacagccccttccaggtggtctgcgccgtcacgatgttgtggtccaggaaggcggtcacctgccacatgggcagcccgcacgccaggatcagacccccccagcccaccaggcacagcaccaggcccaggatctccaacgctgcggaccccatggctagaggcgagacgcgcacccgaaggcccgcagaacccccaaggccgtgctgcgcggcgccctgggcgggccctggtgcctttgcgcccgcgctcccggctcttggccccagtccgtttgccccgcgggtctgtcgcacctcctgggtctgccagctcctgccggggggtaccctctttgaaggttcgggggcggattctgtcccccgggcccggccccccggcccgaagcagccaatccgtgcgcgggtcatcgtgccgcagccaatcacagagcctctggcagctgaagttagggaaacaacggctcttgaggggtagctgagggcgcgggaccgctccccgcccggcagccgcccccagccccacccgccgttgtcctagtcgcggccgagcgcattctgggctggcctagggcgcgcttcttgggccgcctccctgcgcgtcccggccccgtcacttcagaaggcgctcg

SEQ ID NO: 5511 - DNA, 1361 bp, Homo sapiens
gcgcccccgacccccgccgctgggatttcccgccgcagctcctgctccagtctgtgctgcgggtggggtcgggttgagcagcccggcgccccccaccgcgccccccaccgcaccgccctcgatctaaccccgcccccgggcgctcattggcctgcagcaccccctccccagcctgtgaagtgagcagggggaggcggtggtcggtcgcctccctccagcgcccagcctggcttcgcggcggaggcggcgcctctcccgcaggacggagccaagctggactgccgcgccgcgcggggcgggcaaagggggcgctgcgctcggccccgggcagggagtgacggcggcggcggcggctccgggcgagcgtggtccccgcgtgcgcacacgcacacgccgccgcgcagggacacacggaccccggccgccagccggccacacaggcgcggagacccggctcggcgcgcgctcctcggcgcacacgctccccatccccgcgccgcgcgggccgcggacttgcaggctgcgcgtcctttgcggagtctgccccggccccacggacaggccccgcagtgagcaggtaagggtcgccccgccgcggctgcccctccacgcctcggccgtcttctccccctccagaaccttcgcccagccgggacctcggatcccctcctctggcttggcggtctccgccagccgcgacctccaccgacggagagcgggcgagggccggcgccaggcaagcctcccagatctgaaatgaagccccctcccgccgctgcgcccttcctgcgcgtcaggctgacaccccccaacccaagtgtctggcgctgcgctcggggcggccgatcgccgcagactgccggggtgggggtcgacctagctatctcacgcccctcctgatgcggagaagggagaccaggggggcaggcaagccatgcggccggagggacccggagggacatgcctccctacccttaggtggacggacgcacctacgcggatcgggaaggcagggctggagggtcccccggggctaggtaccgcaatccgcacggggtttgaggggtgggcaagcaatgtgctaggtgggggttggggtaggggccagtgtagaatgcccctctgtggtgacacatccgggattgttcaaaagagtgtcgtcttcgtttcccgtggcgcggaggggctggggttggggatgccagggcttcagtggtccccagaagaaacgccctgcggggtctgtggggaaacgcaccggccttcccaggttgaagtgggcccgctgagacccctgcctgccgctttagaggcagaagctcctgcggcggctgcggggggcggaggccacatcctcggcg

SEQ ID NO: 5512 - DNA, 1175 bp, Homo sapiens
acgctgtctggtcggagcgctccataactcggccaatggggagggagtcgcccgctaagcgcctgtcaggcctcgaccaacgggatgggcccttcccgccagagcacactgctccaatccaggagcggctgcaggacctgagccaatgagacgcaacctccgctagccgcgcggtgcccggccaataggaggccgcccgtgcccggtagcgtgggaggtgtggggtggcgggcggcgctgcgaagctgagggagctgcgcgcggacgagccacagcctgctacagggtgggtgcgcccgccctgcccagctcgcccgccgcctcccggctcttcttgcgcggcggcttctggatgggggtcttcttccggggggtctcaggcgcgggcaagtcggtcgccgccttctcaggccccggggtttcggtcgctgggggcgcgcgggcgggcgaggctggcggcacggagcgcttggctttctgtgggggcgccggcttttccctggggccctgcgcgcccagggccacctcggcgcggcccaggctgcgagtcttgccgcgcacgtcagcggccaacatggaggcagcctcggcgcgcttcgcgggggaccgccggcgtccgtgggctccaagaggccggggcgcggcgcgcgctcgggccctgggcggcgagggcgcagcgagggctgtcgcctcctcgggcagccccggggggcgcggcgttgggtcgcgggtccgggggctgccgtgttcgaccgtatgcgccgatttgtcgctgggcgtccgtttcctcttgctggggctgggcgcggcctcggagcctggcggcggtggtgagggcgcacggccagctgcagcggcgctgtgcttgccgtggatccaggacaccttaggcttggtggcggggtcaggtggcggcggtttcctgcgctcgggcgatggcgacagcgacaggcccccaatctcgccccgggcccgggccggccgggcctcgcgtcgggccacgcgcgcgtacagagcccctccgggcccctccacgctggacgccgaccgctcgctgtcggaggacgcggggaggggtatcgcctcctcggcggaggctggcgtggtcaagggcacaggggacggcgccggcgcctcggcagggacagtggggacttcggggtcccggctctccg

SEQ ID NO: 5513 - DNA, 1087 bp, Homo sapiens
tcggcacccgcgtccctgtgcttctggtggttccggcgcttcctcggagcgcgcggcatgtctgctcctacacgtccagcacctctgtccccagagcaaacccacctcccagggcacacgcagaggggcagtcaggcaccgcctccaccctgccccacccaggccgcgcgcaccccggaaacctggactccgcgaccagctccctcctgttcttttccgaggaccccagcggcagtgtgtcctggacccacctgtagcctccaagctcccccacctctgcgtccttcctaggcgcttctgagcctgcagagcctacgacccccaacaggctgctccgaagtgcctctccctacatcgctccaggaatgactcccctacacccgttccccgcaaaaaaaagttggcccaagatccaggcgtcccaaggatcagcccaggtccccatccgacgcgggccagggggtgctgctctggcagctccggagccccggcaaagagcaacctgcagggaggcgccacgcgcggttcccactacccgccagagacccggtccatggggccaaacggaggggcctgtgccggtcgacaccccaagccctgtcgcgccccccccgccgcctaccgtatgggaccggcggaggagaaggcgcggtcgcgggctccctgaggcagcgtgttccgtcccgggaggaaagtttgtgccatacagaggaggcggcgcggggaggacttgggcgccggtgggtggaggcgtgggcggtggcgccgcgtggtcgtgtgtctgtccctccggcgatcggtgcgtctgtccctcgccggagcccgcggccgccgcgctctcgctcgctgcgcccagcgcccggcgcgctccggctccagccccgacgcgcccccgccgccgccgccgcgcgtccgccggctacacttcctcttcctctgaactcatgtgcaaaatatgctacgctgcatcttcagggaaagcctcgcggcccctgacagcagccgctggagcggtgggcccgcccagctctccccgcgccccctcggagttccgcccggtcacctccacgcggccgagctgcaagcg

SEQ ID NO: 5514 - DNA, 693 bp, Homo sapiens
ccggcagccaacgctcagcccccgcctcctctctccattccggaccccgcaaccgcgaggcgagagagcagcgccggcgaggcactggctgggctctgactgtcacgttaattccctgctgctttttctagtccccagccgcctcgcccctcctccctcattcccagcctgggtttggaggcgatttccctctattgactgagccgactgcatctctgggcaagcggcgctttgcctctctcctgtctttgtctgctcttcctgcaaggctacggcgcctggagcagggtctgcagcggccgccgcagcaacgcgagccaagtcgtgccccgcacggccgcccggggccgcaccctcgctcggtggcggcgcccgaagacgccagccgcgccacgcactgcctgcgtcccgcgccccagccgccgcgcaccaacgccgccgccttcgccgggagccaagcccgccgggccggcccggtcccaggtgggcagctcggcttgcagctggttggaggtggcggccgctgcagccctggcagcgggcacacccctaagcatacgcacccaacgcctcctccctgagccacgaggatggagcagccaccccggcccgggactggcgcaaggtaaggtgcagccgcctgttgcttttcgcagagcgcgggatcatccctctgcccgggtacctaggccg

SEQ ID NO: 5515 - DNA, 5065 bp, Homo sapiens; identical to SEQ ID NO: 5483

SEQ ID NO: 5516 - DNA, 307 bp, Homo sapiens
gcgcgggggccggaccatgagccgctgagccgggcaaaccccaggccaccgagccagcggaccctcggagcgcagccctgcgccgcggagcaggctccaaccaggcggcgaggcggccacacgcaccgagccagcgacccccgggcgacgcgcggggccagggagcgctacgatggaggcgctaatggcccggggcgcgctcacgggtcccctgagggcgctctgtctcctgggctgcctgctgagccacgccgccgccgcgccgtcgcccatcatcaagttccccggcgatgtcgcccccaaaacg

SEQ ID NO: 5517 - DNA, 1563 bp, Homo sapiens
tcgggctccgaaaacggggggagggggacgacgccccagaggcccctgagcccctggttcttcccgaccctaagggcttttctccctcggttcccaggcggcgacggcgggtagcgcgaagcagcaggcgcaggggcgctgggatggggatgtctctgcaggtctaaggttccccttgggagtctaaacaaagactacggcagcgccgtcccctcccccgggaacccgacgccgcgcggccacagggggcctggaggggcgggcagggcctcgcagcgcacccagcacagtccgcgcggcggagcgggtgagaagtcggcgggggcgcggatcgaccggggtgtcccccaggctccgcgtcgcggtccccgctcgccctcccgcccgcccaccgggcaccccagccgcgcagaaggcggaagccacgcgcgagggaccgcggtccgtccgggactagccccaggcccggcaccgccccgcgggccgagcgcccacacccgccaaacccacgcgggcacgcccccgcggcgcaccgcccccagcccggcctccgcccctgcagccgcgggcacgcggaggggctcctggctgcccgcacctgcacccgcgcgtcggcggcgccgaagccccgctccccgcctgcgcgtctgtctcgtccgcatctccgcggtgagtcggcggcgccctcgcccctgagcccagggccagcttctctcgccgccgcggctgctgcgcgcgtccccgcccagcccagcccagccccgagcacgaccccagccccacgcacgaccctagccccgcgagtcccgcaccgactcgctcccgccccatttcgcctccgcgggggcggcgccccctcctccccgcggctcccgctctccttcctcgccttcccggccgcgctggggacccccagccgccgtccgcgaccccccaccgcgacgcccggaggcggcggggtctctttgttcgggcggcgggcacgggggaccacctcccacggtgtcaccgcacccaccccgcgcccttcctccgcctcctggagttcaccgggaccaggtggcggcgggtgcctttttgggggtgcgcggccatgcaattggtggatttttttaaaccgttttggaggggggagcgcggcgttgggggcgggagagcgctcctggctgtgagctgctcctgccgcttcgctccgcgctctcctgccgctccgctccgggtctcccgcgctcctctccccggctcggccgagcgcgctgccccgacgccgccacccagagccgggccgcgccgggcgccgagatgaaggtgctgggacaccggctggagctgctcacaggtaccgcccgcctgccccgcagccggccgccactttccgagttggagcggactccgggcgcggcggccggggactggggcggctcgggtctgagcaggaaggggtgcggaccccaactaagtcctagttttgtgctacctgtttgtgtgcggagcccagccccgggagaggacttgaggttgtggcgagtccctggcgctggcgtccgggctgcgggagcaccg

SEQ ID NO: 5518 - DNA, 512 bp, Homo sapiens
ccggcccaagtcagcgcaccccgccgactccctgcccagtccaaactccgaggctgggcaaggcactggatccacggctggaccgacccggggcagcctctgggtgaacagcagcgtgtccgtcggcagagaaccgagaccagcgagccgaccatgcggctgcacagacttcacgcgcggccgagcgcggtggcctgtgggctcctgctgcttctcctccagggtcactatgaggctcccgcggaggggtgacagggaccgggctcagatctgccaaatgctgcggaggcagaacctgacagtgcgggagggcaggcgcctgggaggtaggagctggtggagatgacagcgtggaactcgtgagccccacgcaacgcctccctgccgcccagggtgggctcctagaagcacagaaatggtcgggctgcgggacaccacagcgaggaaccagcggagtacaggggccccaggagcgccgggacatgccaggccgggtagacagcctcgggtcg

SEQ ID NO: 5519 - DNA, 1070 bp, Homo sapiens
tcgcgagaagcacaaaaggggaggggcgggccgtgtagccaagaggacggccaaacggggaggcctcctctttgtcctcgcagatgctggagcagcgactggcccgggagatccgtgccctggagagaagcaaggagcagctgctctcggagagtgagcctcccgcgccaggtgggcggggggagggggatgtgcccgggcctcggccctgcccctgacgcccgcccaccgacagggaggctggtgcgcgccaagctgcgggaggtggagcggcggctgcactcgccgcctgaggtcgagggcgccatggcggtgaatgacgggtgagaggggaagggaggagtgggcgaggagggcaggggcagggcggaggggaacccgcccaggtcccccgctccgcccccgactgccgcttccccggcctgtgcctccctcggcgtcgtcgggtctccgcgtctcggtggcttcctcctcgtcccctggactctcgctctcttcctcctgtctcctcggccccttctccgcaggctgaaggcggagctggagatattcggggagcaggtccggagcgcccccgaggtcggggccggcgagggagaggtagggagcccgaggaagggaggcggggcgggcagggaccgagtcaggagagagcgggcgggggtcctgggagcggcccccgagagtggggtctgtggggagcagggcggccccggggacagaggaagccgcggtggaggcctagggcagacgcgggcggacgcgaggagcgtaggaacctggtccgcagcctcacccagcccccggcaggccggacctgagctcccccgcgctcgcgacgaggaggatcccgagccgccggtggctgcccctgacgccctctaggccagcaggacccgcccgttcccgaccttccctcgagacccgccaagaaataaaggcgatgatttccgaccatgctcgcgttctccgcggagtctgtgctacaccgtggagcggggcggggcgtgctgggatctcgaggcggggcctctgccggacccctcccaccagtcgagccccgggcgccg

SEQ ID NO: 5520 - DNA, 766 bp, Homo sapiens
acgaaccatcatttaatccgctggcgccgctgctgctgtcactggctaaggccgcggcgaccgacgcacagcagaggcagcacagctggagcgcctgcaagagaaaaggtgacatcgcgcgtgaggggcgcggcggggctggcgtcgggcgccccctgccacccgctctcggagctccgctcggcggcacctgccttggccacgcgccccagtcccgccaggcccctcggcgggcccgaacccgcagccgggaaggcacacgcgagcaggagggcgcactccatggtcaggtgcggacgcggcggctgcgggtggccagacgcggcaggcggagcgcacgggcggcgcgcattctttccgcggccccggagctcggcgccccaggtgcggctccaggtgagagccgccgccgttcacatcgcagcgggggcgcgctgggacctcccctcctccggccgcctgcgcgccctcccttctcccggcgcgggcctgccgagctgcagtttgcggcaccccagagggtacggggggctccctgggccgggactggagcgcaaacggttgggagactgtcggtgtctgcccgcccgtctgtgcgtctgtctgtgtcggtgtgagcgtctgaggcgatggggaagacagcgccagctggctcccccagcgcgccggagccgagcgcccgcctctccaccgcgcggtgattggcgaccagcggctcccgggctcgtccgagcccccgggctggtgcaagggcgtgggattcccg

SEQ ID NO: 5521 - DNA, 363 bp, Homo sapiens; identical to SEQ ID NO: 5294

SEQ ID NO: 5522 - DNA, 2919 bp, Homo sapiens
ccgagccggacccccgcggagcacttatcagggtggctagctggaatcgcgtgtcagactcacatgaaaaactcgggagaggacgggttgtcgctgctcgagccgttttctcggaagccgctgctcaccaacttctcgtatttctccttgtacgcgtccctctcgcgcaccagcctggagatctcctgcttgaggtggtcgacttgctgcagcagctggttcttctccgactccaggacgtgtctctgctgcaccctcttgaagcggcaggactgggcatagccgcggtttttcagggtccgcctcttctgcttcagccggatcacctcctccttgctgaccccgcgcagctgccggttcagctcgcgcacagacatggtcaccagctgctcgtcggagaagcggtcgtcgaagtgcaggccgccggcggcgtggtgcgggtgcagggcgccccccgcccccgccgcgcccccgccgcctccgccgccgccgccgccgccgccgcccccagcgctggccgggccaccgccgcccgcgcccccagcgccaccggccgaggcggccgcgctgcccgcggcgccgggcgcgccggccgtcgggtggtggtggtggccggcggcgtggtggtggtggtggtggtagtgcgggcccgcgccgctctgcgcggcggccgcggcgatcacggcggacaccacggcggcggcggggcccatctcctcgccgctgccgcccaaggaggcgccggcaccggccccggccgccgcggccagctgctgcgccccgcgcgcgtagccatcgaagccgccctggagctggtggctgttgctgatgagcgcctcgaccgcgtcctcggggctgaagcccagcgcctcggggttcagctgctgcgggtagccggtcatccagtagtagtcttccaggtgcgccttctgctcgctgcccgagcccgggctgggcgccgagaagctgggggaagggggcaccgagctgcacggcgtgctcatgggggtggaggacagcgagcccccggcgatgagacggccgcactggctgatgatgcggtcggtctccaccggttcctttttcacttcaaacttcatcagatcgaagtcattaacatattccatggccaggggactggtgggcaggtcggagttgctcattgccagttctgatgccattctcctgccgccgccgccgccgccgccgccgctccgccagatgggctgcaggagaggggccagcgggctgtgctgggtggccagcgggtgagccagcttgccgggctggggcgcttctagcttgcgcggcggtggctggcccgaaacctccgagcgcgctcacacacacacccccccgccctgcccgcgccccccgcgcccgccctccctcccccctgctcacgccaatgtgctccctcgctcgccccggcccctccttgctcgctcgcctccttgcgcgccgagccggcggcttcaggctcgggaagatcctccgcgagctgcggtggcggcggtggtggctgcggcggcgaagctggaggagcccggcccggtgcgcggcgtcccccgctcgccgctccgctgcgcgctttgcataaggaagggctcgcctcgccggcccgggctgcaggcagggcgcgcgcggcgtccgctcggggctggaggcgcggcgggcgtctgtccgggcggcgcgggccttggcacgggggagttaacacttcatgcttctcgcctcctcttctgcttggctctctttattattttttttctttcctctctctccctcgcgcgctctctacctctgtgcaaagtgcaaggcagaggtgcagcccgactggaggagagggaggggggagtttagttctttcttgcctttttttaaaaaagcaaaatagcgaagtcctggggaaagacgaggcagagagcaaaggggggagggggaggccaagccgacaagcagcccgagctacagctagaagatgaaaaaagattttaaagcctctgatccagcaagaagagtttaaagcaattgctgagttttatagcactcgtgacgtcaggtccaaatgagaaattgactggcactccgggccaatgggaggcggcgagagcggccgcgattagcataatagtatagaaacaaggaaacttttcggagctgtcaatcagggcccaatcagctgactgtcagctgggacgggctggcttaacccttcctgcgccgctgcctacccgggagggaacgaggcccggcgcaaagtttggtgtaagaggggaaggagtttttccagaggggcttcggcaatccgggcggacctgggagggcggtttgcttttctttggagcgcgagacaggcctcccatccggagccccagctcgctgggggctcactcggctgggattggcctgattcccctcccctgcctgccctccacccccaggattgtgaattcgcctcccagcttttcctcctcgcaccaactctggtacccaggtgtctgccggggaccttccttccctgagcctggccgtgcccggcgctcaaacttggccccaactctttgtccgtctctcgggcgcccgtgcggggaagggaccgggaagggagggatgcagtggggtgtccggatcggggctgcgggctgggcgccgcccggccatgcgcctgcccagaaggctgggcatccgtggagagggaaagcccattttatccctctctttacaacgaggtaaaataagttgtttagaggccattcttcacggagaccggctgcccgctggcgtcgcgtgcccttggacagagcgagcgcctatgcgagataactccggggaagctcaaagtcaggtcagccgggctcagccttccggctcctgactggccggagtttggcctttgagactcatattgcgcgctcg

SEQ ID NO: 5523 - DNA, 2267 bp, Homo sapiens
ccgaaaaaccggcccccgccccttatccccggccgacccgtccgccgaggtggctgccctgggaacctcctgttcctcgtccaggagaggaaacgcacacccgggccggacgcacagaagccgcaccctggctggggccacaagcctgacagctaccgacaagcccccacccacaggagcacgcgacgtgctctcttttcaagggaaaggtttttcttcctgggccctggaatgggcctgaagtcagccggcctcagcccacagggtgaatgaggggtgggcacagcccggccgcggccccagcacacacgggcggacgcaggggcgggggagcgccagccccgcagtgtgttcggagcccagcggctctgagtcgccgccaccagcctggccgccttctgctccacgtaagtgaagtcagccgtctagggctgcgtttccagccatctgtccctccacagaggctcacacctccctccccgctgttcccacagcctggctcggggcctgcccaacacagatggacgcttcccaaaggctgtgcgcgccatcgctgccacccggctgtgccgaggcccgcggccgtcaggaccccagggaccgcatgccaggcagggtccaggacccccagcgcggaccacctttagcctgcggggcagcgccggggacccgggcaggagggagaggagcaggagggagctctggacccccctccccagaccggccgccgccacctctgcctctcccagggccgccctcggcctccccactcccgggtctccgtcacgcgggccgcggggcctttgttaggaaaaccgggcggccccaggggagcccgcgagactcccagcgcccgggcgcgtcgttcccctcgaagtttcgccgcagcccccgcaggtcaggctctgctcacggggggctgcgctcagcccggatgggtgggcgctgggcgggttggctccaccctgccgtgggcaccaactttgaaaacggcccgtgcgctcggcgcggctgcggcgcagatccgggaacggcagccgcgggcggagtcggggtagagcggcggcggcgcgcggggcggacacggcacttacggtcggggggtccgggggatccggcgggcggcggacggcgcacactcgcgactcggtccgggagtcgctgctccttccagcttggtccccgcctccacgactcaggggcggctgcgcgctgtcttctggcgccgcaccgggctcaggcgcgcggcggggctggggcgcgcggggcggccgcctgggccatgccggggactcggctccggccaccccgcgcgggaacaaagcgcgcaccccgcccggggcggtctccggcctccgcggcccgcgccgggtccagccgccgcgcctgtggctccaacgccgcgcgctcgcccgagagtctcacggggccccgcggcccccgccccgcgcgctccgcctccgcctcctgccccccgccgccgccgctgcgccacctgcctcccgcccggcgcccatggcgctcagctccgccccggggcgccggcctggagaggggctccccgccgccgagagccgcccccaacgcctccgccaccggggcggcgccctaagaactggccgtgggggccggggctgtgcggagcgccgggagcagggagaggggagaggggcgcggggagggggcgacgggcgcgccgcctcctgcggggggcggcgcggggaggcgcaggcgggggcgagcgaagaggttgaggggtgcgggcgccgtggagggggcgcggctctggggggcggcccccgcctgcgcccaccctctccccctccgcaggccgcgcacacccacctcgcagcagtcggcggccgcgggcctcgcagctttagaaccgcggcttctggcggccgcgcgggaggctgaacgggagttggggggtgtggggggggtggggaggtggggagttgggggggaggtcgctccttcggccgccgcccccgccccctgccccgcgctcgcccccagcgcggcgcctggcccggcccggggccacctccgtgcgtggccggcaggggtcgcgctccccccgctcagcctcccgggcgggtccgatgcgaagccctcgcttcccgcgggtcccggggccaggtcatttgcatacactttgcattcatttgcatatcgtgcgtttcatgtccacctgcagaaacgccccgagccgctgctctgccctctccgcactttctctgccggcaggccccctcccccgcccg

SEQ ID NO: 5524 - DNA, 265 bp, Homo sapiens
tcgcggctcgcgtgggccccaggcgcgggatggcggcgtccagcagcgcgggtccgcgcagggcgcgcagcgctgggggcaacagcgtggggtccggtcggcagtggggcgcgggctgcgcggtaagcagctcctcggagctcagcaccagccccagcactatgcagggtacccacgaggcggaggccagcaggcgccgggcccggccaaagccgcccgcagctctcagcacccgcgcctcctgctccatcggtcgcaggctgcg

SEQ ID NO: 5525 - DNA, 374 bp, Homo sapiens
tcggggagggcagccgcccgccctcctcggcgctgggagctttcggctggtactgcgggaggagctcccgggtgacccgcgggttctgaaaccgccgctcgggagctcggggcctgcgctgcgtctacggggcgagcgagggagaactgacgcctttcgcccggatccttctccccttccgagaaccaggtaggtcgcgtttattttcaagtccgactgttttcgcggtaacatttgtgggaaacatcacggtggatcctgtgggtcgctgagttttctgactcccggtttgtcttattttgctttgtcagtgggctctgcgctcgcgttaacaattcgaatgggcacgtttctgcgtttcagaacgctgttcg

SEQ ID NO: 5526 - DNA, 1133 bp, Homo sapiens
ccggcgcgggccgccctcgccttcagctccaatgctgctgcgccccaggccgccccgctcctggcaggccccagcctctgactcagccccccgcctagcccctgagagcagcctctccgcgggactggcctgtgcgcgcgcgtctgcggcaccgtcggaccaggggccgcccccgagcggggagcccaggaggacggccaggtggcctgaggcagaggcgccagggaggatggagaagggacacccagggcctaggcggggtgggggcagggagggcggcgggacagcaaggaagtgggtgcacctgggtgacccagctgcgcatgagcgggcaggggctcggggcgcgcggactccaggcgctggactgcggcgtggagcagcgctggggaaaccgcgccgggttcagcgaggattgctgggcggggcgcgcgaggagcgaagctggccgggggcggggcctgagtcgtgtcggggcggggcctagacccgggctggccgtggtgggcggggcctgagtcgtgaaggggcgggccttgcaggggcggggcctcgaggggcggagcttgcggtgaccagcgagggggcggggcttagagccactaagaagcgggacccagtgagggctaaacgtggggcgccgggggcgtggcgcggggcgcaggtgcacgcaggttggccgcgggcgcgcggggtccggcgggagtcccggggtggtccccgcgtggggccgggggcgtccgcgcgggcggggcgaggtcggggagggcagctgcccgccctcctcggcactgggagctttcggctggtactgcgggaggagctcccgggtgacccgcgggttctgaaaccgccgctcgggagctcggggcctgcgcggcgtctacggggcgagcgagggagaactgacgcctttcgctcggatccttctccccttccgagaaccaggtaggtcgcgtttattttcaagtccgactgttttcgcggtaacatttgtgagaaacatcacggtggatcctgtgggtcgctgagttttctgactcccggtttgtcttattttgctttgtcagtgggctctgcgctcgcgttaacaattcgaatgggcacgtttctgagtttaagaacgctgttcg

SEQ ID NO: 5527 - DNA, 2358 bp, Homo sapiens
acgacacctcggtctgttgccatggaaacaggggcggattaaggctggagcgtggagcgcagggatcaggcccctcggctacctgagctcccgcctcagccgctcccgcagggccggggcagccagccgcaggcgccgcggcttctcagcctcctggccgggccaggcgcgggggggatcccggcggggcgccacagcctgctcgggcctgggaggggagaggcagacgcagaggctggaacagctggtggcggggcccgtgggctcccggcgtgatcacctgccctcccagggcccgggggacggcgccccgcgtggcaaccacgtgggggcgcggcgggacttccccggtgcccgcaccaactttgccgcgctccgtaccgggccgggctgctggggcgtctagctacggtggtcgcgaagccagctgtcctcaagttgagctgtgcaccggtcgcgcacactggcggcacggctttcgcgtccctccgctcccagcataatgaaagtttgaggaactggacatcaggcgctggccgctccccaccctcagccgctgggtgcccagagcccatccctagcgatcagagcagaactgcagagaagacgtccgcgtccgggccccgtctggggagctagggcgcgcggggagcgcccgggccgcgcggtcactgaccgctggctgcacgggggcgccgtgcggactcggcctccacaaagcggcagaagcaagggcgtgtgcccgcgcagggaatggaggctgcaagtgcaaaactttatcccagcaaagcaaaggtcccaggaggccggctccccttccaccaccggccgctcactctggtctccgactgacccctccgggccggatctctaggcctggccactcgatccatggagaaaaccccgtgtctcacaactggccgctgacgggagctgagccccagcagcagcccctcggcgggtgcgcccggcaaaacccaccagcccgccgggggctacttcccagaccgggagccccggcgccgggcggcgcccgggctcgcggctctttccggagcgcattcaacttcaacttgcccctgcggctccaactcacctttgcgaagcatgttggccacggggccgccgctccgaggtcggcctaggcgcactccctcccggggtccagattcaaatccctgggcgccagctgcagctaatccgagcgcgtcgaggcgggggcaagccggggatccgctcgtgcccggtggcccggccccgcaggggcatggtgagctccagccccgcgccgagggcaccggcgcccgcaagcaaccgtggtgctgcccggcagccccgcgcgcttgctcagccccggggcgagcggcttgctccgcggagccggcggcctgcttctgccacccggagcacttcgcaggcggttttgaggggggacgccgccccctggccggccggccgcagccccctcctctccgccccctcggaccaccgccgccgcggctgcagcaaaagggcgctcgcacgcaccgccgagctccggggaaagcgcccggcgcgcgtttgcaggaccgagcgatcggcggagcggggcgcctcccttcctccccccggcttccccctcctctcctcctccctccctcccttgctctctagctccctccctctcgctccgctccccgcccccgctcacggagcgcctcccatacaaaatttatgaaagtgctctcagctcgcagtgccgagcgccgtcctattcccaaggcagcagcgctcagccgcgcggcgccgcctcccaaggtgttttcactgcgcccgcccccggggaagatgctcggcccgcgtccgtccaggcacctgcccccagtccccaagccggtcctcggaccactccacgcccctccccggccccgcaggcctcctggagcccgaacccgcagcccagcccccgcccgctcgcccttcgcggctggaggtcatcgggagacgcggctgggacgcgaggaccgccgcccagagtacggatcgcgagtccgctccctgccccgtctcctccctggccagcgccccttctcccagtctcgacggctcttccccgcactgaacagctccagcgaacccggctgccccgcaccccgagtcccaggacactgttctttcgtggggagaggaggggagcaagcattcggaaagggccagctgcaaattccagggagaaggaaggacccgtgcgggttcgggtgggccgtctccgcctgggtggggtggcggcggggggtctctgatctcccttggtccacacagaccccgccggggggttcgcggaaaatggaggaggcgccgcttggaaagcgggtcccg

SEQ ID NO: 5528 - DNA, 1050 bp, Homo sapiens
gcgcgcgccccgggagagctgtgctccccgcgaaatccgtgcgctccagctcagggctcccgggatcggtgcccgttagtgggcacaggacgccgggtgtccgaagggctgcctggagatgcaactgaccttggcgggcatcagaatgacgagtggcagcagcaggagcggggtgacgaacaagatcacgaaggacttgaacttggagacatagctcagcgccgaggccatcgcgcgggagggagactggcgggcgagacgagtgaggggcagctagaggcgccgcgggcttaagaaggggccacagtccccggggattggggagggggcggtgacaactccgccccgcacgggggcgcctccccgcggccctggggcggggccacccctcggggtctgtgggacgcgcctgcccccaattctgccacccggcggcggtgggaggcgtctttggactccaacgcttcgggccagccctctaggggcagcctgggccctagcatctcgcgctgtccaagcctctcctgcgctgccgaggcagaggtgcgtcccggggctgccaagcggggcgtgttttggtcactggtgctgcccgctttggcgtaaggcgccctcccgcgtccgcatctgctctttcctgggctctgaagggtcccggatgaaactctctgcaggcctctgggtctctcaggtctatctccccgatctccctctcctttccatctccttacttccgcccctccggtgtctctccgagaggtgtccccccacgccccgcgccctccgcaccgcgggcctcgcttcccggtcccccctggcttcctcgccacgtccgccccactctaggtgcaggaccccttttccccgctcgcactctccggcccggagctcctgggcgatcgcacagggaagcgaggccactgtcctcctctgtcccaggggctgtcgcgctccagtggacgctgcaccccgcagacgcccggcgggcagatgcggacacgcgtcttggaggggccccaccgagcctcagcagccgcagctgcccgcccg

SEQ ID NO: 5529 - DNA, 1731 bp, Homo sapiens
ccgggcccgccccgctcaccggtaccaggcgaggcccttgtcgtagctgcggtcgaagaagtggggctcggcgcccacggcgcgcacgtcggggtgcacgcgcaggaactccagcagcgcccgcgtgccgcccttcttcactccgatgatgatggcctgcggcagctgcttgctgccttcgtccaggagcagcgccagggtccccggcggggcctcggccacggtgcttccggccccggagccgcccggaccccctgacaggccaggggactcttcttcccaggccgcctcctcgccgtcgtcgcggggcgcgggcggccggcgcctccgccactgcggcagttgcaggaggcgctttctctgtgccgccgccggccacaccgccagctccctcgggcctccggccaggacgccgccaccaggggcccccgcctcctcgccgccgccggacagccccacgacggggccggacagggtctggcagcgctcggccaggcagtagaagacgtaaagggacgtgagcagggagcagagcatcagcaagaacttccggaagatgctgcgggacagcggctcggccgaggtggagagggcactggccgggcccggaggggccatcctagccggaggcgacgtcgggcaacgcgccggccatgctaggcctggaccccgacaggtgccagagcatccccccggcgggccagcgcgctggacggaggccacatcgccgtgcgcccctgtggccgtgcgaactgtcccgggaggcagcggccggggctccgcggggaaacggaatcccgggggccccgcgcaggatccctgcctccagtcgagggagcgggaaggggaacgcgggtccgtgcttaagaaaccatcgtcttagactcgcccaagtcctgagcttggggcagccttggcccctcggttccccgcaagagtcgccggaatcggggtcttggcagcggtgtcgaaggcgtgcgtctcagccccggccccgagagacttctcggcgcggatctccgctcagcgatcctgcatcactggctcggtccccgtgagggcacgcgcggctgccgggcctctgcgctccgtgcgctccagacagtggcgagcgacagtgacttccagccccggctttctctggtccccttgcccgcctgggcgcgttctctccgcccgagttcaggttctctcagccaaggagcgaggtccccccgagtccctctgcccgagcgggagacaggaggcccgtgcagagccgtccacccctctccgtagcgccgggttgctccaaactgctcttggaccccacctgtgagccgcgtggctgggctgggctgggctgcgcgggacctgtcagcggcccccgccactctgctcgcaggcgctcaccggctgcctcctgggccgccgctggccgccgccacacgtgggacgccgagggcagcaaacttgctggtgacgtcaaaggcccgggccggaccagcccccggacgagcgcagcggggcgcggaccagcggccaggcggggccagacgggcggggtgggatggagaaaaggtggcgcgggctccgcagcagccgcccaatggcactggagagggcgggggcggcaggggcgacgccccttccccagtgtcccccattcctccccgcggcttcgcccccttccagtggatccggtgtctgcggcggctccggggttgcctgagtgacagctaaggccggccg

SEQ ID NO: 5530 - DNA, 3535 bp, Homo sapiens
ccgcccctttgggcccgccccttgttccgaagccaatagcaacccctgaccgccctacaccgcccagaagcctttccacaccccctcgtcctgggagcgggttggctgctgagctctcggagaagcgcctgtatttgcatggcgttcggggtttttggtaggtagagcagcccgtcactctggaaggccgggaccgcccactccacctcggtccacagctctcttcctgcgcagttcgcctctgcagcctctgcggggaagtgccggggctgctcgaggctcagttcttaggactgcaaggaggcagccccggcgtgcggcggtgcgcacagtctagagtggccagggcgcgagagtgcaacgtcctcctggccccgagcgcgtcgtcgcgccccgggagcagaccctcgcccagcagttaccgccgtcccgactttccgttccagttgcagctcctgccgggcaacatgtcaagagccgccgccgctacagctgccgccgccacctggggaagagcagcagcagcagcggcggccgcgggcacacgggggcaataaaccgagccacccgggcgtccagcgtgccggggaaccctctctgcgctcactgcccggcgggacccacgccatgtgctgagccatgtccctggccgcgcccgcgggcagcgcatggggcagcgcctgagtggcggcagatcttgcctcgatgtccccggccggctcctaccgcagccgccgccgcccccgccgccggtgaggaggaagctcgcgctgctcttcgccatgctctgcgtctggctctatatgttcctgtactcgtgcgccggctcctgcgccgccgcgccggggctgctgctcctgggctctgggtcccgcgccgcacacgacccgccagccctggccacagctccggacgggacgccccccaggctgccgttccgggcgccgccagccaccccactggcttcaggcaaggagatggccgagggcgctgcgagcccggaggagcagagtcccgaggtgccggactccccaagccccatctccagctttttcagtgggtctgggagcaagcagctgccgcaggccatcatcatcggcgtgaagaagggcggcacgcgggcgctgctggagtttctgcgcgtgcaccccgacgtgcgcgccgtgggcgccgagccccatttcttcgatcgcagctacgacaagggcctcgcttggtaccggtgagtttccctgccaggggcagggtctccatcgtcgattcagaccctgagctaagggagacatggcgtatgatagggaattggcagggttacagcttcggaccacccggggtagggcagggaaactacggcagattgcgcagcgcatcctgtccgggtgcggtgagggttgcgctccgcttggttctcgtcacaacccacagaaagttctcgcggagcactggtgcccttgaattcatcaggcgacctcgccgcaaagaagaagggcagcgactgagaccgccctcagcaaagcgagccaccctctaaccatgggggtatccgactcgaatcgtattttatgactcgttttaaattttttcctcccggagcccgagacgctgggaatgttctgagcccctttggtcggtctccgccctcaaggaacttctagagcagcttctgcttcccagatggggagagggggtgggggccgcggcgtcccggcgaggccgcagagtctgttaactttttgttacagtccgcctggttaccggaaccccaagggtgtcagacccgcctcgctcgcgagccgcctgggctcgggagggtgagccgggcgggtggcccggcgcctccgcctggcgggcgggcggcgcgcggagcgtggagctgtgctggtccctgtcgggcaaaggcgcgcactgcaaccggctggagcggcgcgaggctttgaaggcgtccgggcctccgggcaccgccgcccgtttccgcctccctgccctcggtgctgggatagggaaagcaaggacgcgtgtctccgcggggcttttacacgtccggagcaaagaatattcggggcccattgattgagaaatgagggttgcttcgaggtcgcggcttccggaaattctgttctcgagtcgggttgcgggtcaggttccaaagggacagtggccccggggtcacaatcactacctctgcccactgctttccgcagctgctggtctttggggtgagctgttgggttgcccgagcttcgggtaaggcgcgagtgggcaggaggtctagatttcggcctccgataactgtcttcgactaggggcccaggtaacgacccccacattttcgttggggtctccacccgtaaccccagccagcacgacattcagacacccctccaggcccaattagcttcacagacgctcaagacttgggaaaacaaaagaggagaagataactgaacccctctccctgtgcccaccccactgtcgggacctgggtgggttggagaataaaagagggctgaccccgcggattaaaacggctcccttcccagcctcgtcctaccccttcccctttgtccttaatggttttttattattgtcaggagttgcccaagtctcgaggtttagccaaccgtgacagtcatctttcccaccgttcccgggctgtgacccattctcgggacactggtggataagaatggggtctctggagtccgacgcctggattcacgtcctggctagtcgcgtgaaccttggtgctctcatctgtgcagtgggaataatgcaggttctgggcagggatgggaagagtgaatgcgctggtacggtaaggtgcctcgcaggcacgtgagggcctctctaatcgttagctattgtcaccgattgtattgttatgacttctaccaccaccactccccctcctcctgggatggtgattccagggccaggcggcaggctataactagcgcccttccaggtggaacccgccagagccccgaggcagcctaggattttctgagatcagacacacttgggccgggttgggaggaactggcaggaaaaggactgaacccttaatgtcaggcggttttgaagcacctggggcaagctatggaaatccccacaggaaggctcacgcagtctcttaggcggctgccctccacctgccacgttctttttgattgactaaaaaacgctgaatgaagaacgaagtcgcgtggaaaccctcgccgcgcgcctgcagcggacagcgcagcccgggaggttcggctgccgacttgcgcccgggggctgcgctgcgagcggccacgcatggcggctggacccgggcggccgcaagggcttggctgggccgcgggaggcgggaggttcttcgtcctcccgagccatctccctgaactgacaagcaggactcccgggtccagggggcacagggcccggggcggtgacccggcggatcgggctgccggaggagcccactgtaaatgccgcaactggccccaaacactgcgttcctggactgcaccagcagctcctggcgcggccg

SEQ ID NO: 5531 - DNA, 2896 bp, Homo sapiens
gcgtgggcggtgagcggccgggagaggggcgggccagctgagcgctcaatcacagccccggggctcggcgcccgccagctgcactcagaacccccctcaccgtggccctgccctgtggcgcctaattacgtgcccccagggctctggagcggctgctgggactgcagcgaagaggggcccgcgccacctccgccaggctccacgcgccggccttgagtgcgctcccctcggccgccgggaaacctagaggcgcggtttggccccaaggtccccggtcccgctcttctttgtctcggcctagttctcggctgtctccgggccgcgacccacctctcctggcggtccttgccgcatgcttctgtgctgcgccagaatcatcgagtctcagttctcgctgccttcccggccagtaggcgtctcccccagctggggagggtcccccaaaccctgtgcttctaggaccgcggggccggcaagcggcaggatctccaagctgcgtctctgatgcggctaggggaggcgcgcgatgaaggcccccctcttctccgccttctctctacgccccaccgctactacacgtcgcgctgcgccgcgaccccggcgctgcctgttggcgccttaagcggctcttctgccgcggtgcgatccccgacgccaggaggactaacccccacccgccaggcctcagaccccacgcagatccagccacacacgcaaccgcctgcagatacccaccacagccctttaagttaacccaaagccccgtacaggcgcactgcccctacatgcgcagccccacggccccacacacccaccagcccactcgcaaacaggcccacatggccacacaactgccctctggacactcagccccacgcaggcacaatcccatatacacacaaccgcacacaggcgcaatcccacccacgcagtacctcacggagtcacacaacccccctataaacaatcgcacagacacagccccacgcagcgccacatcattcagtcaaactgagacccagaaacacattcactagcttgtatccagacccccccccccaagccccgtgacattcactcgtaggacagaccagaaatatacagccacattgatacacacacggacctaaacgcacagccaagacctcacccgcaggctcgtaagtcactggaaaaatattaaagcgttccctccctcccctcctctatctttgacatacacacgcctgcgcgcgcgcgcactcttacactcacaccccccgtccctaagcgcgtcggagcctcgcagcgggtgaccccgaggccccgcggtgagagccaagggagcgtctccccggcgccccctcctcccgctcccttcccgagctcatctctcgcccccccgcccgcctcctccttccctgccccctcctcctcctcccttcccccgagtctggggcgcgggctgcgcgcagccaagccccctcatcgcgcgcccctccccgcgcgcgccccgcgccagcatcgcgcttaccgagtggatgcggccacggggccgtctctaattacctcctgacccccggcggcctgtgaataatggctactgagggcgctcgcaggggctgctaagaaggaaacgcggggcgcgagaggcgcggcgcgcgcgggagcgcgagggaaaggagcgagcctggggccgttgcaagcggctggcgagagaaaggattcgtgcgagcgctcacatttgtttctcccaaggatctcatctggccaccgcgttctggaagaggcgagagggagagcgtgcgcgagaggagagagacggcgggggaaagggagacggcgagacgcgcagcgccggcgcccgggagacccaggaggagcccgcaggtattgttggcggcggagctttgtgttttcggcgggctgctgtgggcgccagggctccccgagcccccggcccgccgccgcgcgcagacctgcccggagtccggggctgcaggctggggtcgccgcccgccgcggacacccctcccgcggcgccaggatcttggctggagttgcggatttgcatgtttgggggttttccacgctggttgagggaatcggtctcagaagaaggaatttctttctttcctttttttttttttttttttggccgcttttggccacagtttggttgtgctggggattcccccctcccctttcctccacaaagcattggtgagcggtcttgacgaatgtggtattggcggaaggcatggggctgagatggcggggctggtggccacggatggggaggcgagagatgccagagaaggaaggagttctgttcaagttcgcaatctgcgccccgaagctggtcggaccggggagggcgatccgcgcgtccgatcctgctccgggcaaccgatgggaaacttcccgagagcgcggcctccctggggactcggcgcccctgacgcctccaggcgcttcctcgggccgctgcggcccctcctcgccgcccgccagcgcttaaggtcgcgctctccccacccccgccttcctcccttcctcggcggcttccggatctggacagagctgcaggagtggcttcaaacacttcccctggagacccctccccactccccgcacgagagcctgcccagtggcccccctgccctgcgccccagtctcacgcgcggtcgagtggccaggctgacaatgaaatctcgcacctctgccggggggagtggggtggggaggaggtccctcctggggctgctgaccctgggcctcgggcagggggagggggctcctgggggaggggcttgttttggttagagacgtcgacctgggatggcgccggggcagggagggggctggggggtgggcgcggcgaaggcggcaggcttgggttcgcggccgggggtcg

SEQ ID NO: 5532 - DNA, 2567 bp, Homo sapiens
cgtccccaacgcgggagcgcagtgcatcccagtggacaaactcgagaaccgcacgctgctctccgcctccacctctgtcctccccgctcgcggttccaacccgggacccaaatgcacgagctcggtgaatgccccggcaggagggcgagggctcagaggcagcctgcccagcaaaaacgacagctgtgctctggtgggccctgggccaccccaggcagaagccagagaagcccgagaaccccggcgggctggcaaagtttgccgagaagggtctttctggacacccccaccacgggctctaggctcgaaccccctcttccatctggccctggagtcccagacacagacaagccccgggcgcgccggcgggcgtatgtgcgtgtgtgtttacagcggggtggccgccggagctccccaagaaccccagctctcccgccccagctgcccgccagctgtgagcgcccgtcgggcccggaggtcacccgcaaacagctgggtcggcagctgggagcctgggaggcccctgctcagccccggggccccgagaaaggagaagggggagcggagtggctgtttggctgtggtttcctccaactccgcctgcgaagctctcgctgggagcccggagctttagctttccccggcagccccggcccccgcgcccgccgcgcccagcggccggcgcctcgccccgggccccggggaggaggcgcgccggggcagccggccaggacactgcgctgctggctcctagagctgcgggcgcgcctggccggccccacttcccgggttgctggggcgggcgccgctgccccgaccccggacgcgcggaaccctggagacccggccgctccccgccagggccgcggtgctgctccaggctccgggcgggcgcccctttccggctaccggtgcaccccgttgcccgcttgcgggaagcgaagaggggtcccttgatttgcaacatagaggaaagcgccgcttccgcccagcctggcacccacgcgcccacacgcacccggcgccggccgggtcgctcacctgagtcctaaaagctgttgaatccacatggtcacgtttcggggagcggggcctcagacctggctcgcccaggccatctgcgcggcgcccgcgcccgctcgcttccgtcccgcggcgccggtctccggctctcggtccgccgcctcccgccgcccgccggccgcggggcgcacagcgagtcagagcgcggccgcgcggggctccatgccggccggcgcgccgccgccgttggggcgcatggctcaggctgggcggcccgcgggggcgcacatcctccggccggggcgcggggctcgcggccccctccgccggcggcacagcgaaggcggcagcgaggcggggcgtgttccggcgctgtcgcggcgcagcaaagggctggggagccgcggcttcgccctccggggcggcgaggagggaggccggcggcgctgccgctcacggtgcgtgtctcccggcgcgcggctcttgcctccagccggagctccgcgccgatggggcggcgctgcttagggtttggggtgacgcgacgcggacggacgcgagtcccctccgcgctgccgggtcggggggctctgccagaggctccgccgccgatcggcgccactcaagttgcccgggggctccgtctgagcgctcgctctgcagacggccgcggcccggagactggcaggaggcgggcacgagaggcgcgcggggcgagggcgccgtggagcgcggggcgtggggacgcgcggcggcggcgccgcgcggaggaggcgcgcggggatcccggggccccgccgcccgcgcccaccgcgcccgccgcagagccgcccgcgctgctcagccgcctccctcctcgcgtctgcctctccgcgcgctcgcccccgcctcccggagccggtcccaactccgcccgcccggcccggctcacgtcacccgccttccccgcccctcgaacgggagctcgagcccctggcctggccccggctcctgctcgccgccccaccttgcgggggccggggtcgccgcgggtggtggggggcgctgtgcccagcaggggcgacagcgcaggcggggcctcctgcagcccccttccccatccccggtcgcgtcccggtccccaccttgcgaaaggctcgagagaggccgcaggctaggattggaccgccgggcgccgccggatggtgttgccagggtaaccggatggcacgcgaagccgttcgaggttccgacccggttacgggggcgcccagtggacccggagagctactttggggagggggcggccccgaagaaggactgggtgggggcgcatggagcgggggctgcgcgaaaagtttcctggggcggagctgagccacgcgggccgcgcaggagcgtctgtccgagggtcgcctacgagggactcctctgctcggctgcgcgggcttctgcgttgatgaagtcaccgcgttccgggtcggagcttcggcgcttctgccccgaacccagcgaagcccggtcctatgcccccaattacccaacggtccctcatcgcccagcgc

SEQ ID NO: 5533 - DNA, 573 bp, Homo sapiens
cgctgtccgccgggccggtggcgttcaccccgcaccgcgctgccccgcccggggcactatggcctggggctggactatgccctccccacctcagccggcgccccccacccacgcgcgctgagggtgcggtgagctgagtgcggggccaagcatgttctggcgtcgacttcgcccaggggcccaggacctggcgcccaaggggctccctggcgacggagacttccgacgcagcagcgacccgcggctgcccaagctgaccccgcccgcgctccgagcggctctgggcgcgcggggctccggggactggaggatcccggggggcggcgccgcgtggtggccggaaggggacgccaagcccggggtgggcgtcggacgcctcccgccgcgcctgcccgccttgctcaccgcgacccggcgggccgtgcggaagcgggggctgctgcggtccctgctgccgcctcccctgctgtcggccggcgcgtcccgggaatcggcgcccaggcagccagggcctggagagcgcgagcgcccccggaggcgcgtggccagggaggaccccgacttcttgggcgc

SEQ ID NO: 5534 - DNA, 383 bp, Homo sapiens
cgcccgtcggctcctacaggggcgaaatcaggcacccaccgtgacggcgagcgtgacagcgtccggctcgaccttgcccagatgtccacagaagatggagctgacgaggctgattataaagatcatcaactgcgcaagaaactgcggaggcgcggaaagcaaggcgcgttcacagccgccctccctcctggaagcccgcgcccacccctgcgcggcggccgctccggaggcgtcgggctgggcgtgaggacgccgcactcaccactgggcccgcgagcgccgccagctcagccgcctccccccgcaggtccgggggcagcgcaccccgcaggccccacaagccgtcacgccatccgagggcccggagccgctatgggggccgg

SEQ ID NO: 5535 - DNA, 853 bp, Homo sapiens
cggcgcggggtgaggtccgggggccgccttattgctgaggtccggccggttggggccgccgctaggcgcgctggctgggcagctcctgggagatgaagcgacgcaggcgctccaggtactggctgtagagctcgatgtcgttgtgcccggcgccctccacccacagcggctccaccgccttggggcagcgctcgtagagcgccagcccgtgcgagaagtcgatcacctcgtcctccgtgccgtggatgatgagcacgggcgacgtgatctaggacaccttctcgatgctgcgggaggggcgtggagcgggtgagacttagcgcccggcccgggccccgccccgcctccgtccccgccccgcctccgtccccgcccgggccgctcacttagggaaggcgtcgaagcagtaggtcgtcttggtgtcagggaaggcgacgcgcatgcccgaggtgagcggcgagtgcagcaccaccgcggcacactcgtagcgcgaggccaggtccacggtgggcaccgtgccgatgctctgccggtacaggatgatgctgtccgggctgatgccgtacctggcagcgccggagcagggtcagccgcggcctccgacgcgcgcacacccttcccaccagcgggcgtccccgggcccagctccggatgcgaccctccagtctccccactcagccaagtcagtgggtcaggcccaggctccacaccagtcccgagggccacccccagcccccaacaccgcggcggtgggcgaagccagcggccccgccccgttccctgcgctgccgttcactggcgtttcctagctaggatctgcagggatctcgcctacggagtgcccctggggcgg

SEQ ID NO: 5536 - DNA, 1062 bp, Homo sapiens
cgaggaaggaaggtgggcgcagaagccaccctaggcgtgacgcgtgacgctcggggcacgggcgccggggggcggaaagcgagggcccggctgggccagggatacccggggggggccgaggtcctgggctccggcggagggaggggattgggagggaggccaccgcctcgggccacgcgggtgacccggcgggggagctgggggaggggcggcggggctgggctggggtccccgggccgggactggggtcgggccagcttacctcctcgccctggccgaagcgcagtccgagcgccgcgacgcgctccacgcgcaggaagccgtcggggtcgcggccgcacacctcgaacacctcgcgcaggcggcgcacggagcgcagcagagccgcgggggcgcccgaccagcccgcgccgcccgccatccgggccggcccgcagctcagcccggacccctcgcccgccgcgcccgccgcctgcccgccgccgccatcgccgcgcgccctccggggccgcccgtctgggtctgcgccgcgcagcctccgcccggtggcggccgcggccgatccgtgtcagcagcggcgccgcagccccagccgctccggaggggaagggaggggaggggagggaaggagaagagtggggaggggaaggaggaggggcaatagggggcggggaggggaggggcgggggccgcggcgaaaatgggagggagagggggaggcggcgggggcggcggcggcggggacgctgcagacaaaaggagcccgcgtcctcccgagtggggcggcccacgcggggccggcaggcgcagcgagctgccaacggccgcgtcctccgcgacctcagtttccctccgcgtccccagtttccctccgcgtccccgagcccaccccttcctctggacacccggagccacccaaaggccctgccctgccggaggattccgcggggtcgcgcccctttccgctatccgtgcccgctgccgcgcctggcgtctcccgagcgctcaggatgtcctgggggcctcctgcattggcgcgttccgtgactgcattcatcccgg

SEQ ID NO: 5537 - DNA, 918 bp, Homo sapiens
cgcgaagtttccgcggcggagagcgctgcgcggggagacaaagggaagggacagggatcgcagggacagggacaggagcggctgccgggctctgggtccccgatcgccaccagacatgtctccgagcagccgaggcaaagggaacggatgggaaaggaaaacagaggagcggcccagaagggcggctcgctgcggtggtggggcgcggactcgggaactcggggcgggcagggcacgggcgcaccccctcctctcccctccctcgctcgaggccggcagcgccccccgccccgcgccatgcacacccattgtggtgatgagagctcgcgccccgtgcccgtcacggtcactgtgcgtccaataaaaacaaacactgccgaggagccgccgcgatgcggggcggacgcgcggcccggaaaggggagggggccctaggaagagctacacccgcgagccgggcctgggccaggggcgaggggagagcgccaagactgccccgccgccgagggcgccgatggaggcacaggggttcccgtggggcgccccgagagacaccgtgcctggccggcgggacgtgggctggcttctcacccgacggagagaagcggcactctcatcttcgggcaccgggtctgggctccgagcgggggctcctggaacacaaggcagtgggggcagacgggcctgggcccaccccaggctgggaaggggtctgagcggggcgtcctgactggacccggccctggcggaccgaaggctccaaaagatcttgcattctcaaagacttctgcagatcgtcaccgcctaaggcgccccaggcccggctccactcatgggaagggtaggaaagaaagctgggagcgctctggggcgcggggcagagacagcggtgttggaggcgcgctgtggaggcggcgg

SEQ ID NO: 5538 - DNA, 865 bp, Homo sapiens
cgagttgtgccggcctccgcgttctcctcacctcccctctcctccggacctccgccccctcgcggagaggccttgccgctttaagagccgggctagcgattgacaagcaataaacgctgagcgcccggctgcgctggagccgcccggagctaggggcttcccggggcgcaggtaggcgtcccccggcccccgggccagctcctatcccaagacctccgccttcttttcgtcctgacacggcacttaggaccctattcactgggtttaaactccacaggcccctttcacccaggcccgttccctccctgtccacccgcccccgcccctgggccctctttctggggtgctggttgggagaaccaagccccgctgcccattgacactggtccccgcccctgcggtaggggctccaaagtggcttcaggcaccaaggtggtgagctgtgaggggccccggtatctgcgcggcctccccgggggctgtgcgggttgggggtacttagaagcccggcattacgtaagaaccgtgctgttagcgcttccgggggttggggagcgagacagaggttgcgctgggtcccggtggccccctggtccccctaggcagctaacaccacaatcttccctgggagggggtccgcagaagggcgcgcgctgcttctcccgcttcccaagctgtagcggggcgggtcgggagccagggttagggtctggagacttgggaggggaccggtgccagaagcgaagagctagggttagaaagttaggtcaattaaggggggggcggtgcggataaagacggggtgggggttggccggggcagtcatttagtgacctcatccctggtctccggcgggcgcgcacgt

SEQ ID NO: 5539 - DNA, 408 bp, Homo sapiens
cgaagcggggagaatccggctgggctgacggagacgccacaccgcgccaggggagcaggagctttttcggagcgggaggcggggcgccgtgtggctgcgagcgcgcctcttggatgccccggccggcgcgggggtgggtgggcgctcccgccccatccttggccccgggcggccagccgcggtgtgcccggagggctctgcgagggctgtgggtggcgggcgagccccagcggcgtagcagaggaggggcccccgagcgagcgtactagggagaagggggtccgtgcaaatcccaggctgacgaccgcgcacgcgcccctcgggtcaccagccctgtcgctcttggtggggcacaccgaggagaccgccgtggggaaccggggaccggattgcctgacagccgagcgc

SEQ ID NO: 5540 - DNA, 2245 bp, Homo sapiens
cggaccctgcggagtcccgagccccgggtgaggcgatgcccagactggcgcgaagcggggtgtcccggcagcagcgcagaggcccacccgcctctccggccggctgcagcgggcgcgcctataccctgcaaaaccaaaacgctctggaaagcgcttggggctgcaagtgacgcctgacacgagcggcgggccggactgccggcctcccggcccttccctggctcacacaacccgcgggccgcccccaccgcccacgaacttcagcgggcagacgctggacgtgcggtctggctactttcctaaactccagcgcccgatccgcgtcgcagggtcggccgcgcagcgcggggatcgcgggtgcccaggctcggagaacgagcgtcgcgctcccagccgcggtcggggaacaggaactgccgccagaggcaccgtctcctcccccgagactgcgatattgatcaagggctcgcaggcgcgggcggcattcatctctccggactcgcagctcgccgcggaggggaaggggcaggacgcgctcccaagactagggcgggggcgtgcggagtcggggagctgtttgggggcgctggggcgaggtgggaaccccgcttcagagtctccagtcccggggccgaggtctgcaggaagggcgtgggaggtggaacctcccctcccctaggcgtctgcccgagagcctagagcgattcttggcgcggagccggctacccgggtgggcggaccccctcctccgccaacatcccggcggcttcgccacgatttcttttctcacctgagtctccccctgcctacccaaccctggctccaaaggtccagagagttaggctgccccggagcccagccttccccgacctaagcacggctctcccagcgcccccgcccccatcacacccacagcccagccccgtcccgcgtccgccaggggccgggggcgccagcgctcgagggatggccggcgggctgttaccttgacgagacggagctgcgggtgccctcccatcctcgggctcgctcggctaccgtcctgaatgcccgggtcctacggacatcccagagggaccggcgggcggctgcgggctcgggcggcacggggtgggcggccgggctcctcggtcgctgcctggtgaggagatgcccggctcggcgcttcccggccccgcggcccggcccggcccggcccggctctcgctcgccccttcccggggaagtctggccgccgtttcccgacgcagcccggcccgcggccgcctcttgccggcctcgcccccgccacctcccccacggtccgcgccgctcctcgcctcggctccccgccccctcgcccagctcgtcccctccccttcctccccctccctctcccctccgctccccttcggtccctcctccgcgcctcgcccctcggctccctcccagctcctcctcgcctcctccgttccctccccttcccccggcccgctctctgtgtcccgccgccaggatcccctttccctgcgcccggggtttgcggcagtcctcggggcgcgctggcagcagtggcggccgccgcagcccggggagaagccgggaatgggggaagggggccgcggtaaaggatcagcctcccgcccggccgaggtcggggcctgggaagtcccagggatctggggtgacttgggccagggtgctcaggtgaatttatgagggcgaggctattgggggctagggaacagggcggtccctactgagcggagccgccgcggaacccagtgaggctgcgacctgcgtttgggcagttcccgccctgcggctggctaggaggagctcctcgccgcccccattccagccgcgccgggcgctgggcccgacccccagcacctttggcactgatgtgcctggtgcgcgctgagacgcgaacgctctgcaagatgagcccttattcattcgttccttctttccttcatttgttcatcttacaaactgagtgcctggccactttggttcaggcaagaggctggatctgggaaccctttggacctgggagccccaggatgaaagggagacggcggtgccctgcaggacaagcgggcactgaacgctgcccaggggaaagccgggcgcgcattgcgttgcagcgcggcgaacgctgctaggagcccgcgggcagggcgtggggaggacacagcgccccctcccggccggccgagccctctgggcagcggtgggcctccccgccagaccccggggccgt

SEQ ID NO: 5541 - DNA, 2972 bp, Homo sapiens
cgattattcccgcctccccacgcggtcccccagggaagaagcgaggcgcttgagccagactgggctggaacagtgcggtaggggcccgtcccccgcggagctgcctccccatccaccatccacccagctcagcccggccgctcacgcacgcccatttgctgccctcgttccatccctattaggcgcattagccagcccggcggctctggttacagacgtctgaatgacaaagtgcctccattaccggcgcggcccgccagccgacccgccgggacgcgctctggtttcagccctctctctctcaccgcggcccaggaagaaactcggaccgcgcacagccatcccagaccgagcagccgcgcgccgaggcggaggcgggagccgcaggggctgcagacggcaggttcctgtcggggtacaccttcccaagcgcccaggtcctccacgcccagctcccctccttccttgggtcttcgcgcggggaccctcgctcttgcccagacccggagcccaagtcgttgcccctctgggatccggtccctcctccccgctctcctggtctacgctcgcccacccgcgtctgagcagcgtctctaaccagcggcgttagtcagcagacgtgcccgcggtcgctcccaaatccccggacgcagccacaggtcctgacagctccagggaactggggctgagctttcgggctggggcccgcacccggacagaatctctgcccacctcacccgcaggctctaccgccgacggactctggggacagtgtcaaccccccccgccctgctgggaaacgcagccgtgaccccgagctgggacagcggctgccccctgaaaaggtgggggagtaccgagctgggaatcaggtcggggagtctagccacgactctggcccaacttgctgtgagatcttggccaagtcgtttaaactctcagagcctcagtctccgtatctgtaaagccggaatttggggcgcagtgctctgatgaaagatgctggcggggagagtgaagacgcctcctccgttgccagaccttccagggcattcggttcatggccataaagcaggccacatctgacaatctcgtcggaccacccggaggacccgccgacctttgccgagtcggtggcccgggataccgcgctacagaatccgaggcgtccgggcgcccccgtctcgttaggtgcccagcggcttgcaccgagagccaggagaggctcagaccggatcccgacccttcgaggcgcgggagcccacggagcgcggtgggcgcggcgctcgggtcgcgcagctaggtggggagcggcgcgcagccccagactcgcaggcaggcagcggcggactgcacttgcctcgccccgcagcgccccctgcctgccgcctcccgcctgcgtagccagagctgcgcgcggccaggaagggtccccgcctagtgcgccccggcgctctgcaccccgagacgtagccaccgccagcccgggtaggggcacacccgctccgtccctcgcgatccgctgcgctgcttcaagccgtgagaacacgcgcgtcggaggagcccgccggccgtgggggaaccccgggagcgggttcgccccggcgaagtgggcactcccctcccagccttagatccgcagccccaattccgggactgggagaggccgcgagcaggagcgcggggacaggcgctggaaatgtccaagcctctgctctctcttctcgtctcactgtccctcagcgggcaggcgggaccccgaccacttcagggtccgcgccccgctctgtctcctttccttctgcttccatctctctgccgccctcgccgtcgcccctcttctgccctccctaacccacttctcaacctctctcccgctccccaacctctccctccgacgcccctcccccccattgtctggccggtccccattgtccttgccgggtcccctctgcctccagtccctccgacctcctccattgttccatcccgtcgtcccgggctccccgccccagcccagctcgcccctctcatctctagtccccgtccagttccccctccttctctcgccttggttctgtcccacgactctccagagaccgagatgctgaggggaaagtcccttcgggatcccggcattcgagtgtcctcttccgaagaacctgggcatcggagagccccatgccccctcttgaaagacccctcccagctcccccaccgccccctgcggtacctgaggaccggcatccgtgctccggtcttgccctcatctccaccctggagagtcgcctctgcgctccgggaaccctagaccctccttcgtggtcccggcatcagaggtcctttcccaccacccaccctcagtatctgggaccccaatgctctgttctgtttccttggtggcggcgcccggctcttctcggagttctgatcccgggaaagggagcgggccccctccggctaacactcacccccagaagcagcaacagcagcaggcgcggcccgtccatggcgcggccggtggcacctgcccccatcgcccgcctcccgcggcagcgctcgacttccagctcggtccgctttgcggactgatggggctgcgctgcgctgcgctccagcgccccccctgcccgccggagctggccgcggctcggctcgctctggctgcgggcgggagaggctgggtgaagccagtgctgcggccccgcctccgccccgcccagcccgcccacccccggaaccgcgcccgcccgccctgccgcctcggggtgggaagcagaggcaaagggagggcgtgcggttccccgcaccccgctgcgcttctccctgccttgtcccttagagcctctcacccatcccgccctggtacccagttcccggcccgcgctactgcgcgtccgtcccggatgctgtgggcccggggaccagggcgtccccactgcggttcctgttcctctccggctgcggcccgc

SEQ ID NO: 5542 - DNA, 1026 bp, Homo sapiens
cgaccgcccgggtccgagcagcgggggcgctttcagcggcggcaggcgcgggtgcgggggagaggagcagaaaagagagcagtttgaggggccgagggagccgcgtccgaggccggcgcggtggggaccgcgggcccaccaccagccaagcccagctacttaactatttgtagagctgctgcaggcacaggtccaggctttcgccctccacctcctcgcgggtgatgcgctctgacagcggtcgcgggagcgggggcaaaggcggcagctggggcggcggcggcggcacggccgagtgccccggggctgccgccgccgtcgccgcgccctcctcctcctcctcaccctcaaccgccgcctcctcctcgggctccgggtcttgctcctggtccccctcctccgtcgcggctaccgtggccgcctcctccccgggttcctctaccgaagcctcggccgcctcagcttctaccagttcaggttcgggctcgggctcggactcgggttcgggttcgggttcgggttcgggttccggctccggctcgccgccgccgcacggtccgcgaaactcgcccaggaatagctccaggaagcgccggtaagttttctcctcagggatgcagccggccatcgctgctcatgccccagggcagaccgggaaaggggttgggggaagcccaggaagggtaaggggctgcttttgagcctagggctccggcaagggcggttaacggccgcaccggcacgagcgatcagcactaggttgcctggagagggctcccgcaggcgtgcgcgccgccgagcaccgacgtgcgcggcccgggggcggagcgcgccgcccctctcggatctggagggaaagttggtggcgggcgcgcgcagggtccagcggcggcccaccctttattcctacggagagctcagcccacgctgcctagagactgtcgccatggcaaccggttctaattaagcattgcagggtccctcccgtcgagtccgcggagtctaaaggacactccactcgcccgc

SEQ ID NO: 5543 - DNA, 10207 bp, Homo sapiens
cgctggcctcgccgccagctccctgggccttctccctcgctggcgctgccgcggggtcacaggccttacctgagatgccagcatgtgctgggagaggtggaacgggaagggcgcggcggtgcttgctgcgctggccgcgggacccagcccgcctgcgtccagccccgcggcggtcccaggcccgccacctccgccgttgccgccgcctgccaccgaggccagtaggtgacccatgcccatggcggagaaggcgccagggcccatggtgaactgtccagggtgcaggaagagcggctggccggctcccagcggcccaaagaactgctgcccgtgcaagtggctggaaaaggccaggccgggcaggtgtccggcgcccaggggggacgcactgtctgtctgcaccaccagcggcgccaggccctgctccttgccctcggccgcctccttgcgcccctcgtccttcctccgagcttcggcgcgctccttctccaggctcctcaggccgaacgggccgtccccgccgctctcggccggctccttgcccctctcgggactacgccgctcccgggcgcgctcgggttcggtcaagcgagtggggctggcgctgtctggagccgggctgcggcctagcggcgcccccgcacgctcctcgctcaaccgctcaggctccgggtcgctgtccgcggcgcacgacttctcctcagctgcggggagagggcgcgcggattacaggggcctgggcggaggccgacgagcaggatcagggacactcgggaagggctgctctcggggaggccgagtcggaggagctgctggagtcgggcaaagggcagctgcaggtcacctaatccaagaccccagatttacagtggaaggaacccagccctggagaggaaaccctacagctatagaattacacggcgcccaaggggccaggctcggagtccggccggatcttctggctaccggggaccgccctcgtaggggagtcccgggacggaaaccccatcccagacactcgccgacgtttccttcctggcctttcaggttagcgggtggctcagcaaaagaccagcccagcgacctgaggaccccccgccgccacctccctgtccctcctccggtccgaccctcacctcgggcccggtgcaggcgcagcggactgggcgctgcgcccggggaggtgggtggttcccgcgcggggggagggtcgcacgacgaggcgtctgactccgcgccatcgcgctcgggtttgcagtgctcctcgtacaagcgtagagacggcagcgtcagctgcttcctggggatgagcggatgaaccaggtcagcggggagcccatccctccatccctcctgctcgctgctcccgcgggcacccgccacagggctgctgtcctcggcctctcaccttttctcccgccggccgttcccggtgtcccggaagcccttggcaaacgggttgttgtcgatcttcagctgtgtgatctgcggggaccaagggggcggcgctaagtcaggccgtggctcttccagcgtggtcggtggcaccccgaggtcagcgggtgctggccgcagagggaagacccggggagcgtccacttggtacccacccgcctgggatgggacgccccgagctgaggccggtgggagggcctcgcggaaagcgacggggtctgtcctccaaaagcttcattcgaggaattatccctagacaggcctagacagccccacacaggcctaaagcagtgccacagtgtcggaaccagcccaagcatgcacacccgcccgcgggcttgcgcaagttaaacgactccgcacccgagcaggcgcgaacagagactgcagttcacacgcaaggctgcaggtacacacaaagccaaatcacactcacgggctcgcacacacgcaagtgtgcacagacataacaaacgcctacggaaccaaacgaattcacatgcctccacaggtatccaacacaccccaaacggggcacgcacagcccagcgtacaccttggttcacaaagccacaacgaccggcacggacactcgtaccctctctttcactcgacagtggcgcacaagggcacaggcctagaggggtgatgctctgccccactagaacaagggtggagaagccgcaagcagaaaaagccctttgattggaaggtaattctctaagcgcctcccaaggggtctggggcctagactgacccagagcagtagccaggagtgctttggggggctgtgtcacctgtcccaccctctggctccccccgagagagtgaaaactgggccccgggttctgagcatcggtagagcctgggcagattgcctcgggcgccctctcttcacttacattctcattcctgagccaagaaataaacgaataaaatgtaaaaatgtcagcgcgggcccggagtctcagctaattgttaagtaaacatctccatcagaacgacggcccagctgttcgctcgccccaggggagcctgtgtgtgcgcgcggtgggattgagagggcgccttgaggacttccgtgagtgctgcgcgtatggatgcgaggctcggtgctcgggggcgggccgcaagagcgcggatcccgtgcagggggcttcgaggggcgatgaacggacggttgggcctgcacgtgttgaggggcgtcagtgcaggggcttagcccaccgcccgccgcgcgcaccttgtcattctggtaggcagtgacggcgatgaagtcggtctccgggaacacgtaggtgcggaaggtgctgtaaggcagcttcaggatgtcgttggctcgcactatgtggaagcgcggctggtacttgtgcatggagtttaggatggtctgcggggagggtgggggtcagccggcagccaccagccccggcccgagcttttctattctttgggtacctgacctcttcctctccactttctctctctctctctctctctctctctctctctctctctctatcggttcttcctcttccccattttctcctgtctctgctcttttctcacccttatttctttttcttctacttttcctctcgcttttctcttttcacagcttctttttctcttgccattaaaaaaaatttcccagttggaaacagaaatgagacagagcaaaaacaaaacaaaacaaaaaacaaaacaaaaaaaccaaccaaaaaacaacccctccccacaaaagaaacccaaacaaaataaaacaaaacagagccctacaattccactcttaacactctcttcctttctggcactggtaaaccccctaaccccacaaagaggagattccaaccttcgggggctcaccaactgccctacctcagaatgggcagttccttttaccctatgaaacaccacccccgttcgctggggccttgctcaggcataaatggagagaacccccaaaccctctcctcctagttgggcatctgcctgtgggaggagggaaaggtcttagggaggctgggggggtgggtggggagggtggtttaacttttaaatcccctagtcttgggggagggccagggacgcgggtcttggcagaagggtgatggacaagttgaggtcatgggcaggtcttccaagctcggcacctacaggccaagagcagggtgacctccgtggtccagcactgcagacccagtcctggcagcacctgcctccctattgacggtacaagggaccctccacggcctgaggaactgagattgtgagctgccagccactgaccccaccatttcccaggcttgcaaaggagagcgctggggcccaggcccaggcccagcccacgtagaccacagggcagtgacccgggcaggggcactctgggggtttgcccagcgcttccccctgggagatcctgccgccctgctctcctgctcagctgcagtgctgggtcaacaagctcctgcaccgtccccaccctgccccaacactcacgaagccgtgcttgtcagagatgttgttggtcagcttcagcttgtggaaggccacaggcttagccatccactgctcccccgtggctgggctgtctgggtggatgtacatgcgtttgggcatctcagggtcggccttgcccgccaccatccagcgcgagttgtggaacttatagcggcaatcgtcagcggctacaatgtccatcagcaggatatacttggccttcttgtccaggccgctgactcgcaccttgaagggggggaacatccgcctgggagggagggaagggaggagatcccattggaaccggctgttctaggttccaggaccccactcctcctttatttatccctcctcgttgcgcacaccgctgccgcctggctgtttcccctgtggtcggctgctctgccctctcatcactgcccggacgaccccacctgtggttgttgctcccaggagatcccatttctgcctgtcagaccctctcctaaacagcctcctttaggccttgtgctcagatctggggaccctctttctccctgatctgagatgaaagctgatgcccaggagagaagtctaggccctctagaaatattctcgcttctccttaatctccccgaaattcgttcaggggaaatacccacttgggacggaagctcccagaaataaatctggagggtgtttgtattgggaactgggctacagagcctgataagacatcctggccgtgcagttcgggggaagagggtgaacccgaggcctggattctcggtggctgagtcgaagggtggaggggccggggctgtggctttcttcaggctttaaggcctggggcggcggatgcgtccagggctcggatgcccgcggtggagaaagggctcccagcccggtgaggcggagggctcggctgacccggggctcgctgccaggaaccgagcaaccagcgtggggttagctgggcccaggtcccactaggggcttcggggtcggagcagagtctgagagaggctgaatttcccccgagctcggagacggacccggacgcagaagagcgagagcgcggggcggaggagaccgccagggccaagccgcggggcctcctctgcgctgggactcagaacggttggggctattctttagcagtatgttttcgttttatttcattcggaggattttagcgtttttgttttaaaaaaaaatcgctccggtgccaaacgagaaaagtcaacttggttgtccgtgggagcgaagcgtggcgtcagggccagaacctggagccgggagccgggagccgggagtccccagctctgctctgatccgtgcagtcccgtgccccagcccgcccgcccgcccgcgcgccttccagccggccggcagccctacctcccggacttggtgatgaccatctccgtgcctagcttgtggaactggtcccacagctccttggcctccagcgtcaccttggggtcgtcctccacctcgtcctcgggctccaggctcttgagggagcgcagatgcgcggcgggcgggtgcgggcccagtgccgagacgtgcagccccgcctcggccgctgctgccgccgccgccgccgcggccgccgcccccgccaggcccgggtcgggcagcggcttggccagcgcgccgggcggcagcgcgagtgccgggaagaaggagggctgcgccgccgccagaaaggcggacatggggaagtcggcgggccgtggcgcgtggaacgggtggtaagccatggcgctggccgccagcgccggctctctcatcgggacatccggcccaggcgcccgggggccggggccggggccgggggcgcgcggctcggacccccggcccgggcggcggcgcgcgcggtggacggacgacccgggtggcgggcgcagcagctgctcctcggggcttcccgtccggcgcaccgcaaggggcacccggctctgtgcgcgggggcggcgggggctctgcgcggggccgggctgggccgggctgagctggcccgctccggcgccggggaccacgcgcgactggttagatcttgtcgtgatctctggaaaactgtgactatctcacatgtcctgcccagctcggatcccctgcgctaacgagccaggccccccttgattgctgattttacgctttttggaccaattgtgggtctccgggggcggggttttgacagctcaggccaagctccggccgggagggggggcctgggagaaggtgtcggaagcctcagcagtaagaaaacatgtcaacagaataaaatattaaccaatgacgggccgccgggccccgagacccctcctcctgccccggcccccaccgcccgcccgcgcctgcggctgcctgcgccggactggagagcgcggagggccgacctgacccgccgaaagggcctgaggcgaggggagcccgggtcccggggccttggggaaggacccgcagccgcacgccggccccaagtgcaaagcattgacacgaccccgagcggagagggggcgccctccttctcccgcgcccagaggcccggccgctctggcccgagccccagcctggcctccgacccagctccgggtcgtggcgccgcctgggggtccctgcgccccggaaagagacagcaggcactggaaagcgaggccggtgggcgggcgagtcgggaggctcgggcggccgaggtccgggagcggatcccaggtggcgggagctggtgagtggagccatggccgagccctgctggggccggcgcgggcgggagcgggacgcggccttgcgctggggaaacgcggggaccccctacccgcgcccgccttcaccggaagactcggaaggaacctggagttctccgcaggcccgggccccgccctgagctttccagcggccgggaggagcggatcctcggggccaggaaggtgagcgcacctttcgctgagcacagggcggcaccgcgcgggcggaccccggattctccacccgcgacccaacgaattttcgccctatccggtaccggagacgaaagtctccttcttccgaaataccggcttcctctcttcgccctgccaaccacttttttagtttcttctcatctctcggaagcgcacgtctcctaagttaaggagtgctgagtaacgcgtgagggagttggggtgtctgcgagcacctgtgattgaagccccctcttctgtgatcagtcttcgttttctgtcttccggcagcctcagtttcccccccatgaagtgatggtgtgtgtgtgtgtgtgtgtgtgtgtgtgtgtgtgtgtgtgtgtgtcgggccccgtgtggtgccctctgtgcgcagcgagagctataactcaaggtgtgcacggggagagtgaagcgaccacgcacctgcttccaatcgggctcgggcgcgaacactcaggctgattcctgaaggtcgttttctgaaggaaaagacagagcatgcactagccacgggtgacattcccacccgtacaaccgcgtggtgggcgcgtacatccaacattgacccatgcaggcgcccgcccactgcgcacaccggtcgcagggcacttcgttgttgaacgttgggagcagcgtttgaaggccggatctctcctggcagtgcggattcgggaccggcggaagcagtatggcctctgcgaccgttatccctacttttcggggccgaccccagggccctcacaactcctcatcaccgcatatgtgagcgccgcccccacagggttttctccacgacctcgttcttggctaggtcgcacctctcttagtacctcctctctggccagaacgaatctttgactccgagctgcgcagtctacgcagacggggcaggatccactgcagttttccacaggcaaatacctgctggctccaccttaggcgagatgtggcctctcggggagggacccgttgtggacacgtttgcgcagccggtgaggtgaccagataataaccagggcagctttccttagccgggaacccaggtaccggcctaggaatccgtgaatacattcgcaaagtcgcgcgcgcgcgcgcgcgcgtgtgtgtgtgtgtgtgtgtgtgtgtgtgtgtagacacatacttttgtccttgtaagagtatgtgtacatctaaatgtgtgcgttttagacattagtccatttcattagtccatccatagctggtccaggggtccgaggcctgaagagtttgaaacactcaggcctgggttatttgaccgagaaacctggcggcgacagtgcagcggctgcatctggggacggcgaccccacctacagtggcaccgaccttccctctggctttccggggctctgtccgggccaggatcccaccactcgccccgccccgcggtcccgcgatcaccctgaggtcctgctgcagccgctctgaagagtctgtagcgacccccagccaaactctccagctaggaatgcccgaggctcaccgaaagctggcgctggggaggcctgggaggccctggagcggcgccgtgaggcctccgctgggcccctcccccacctaggccggccccctcccccttcccaggaaccccctcccctggcggagccccgggggccgagtgtgcgtgttcctttaagaggccccggggggcgcctcgcgggccgcccggggctggagggggagggcgcgggcgggggcggctggcgccaggcggccgaggctccacaacaaagctccggcccctgtcacttcgcatcggccaggtcccgcagacaggcgggggacgcgcgctcggccgcccctccctctcgcaggcggtctccggccagggcgtcgggcgggcttgggctggtggcgcgcggtctgtgcgccccgcgcttcccgcaacagtgaaatggggcgggagcggggacggcctgggccgggtggggccgcggtcctgagcctggcgtggctgcccttccgtcctccggccccgtcacctctcgcagggttaaggggcactgctgggaccttccccgggttgagcctccaggtggcagggggtccccgccgcttcctcctctgtgtgcagggccggggttgcgtgaccccgcgggcagtgggcagcaggaagctcgggctgtgcggccgcgtggcagagcggacgacggacttgcgtccgagtgacggggcgcgggctgcagactggcttaagccctcggtggcagacgaatgtgcccaggctaagctcaggggacgtgtgtggccccgtgctatgggcccgctgtgagggtgccgccaggccgtcgatcactgcctggacgtgaggagtgtggtggtgaaggacactccctggacagagtcgcttcccatcacggcttccccgccggaccgcacctcccggagccctggcgccagccagcccggtttagcggccggaccgggctcccccgcggtcccaggtctggttggggtgggggccgcggcctcggtgaccccagcccgcagcggcccggcccgtcccgtccacttaaacaaattgccgctgacaggcgcgcagtctctctggagccgccgccctcccgtcgcctccctcccgtcccaattatcccgcgcagggtggggccaactggctgggatggggcgggggacgcggggagagcgggcggctcgactccctcctggtcgcggggtggcccggggaagcgtctccgcagccacggcctgtgtggccccgtccctggtcttcccgggggatgcgagggcaaggcccagcctggcagctgtgggccctggaagggcgtcgttctgcacctaagggcgagatcacgcggccgagaaccaaggccgcatcccggatggacttcgggtgactttcccggagttctggggaatcccctaacccggggagctgcagacgactcactggccccgggccgcggttccgcgggtggccgctgtacgcttgagacacctggtccgcagaagtcaggtgcacgtctgtgcaccgtcgtgcgttggatgtgcatggaggcgagatcgtggttatggatgtctgggatcacgggagcgtgaacggggcgatcgactgagtgacttgagagacggggtagagcgcaggaaggacccctaggacgggcccacctgcgacgggcggcggtgggggagtggggggcttgccggcgcgttcacaggctctgggttcgcgttcggaaacgctttcgcagggagcgggtcgggattccccggagcagcacggtgacggcgtgccacaatccgggctccagctgtgccgcctccgc

SEQ ID NO: 5544 - DNA, 2392 bp, Homo sapiens
cgaggcgcacttgccccgagtgtcaggtctggggacgcggttccggagaggggagaggggcccgggaatgcggcgggaggggcctcgaggggcagcgggccgggccgggccggggcggaggtggcgggccccggcggggcgggccctcgcgggcggcggtgagagctcccgcacagtcggctgcgagctctgggagcaggaggcgcggtgcgcagcccagcccgggacggagccgggcgccgtgcgagcctcgggagggtcgcggggcgcaggggcgggtcggggccagcggaccaggccgcgccacccgcccccgcccccgccccgccgcgcccgggctccggcgcccgcggagctgagactgagcgcgccagccctccggggccgaggctctgggacagacaccgcgagggaggcggccggcgcgggctctcgtcgcgggcgcagcgccccttcccctcggtaagtggcgagcggcgggcgaggggcaccaacttcgccgccaacttggggctgggttcccgcggcgcgcgagcaaggacggcggagacagaggcgggacacccggggggttggacccacgcaggactctcggggctcaaggagggggcggctggaggacccggaccctcaagaacctggccttgggttttgacccgggcggccggagagaaggcgaagaagaggccgagcagacaggcgcgcggcggacgcgagagaaggacgcgggcgaagcgtccaagacgttcgtccccagggtcgccgagccctcctcctccttcgcttggcgcggcagcaccgcgggaccaggggagtctgggctgccgcggacccaaactgttgctgctggaagccgccggggcggagagcggggaacagggccgggagtgggggccggggctgggatccaccagagcgaggggttggaaaggagtcgagaaggtgaaagggggctgtgcggctccccagcccagtgccccagtttccctaggtctgctgggcacctgctgcgcactcgcctcggcgcccagaccccttcccccgccgcgagtcccgcttcttccccttccagctctgccccatctcctttgccccagcctagctctctccttcctgcgacctgggagaatcggagtgggcttccagagtagtggcatcttgcagatgctggcccgtgcccggctcccgggcttccagagcgcaaagggaagggtaggcagagagggcactgggcgagcaagacctggcgctgggccctggctgcgcaccagccgcctgcgccggtctctgggggcttcgcccaggatccccgacggcggggaggggaagccccgagtctcctgtttcctgcctacgcgggcagggcggggacacgcggagcaaaggcacccggcaacctgaacccccaggtgcgtcccgcgaccctgcaaggagctgctgggtgagcaagacgggaattcccgccaggccctgatgcccaccccattcgtccactcggtttcccagccctggtcgtccaaggggacttctggctcggtcccccagccctcggatggtggcgttatcttagttcagtccctgaccccgggccacaggaaaatcgaggaaagacacttatttggggagggtaccattccgctggctgtatttcagagcccgtccaggtcttggcggtgctagtgactttgagcctgtttctaaactcccgaagaataagagcgtgccaggggcaggtaggcaggtccgggacacctgggttcgcccagggcccccgggcgggcctgggatggtactggggccgcctgccaggctggcttggtccccccactgcgggactcggggtcacgacccagcttgggggagtgggggtgggggccccggagccgcggacgccggcggggggcagcgtggggcggggggcgccgggtgcgtggtgctcagcttggccgccaggaggcgtggcgcgggtccccgcccggagccgccgccgccgccgccgccgccgcatcgcgagtgtccttgagccgcgggtgacggtggctctcgctgctcgcgccccctcctcccgcggggggagcctgatgccacgttccctatgaattatttatcgccggcctaaaaataccccgaacttcacagcccgagtgtaagagattgctgcggaggggagggggcggggcgtcccggtggccagggggagtccgggcggggtccgcggagacgggggccgtagccttggaggagcaagaactccgtgcccccagcagtggggcaagctagaacggcggtcctctcccctggcgcctgggttcgggttttggctgggcaaaagggagggagggaaacccgacggcaaaggaggggcggctcaccggaagggcagggggtccgg

SEQ ID NO: 5545 - DNA, 564 bp, Homo sapiens
cgcctccaaaccgcccatctgcgacggccccgcgagcgtgcgcagcccagcccctcccggacgtcctcgcccccgcccgggcacatcgtgctccgcaccgaggcagagaggggcacgcggatcccagcccctgcgagcccctctgcccgccgccacttcacaccccgcattgcctcagctgccgttccagaagatgcatcgtctggcgcgcaaagcggtgcacggtccccagcccgcgcgcagcagcctggaggggcgccagagtccccgtcccacttcctggcggcactgcccccgggcagctccctcctcccctctctccctccatgcccccaccccatcttgggacgcttccaggaccgaagaggcaggagggggatcgcgaggggaaggcgcggagctggggaaggaggagcagcgccgggcgcagcagctcagggcggtccgggaggctgcgcggcgctcgcggacccacgccccaggacagaggacgcagctccgagcatcgcacgtggcttccagattcctcccacccctaccctggcgaccacgagagggggtcgg

SEQ ID NO: 5546 - DNA, 3277 bp, Homo sapiens
cgcggcatggtggccctcgcgtgtgtgtgcagcgcctgcaggtgtcccgcccagcgcctcctgcacaacagttgcaggctggacccgagggtctcctctcctggggccccacagtgcccagaggtcccgctagccccagacaccgccccaggctcccctccctttctgacgccgtccactcccttcctctgcggaagggggacacgctcctctgtgccgaggtgccaggccgctgagatctgctgccctggaggaaaagccaggcagggtccctggccttgggcggctaggaaggctccacggctgctggggatagagacgcggggccaggctaagggttcccgccccgtctaaacagcctgccctgggcagggcagggctcctctcccgcgcccgcgcgctctcggctgggcacggtccggctccaggcctgacgggcgcggcctccccactggacgcgtgcgggagggcggcgaggccaaagcgctggggccaggagggcacccgcctagcggctccctacgggagttggggcagaagacgccgcgaccccgcgcgggtaatttctcccgaggcgcgttccagcccgtggcgctgccggcgcagaccccgcgtggggaccggcgaggctaacccctcctgcggcccggggtcggcagagcacgcaaggggccgcgggccgcgtgggtttgggcgcgccgtggtgggcaagcggggccagcggagcgggaacccgcacaccctccgagcggagccgaggacaggcccgtgcgggccgcggggtccctctggcgccaggaagcggcggccgaaggagacaacgagaacgcagccccggctcagggaggcttaaaagctgagatgctgaacgcagacggcgggcgctcgggggctggggggcgggtagaggccgccatttctcaaaaaggtctccatcgagccggcctctgctcccgcccgaggggcggacgcccgatcccggcacccgggactgcccgtgggtccctgctggctggggacccccagcccccggctgcgcgcagggaaaggctgcagaacgcagagaccagagaagccgggggcggcggggaggggtcggggggccacggctgtagcccggccccgcagtctcggagcctcagtttccttctctgtaccacgggagcgtggacggagggatttccgaggctttgaccgctctgatagccccggggcggggcggggcggggcggctgcgccagccctggtcctgagcccccagcccggcgccggaacccggaccgcgatctcgggagccgagccccgcggtccagatgaaggcgcgagtgcgcgggtgccgggtggggtgtctgagcgagagcggagcttctcaggtggacgcccccagccacctccgggacccttcctgctggcctttgggcctgagaagtgggcgcggctggacagacgggaaacagccccccacgcacaggtggacacccggggataccgggcgcgcgcggcgcctggcaaggggaagctgctggagacgcgggcggctgctcccgcggggcccccttccgaagcgccgctgcgaacgtccagccccggcgacgccgcctgcccgcgatcgggccggcgccgcggacaggaaaggctcgatcagctaggtctgcctccgagaagtccccagcgccccgcccgcacggggtggggactgacagtcccccggggacggggccgggtccacagagcccgggagctgggggaggggaggcgccgggggccccgacccgtgggaagtccctgtacccaggctgcccggcggcttctcaatagcacacggacatctaagaaacgcggggcggcccggtgacccccgctctggacttagtggcgccgcgaggccccactccgagccgttgaccaccgggcactcgggtgttgacgacctgggtccttgggcacccagcccggctccaaacgaccccggcccaagggtgttcagtgcagccaggagggccgaaccgaattctatctcccggacgcggtggtttcccgcccgcctggagccccgtcggaggttcggggacaccacgcaggtggtccatcctcgagtccggggccggagcccgacttccttccccctgagctctcggagccttcggggcagcagcgccggcccaggcgggggcgggggaggagggggccgcggcagctcccagaagggcgggggggacgcgagcggaggcagccccggtggcgcgctcgtgagacccccgccgcgccgcgggcccgggccgcggacaattaaagcgggattcctcccccgctgacgtcggcggctcgaggcccctcccgcggcggcataaaaggcgcgggctccgcagcgcaggcggcagtgggggcctgatagcgcggcggtgtggaccgcgcggccgaagagcgcggcgcccagagcgcgggccgctcgcggagccacagcccgagccgggtcccagccggagccgagccccagccgagccgagccgggcccggagcgcccggtgcccgcagccatgccggccggccgcgccgcgcgcacctgtgcgctgctcgccctctgcctcctgggcgccggggcccaggatttcgggccgacgcgcttcatctgcacctcggtgcccgtggacgccgacatgtgcgccgcgtccgtggccgccggcggcgccgaggagctccggagcagcgtgctgcagctccgcgagacggtgctgcagcagaaggagaccatcctgagccagaaggagaccatccgcgagctgaccgccaagctgggccgctgcgagagccagagcacgctggaccccggagccggcgaggcccgggcgggcggcggccgcaagcagcccggctcgggcaagaacaccatgggcgacctgtcccggacaccggccgccgagacgctcagccaactcgggcaaactttgcaatcgctcaaaacccgcctggagaacctcgaggtccgcgcgcgccctcggctccggttccccctccggctcgctcgcccctctgccctcccccaccccgttccctacccggccaggcatcccccgccctcgcctcagccgcgcgggtgcccggccggtgcctccccgcgcctgcgaggccccgcggcggccactcgccccagctccctgccaggccgcccccgcagtcgcccagaggggaccgcgccgcgggccttccagcacggtccccgcgcctcgcctaacggtgtggtttcccccgcccttgcaccccgcagcagtacagccgc

SEQ ID NO: 5547 - DNA, 5692 bp, Homo sapiens
cggacgccaatcccacgaaccctgcccgggctgggggcctgggacgctttccctggactccaggatccgtttgtacggagtcacagaacacagcgttatcgctcgtccgagcccaggtaccctccttccttcccggggcctgcgtcgcctgcacgtctctccgcagatcctcgcggaaacgtgcacagtagggctctgaacagaacccaggctgctctgagccgaaccctctccggcccggggctgaccgtgtccatccaagccgccgtcccgctccccgcacccccgacgcggggccacctcctcccacctccctccccactcaggcgcttctcccgacagcggagggagagtcaaaaacccacaacccggcggcgggatcctgccggctctagctgggcgacctgggcgcacccgccggcgacgcagtctcgggtctcagcgcatagaacccggccgcccgcagcccctcccgccagccacgccccctgggccttccattggccaagccgcccgcgcctccgcgtgattccattggcctgcgccgggggctcagacaaagggagcagccgcggagggcggtgattgggcggggttgggggcgggtcgggcgggcgcgcgggtcgggcgggagccgcgcgctggagaggcggggagcacggcgctgggggaggggcgcggtgtttcgggcccgggaccgggaggcgcgggtgtgcggcgaggctcgggtgccttccctcgtgggggcggggcggcgggggcggggcggttccacgtgggtggggctgggcgccccggagggcggcggccgcggggcgcggggcgctgggatcccgcccgctcctccgccctgcacccctcccgccccggggctcctgcccggacggcggccgccgccgcctcgtcttccccgagggctccgcgtccgtctccgcagctcggccgggaacctgggaactcggacgcagaaggacgcgcccgagccaggacccgccgcggggtccctctggtgggccgtggccggggagaggacgcgggccctggcggtcgaagacggacgcagcgcccggaaaggcgagccaggtctccggctcctggcgcttcctgtgagctggctcggcggggtgcgtcgccggggagggagggactggccgtggggcgagcagccgggcggggagtggcttctgggggccttcgccagcggagggcccgcgaggccgccctcggagcgccgccaggtacgtgcgttttccttgtttcccgcgctcccagagcgcactctcggtagggaacgaataaaatcccggctggtgtgtaagagcctttcgctgcaaacgtgtctttctgcgggattcggggagccgccgaacgcggggtagaccccggcccaaagtgttcctgcagcttccaccagggacccttctccaccctcaccttgggctcggagcgggtgccagtttggaaatgcttgtctcttctgcagctccgattgaattcgcccaggaggaggtgcgccctgcctcggcctcagagctgggaggaccgggctttgttccccgaagctctcccaccccgtcctcctggaaaatgcggattttttctagtagggatgctcagttttgagggggttgttttcggaggaagcttgggttgggaaagcccgatattggccccaatctggcgggcagcttcccttgtcttggagcagcccctcctagcccccggagccccggacttacacggttaggagacgcccatgggctttgggggtattctgcggggtccgaggaggccgggtggcctgggcggggtccgaggaggccgggtggcctgagcggggtccgaggaggccgggtggcctgagcggggtccgaggaggccgggtggcctgagcgggctccttcccctcccccatgtgcacgtcaaacaaaagaatcttcgaacagttttggggacagaactcttcggaatgtgagcctgtcctccccgccccccttcctaggaaggacaggggtctttcaacaaaggcaaggctgcggttggagcgggctgaagggaaggagcgctgttattttggggtacttgatgaaagagaaactcactttctctttctcctcccaaaattagaggcagctgagtcagagctctccctactttcttacctgattaatggggtttcacacgatgtttgcatttggggtgactgggtttgaagactttcagaagtgggaaaggatcctgcttgtgtgggagattggaaagctggcctccacccggtgggggatagaacccctatggagtgaaatggattccaggccattttgcggaagattggaaatttaaggatttgacgggggggcggtgattttgtgtccttttctctcccccctcccccctccccagtttagaacaaagggcggaggcgaaggaggcaagatgggtggtgggctcggaagccggagtcgaaagaagaatgttataaaagtccctcacttcccagtccccgcgcactcccaaatagctcatcagagtttgggtggggacaaagtgaatgaccgcctagagtcgggtttggtacccatggcccggttttcggcgcgggcgtccggagcccgggggaagctcctccagctcgtcccaagtcgcggttggccagggcgagagaggtcggggcacagcgcgcggtttctcctgccgccttcgaggaccgagactcggggttcgcggctccctgactgcgcaagtctcctcgcccctcctgctcccccctcccccccgccgaaagacgctcggagcgcacacccgcctgcaccaaagccagggatctcatttctctcaaaataaaacaacaagccataaaggctcctgattccagtggaaaaggcgccgcagatttatggtccctccaaatccccacactctaattatccctgtttttagtttacttatgggtggtgaccaataaaatgattttccattttgaatttttttttcaacataaaaaatgcaagcttcgcttccctcttacccgcttggatggatcttttccgtgcgggaagcaaagaaatcccgtttccctcggccttatcggcccagggctgagctgctgcctccggttgagcgaacccggcctgccgcagcaccccccaagcacccccgccccgcacacccttaattgcaatttaagggagaatattctttccgtcctctcttcgcccaagggcatttgcagggacccctccctagaagtcctgtcgtgggcctagcggctagaagggccaccccgcagagcgggtctccgacagccccagcccggtcacctttcaaactgcgccctcctgggccccgcattgggcgcgagcctggggcgcccaagggcccccactgaggaggaaggttgccggaccgagccctcgccaccgcttggcgcccccatcccccatcctcctccctttgttcgcctttccggacgccgacttggagatggcaggaaaaaaaaaataatcagatggaaatcaaagattagcctgggtgcgcgggcggcctccgccgggccgggccatgctcggcccgcgcctcataaatcttcctcgcgacgtgacaacagccgcggcctcgtttccctgggaactcaggaacgcatcgatcctcctcgccgtccgcgcaagtcccctcttcgggagcgagaacggagagtccctggtgaccctgacttctggccagcgcaggacgccccaggccccagccagggtatcatgcacaggagtggaggaaggtggaagggaaggggcccaaccctcacccaagaaagcgcagcaaatacccacaccccgcaggttaaaccaaacacattattaggggccgcatcttctctcctccgcgccgcctgagaagggggcggaaggaaggacggagaagggtgaggggcggattaacccctccctggcgactcctttgtctggcccggacattgctgagccgagtggggcgcccaggagccagcgaggggctcccgaggcggccccggctcggcccaggtgtgcgggccgcggtggggcgcaggttcgcagcggagccacgagatccccgcgcctccggctgacgtccgggcgcccagggtctgcggccccacgtgcgatccatccgggagctgcgcctcagacgcctcgtggagcgggggagaacctgaaggaagtcgtggcgcgtttagatattttaaaaactcgaattaattgggaaaataggaagggcgcttccaaacgcggagaagacatcccggggtggggaaggatgtcttttaaaaattatatccccttgttgtggcggttgtttttgacctttcctactattaaaagaaatgttgccacgtttaatttttgttgccatgagatatggagggggtagcccagcattttgaagtaatttgataagccttcaagtagtaaatccgaaagggaggccggcggcccaggtatagtttctttgtaacctgaatttacaatgaaagcattctcctttatggatataatagattagatttcacaacttaattcaccggaatggctccgtttaagggagctccggctgattttattacgccaagccaaattggatgtttgtggtcttaacgaaaagcgatcgtgacataaaatatataatttttaaagtaaaaaaccagcgggttggatcctgtcccctcccctatccttgctccttactcccaatcccccagtgtgggaaatacggataattatttgtgtgtgttggtttctaccggggagacaggcgctctgggctccttccccggcgggccagaggcctcgccggccagtgcgcacgcggcgccggttcccgaccaaggctccggcccgctctgctggctcgtttgaaacgtcgacattctcagcgcacgatccggggtctcgggggcacccatggggcccgaagcctctgcctgccggcggcgaccggacagctcccccgggcgcgcagggtagaggaagcgccctcgaaagcccccgcacgcattcacgagccggccctgcgcgggcacagcggcagccgcggcgggacacccggcagggtcttcggcgctactttgtgccaaaaactgcgctcccggagacccgggcaccgccggcgtcggcagctagagcgggacccagctcccaccgcgtcctccactggagcccctttcggcccctcggcgagtgcggcccgtggggagtgggcgtcggcgcgaggaagttccccggcccgggcgaccccggcttctgagcggcccctccccacgtcgccgcccgccaggccgacggaggaccggggcggggacgggggtctcagcggcccattctgctgtcacttctgacctattctccagcaacggcgcgtccccccctcggctttttcgcgaggtttgttgaagacggatttagcccccgcagagctggggaaggacggatggacggaaggcccagcgcggcccaccccttcccctcgtcgtctcccggctggcaggagccgcagcgacagcttcggggagcggggcctgccccaagacccccttcgcggcatcgggagccaggcgtggccggaggcaccgcggctgctccacgtggctcccgccggccgccaccccgcgcggggaggacgcgtgcgtgcggtgcgtggccggcgggctgcggggacgcgc

SEQ ID NO: 5548 - DNA, 7937 bp, Homo sapiens
cggcgggtccctagcgcagccctgcgcgcttcccccgaatctacccgcgccgcctggtgacctctagggcttcaggcgtggtagctgcccctaccctgacctccctcgacactcatatcaaagccaccgggaagagggctgccctggaggcctgggcccgctctgccaaggactgatcctctcgggcagggagtcagaggggaccgcccgagaggatccgtccctgcgaggcccagcacggcgccccacgctctcctcttggagcaaatccgcctcgctctcctcttggagcaaatccgccgcactctcgcctgcaccgaaatcctgagcgccgccccgcgccacccccagcccgcgcccgcgctgccctcctccccgggccgcaggctgagaggctgggccgcactctggccacgctttgtccggctttagcgggataccagaggcactcgttaaggcaaatgcatccctgcaaacccattctcgccctgacactttaaggctttatatagaaacaggatttgctcgtcttacaccagcagtccctattaacgctcgcccggcgcacacaccactctaatccgcgaggccgcggcgtaccctggtcccctccccccgccacaacagccgttttgtttccgcagaaagcgcctcgttgtcccagccccggaacgtcttagggaggtgaatgcagaatgcagaaaagaggtttccgtggaatttagatctgcaggagggggcgggggagggtggcgaggcgcggaaaggctttaatttcagccggctccggggctgcccctccgagacccccgggggagggtggccagggaagggcctctctaagccgcggcgacgcagcttggggggctggcgggacgcgcggccccgctcagcgcccaggcagccaccgcggccggggccgggaaatgaaaccaaagcttctctgctcccgggagcggaggggtgggcgccctgttccgctctcgaacgctcccgtcccgcgcccgccccggccgagcactgacctgtgtgcgaagccatgggcaacggcgacgggaagtactttcccggctggaagtgtgcggggggctgcgcggcgggcccagccggggcgagacgcgcggcggcagcggcgctgcggtggcccaggctcccgcgctccgacagcagatgcggcggcggcgcaaagtcgcggccatccatgccgggccccggccccggtccgccgccgcttcctcggagcagcgcggccggggcccgggggcggctcggcgcgcgggcggcgcagaggcggcggcgtccggggtcacaggcggtggtggcggcggggccggtcagcacgcgggaggactgggcttctcggcgggcggccgcgcaccgagccagcggccgctgtgcgggtccatggtctgtggaggcaaaagcagaggagacacgggtgactggggggctcggctcgcccgggggtccccgccccgcccgctcacccactccccccaccccccacccccgccggcccgagcgagcggcggccaggccgggtggcggggccggggcgctcggtgtctccccgccgcacgcgcgcgcagcccagcacccggggccccgcgcgcgcacgcaccgtcccggccacgcttggcccggggcagccgggggaacccagccgcactgctcgccgcctcccgttctcgtccccgcgggtccctgcagctagggcgccgcggcgaagaggctgctggctctgctgggtgataaaaacccaaatctgcgaagccatcacgcacactcgcacacacacacacacacacacacactcacacgcacaccctctcccctcccccgctgcccaaaggtgtctcggaggaaaaggcctggggtccacactagctctccccctctccccacctcatgccgaggtccagcttttactgcattccgcttaaccgaataaccatgctaattaagcgagtaattttattgattgtaactcaagagttttttttttttttaataaccttccttttctccccactcccatccccctcatgcatctttcggcccattcttctgaatccaccgtggtcccccctccccagccccagcgggaccagctcctgtccccagcatcgcgctaggaccccaggccggctcctcagagccccggaggcccgcaaccgccaccggcatcacctgggccgccacgccgcagtgcccggcctgctgtcccggagccgggagcttcctgttgaggctgtaacaatcaccccgccccccaatcaaattcgcccaggatcttcctctgcggattgggggcttgggggtgtgtgtggggggggtgctttcagagtcagaatgctctctctcaacggcccaaatcggccctgggatttcttccttcagcgcctgccggggaccgcgagcagaggccggtctccgctccgggcagtaccgggcggcctgggtacgcggggtctgcggcgcccagctcggccctctagccggggaaggtgggcccggcccagcacaaccttctgccagcagaccctgcccggacctcggccacctaaaataaccctcacctccattttcttccacccccacccaacgcggagcatccactcaggcgaaattggggacaattttagactctgggtgcggagggtcggagccagtgatagaagctgcgtgcaccaccgtgctcccaggcgtccctccgaaggcgctccctggacgcacttcacatattactcctcatcttctaaatacgtattgttttaatgtttatcacctccaacaaaagggagatggataggcttgatattcctaattaggaactttgcggaaaaccttgtgtttttgtagccattccaccatgacaacaaagcgattaagatgttttccatctactgaatacctttttaaattgcgatattttatggtccgggttctaaaacgtcttatttgcagactattttgtgtttgatttaatctataaccgaaaacataatgtattaagtgaatacatatttgctcagctgataagcttttttaatatttattcggagagcttttgcattgtaaataaatgggtctacacaaagagttctctttgtctggcaactacatacaaaggcgtttggggctcccttccctctggggatcgccagctctctccccgggtctaacaaatagctcggctcccaagccccgatcccggcctgcaaagcgagcgcccggccgccagggcccggagagtgctctggcgagggggctgcgagcgcaggggtcaggggaggggctgcccgggctggactagggacgtgggggcccccagccccggccggcgcctcccgagccccggagggcgccgggcgggacaaagggaaagaaggaaagggagggaggtcagaaacctgcagcttcaaaggcgccgaaggccggagaggggccgggggctgcgcacgcgggggtgccaggcttcctggcggcctccagggagtcgtgtgtgctgtgcttttgttttgtggttgtttttttttttttttttctctccaataagaaatttcaaagttgagaaagcgcgagctgccggcgattctcgggacgcgggctcggctacgaagcaacaattttaatctcccaccccctgcgggcggatcgcaggcccgattgttcctttctcaccagcctgctcgactttttaagcaaacaggaggtggattactgtcgcctgcctgcgccgccacggctctgaccggattggagagagcttttctttgtgttctctcctcccggggagaggccgcgccgcgcctccgcgtctgcccgcgccgggcttcgggggcctggggagcctgaggcggccaggaagtggggcgaggaagggcggccacacggcccgagctgggagtcccacagtcccgcagcggcgacgccgccacccgccgagtgccgaggcccggggcccactcccagcccagctccaggagaggccgcgccggaggaccgcgaggacggcgccgcagcgccaggtcgggctgaggtaagggaggaaatggagcgaaaagtggcggcgggcagagggccccgggcgggcggagaatcgctgacgagggcatttcggaaggaactgaacctaggagcacagggctccctcccgggaaggcagggcgtgaccctggagccgccggtccctcttgccgcggccccaggcgtggctggcgcgctccaggatctggagcttctacaagtttgctttgtttcctgcttttgcatctaaaaacccgctctctcctcgcccgcctgccggagaccaggactctggcccgtctgcctccctccggcgtcgtctccgggagcgcgggcgcggtggggcctgcaggccgggctgggaccaggcgcgccttggggcgcgagtggctcggccgtcgccgcagaacccgctccctgcgaaacagccgcacccgctccctgggagagtcatgagaactggggtcgcgcctgacccccgcgcccgaagaaaaccagcccgcggaccccgccacacgggccgtgacccgagccccgcgcgccgtcccgaacgcgcgcggtgaaaacgccccgctgcgccggccttgctcggtccccctcctccacccccacttctccggaaaaaaaaaattctgaattgggaacgaagacccgaaaaactcgccatgaccattcccctccccggcccctagcttcggcccggaaggcccctcagggcagcggccgtgggtaccacgacccggccagttcccctcgccgcggaccgaccgggcagggccaacccaggactgttccggggaggggagcagggtaggggagcgaatgttggggttcgttcgtgggtcacccagaactgggcgcacgctggcggcgcccggacttcgcctactgtccgcccggtgccacccgcgcggctcgcgccagacgcagcctggcggtccctgtcctgtcttcgagtatttgtttttaatgctgggtgtcgatcgagacaacaagcgctcagagcaaagcaaggatgcattacgggggtaattttaaaccgatcgataagatttttcagagaaaaaaaaatcgctcatagtccatattttttaagaaaaaaaaaagcctcaacattttaacggattttgttaaaagggaagatatatacttcttaacatcacaatcctgaatttcttttgctaaaaaaaatgtaaaaccccaaagccagaataaaaaataaaataataataaaaatacaaaaacaaaaaaaaaatgaaagcaatttcagttacttactggaggctgtttcctggatacaactgaatgcaatacaattaaatcagtaaatgtgactttgttttgtattcctattggtattttcaatgtgctgactgttgcactgtaaatgcaccgcttccacaacaacgactctagcgagcccatccagagcggctctcaaacctgcagcctggcgcggcgagccacgggccctgcatactaataagctcgtgccactcagcccggaacagccagcgcgctgattggccgcgcagccctccacggccgggagctcgtgccactcattcggcgtaaacaggcctcccaataggctggcgccgggccagggaactgccaatcaggaagcagcggggctactaccaagcccgatggcgcctaattcaagcccggcgactgcgcagctcctctgcgcagatcattgctgctgaatgggaatgtggtggcgcagggcgggagagggagctggagcgagcgagtgcgcgtgtcccggcggagggggaggcgtagacacagacacagacacacacacacacatatatgtttaatccagcaggtctaacgtttggcttctgccgcacagaaggccaagggaagaaacaccaccaccccttaaaagtagctgctttttctccctggaatctgtctggcaggtggcaggtaggccagacctccaagcccagaggcctccccaggttgcctggcccatctaccgctctgaagctgctgcctgcccggacccgagctcgcggatgcacgcacgcacgcccgctgcttgggcagcaaaagctttgaatagcccgtccggctctctcctccccatgacctggggatcagaccctgggaagtgagttctgagtctccagccgtctacattactggctctcaattttatctccctctgccacactttgcaacagagcagctactaaaatgaaaatcagggatttattgagaagacaaggattgccctttcttcatctacacctagatttagaaaatattttcagtttggtaatgggggaagcgggtatggtgtggtaaaccatgtatagtatttctcaatgctgctccctgtctgcctatctgctaaatcctcactccaactaaagcaagccactgaacaatttttatcgtaatcagatgcaaaccacttctaaaatattccgcaaacaaatatttctgttagaatttggtttcccacccaaatgctatttattctcagggagtcgaggtgatgtcttagtggcgatggatacatttatttttgctcctctttctccatgtgaatctctgcctccccctctgggggaaaaaaggatatttaaactaggagccaactgacagattcacacgcattcgaaattctccaccgtctcattccggcagggacacgaaagagttaaactcaaagcctgttgtctctctgtttccccgcccccactcccgctcccgcgggaccgctgggattggttggcactccgccagtggactgtccatcaccgagtgtaaacaaggcgctgattggctgttgtccagtccgcactgggcctcctgaaaaaagcaattactggctccgcggtttcaaggcggcccaaggccgcttgatgaaaggagataagctggggaccgtttccaggatccccgcgggccgaccggggcagcccgggagccgaggtgcggcggagagcccgcggatcaaaggaatctggagagaaaggggaagcgggcggccggccccggccggccttcccccccgcaggccacgccgacctggggtggggggctgcgggccgcgggcggggactccgggatttcccgcctgcctgagtcggggcctacgccggcgcccgcttcgggcggctcggcccggaggggagctccggagagcccggggctcgcaggtaagcaccggcgctccgcgggccgggccggggacgcaggacaaggcgcggggcccaccccggctggctcgggagtggcggtcgcgcgggcccggctcccgtctccggcgtctcccggctccggcggccgggaccccccgcggccgagcccctggccaggccccaggccggcgccttcggaagcgacgtctggcgggccgcggggcacgagggggagagccgggaagcgtaaatccccgaagcgcgcggagatccgattagcgcgcggctattcattaggctgggggcgattgaattaggtccctgggcgcggtcgccggctgggggtgtgtggcgccgacccccgggctcttgccgtggcctcgggaggctggagcagcgagcagcggccccagcgagtgtgtcggggaagcgggtgcctccgggtcccggccccgcgggtgcaggcggaggctgcccgcttcccgcgtacaccgaggacggccggcccggctccggagaaatggcgcttgagaaaggaggggaggggaaggttcccggaccctgggcagggacccgtcgccggggacccgcggagccctccggggatggaggaggcgcgagctggaagcggcgcgcgagcccgagcgcggggctaacaccgtggggcccagtctctcctggctcgggtaagtggacgcgccccgaggccccgggtccacgcagggcgcccctcgcagacggcgc

SEQ ID NO: 5549 - DNA, 1408 bp, Homo sapiens
cgcgcgcggcagccccgaggcagcagagcgcggagccgggagcgcggggagcgcgggccggcggcggcgagggaggacgggggcgcagacggccggcgcgcggcgcggctaccatgggcgtgcggtgagcagccgctcgggacgacttcctcggctgcgcggcgctcgcgcggagctccccggccggcggtgcgtccccacggtcaccatgaaaggtagggcggcggcagctccgcggggctctgggcggggggaacgggcttcggggcgcgcgggaggccacggaggtgcctcccgcgcgaaccttcccttgggctgcgggcccggggagtcggggctgccagggcgccgggttcgtgcgcggacactgggggcgcacccggctcccgggtcaggcgcggctggagacctcgaggttggggttttgaagcgcgcaagtattcccctccccatcgcgtctttgcaagtagtttgaagccctaagtcgttgtttacggattcccgtttccaactttttaattgaaaaaacctgccgaggagagtggaggcatcgccatccctcccggtcgcttttccacgccgcagcgctccccacgctcgcccagtcctctctcctcccgcctctagccgtttcccggcccgagcggtccccgcgctggcggccgggtgttttctccgggactggggatgttctccgtgcgccctcgccacatctggcaatgattaggtgcccgaggagttcagctggctcgggaagtgcatttggcatctttctccatcagattcaccgactggaaaatagttgccctcggttccgcgtcccttccacgtgcccgccttggggtgtgcccactggtgttttggggtgacacacctcagctggttagtcgccccctgcgcggtgtcctctgcaggccggtttatggaagtgtcagatgttatcgtactttagaaagaagcacgagaaggactgcagggcagccttctgtttagtggaaacacggagatttgtcagcggaatcctgatttatgtatgagataagtaaccgcagcggaggcatcaaagagtcgttcaggaatgggcccgcgtggtgtttacacaaggcttcgtgtgagagttgctggttctgtgctaggataacacagccctgcgtgggtgcgaaatgccatctgaccgcggtcaccccgcttccagccgccacagacctggcgatgcaatcgctttgacttctagggttgccgtccgagggaggcgcccgggaagccccaaggcgcttggaaagtaacttttggctctggaaagttttttttctgaagggcagctcccgcggaactaaccggagcgatgatatcctaccaattcactccctttccaagggcgttaggtgtccacgtcgggagacctcgg

SEQ ID NO: 5550 - DNA, 208 bp, Homo sapiens
cgccctcggggccgcgattctcctcgggaggtgtctgcgaaggcggctctgccgcggtgggggtggggaggctagggcttcggaccgctggagttggggtcgcagccagttcctggcgagtgtttcctggctgctgccgcaggggcttgctttttcggatttcccctctaatctcgccggacttcttccccttcccccccacgcccgc

SEQ ID NO: 5551 - DNA, 805 bp, Homo sapiens
cgtcgtccgcggagcctgaccctgcgccaggacggaggaggctgtgcccatgtaactgtcctgaagtactgcggtggccccctcccccgcggctgggagggcaggcaggacgaggttggctttcctcgcacggtctctgggcgtgggcccccgccgcagctccgcggagcctcggtgtctcctgcaacagggggcggggggaacagcggcgagcagccctgggctgcggcttcctccccacgcccgagtctcctgcgcaccgccgccgaggacgcgcgcccgagcctagtccccacgccgcggcgcgcccgggctccctgctgatcccaggtaacttttccgcctctcggagtgggggactgcgagggggtctcggctttacgaggtgcggaggaagagcccgaggcctggggcgaggcgcgcgggacagtggggctgacgcgtggcttcggcgccgcgcggtctcccgaatcccgagccccgcgcccggcgcggccggggtccccaaccgccctcccgctcgccgggacccccaccgggccgagcctgcgcgccgcgccccccgcccgctccgcccgccgcggcgcagtagtggctgggccggcgcgcagagcctgagccccggcctccggcctgggggcctccctgggatccctggccgaaggggcgactcggtccccgcgtcccttctccgccaatttgcacaaatcccccgcccggggcgccatgttttaagttgcccctcgggctgggggcgagcgcgggccggcccctcccccggggaggtgcgggggacagggggcga

SEQ ID NO: 5552 - DNA, 2462 bp, Homo sapiens
cgagcgcgcggctgggaggcgggctcagggcggggcagagcgcggggaccgcccgggcaccgggcgcagccaacgagcggacggggagggcgggcccgcgagggctgagcggcgcgggctgtcacaggcgcccgaagcgcgctgcaggtggcaacttggaggtgccgccaccgcagctgcgggaggagcccgggtctggcggccccttccagcctccaggagctctttcccgccgccgagcccgagactggaccccggagaattcgaaggaaagagcccctgcggagggacctgtgagcagccctacctctctctgcccttgcgctactttttttctccaaggaaggttgtgcctgcgggctgcgaacaagctccgggaggggccccaaaggaaggcttcggtgactcaggtgagcgcctttctcttcttggcagccgggcgtaggccgggagcgccgcctagccccgtgggcaggggcgcgggtgcgggccgcctgcccttggctcgaggtcgatgggggagaaagcgaggaaggggcgaggctggcccgaccgggggctgcctggccgggtccgcccggaggcgacagggactctcagacgggcacctggagactagggacgagcagagaggtgctttgagggggacagagggcttgcgcccggtttaagctgaccgggatcgaccgcctgcgcgctgtgttggagctgccgcggaagccgggcgcggcgcctctgcgaaccccagagctagtgcgcggggcccggcgagcgcaccagtcttcggttcctcggagcccaaggccctggaggacgtcatccctctccgctcgggcaactcctcctccgccccctcttgcctccacccctccgcgccggccgtttagcctattccgagactctgtgcttttgccagcgcgcgctagttgctgctgtcactcccctccccgccctcgccggagttggagcgacctggggtctggctccccggtcccggcagcctagttgtgggctggacgcgagtggggctggccagttctttgcgaggagggcaggagtgagcgcgggctctctctctagtgctccctccgaatccgtccccgcccccctgcagctcgaaccgctagcccagagagcggagtctcagaagctagaccttgctcgccctggggaaacgcgggggaggggggggccttccgggaaggtgcgaacctcgcagatgaggccagagcctccgcctccatctcagcgtttcagcccctgctttcctgctttcaagtggacagtggctctgacctccgcattccggcttgtggcgtggggggcgctagcggcagtgtgtgtgtgtgtgtgtgtgtgtgtgtgtgtgtggtgtgtaaggatgagcgagtgcgatcctccgggaggcagaggcgcaggagccagttcccccagcccggcggagccgcagggaccgcctcccctcgccgccagctgcgcgcagctgcaccccggcaactccgcgctgccggctcctctcctccagctccagctcccggtacccccacgaccaacgcggaatcccaggattaaaatcatctggccaaagggtgcgggtgggggatcgaggcgttcccgaggcgaatgaggctgtttttcaaaatccgggaggcgcccctcgcccggcgttgcatcttcccgtggctcggctgtaaggacctgcggtggaggcttggcggaggcgggcccgcgctccagagagagcgtcacgtcacccgagaaggcgacgctgggggctgctgagcctcccaactccctttggcgcgtcctgctcagaagccggggagctcctggccggcggctggcggggaagcgcggcgcgggaggtggggtggcctggctggtgctgcgggagggcgccccgggcgcgtcaggggctgcgtgccgcggctggagggcgcgccgggagctgcggcgggctcggggcacccgagtggcgctggaagttgagccggggtccgcagggctcggtgaccgccctggcgccgccgctgcggattcgggagcagcaaccacgcggcgcgttcggccgccccctcggcccgccggccgcgtctttcgctttccctctgcagaagtgaagccgccgcctgggctcgctcgggctggcgacctttgcgccagaaaagcctgaggtgctggaggcgaaatcctcccgggagcgaagggcggcgtccacaagacaaggaaagggaagacgccgggctctggcgggtagcgcagtagcgggagggcggcgctgagcgccaaggatcccggaggcgaggcgaggccaggcggacccaacccagccaggaggtgctgcccccgcccttggggctctctcacaggcacctggtgttagttacagacccccgcccccgccagtccgcaactccctcgtaattccctctgaagtgcgatggattaagactgggccgcga

SEQ ID NO: 5553 - DNA, 990 bp, Homo sapiens
cgcatactctgtgcggcccgagtggtccggatggcacagcccaggtgtccgggctaaagttggcatctccaaagtccagaacgcaacttgggcgcgccagtacaaactcggccttcggcttttctgaagccagtcaagttcgcacagggcccccagcgcctggaaatctgagaggcgtggaagggtggggagtcccgcgaagtctccagtccctgggtgtcctccggctccgcgggggagcgggcctggagctaaaccggccggccgtaggctggagtagcgggcgccggagcgcgcggtggggatgtccgaaaaggagttagaggctcagtcggagagtccgagaacacgagggatgcctaccttgtaacatggcctcaagtttcttcctgtccacgcggaagcgctcctcgctccactccgggctgtgcagggtcgccccggcgaccaagtcgtcctcggagccgggcactggggagtcggtgctgcgctcgctgttggagccggggtccgactgcgccgccaggtagccgggctctccctgggcggccatggtgggcgcgcagcgctcgggctcccgctgccgccgccgctctgcctgcgctgccgcctccgctcgccggccgggctcaactggctcccagcgccgcggcgctagctcgtccccctgcagccgccgacgccaccgccaacgccgccgccgccactgagcccccggcgcatcccagccccgggcgccgcccacgccacccgccaccccgggtcgcggccccggtccgggtccagtggctgcgccgccccccgccagcaacgcccgcgcggaatgagcgcgccgcgctgcccgcgcctccatccgcagggctcggcgccccctccccgcccgccgcccctacagccgcgcgctcattggcccggccagcccacggggagccgcggcgggcgggcggcccctggcgctcacacactcgcgcgcgcacacacacaccacgt

SEQ ID NO: 5554 - DNA, 2274 bp, Homo sapiens
cgtgccgggttcgcccccacgccggacccccgactccgatccacagatcctctccgtgaggggttcctctgggcttagaacgcccccgcgcgcgcgtgcaggcacacacgcgcacacactcacacgcttgctcgcacaccgccagtgcctctccttcccacctgggacccccgggcagccgggctggatgaacaagttgcagctggccgcggcgctccgctagggggacgagggtggggagggggagcccagcggggcgcagggccgtggccagggcctggggacctgcccgcttccctccgcggccgccaagccctaccgctgggaccggcgaggaactccccccagcctctccgcagacgctgcacgaccgcggggacctcccggggtcgccagccgcgccgggcagggggcgacagggagggcagggcaccgggagatcgccgccgccggagcggccgccagttcccggcgatcgctgcgggcgcagccgaacaccagcggcctgggcccggccgctgctcggggtcggcggggaccgcgcagcgcctacgccaggcggcccggcggctgcaactgggaacttcaagcaaagttttctgctgttccttttgcagccggccagggactcaagagtgcaagccgcccaaccttgagcactagcccaggccgcggaaggacggcggccgagctggcagtcccggctggggagctcgccctcggggtccgtccgctccgcccgcccgaggactgggtgcctgccagccccacggcccctcgcccagcgcccggctcacaggcagaagcggtgtccggcccgccgcgccccccgcccggccccgacgccagccttagggctctaccaccagggagctgtcggcgtcccgggcgtcccgcgccggcccgcgcgcctcgggggcggcagaggcggtcccgcttacctgagaacgtctcgcccgccgcagttagcaaaagtccggccaaagtcgccaggcaagtcccaagtcccctcatggtgctgagtgcgggccgggccgctccccggcggcggtgggtgggcgcgcgagggcggagggggccgggagctttggttccgaggcagcgaggagagacgggtaaacagcagagcgctaagccaagcccccaaagtgccaacagttgcagaagtccgaactccagcggctccaggggcgcgggcacagggtcctgggtcctcctcccctgtccctggccccactcggcgtctggcgccgctggcagagggagcggagggcgagcccgcggagccaaaatcttccctcggttccggttgctgagctcgccgcctctccccttcccctgcccgggacccgggacccgagctgccggccgtggccgtggcggtggccgtggccgtggccgcgcgcgttccgcccgccgcctctccacaggcagccccaagcccagccccgggcggcggcgcgccgatgaccgagcccgcgccggctgcgcgcggggctcttgctccccgactgactggcggtgccccgcaggccggctgaagggagcgctcacgtcacggccgcccggcgccgccgcggcccgctagagggcgtgagcgcccgtgccccgccggcccgcgcccgagcgcctccgggagctcggctgggggcggccccgcggccacagccactaccgccgccgaagcgggcgtcagccgcgcggggaggagcggccaccgggctccccccgcccacctcctcgccccggccgcgtcttctattttggtagctggctctggggagggtgactgtggaagaggctgcgccgccgccagaagtttgtcccgggtcacgagccgcgagtagtttgtgagcgcggccgggcgggaccagcggcctgcgaccccgcgggcgcggccaggcggcttcgagcctggcgccggacggcgatgtcaccgcacagggccagctgcacccggagtcgccgggcctgcgctgctcggcggctgcgggaaaagcgagccaggagatcgctgaggctccggagggctgcgagcttctctacgccgcgggcggagcgaagttggcgggcgccgggagatggcgcgggagccgggagcgccgagccccgcgatcgccagcccgctcccggccgggcccgccgggtacacgccgctggccccgagcactggcgcccgggaagcagggcgcgcttctgctgttctgcgtcctcatcatgcctcggtgtcccgtgtgggcccgaagcgagccgcaggcagtacacggaaggcgg

SEQ ID NO: 5555 - DNA, 882 bp, Homo sapiens
cgaaggctgtggccgcgctcccgccggccagttcccagcagcagctcatcgcccctgctccgcgccttcgctccaggcccgcacggtctcagccccgcggggatcagcactgagccggtcccgccgccgccccagtgacgggctgctgctgcgggaagccaatcgcccagcgcttggaggagggcgacgaggccttccgcgcgagcgagtaccagaaagcagtcgggctcttccgctccatgctggcccggctggcgcagcccgaccgcggccggtgcctgaggctgggggacgctctgacccgcgccggccgcctcccggtggccctgggcgcgttccgtgtagccgggaggctggaggcgctgcggccggaggagctgggggagctggcgggcggcctggtgtgtcccggcctgcgcgaacggccactgttggcgaggaagccgggcggcgagctcaaggctagggagggccggccctggcgcccggcgcgccccgcgacctgcttggctgcccggggctgctgcacaagccggtgacactgccctgcgggctcacggtctgtgagcgctgcgtggagctggggcccgcgcggccacgggcgcgggcgcgggcgcgggcgcgtgaacgtagtgctgagccgcctgctggagaggttcttcccggccgagtgcccgctgcgcaggctggagggtcaggcgcggagcctgcagcgccagcagcagcccgaggccgcgctgctcaggtgcgaccaggccctggagctgtgacttggctgtggggccggcccgcctccctgacccctgtcaagcccagcggctggagctaacccgcgggcctgggctttcgagcgctttgtccaggcgtagggggtcacttcgc

SEQ ID NO: 5556 - DNA, 4359 bp, Homo sapiens
cggagcgtccaacccagcacaccgcctccggcaaactgcgagcaattcaaagcagctcgcccagtagggaggggagctggtgggaggggggtggaccccgccgcccgcagaggtggggagacctggggggcggctccgctcccaggctgcagcgtgggcctggtcccctgccaagccaggagcgcagcccggagccagcgcggcccccgggtccctgcgcttatggcgagggtcgcgggggaacagcccctggtaggtaacttgccgggcacccacctgagttctccgcaccgcggcccgaaaacctgggagcgtcccaggacaaagggccagccctctggaattagccgtgtgtgactagtgtgtgccagctcgtatgtgggggtcccagtgtgcaactaacttagctgctcaccgcagcctcggagaaacgagcacgcctttctgcacgtgtccagggcgggtgcggcgggcagtgcattgtgaacaaagccggccacctcccgcgccgcacctcggggacgattcccggacggttctccgcggagagccgggcggatgagagcgtggtgtgtgtgtgtgtgtgtgtgtgtgtgtgtgtgtgtgtgtctgtgtgtcttgtgtttccctaaggagccggaggcggcccgcgaggcagggacttgctctaacttgtttcacacctggcgcggtttccccgaagctcgggtggcgtccagggccgggcaggcacgcggaggaccagcagcgttcgctgcagaaaaagacatcgtcaactcccactcagaagcccacactgccctgagacctggtctttcattctttcttaaaaaaaaaaaatgcaaattgatggatgggtttcaattgatgcgtaaaatgcttcccttgagagcaagacaggagggccagggaagggggaaacaggcagttgacataactctcacagcctaactgccgagaattcggacttggaggtaaattcgaggacgcacccgaggagcaggcgaggctgcctcccagcaggacggcctggcaccggggcgcactgctggggacctgactccctcgtgtcccctcaccccagggactcgcagctggcccgcgcgccagggtacacacgggctgcgggagaaggtgaaagttaggatgcagcacgagctccgagagtggcctgggctgtgcctcctaagagaacagccgaggtccccggcggctctgggaagctgcccctgggccgggagagcgggaggcggcgacgcaaggacgcgcccggagcctgggcgcgccgggggcgggcgtttggctggaagtggggcagtgtctcctatgggaaagcgagacccggcgagctctttggctgcttttccagtttccgaggtgcccgcccccgcgcgcctgaggcagcgcagcccggagggcgaacgaatggcggttggcaaactttgagtgagagtgcgctccggatccgaattgccgaattgtggctgcggcagggtcggccgagacacaagttcgctttttccgcctgcccgatgggccttagggagacttcagctccagcttggtggagcgcctcgcccgagggagttgtgtcactttgctcaggggcagggagggcggcgccctgggcgggtggggaagggtccctgtggcccctggggtcccaagcgcctcttccctcgtctcccctcccaccggcccctcccagtcttctctgcctcgctccttcccggggctggctggaccggcgcggacttgccccagacctacggggagcgccccaggtctttaatgacagcttaaatgtggctgttggaaaagtcgaaagggatgtggctgacgtggggcgtgtttcgctcctttgcaagagtcggaaagggagttgggagccgcgcggctggccccaggcccccgcgcctcgccgccagcaagtaggtgggggagccgccgccgccgccagccccatcccgctcccaagcctcgcccgctgcgccctggccgcgggcgccgagagggtgcggggcctcgccgtgcctcctccaccctgctcattaacctgcctgctccgctccgctccgggcggccccagacacgggtttcccgcggcagcacccgcggcccgcccggcgcagccgccgccccgaccccccggctccggggggcaatgagggggcagtggaaggggcactgctcctcgggcattacttagagaaacgagaccgtcccgccctctcgccggccctccctctctcccgcccgggcccgcgcaattctccgccagagggtaagttgggagtgtttcgcccccaccgacagctctccctccctttccttttttttttccttcaaagttttcttagaagtgggagccgggtgggggaggaagaaggtctggtcagcctccgtcctttaccctatctctccggtctaacttgtccccccctcccccctcccctccatcccctgcgcgccgctgcccctccggagctgcgctcgggaatgacaattggagcgcggctcctttaagagcccggctttgcctcccggtagctgaaggtcattaaacacaaaagctctcagcgctgcggtccaatatagcgcatgcgccctgcccgaggactggcagagagacggcaatatggcgagaatgcctggcagcggggactgtaacaccagcgcgggcggcagcgccagcgctgccgccgccgccgccgagaacaatggggagcggggcgagggcgagcgcggcgcggggggccgcggccgccgccacagccgtccgcactactgcagcgcgggcgaggaggaggaggaagaggaggaggaggacgagatccaggaggtgcagataacgggggacgaggaggaggaggaggacggaggtggggggctggaggaggacgaggaggaggaggaagaggaggagatggggctggactgggacgagcccctggagcccgaggactcggccggggaggagctggagcccgagccggtccatatgatcaatatggaccagagcgccgcgctggagcccgaggcgccgccgcgactgctggcgccccgggcccgcggtgggccgcccggggacggctccgagctggaccccgacgtgctgcagcgccccgagcgggcccggctgagcgagaacacccggctggccacccgctacgccgtgcgcatcttccgggagtacctgagcgagaaggcgcagagcccggacttcgagaccatggacaagggggcgctgtgccgcgtgctgcgctccttctatgccgaggcccgctccaaaagcggccagctctacagcaagtcgtcgctcatcagcatccgcagctccctcaaccgctacctcaatgagcccccgtactgccgcacgctcgacctcaccaaggaccccgagctgcgcagcgccaacctgacgctggccgcggtcatccgcaagctcgaggagcagggcgccgggccggtggtgcagaagcaagccatcacgcgcgccgacctgcgcaagctgtacacctccagcgtcttcagcaccaacacgcccttcgggctgctcaacaaggtctggttcgagacgtgcatgtacttctgtacccgcggccgcgagaaccagcgtgagttggaggaggactcttttgggctggccatggacgaggacggtcgcaagttcgtctacttcaagtccctcgggccctaccacaagtcgcgctcgtcgtcgtggagcaagaagcgcgccgagagcagcgacgaggagaacttgccccgcatgtatgagacgggcaccgagttctgcccctacgccagcttcgtcaagtacctgtcgaaacgcaaccctctctgcaaggcgttcttccagcggccccgggaccactgcagcgagggcgatgtgacctggtacgagaacaaagccatcggcaagaacttgctaggcactcggatgcagatgctctccaaggcggccaagctctccaagacctacaccaaccactgcatcggcgccgtctccatcgccacgctcaacagcatcgcgggcattggcaccaagctgggctcgcccgccccgcagggctgctacgccgaggctctgaacggggcggcacggcaccactcccaccacccccccacccatccctcccaccaccaccgcccccagccgccctcgctggggaacacttacatcctccccaaagacagccaggtcgggcccgacgtgaaatccgaggctgcgcccaagcgcgccctgtacgagtctgtgttcgggtcgggggaaatctgcggccccacttcccccaaaagactttgtatccgcccctcggagcctgtggatgcggtggtggtggtttccgtgaaacacga

SEQ ID NO: 5557 - DNA, 2762 bp, Homo sapiens
cggggcggtgctcggcgcactctaggcttccctccggcgaccccccgcgggctgcagcaaaatacggggcgcttcggcggggcgggggcgggcggctgccgcggatccggccggctacagccgcagcttggtggcctccgattggccacgacgcgggcggggaggctcggcggaggagggaggcgggggcgagggcggcggcggcggcgggaggaataggagaggggagcgggccgcgcagccaggcagcgcgtggggcgagcgcggggagagcggcggcggctcgcccaggtcgcgcagcggaggccgagcggggtgcgcggtcggcgacggagggcggcgcgcgcgagtgagcggcgcagggcgaggaccggcgggcgggtgccggtgcgcgggcagcaggggcggctgcggcagcagctgcgcgggacggagccgcggcgggagagaccgcgccggcccctcgcctcacccccttgcggccgaggccggagaacagtctccaactcgccgggggaccggaaagaggagccgagaagcgcccctcggcccccacgcagcggaggcgcggagtggcgggactgctgctctttgtgggtgcagcacgcacgacccggagcgccctccccgcggcgctgtccccggcgtcttcgtcgcgccgagcggccctggagcggggacccggaggaagcaaaaccacgagcccgaaacctcgcgtggcggagctcttggggagcgccatccgctccacttccacctccacatcctccaccggccaaggtccccgccgctgcatccctcgcggcttccgctgcgctccgggccggagccgagccgcctgcgctgccacagcagccgcctccacacactcgcagacgctcacacgctctccctccctgttcccccgccccctccccagctccttgatctctgggtctgttttattactcctggtgcgagtcccgcggactccgcggcccgctatttgtcatcagctcgctctccattggcggggagcggagagcagcgaagaagggggtggggaggggaggggaagggaagggggtggaaactgcctggagccgtttctccgcgccgctgttggtgctgccgctgcctcctcctcctccgccgccgccgccgccgccgccgcctcctccggctcttcgctcggcccctctccgcctccatgtgccggatagcgggagcgctgcggaccctgctgccgctgctggcggccctgcttcaggtacgcggcggtccccgcgggccgggccacgggcggggtggggcgggcggcgccgggtccctttgttccccgcgccgctgcggggccgggctgcgcacccgggaagggaggtgccacgccgcgccgcgccgcgccgcgcggccggtagctgcgcaggcatcgggctccgtccgggcgccggggcagggttgccggggccagtaggtctctcgcgcctttcctggcggggctctaggggctggattgcgggtcccctctgctccttcttcggggccgagcaagctcgcggggggtgtccccaggcagcaggagggtgaggcaggataactcccaggttttgcagttttctgtgcctttcgcccctcgcatagtactttgctccaatttttttgtttatttctgcagggatgggtcgcgagtttacagtaggaattctcactctggtgtcttagttacgggacttgcctccaccttaccccaccctgcacccgtgcgcctcccggtgctcaagggctctactgtcctattgtctttatcccagtctggagttgcctccttttcttcttctcttgccctcacaatattctgtgttcgtcccacctggaaagaaaatctggccctcttgcccggaggagtctctgccggtcagcgcctgcctgtagaacgagtctggcctctcacgcctagtatctcccccgggcgagaagttccgttacgcggctgctcctttctctgtccggctgcctgtgccctatatgcgccccgggggcgcctttgcctggagccttccgtacttttcataccctcgggagagagccagcgagccttttcatttaatctctactaagaggctcctccgcggcaggaagcacctgctccagtccgggcgcaggttccctcgccactgcacgctgcgggttcccagcccgggggcagcccaactttccgccgcctccaacccgaggatgcccccaggctcctcccgaccagccagcccaggcctggaggccacttcacacagcctcggccgggaccctctagctgggcgggtgcagtgccctggtcccaagtcggtctccgcctgccgtggggtccctcgaaggttgcgggaaaggggcgtgcccaccctcgccgcggggcaggaaaatccacggagggtccccctgcctgtcgccctcggggcaaggggagaggtgctctactgccagctggcagccccgaaaagtgcggacgcagctcggaagtgcctgctccgggggtggagacaggtggtgtggattaccccgctccgtggtcttcacgggtcagggcctggcgcgctccggcccgccggggggtgagtgctgctggggcgggggcaggggctggacggggctggcctccgcagtctctcgcgctttctcccgcaacccctagacggtcgtgggccgccgccgcgcggagccctgtccatggtgcgccatggtgcggcacgcctgtccctgcccggctccacgctctcctcccgggtcgt

SEQ ID NO: 5558 - DNA, 338 bp, Homo sapiens
cggagcgggggcggcctggagcgctgatcgggcgccgaaacgccgggagtcgggggctaagggctcgagccaggaggccccggagcagcagccgcccgctcctcacgccgccgccgccgcccccgcggttgcctggacacgggataaccgacttggggcctcgaccgcagcagagccggaggggtgggcaggcgcgggtccgggagacgcgcggggaaacgcgcggagccggtgagtcgggggcgcttgtgcctcggcgcgggcgcttgtgcctcggcgcggggcgctgccgggcggcgcccactccccctggccgcccgcctgcgcgactcccgcgg

SEQ ID NO: 5559 - DNA, 1435 bp, Homo sapiens
cgggacccgtgtgcccttcggggctcaaaggcgctgggcgggcggctgctttcgggagaggcgcagccctcactcctggaccacggggccagtggctggggaagcttctggggcgcgcgcggggaggcggcgctgcgctccacctgcccagccccggacgcagcccgggggcgaggcgtctagggaccaccccaattcaatattgggatttttaataaaccaaggaatgggattttaattattgaaaacccagctcctctgggccagaatggtgttgggatggtcctggtcacaaaatattaaagagaccgaccgctaagggaacaggaaaaacgtccgagacagccgttgcaattacgaatggaccagacttggtagcacggggcattgattgctggtgcccaaccggaccctcctcccctcttcccatcccttcccccacccaaagcaggctcccgctgcggccgggacctcgcatccctgcaacgtggccggggctgcatttttcatgagcctagggtgaacaggtgcgaagtgcgctgggagcatccggccagcggccgagcgcggggaacatggagagcgagcgcgacatgtaccgccagttccaggactggtgcctcaggacttacggggactcaggcaagaccaagacggtgacccgtaaaaaatacgaacggatcgtccagctcctcaatggctccgagtcgagctccacggacaacgccaaatttaaattctgggtcaaatcgaagggcttccagctgggccagccggacgaggtccgcgggggaggcggcggcgccaagcaagtgctctacgtgcctgtcaagaccacggtgagtgactcgccttcctctgttatttgtctgccggagcagcccggcggggagggaggaaggagagaggcgggagagagggggagccgtgagccgccgttggctcgtgtgccccctaccttcctcaaccccctccccaagtcgtccccactcgcattagccaggcgcgttttccccactgtacagtctttgtggtcctttattttaaagcggcagcgcacctccagagctggcctccctccccgcctcgggttcccggaccggctgcaggagcttccttccccgggtcgggcggcggcgtctggcgtcctcgggctgggccattgtcccatgtccttctctgggcgcctggcgcgtgtcccaccgccgccaccgcgcctaaaggccaggctggaagcccggccgcacgctctgagagcagacgagtctgatcgatagtctacagtgtctccttattggcataaagcccgaatgtagcgctagcggtggatgtggggttttccccaggacactgtcaggttttatcgttagatcgctgcccgggaggcacggggcagcccgaatgcctcgatcactcccagagatcgttgccgcga

SEQ ID NO: 5560 - DNA, 510 bp, Homo sapiens
cgagcgtgagtcagcgctgaaggcccagagcgcgctgcacgagcagaagactctgcccggggtaagtggcgcccgccgtggcgcaagcggccgacgcgccgacagggggcgacttcgggaggccgggcggcggcgcggcgcgcggggagaggacggcagggcgcccgccgccccgcctgagctcgggagcccgcgcgcccccccaaatccctgggctctcggccgtccgggcccaacgggatccgggacaggggccccacttggccgtggccgtgaagttcctgcgcgggcagcctggggcgggggagcggcgcgtcccgggtccccggagcgggagctgcctccgccgggcccgcgggccgcgtgcgcgatcgagtccgcccatcgagtcgacgcgggccgctctagtgggggaggagggggccggcgtgggagggggcgccgcaagtgagatcaccgcggtttatttaaggagccagccctcgtctttgataaactatcgcgcctcgg

SEQ ID NO: 5561 - DNA, 2722 bp, Homo sapiens
cgaaagtggctagccgagggccggcgggggttaggccagccgctcagccccgccgccccagctccccagccccgcagcccgcgggggagcgggcgcgttatttcaatttgccaggcttctgaagcgaagaggctgccctgaaaaagcaaacatgagagaggacggggtgcaggtaaatatcattaacgtgaaaatctgctaccccagccaagttcaccaccagtattcacccctacaggcggggccgctcggaccctgctcccggctccgcgcctgccactccctttcccgcgcagccgagatgccagccccagtgggcctggcggggagtccggcggggtccggaccgggcggctcgacccccggtccccacggcaggaacgactcagcctcgcacctcgggagctgtaggtgccgaaaacgaaacccgcgggggcagcgcacgccgcgcgagtctcggtccggcggcaacccagatagcgattcaggggctttattcttttgatggtgattaaaaaaatatattctatttgaacccgtaaagcagacgagggcaaatcaagccatcccccgcgctggctcaccggccaccgcgcccagcgccttcctccccctccggcgggcgagcgggcaggggcgcccgactcctaccttcctcccgccagccaccgggggaccagccgcgctctccggggcgggggaggccgcccgggacggggacccccaccttccgccttcggaagcgggttggggcgggggtcggaccccgagtctctactccccgtccctctgccccccggcgcggcccgacagctcccagccccatcctggcaggtggcttgggtggcggtagatgccgggcgggaggaagatgtggggctgctctggcaggttgggggtgcgaggaggaaaaaaaaacagagaaagacacacacagagagacagggagagagcgcgcgcgagagagctcttgtctatagatttatccacataatatatatttatgtagctttttttctctcgacactgatgaatgcgcgctcggatccccgggcggactccctccaagccggctcgcttttctagtctaaataaataaataaagccagatggaagaaaaaagcgcccattccacctccgccgccgccccgcccgccatccctgcctttgcttcgcccgcctggcgccctaatagagcatagcttggtggataaagcccccctacatacccacacgaaaataaaaatcactatttttaaaatacaaaaagttgcacctgctgctattacaaaaagaacccccaaaaggcaaagagaggaggccggctgcccggctcctcacggacacccgctccccgcggccgccgggcccggaatctcagcgcctcccgaagagccatgcgcctggcgctatttatagccgggggccgtctcggactgtaccatcgccacggcgcggggccgccgacgggggaggcgcggtggccgccgccccacgccgccctgcccccggccgccgcccgccgtggcgcgggcccccacagcgcgcccattcccggccccccgcgccctcctccgcgcgcgcacactcgccacccccacccctggtctggctgggaacttgaaccggtccagcctgtttaaacggaaaggacagagatcctgtctgttcaatgtaaaaaaaaaaaaaaaaaaaaaaaaaagaaaaaaagaaaaaaaaaatcagatcagaccgagagagagaggagagagggagagagagagggagagagagagggagagagagaggagagggagggagggagagagagaggggggagagcagagagagagcgcgagcgcgagcgagcgagagaagaggagaaagagagagagcagagagcgagcggagagcgaggtgtagagaaaccgagggggagagaacccgagtgtgtgtatgcgtgtgcgtgtgtgagcgcgagcgagcgagagagaggagcgagagagtgtgagcgagaaagaataaaaggaaagaagattttctctatgtatataaagatggccacgttagcaaacggacaggctgacaacgcaagcctcagtaccaacgggctcggcagcagcccgggcagtgccgggcacatgaacggattaagccacagcccggggaacccgtcgaccattcccatgaaggaccacgatgccatcaagctgttcattgggcagatcccccgcaacctggatgagaaggacctcaagcccctcttcgaggagtttggcaaaatctacgagcttacggttctgaaggacaggttcacaggcatgcacaaaggtgagtacacctttccctcccaactttgccggggagcaggagcgggctggcgggccgaccggccggccggcgactgacgagcggcggactaagcgagaggaagcctcgggcgggcgcggtggagggaggcgctcgggcagcggagaccagagctggggtgcgtggggagctgttcgctggggcaagactgggttttgggcgaggtgctgataggaacgatgccatggagagagcagcgggcgccgatgaagagaaagagagaggggatcgaggagacggggcttggatttttgggtacagcgacctgaaagatggggatggggaaggctgcaccggtcgagcccaggacgctgagcggacggactcgcgggctcctggccggccgaggaccgagggtgctgtccatcgccgt

SEQ ID NO: 5562 - DNA, 1133 bp, Homo sapiens
cgagggcggccgcccccaccctcgggggtccccctaaaatggggtggggggaagccaccgctcgccctgcgtcctcgcgggtgtgccctgagcccccggccgcccgcggcgcccgcccccgccccggtgcctgcggcgatccacgctccgaagcagaccccgaaaggaaaaagcgatacctctgtttcgcacagagccaaacactggaagcacgagatagccgacgtggaccaggaccatcctggctcctcgcgcggcggcggcggcggcggctgcgcgcgggccctttgtggcgcggctccggggcgcgggcgcgggcggcggcggggctgcgggagccgccggggcgggaggcggagcgcggggcgcgggcggcggtggggcggcggctggcggggagacagatggcccatggaaaggctcccttcccggcccctctcgacattcaaaggcgctggggccgcagctgccgccacacaaaggcgcgcgcagccaatgggagcggagcgcagcgcggcgcggcctcgccggaaccgcgggggacagcggggaccgcgggcgcgcgggtggcggagggagggaggggtgacggctggaagggggccggcggccaatcgctgcggcccgctgcggggcgcgagggaggggtcagccccacgggaagcgtggagcccagcgcgggtccctggccgcccgcgggccggagagggcgcgcgtgaagcgcccctgcacagacatgggcggcgtgaacacggaacgtgcacacatggagagggacgtgcactcagacatgtggaggtgcgttccttagtgcagagagacgggcacgagcgcccttagtgcacacgaccctgaggtccctgcacaccgcgcacgggtcactcggggacgtgcgctcggaggctggcgcacgtgtagagcctgactgcgggcacaagggaagctggaatgcgaacaagcagccgcaaacaggacccaggcactgtcacacagacatgcacacaccaaacgccttgttaacgcaggacgcgtgccaagaacgcattctcagagacacacagagggaacacacgatgcagacacaggtaagacacgcacactccccaggctctctgcctggcgcaccgcgtcgt

SEQ ID NO: 5563 - DNA, 2401 bp, Homo sapiens
cggcctgaccggggcgccccgccgtcctcccagtgtaccccaccgctctcggctgggggcgcagcaccttggagagaggcgcctggccccgcgcctgggctgggggcgctctaccttgcgccctgggggtcaggggcgcttgccgggccgctgccgaggggccctgcccacccctgcccagcccggagcccaggcgagccagcgcggcgagcctcctcccctcccgcctgggtcgtcctgagtccgcgcccgctccagttgctgcagctgctgctgctggcggctgcggggagcgcggggcgcgcgccgaagaggcttgggcggcgaggacggggacgaggaggagtcggaggcggcaaggaggaagagcgagcggaggccgaggggctcagcggcgtggcgacaggactagggggtcccgagaacatgggctagcaggcggccacgggccggcggccggacgcggtgaacctgccgcggccgggcgcgcactggcgcggcgagccggagccgagcgcagccgggggaggagggctggcgcaggggcgcccgggcggagggggccgattatccattattaacgagttaccacctaataagcggagagcggctcgttagccgcgcgggaggcgctcggggaagggggtcaccggccgagcgcagcgcacacccgtggcgcacggcgggcggcgcggcgccgaggacacccgggaccgcgcgcggagccggggcgggcccgggggcggcgcagaccccgggcgcgggcggcccgcggcgccccctggctctcggcgctcggggccagcgcagcccggggcgagcggggcgcgggccggggagggggagctgcccgcgcactccatccccctcccccccgggcgggcggcggcggctcgctgtatatatctcggcgcaccccgccaggtcgcgcacagcgccccgagcccaggcgcctccccgcccccctcccgcgctccgcggcggcggcggcggcggcagcagtagcagcaatatggctgttgatgggtgtttggggtggcgctggcggcgggaggagctcccccgagcccctgcgccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggtaacgcgcgccccgggcgcccgccctctgcgccagccccaccgcttctcggcgtcccctgcagcccacctcctcgctccgcgccgcgccgtgcctccctccatccccgcctgccttcccctcgccgccttcccttccctcggctctcccggtgctctcggatcggggcagcgggcggcgcgccgggggtgaggagttgcccccagccagtgcgctccgggacgcggacgctcaatcctgtcctcttgtttattgtagggttgttggcggctgcggctggggccggggtcggggactcacaggctcgggtgccgtggtgcggggtggggacagccaactcagcggggacggaggaagctgggggcagctgggtgcgtgttttgcaccgctcacctgccggggctcggctcctggcggtgggcgagagggagcacatccgcccatactttaggaacctgttggggagatgagttcgtggggtcagaaagaagggaaaaatcctttgggcaagggagagaataattttgcacaagggaatcccgggggaggagcatggcccgagataacagggggacttcgaggggcgagagaagttggggagatccatcccactattgggggtagcccacggggctgccacttttggaatgtgtcgaggtcgcatatctgatgtaacctcccactccgtcccttaggtgctctagtggaacataccccaagttcttcggcctctgttcctttgcccccaggccacccactttgggtccccggaaatgccaccagcagcgcggagctggagcgggagtccgcctgaggccgcggttttacgcggagcgtcttccctggcgctcgaggtggctagatgtcgtcggctttagctattcctggtgcagacgcccaccggcactgaggctggcgacaccttcga

SEQ ID NO: 5564 - DNA, 769 bp, Homo sapiens
cgctgagccgcagggaagctgcggggccagctgagtagccggcggcctgttgggtccccagtgtcgcgcgacagcacgacccgagacaaggcacctggggctggtgccaggcagaggccccgcgttgcgtggccggcggcaacagcgcctggcggtcggttccgggcggggctgcaggcgccgggttcccgcggccgcgaggcggggctggagggcgctgcgggctgcgcggaggctgcgggaagcgcggggagcacgcggagcccgactagcagggagatcgcgtcgcgccgggcacaggcacgggacccgcgctctaggagggcgcagcgagaggcgcactgcgcacccaggggctgcggtcccggccgccgtgcggtgacaagctgactccccgccgccgcccagccaagtccgcgcggggtgctggcggagatgtcgcatgggaggcttcttcaacgaggtgcaaatccaagccacctcgcctgagtgaatgaagggacggcgcggggcgcgggtggggttcaccgtgacaaaagcccagtacctggttcaaactttttttttttttttgcccgcaggattagaacatccgacattaaaatgtctcagtgcagcagaatttcccagcgacttcggtggcgggagagcagcacctctcaggcacagctgtgcgcatccctcgggccccaccgaccgcaccatctgaccgcgggaaacgaaatctgagctcaggaatttgaactgccccacgcacgttcgttcccgg

SEQ ID NO: 5565 - DNA, 1169 bp, Homo sapiens
cgggagccaggcgcgcgggcgggggctccaccggtcactccgaaatcgcagaatgccccagggtctccgggacttgtgggtttaggggaacgttcgggacgcggagcgggcccagttcacctgccggacgccccctccgtccatccgaacccgggagccccgcaggagggacccttctcgtccccagtgaccacagtccggacccgggctgcgctcggcgggcaaggctgggagctccccgggccggaggacggggcgcatgggctccgggtttgcagaattcgcggctgcgggagctgggtcttctctcccccaattcgggccgcgccccggctggtcggaggaggcagagtaggggtgcggccgtgtgtccgagcgggagtggggcgttcatctccggggagaagggggaccgggaaaggcgcagcgcgccgagcattcgcccacaccccgcccgctctccgcgcgagccgggtgcgcccccaaccgaaccggggcgggcgccgggagagtcgggttttcccgagacccgcgccccttcctcgccttcggctcacccgggctcccgcaggaccagcgcgaatagacggggcgatccgcggccgagacctccatccacgcgcgcggcgcggccagaccggcgagcgcctccggcccgacgcccccctcgactcccggactctgggcgctgagcgggagggggaggcaccagccccgcccggccccgagccgcccccgcccccttggcccgaacagggggattccaaggtccccttcgaccctcccgcgcccgcgcgcaccgcgcacccggagaagaagctgcgcgcggaaccatcagacaggagcccgcgccccccgccccaccgcccactgcggccccggctccttcgccgcggaccccccacccccggccccacggcgcgctcaactttacctgcggtccagactccgcgagctccgggctccgcttacccggccggcggcctcctcggggcggagcgcggcgtctctggagccggcatcccggactccggcgccgccccgcgcaccgcccccgtcccagccttcagtggcgcggcgccccctcgcgacatccgcgggtccccaggagcgagccgaccctcggctgggtttggagccggggccaagtccactcggagggagcacgg

SEQ ID NO: 5566 - DNA, 6036 bp, Homo sapiens
cggtgcggtcctgggcactgaccacgcccacatgtgatggtctccgtaacgtgcaggctccgctggggagaggccagcgcgggctccaggtcccagggcctcgggctcactgccgggactcccctcagtctcctttccattggcctcgcccgccgcggctgcgccgggccgatactgactccagcgacccttggggtcgccccagctggtagccagcatctcctctgggatggggtccaaatgtcagccggcccggcgtctgcaccagggtcccatcgtacgcagcccgctgccttcccgtctcccgccaaggggtgcgacaggcagggggatccgttggcctctgcccctcccacccccacccttttgggctccgccggagcgcttgggctccgggttccctgaacaccgtctgggcggggcttcctgccggggctcggccacacccccacccgcactcccacagctggggctgagaatgaaaacaatccctgcaaagccctcattagcgaattaccggcggctgcagtgattacaggcttcgcccctgcgcgccgcaaaggcccccagctggcaggcccgccgcggcgccgccctcccccagcctcgccccacctgcggcgggcgccgtcacctccccagcgctgtccctgcgaagcagcggacccagacccagacccggacccggaggctaccgcctccctcgcccggggtcaagcaacggcttccgacaggggaagggccgcgcgctcagggctgggccaggacgcccttgccagcgctccacggtcgggacttgaggcctagcggccgccccgtttcctcctggacctccgcggcacagaggcaaggtcttccggtgaggcgcgaggtcgccgtgcgctgggcgggggttctgagagtggtggggctcgggtgggcagaggccctggggcgacctatgggggacgtctacagcgcaggcccatggggcagccagaccgcgccgcagggccgggagagaacgttccagaaggccggcctaggccactattccaggagggtggcggaggcagtggccggggctttctccgcggccgagtcggtggtggctgcgaccaccatggggctgggcacatagttgaaggggggtactcgggccgagcggctgggggagccgtgccggctggcggggaagccccccacggcgacccccaggccctcgtgcacgaagggtgcggagatgggagccttggcgaggctgggaccgtccacgtcgctgccgaggagggagagctggccgccggcgggggccccggggggctccctggtctccaggctcggggacgtgctggagttggtcttgggggcggcgacctcctcggtctggaccacggcgtcgctggtcttgcgcggcgggggcccggccggggcgtcctcgggcgtggagccccgcagtggcagggccgtggcgggaagcgtgctgcgcaggatgtggggcacgtcctcatctcggatgcgccgccaggtcgtgcccggcgcggccaccctggggagcggccggggctccccgtcgctgctgcggcgcgcggcgtcggctgaggcaggggccgcggggacggcgccgtcgggcctgcgggccacgctgatgtgcggcagcgacgcgtagcgcttgacagtctccggccgggcggcgggcgcgcgcacaggcaggcgggacgggctctcggaggtggtgcgccgggcagggcgctcgccagggctgggtcgggccgcggggggccgctgccgggccggggccgggccctgccggggtgccgctcggagctcttcgcagcgcgaggagcagaggaagacggcgggcagcgcgggccggccgcggcggggcgaggcgccctggggggcagaggccgcggactcggccgaggacagctcggagcggcggcgccgcaagcccggcgactccttgatgaaggttagctgtcgccggaagcccgagcggtcggaggactcgctgccgctggagagggctgaggccacacgcaccaggcccaggcggcccccgcgcgcccccgggcccgcctcggtccccgcccggcccctggggcccggctccgggactgcccgagccagcggtggcggcccacgccgggccggcctctgcatgaacgggatccgcacgggcgatctctgcgtcttgtgctgcttcgccagaagggtgcgcgccggcgttttgggcaccggggaggctccggggccgggcagggccccagcagcctgggtgaccggggggcgctttctgggcaggggctgggaggcgggcgaggtctgggaggagctggaggagggggtcttggcgaggcgggcgggcggtgtggcgcttctggggggctggctcagcgtcgccagctccgaggtcttggcaggccggtgtaggctccgcgaccgctgctgcccggggctcgggactttggctggagccgcgggctgtgccaggcaagggggcgccaccttccgcggtgtggcgcgggggccgggggtccctttgggctgggcacggggtgccgggctggggacgtagatcactgttcgtccccggagcacagctggcaccccgggcgtggtcttctgtgtgccacgtggcttctcggggcctgcaggggaacgggggctcccgctggtcttgactgaggctgcgccccttttctctggccgccgggcactgcccatttctccctccgcctgtcgtcccttcctgtgcttggggggctgtagggtggatcccactgacagcccggatacgaaggacaggatggagtcggactcggacgaggcctcccgcgtggcagctgctgcctggtgcagccacgtgacaattgaattggcgccctcctggatggcgcgccactccacgctatccaggtcggaggcccggtccgagcccgctgcctcctcgccgcgttcccgggacccctctgcgggccgctcatccagccgggtggctcggggcttgcggcgccgcaggccagacacggggggccggcgcctgggcagggccgagctgatgcaccgctgcagaagctcctccgcggcccgcgggctgggcgagctgtcgcgtccgcctcctgggcccgggtccttggtgaccgcgggctcccggcctcgtggatggacggccggcggctccgagggctcgggctcgctgagggagctggcggaggagctcagggagtagcagggcggggtctcgtcagcaatgaggctgggctgggtccgggcgggcggcggggcagctggtgcagccttggacggggcaggggcctccttccggccctgcggacgctcccgcgtaaaagcgcgagggatggccgatgtgcgccggtgggttggcgtgggcgcggccgccgggggctcctcgtccgagtcgttgccgtagaagcagtacacggcctcctcagtgggcgtcgtgaggcacagcgactggagcgccccgtccccgcgggtccggccgggctttgagccgtccttgtctgcgggggcgctcgggggccggcccaggggcagctccagccctgctctgttcttgcccgcgccccgagactgctccgcgctgcggccggcgcctcccgccttgtgccggtgccccatggcctgtctggcagaggtggggcggccggtgggtctttgcctgcccgctggtcccccgggctggtccctggggggtccctgcagcgtctcgtcgctgagcgaggcggcgctagagaagttgaccggcgtgccctccgcggagtcagtgcaggagtcgtcctcctgggccggggccggggcgggcaccaacatgtagacgggcacggggagtgcgcggcgacctggcaccagcgcggaggccaccttgcgcagccgggcaggcacggcggctcccaggcactcccgcagcagttccagctcctggtccgcggcgccgcgagggcgagaacccgtgggcgccggcccctcctcccgccgccggtgccctgcaaagtggaggccggcgcccccggcgcccccgccgcgctcggggcaggccgagggcagcagccgcagctccacgtcctgctgcacgtagtgctcgtgcaaggccagcgcgctgaggctggaggcgcacgagaagttctcgtctggcttctccacggtaaagcgcacgctgcctgcgtccagctcagatggcagccggcagcgctcccggcagtcggcgatgtccaggaagcgcttcacgtagctctcccactgcaggctgaactgggtggcctcggggggaccctgtggcgcgggcgccagcggtggcgtcttgctccggctgggaggcatggtctgtccggggctgtcgggcagctcgctagggctgatggtgccgctgccctgcccgctgcaaggttcactggggatggagctggcgatggacgggctctcgaagctgcccagcgagctcacagagctgcagcggctcagcacaagcggtgtctcctgcacgtagttctccgacgagctggacggcgtggcgtcttccacccccaggccccggcctcggttacgccggggagccggaatggctacgggcagcgaggtggccccgggcgcccgccacgtgctgtccagctcagcctcgctggggccggcctcctccagcccctccagggaggagtcactgtcatccaggtcaccaccctcgctggggcctgggcggccggccgaggacagcgaggaaagggagctgcatcgggacagcgagagtggcccctcttgcgccgccagtttctgcagtgccttgctggccacagacagcggggcagccgccagcttctcgggaaccttgctcaggtggtctgccggcagccaggcctgcttccgggcccctggagagattccaggccccgcgaggggctctgcacccgcccttgaggcaccctcaagcagtggcacgtgctgataggtaggcgacagcttgatggtgcgcacgcgggcgtcggcggaggtggcctcgcgggccgggggctcggcctggcagccgggcaggtcaaggtcaagccggctgggccgaggctgcccacacctggggtcctcgcggcgcgaagccagtgcggccagcgggcagggcagcatatgttcgcgtgggcagtacccgtcgctggcactgccgctgttgaggctgtcgttggagaggctggcgtgggccgccttgagccgcagcagcgggtgcgcccggcttcctgcctctcgccgcccgccctccgggccgcggcatggcgagcaggactgggcgcggccctcccgtggcgcctcctgtcccgggtctccagagctgaggctgaagctatcgtcggacgaggtgtgcagggcggagatgtcctccaccagctggtcgatgcgcgccactgcaagcgccagcttggccttggccttggccgccacggctgcctccccactggtgtccttctctgcctccttgccgcctcggcgggtgggcggggtgcgagccagcgcctgcccctgcaggaaggggctgcccaggaagagggacagcgcggcagggctggctggctccccggtggccgcggccgcagccagggatgacggtgcatcgtcgtcgtcaaagcagcccgaatcggaagcatagtcttgggccaggccgtccaggtgtcgcaggggcggcagcggcttcttagtggcggcctcggctgccggcgggccctgcttctccaggtgctccagcgcctgcgcgaggtgccgtgcgtccagctcggcctccagcgcccgctgcttgcgcacgtacaggctgggcacgcagctgcctggggacacggcggtggcggccgcctggtgcttggcgggccgatgggccagcaggttgcgcagggcggcggcgctgcccatggcgatcatcttgtgcttggagtgcaccagattacgcagcatgcccacggcgcccaggtcccacagcagctcctggtcacgggcgctgcgggccgacaggttccagagcgtgccgcacgcgttgctcacgatggtcaggctgtgcga

SEQ ID NO: 5567 - DNA, 3400 bp, Homo sapiens
cgtgcagctgcggggcacccggggctgggttcacctgcgcccggggccgcacaggcaggcagagagagccgggttcagggcacaggcctgtctcttgtcccctgcgcccggggaagggggcggcacagagccagtgaccacagcgcagcgcgcacttgcccccgcaggccctcggagcgtccccgcgcgcaagaaggcgcagaccgcgccgcccctgcagccgccgccgccgcccccggccctgagcgaggagctgccctggggagacctgtcgctcaacaagtgcctggtgctcgcctcgctggtggcgctgctgggctcggctttccagctgtgccgcggtgagcgcaggctccccagaggtggggcgaggctggggtccacctgtgcgcctattcctccaaggaaaggcgctgtgccgccagggtggggtctgggagcctcctctccagggctgggtcttgcacgcccccaaagttggtttgtgcatctccccttaagtgacgggccttgcgcgcccctctcacccggtgtggaccttttgcggggcccattcccctcgccgcgagtaggttctggcttccggatgaaccttgtgcaacccctcctgcctcgtagcgttctgccgcctttcccctgcgccctctctggggaccgctcagctcgtgagcgccccccgggggcactcctgcgacccctcccttgctaggggcctcctacagcccgtggtcggggggaagaatgaccaattgaaagagcgaggttcggagaaggggcgccgcggcagcggagtcccggagtcccttcccacggctcgggggcatccttagtctcagccgtaccgggggagccccactccaactgtccagggaggggggctctaggggtgagggagggatggacagtgtggaccgtgcctcggcccagctgactcgggtcccgaccctgtcgctgcagacgccgtccctggggaggcagcactccaagcacgtgtgcccgagccctgggtcccgccaagctcagccccgagggagccatcgtcgcccctggtaagagcttccttccactgaccgcgggcattgggaccttcatccccaaggaaagaaggagcccgggccggggggaaggtgggcgcttaccccaggaccccactctgtcttgcagcctaagttcgaggcccaggcgcctccatcagcgccgcctgcgccccgggccgaggcagaggtcagacccaagattcccgggagtcgggaggctgcagagaacgacgaagaggagcccggcgaggccaccggagaggccgtccgggaggaccgtgtgaccctcgcagaccggggacccaaggagaggcctcggagagaggggaagccgcggaaggagaagccgcggaaggaggagagacctaagaaagagaggccgcggaaagaggagaggccacgggccgccagggagccccgggaagccctaccccagcgctgggagtcacgcgaagggggccaccggccgtgggcacgggactccagggacgccgagcccaggaagaagcaggcctgggtgtccccgaggcgtcccgacgaggagcagcggcctgggagtcgccagaagctccgcgcaggcaaggggcgggactgagccggccccgcgccggagtccaggggccccttctggacgccccgcgactctggcgaaataaagcgagtgctgcggccgcagagtcacctgctcctttacgcctggacccggcaccaagtccggggcctgaaagacggtggtggggcgcttcaggcaggggagagacagcgagcgctacagggcggacccgggccgtgcgcgaggagagacggcaagggaggtcccacgggccccctaacacgcacggacaccccagccggttgcttgctggtctttattggggcgatgcttggggtccgaataaatatgggaaggggcgcgagctggggcgcgtccggaccctcggggcaggagtccgcgcggcgcaggggtcaccggcagccacactcggtggccaccatgttgggcacgtggtgcgcgctgatgcgctcctccgacaggctgatgagcagcttgcccgcgtaggcggtgggcacgcagcagggtgggcgcgccagggcggccccacggacctgcatcttcagcagcagcaccacgtggttgccgtagcgcgggttgcggtcggactgaggccagccgcacacgccctggcaattgttggcctggtaggtctcggggatgagtacggagcgctcggcgcggaggtctacgctgagctcgcgcagcgcgcacggcccgtcggcggcggtggcccccgcgctgcgctgtgcccgacccggcccgcgcggatcccgcccgcgccactccacgcgcaggccctgcagcgccttcaggagcagcagcgctcgcaggggatcgccgaggccgccggggccacctgggcagagcgcgagcaggcgcgccagcagcggggctgtggccggaggcagacccgggaggcttcgcagctcggcagccgccgcttgcagttcagcagccacgcggcgcgccagggccgtggcccacggcgccgacgtggggtcgtgcaggggcgcaggatccccggtggtggccgcagtgggcctcagcagcagcagcagcggctcctcgccgtcgagtaggcgctccagcgccgcggggtccgacaggttgactaggccctgcgggaagccggccagcgcgtccggatccagggccaggcgcggcgcggaggcccgggccggggggacccgcagcgcccgcaccaggcgcgtgagcgtctccaggaaggggtctgcgctgggtggcgactcctcgagttccgcggatggcctggaacccgcaattggaggagttgagagcggccacgaggccacgccgcccccgcccgctcctgccccgtgtcccggtgcctgcgcgcacctgggcggcgggaagggcacggtgtccagctggccgtgcgcaggcagcggcgcgggctcggaccgcggcagcaggagcagggccggggtcatccgtgtgaagcagcggtggtcgtcgccgaacagcagtgcctgcagccgggcggtactcagccgggagtctgcggtgggtgggcacgcggctggctcaggggctgggggcccgggggcagtcgacccggctccccgtccctctccacgcggacctaccctctccgcggggctgcagggtcaaggccagcccggagccgcgccaggcccccgcagggcggtccaccgctaacaccaggtagcgggtgtctcgggaggggcagaggctctgcggagaccagggctcagcccggctggatggaggcttacccagccccgctctaccggtccccttcctcccatcgccactggttctacgc

SEQ ID NO: 5568 - DNA, 1143 bp, Homo sapiens
cgggcttggcgccttgcttatctccccggacgggcagctcactctccctcacccccggtccccgccgcgcgcactggcggcgcccgttccacgctccaagaaccccgcttcccagggtgggtggggggtgcacgcccgacagggccaggtcagggccaggcgtggagcccgcgtgcgccccgggaccccgcccggggcgcgcgggaggcgccgggggccgcggaggcggggcggggaggggccggcggcggcggcggcgcgcggaggagaccgcagtgcggccggcgctaggacccgcgggggcctcccaggccgcggcgcctcccgctttcccccactccccgacccttcttcgcccccaaaatgaggaaacggagcaactcgctccaagttgtgcagccgggaccgcctcggggtgtgcagccggctcgcggaggccctcctgggggcgggcgcggggcgcggctcgggggcgccccctgagcaggtgagcacgtcggcggggagacgtggagagaccccgaggccggggtggggggaaaccccgagggctctaggcgggggtgggcccgggacgtgcgcaggaagggccggtgtgtgcgcgagtgtgcgcgtcccgggcgcgcagcgggtgcgcggctggggcggagggtgctcagaggcgatcggaccccgcgtggtggtggctggggtttcctgggtgcgggtgtgcgcggctacgagccccgggcgtgtgtacccgcgcgtccacgtggagggctgtgcgcgtgtggccgaaaagcgtgtgcgcggccctgcgtagcgccctgcgtgcccgagtggcccggcgctggcgcccaggtgttccagtgtggggcggctgtgtgtgtgccgggggcgggggacaggtgcgcacgttcccaggtgtggagcgcttgtgcgcgcggatgcgcggggacgtgtgcgcacacctgtttccacgtggacgtggtcctttgcttgtctgcgcgcagctgtgtccgagccctgtgtgtttctgtgcgtgtgcatgcatccgtatgcgtgtgagtacacgtgggactggaggatttcatgggaggcgcatcttggaggggccgagactcaccccccagcaccgcccacttcccagccactagcggtcgg

SEQ ID NO: 5569 - DNA, 220 bp, Homo sapiens
cgtggcaaacccgggctccgacgacagaggcagcgcagaagctcgctcctaaatgagacaattttattaaaatcataattccttgcatttctatagcgccttttcagtggcggagatctcaggtgccccacgccagggtctactagagaatcggggcgaccgcaagctcagtcgcgggacaggcgaggctcgccagctccacgaagcgtcaccggcacgt

SEQ ID NO: 5570 - DNA, 1860 bp, Homo sapiens
cgcacggaagtctctgcccagctgtcagcgcgcgtcgccaggggctgcactgaagctgtggacccgggatggggaggaggctggcggcctccgaagcagggtctacagcgggggagggctagcgccgtctggcggtggctgcgcgtggccagtgcggacccaggctcggctcggccggcgctgcctgcgtgtggtccgggcggagcgagggtccttggagcccggttcgtcctgggtcccaggaagctcggcgtgcagcgtcagaggccgcgtgtgctgggggagggaggagtacagactgtgcctgggggcatccaggacgaattcacagaggggtggtcctgccccacccagggggtgtcgtgggcaaaggccctggggccacctgcctggtgccttggagggcgtagggcaggagccgccgaggcccgcgggccactgtggggcgcggaacttcagaccaggcacccgcggctcaacttccgggccaggggacccgcgggggccttacgaacctgtttggcccatttgtgcaacagaaatccgcccgcgcctagcagcgtccggggccgcctgcgccggatccgcagcccagtaccctccgcgccctggactccgaggaggccaggtagagagcggctcgcgcggtccccgtctgcgccctcagccccgcgctgggcagcgggacatgcctggctccggcgccgccacctcggcttccgcttgcccttgagtgcggagcccggagcctccctcgcggtgcgctgggtcccagagggccagaggccaccagggggccggcatcggcgggagcccagccgggcgcgccctcggccctctcccacccacgtcctccgcggccgcccgggtccaggggcgcagcggggaggagaccccggccagggccggggagcgcgagggcggggcggggtccggcggggaggggcgcgggcgggcggggaccggggcgggggccgggtccgggggcggcggcggcgcgggcgggaggaggaggagcttcccgcgcggggcaggggcggagcgagcggccgcgccgcggagccaagtgagttcgctccggagccgcgccgccgccggcccagcatctcgggcgcccgccgcccccgccgccgccgtcagcgcggggatgtaggatgcaggcgggcgccaggttccagcggcggcggcggcagctgcagcagcagcagccccggcggcggcagcctctcctctggccgatggacgcagagccgccgccgccgccgccctgggtctggatggtgccgggctcggccgggctgctccggctcagcgcgggggtcgtggttcccccggtgctgctcgcctcggccccgccgcccgcggccccgctgctccccggtctccccggctggccggccccgagcgagccggtgctcccgctgctgccgctgccctctgcgccagactccgccgccgccgccgccgcgcaccccttccccgcgctccacgggcaggtaacgtgtccccgtcccgcctcggcccgggtcgccgtctcccctgctcctgggcgcgccctgcccggcccggctctggcctccggctcgcgcgccctcctccccggcggtcctcgccgccccaaaccctcaggacggagcccggcagccgtgcctcggcgagaaagttcgtgcttggacgcccggtcgtccacctccgcagctttggcaggtgcctccgggtgtctggacggagccgtggagggacccgccgcccaggcccgcgtggggaccgcagggaactcgcgccacgccgggggtcactgtccatcgcgaggtgctgaagtggctccgtgaccgccgcgggccgtggctgacatcgcgg

SEQ ID NO: 5571 - DNA, 441 bp, Homo sapiens
cgccggggccccggctgtcagcgcggccgccatcgtatggctgaaggggactgaggccgagctgggcaagaactctgggcgcagattgtgaagctgactgcggggaggcctgggtcccgccacagccgcttcccaccggttccaaccagccccgttccctctctcgggatgtcggaccggcactctcaccatttctaggcttccagggggccctggcgtcttagctgtggatctcccaatacccgcaggtcgcagggccacacaggctgggcttctacgtgcagaggacacaaagcagacagacgaaaattggagcttcggcggcagcgagaaacaaaggccgcgccaaatcccggaagccgccctgtctgctccagctgcgggcctgattggacggccccccgcccagtgtccccgattggataacgtttaaggccccgc

SEQ ID NO: 5572 - DNA, 5587 bp, Homo sapiens
cgcgggaagaaggccctggggggggcgctcccgacctaactaggaaggagtatgcatatgcaaatgcgcccagggggcgggtcctgggtccggagccccccggggcgtcccggcgcagccctagccctgcgccatccccgcgcgtgcgccccctctccgcgatcccttacccgagccgtgcctctggcgcagcaggaccgcctgtcccgatggcggcgacgctgacgaggcagcagcagctgccgcgactgtggtggtgggcgtgtgggccgccgaggctgccgcggcctcggggactgcgggatcgatggcggcgggagggctcccgggcggcgggctcttgtcgccgcggccgggctcggaggtggtacggctcgcggcgcccgcgttgttggcgttggcggcgctggctgggccgtggcgacgcgggccgctgctctggatgtgggacacggcctcggcggcctgcatgttgggcggcgcgaagcgcgagagcacgcgcagcatcgcctgggccttgtgctcctgcgtgtcgtcgtcgctgtagtccgacacgcggcactcgtacacgccctcgtcctgcagccgcacggcagacagccgaagccggtgtgagatgtcattgccctggacgcgtacggtctgcaagagagcagggttagaggccgggctgggcagctcccaaacctactcttctggccaccctggccgtcgcgccccctcatccgcgcaccccaacacttcccggatcctggtttgcccaccatcacgatccggcttccctttcacccgcgtctacccagtggcatagggcttccaactctgcgtggacgccaggcagccagctctttggactgtgtccccacgtccccatcacgttaaccaaacgcccaccttgcatctgccccgcccatacaaaccaacactgcttgtcttcccgtagctggcgcttcagaagggcagagtccacctctccttcctccctcctgcaccttcaggaaaccccaggctggattccttgttccttaacttccccacgtctttcccgccccgacgcgctccaaccgacagtcccgccccagccggccctcctcacctcccggagcacggagggcctgcccgaatcgcttcctaaggaaagccaccctgtcaccggaccccgccctttacagctaacactgtgctttcttaagaaggcaagcaacgctgaggctgctgcctggctccctggccacctgctaccaacccgcctttccgcgggatctccagaagccccccagcgaagtgctcctcccctgcgccccggtggggacttcgggaagtactgctctacggctctcaacaaacacccagggagccctcacctctgaaccgagcccacgaggaggcttcgtcatctccaggcctttctacgctccaggtgggaagcttgggcgcatctcctcccagagttagcaaccccatgacccgggcccctcgcagcctggcacaaccaccccctaccccgtcccctgcaagcctgcaacaccccgcacccagacccgcaatccaggcggaggataaagggttgcagcggagggcgcagagcagatgctcagggcggggcagagggggcgggaagctggcgccacggtcgcggcgagggcgagcagccgcgcgctcccggtgctaggaggaatgcccgcagagcggaggctggcaggcgcgagaggccctaagcgcgcagtccgaccaaggggagttttacaggtcagcgccgagccgaattaggggactcaagccttggacccttgatttacacaaaagagaacccgaccctgcaaccggcgacagatggcgcccggacacgccgagcagccaccgatgcaaggctgcgatcgctgccctacttgcgcggccccacatgcgcggccgccgcggcttgctaagggagggagctgcgggacccgaggcggccagaaggggtctcccgcggcccgcgctgggctccacacttacgctgattttagttgcatccttatttgttacctaaaatgcaaagagggagagagagacgtgaggctcgcggccttctggctaggggaactcggatccgcctttaggcaagggcaccctcctccggcaggctaggaccgaaaccgcccgggggatgggggttgagggcacaaaggacgtccggctttccaagagtttcccaggaggaagcgggctttggagctagcatggtgcctgaccaacgggtggctgccctggtgcacacctgccggctgaactggggagactggatggacaccagggtgggaaggaaagcccctctccttccctctgggcatccttaggccctgccgcgtggctcaaaatcctcccccagctcactgggagccgtgaagaactggagggagggccgctgtgtctggacagcacccagcgggaggctcagtgggagtaactctgggtgggaccctgggagaatgtaggtgtgtgtaggtgtaggtgtgtgtgtaggtgtgtgtgcacgcgagcacactagagtgtgtaagagagtgtgggttttgaggcagacaggcagcgtgggcctgttttcggccacagagaagtggcccctctgtgcccctgagggctggaggtcctgccggctttccggtactcggttttctggtggcctctggaacgcagccgtgggagccctggggtcctcaaagtggcagagggcggggagagcctgatgggaccaagggggcttccttcactacccagcacccatcagagggccgcagccagcgagcacgagcaagcgaccaggctgaggtgtggctctttaggggctgggcgtgaatggagttctgggaggtggtgggaacagcgatgctgtcaaaataattgacaggtttgggggtaaccactgctgactttgaagatgctttgggatgcgaaggtggaagatgggctgcgccacagggcggcgccctgcgcgagtgaagcccgctgcttccctccctgggttagccttcgccgccccgggcgcgagccgggcgcgcgccggtaccgcgtgggcggcgggttaccttgctccgggcgcccggcacgctgagcgccagctcgtgcagcagctcccggggtggctccttgaggtaccaccactgaatctccagcgaatacgaggtggctccgctggcccggaacgcgcagggcatttcgatgtcgtctccctcccgtactgtcacatctttggggacttctgtgaatgcagctgggggtggggagagagagagaggcgtgaccagctgtaggtcgggggcctggggcaacctaaagcgaggcagtcggtctctggctggctggccttgtgccccccaccccgcagctgctccctggcgcacggccggaggggctagcaaagttcggggaagcggctgcagggccgaggcagggaccggccatcggctgcctactgcttccctccggatggggcggggcggcaggggcgactcgtgcttctcccccgcccctggccgcaccgccagagcctggctggggcgcgcctactcccgctccccgcaggcatcctttccgcagccggggccccggcgggactgggaacgactcgggcgcggcgctgctgctgcggcgacccttcgccgctcgcctctccctacccctccgggcccaggctgcacagcgggattgctggagaccgcgaagcttcccggttcgttctctttcttcttcttctcggtggcggccccagcaaagacccccccgagtccacagcggcagcaaagttcccgcgctcaccgtcggccacgaagagcagcagggcatgcagcagcagaggcggcaggtatccgagggcaccgagccggttccgctgttccatctcccgcggggggcgcggtggcggcgggggcccgggagcggagaggcggcggccgcgtgggctcggatcggctccggctcgggctaggacgcctccgagcctgccatggccccgcgcggcgccccctcccctggccgccggcggccgccaatcagccccgctccctcgccggcttgcccggtgcggctccggcggggggcgctgcgcggggtgtgcaggagacgcggtcccaccgggaggctgctggcgatcggtcagtgcctctctctgtccggtcgtccacaggacggtggggatccgcggttcagtctctgcccggcgggccgggcaggggctgggccgcgccgggacccatccctggccgagggagtgcgtgccacggagccgcgagcttctgcctccctgtctccttctggttctgctcccgattgccacctccttcggctcccgcagccgcccccgccggttcctccgcggctctttccgcagggcgagtgggcgctcagccgcggcgcgcagacctggcgtccgacccagcgcagcgcggggagagcgggtccggcgtggcggacccggagccggagagaggcggggagagggggaggggaggggaagggagggggcggtcagtggctgggcgccaagccgcctccaccgctgcatcgcccccgccctcccctctcctgccacagcccgccccgcccccgccccagagcgctccccctctctcctcgggggtcgctcggagggaccaccgtctttctggttggagtacagccccgccccgcacccgcttgggttgggagtcctcccacccaaactctccctggcttcttcccagtctgcacggctcgagacggccgctcatccctgctccccgtgtgtccctcggtcctctctgcagctcccagccctcaactccttaccccagtttgggcaaccagctgccccgctgtttggcccaggcctgggccatgacggatgggtgggcgcccggggccgcgagaagggcggaacgctgtgcccagccggagactacgctgggtggcggcggcagcgccgggagtctgcagtgcgcgagggagaagtgagcgcacagcgcccagcgagcaggtgcctgcggcgcggagagcgcacacgctagccagcccgcagcggccgtgagtgacggcaggggcggcgggggtggggtggggtggggagcgccgggcacgactcagggcccgggaggtttccgggagggggcggggttcctgcccctggatcgcgggtccctgtgtctccacgcgctcttcgccggtcgtggccccttctttgcccggtgcaaagcgagatgccgaggcggcaggaagccggaacccatcccccgcctgctctggcgtactcggcatcccggtacctcccccagccttcacccggagtctgctccctccccagccatctgagggagcgcggtctggtccccgaaggcaaatgcggggtggacatgtggttcggacgcagcgcgtagtcatagtcataggggcgagtcctaaggctcgccttgggtctctcctatctccttcccccgggagtccccagctagtgcgtttcggcacctctgcccctaccccggcccctacgcctcagctctgacctcaggttggggtggggcagcccggtggattcacgtgcctgcttccccggctaccagcctcccggaggcaccgc

SEQ ID NO: 5573 - DNA, 3643 bp, Homo sapiens
cggcgcggcgcgaccagcagccggccccgctcgctcgcagctctgccctcagcggcggccactgggaccgactgcccgcccccgacccaggcaagatgcccaactgcgaccgcgcgccccccaagatcgcctcccgagtctcgccacaggtacacgcgtggcccaaacacttcacctggcccgaaaagtcagcagacgggggaaaaaaaaaaagttgtgcgagcagccagccgggcagtcccggagcccgcggaggccgtcctcccgccgcccagccgcccagccgcccacacgcgaggccggcccggggcggcgcgcagctcgcggcacctcgctcccggctttgcgcgctcaccccggggcgcgccgaggccaccgcagggcacttacttggcacttgcttttgagtgtgcagatcgtcgcggttttcacttgggttttcaaacaagtttcagggagaaagaaggaggcaaaaaaaaaaaatccaattatgcaaatggactccggactgggaggcgcgggatggatctgacgccgctactgtacgagttctcggagcagccccgggccgggcagatttatgggggcgcgtcacggctacgccaggtcccgccgccggagcatctcgaagttaattaaagcggtaatgtccactttcctggcgaccctccgtgcgtgggtttactatttcaccatcaaacccgaccccggcgggggcgggggccctgtccccacgcctctccttccctcttctggccgcccccctctttttcctctctccgtctctcacccctttttcctctctttcgtctctttaagtcgcctgccttccactcagtgaacaatgaacaaagatgtgagtgatgggaaaagatcgccccccctcccaaccccagcagagagcaaagccggtcttaaagtaaaaatccagttgctagtatcaaactgggaaagaaaacagcgcgttcccagtctcaccaccccttccacacacacacacgcacgcacatacacacgcacgcacgcacaccccaccccaagttcacctaagccctggctggagactggggcgtcaaggtcagggcgcgcggggctgcccaactcgccggggacaccagggttggggaacggcgcgtgctctggtcaggcgtgcttcccgcgcccatccccgccggtcccctccgccggccccctccgcgcctctacaccggccgaccaggcccggcggcccgctcgggctgcccggccgccggatgcgctcagcaaacgcggcccctgtcggatttctgctaaattgcacagcggcggcggcggcggcggcggctgccgggagaaggcgcaggaggaaccggagggccgtaccgcgcgctcgctcactccgcccctcccgctcgcccctcgccccggccccgccggccgccggctcccacccgcgcacacgacccagcccccaggacgcaccgggtgcccgagccccgcaggccgggacacctcgcagctgccgtattttctgctaaagtgaaaacgaaggcggctgacaaatcacgtctccggcgaggcacccgttagacataacaatatctggcaaacaaaacccggccgccgctgccacccgcacgcggggctgagaccccgccctgctctttctcggcccccagcccctggccactgcgtcctcaactccaacgctccccgccccccaacattccaatcctccacctaactcgggaacggtggacatgttctccaacaggcacacagtaggaaccactcacaatacagaagtgaaaagggggggacttaactttccacctgtccccaaagaaagccctgccggagttcactccgcagagtgaagagtgagcaacacaggtctctctctgcccagccctttttctttctttttccctaacttccccgcgtttcgaccttcctccacttcacatacatccgtctatatggagatatctatattttaaattatttgcaaaactgcaacagatgggcgcgtcgagatctggacactttcctactcatcaaaggaaagctctcccccaaccctaacttttttttttttgcctaaaatacaccccgagtctcgcctacgactgttttcctcaattcatcttcgaaaaataatgtcttgaagcaaacagaaaaaggcttatcagcaaagatcattcctaccccagtcatgcatctgcgctggggggacgggaggcgtccccccagattgcactcttcccagacgccgcgcaagccctgcctctcctctgccttccagagcccccacgcccgcacttcctcgctctgattggcctcatttctccagcctgggactggccggctcttttccctccataacctgttacttatttatttatttatttcctctttggcccccggctgggcccccaggccgaggcccggctggggcaggtgctgcgggcgccgcctgcgcttgcaggcgccacggcctttcctggggtcgcgggttcggaccctggcacctcagccctgaaaccaactctccggcctcagcctggccaggctcccggggcacaggaggccgatgcaatcacaaaatggcagatctcagcggctctcggcgcccgcaagtttgacacattgtaagcatcagctaactttaattgaaaaaaaaaaaaggttgcaaattaccctctctccacgggcggaggggccggaaccccgcagtgagcgcggaccagagaaagagcgcaaggcgaacccccgtcccaggcagaggagaaaatggggaaagtcacttgagcagaagtttccgcggccccagcctaccccctcccctttttactccccccaccccccagaccctcttgaaagtttcccggggcctgagagtggctcgcgggccgctcgcgggtggggggcgccggccgggtccccggagctggacgcggggtcccgatcgcgcgccgggcgccaggcctcgggactccttttcaaagtaacggtcccgggaccgcgggcggggaggcggcggcccaggcgcaggtcccgctcgccgccgaagttctctagcgccatacgatgcccggccgcagccgccggctcggttttcctcttctttccccccaccccccacccgctgacagcttctctcgccaacgtcacagccacggatatttaattagaccgtattttttaatcgcgatggggcgagaaggaaccgggcggcaggcctcgccgagatggggagggggaggggacgggggggccgcgccaagagtccaaactcactttgccacctcccggacgccgaagctgcccccccacccgccgccgcccccccgcgccgcgccccccgcaccgcgccgcgccccgcgatcccccccccacctttgttttccttaccttaaacattgaaacgcgggcgtcaggagcaaactcgggcacgtaaacggagcgttgtaaaagattgtgttcaatgaataatgaaacatgcccacacgattgacttgatcattttccggggctgaggggggacgggcgccctgctcgcgcgcctcactcgcccactcggcagagccctgcgaactgttcccagcccagccggggcagggcgggctcgattttcatcagcctcttttcagaatcgccccgt

SEQ ID NO: 5574 - DNA, 808 bp, Homo sapiens
cgggacctcccacaccccgggccgcagcgcactgtgcgagtggagggggtgagctccccagcagaggcgcaaggagggtgtagggtgcgcggtgtggctgtgggctgcggacaggggccgggggcgcgcccgggtcggtgccgcgtggtgggagcagcaggcgcgcaggtagcggggagcccccgcgcacccagcccgcgggtgattactatgcggcggcagctgtctccggcgcggtgacggcgcctctaattgatctcattatctcccctccgtaaggtgaagtgcggccgctcgcggggcccgggcgcgggcagggccggctggcagccgcgggccggcgggggcagcgctcggcctcggggtggcactaccgccgggcgccgcgccaacgaacgcaggcggcgggaggctcggcggcggggctcgcgttcctgcaccgcgaccgcgccagaaaacaccccggggctgggcggcgtctcggagacgcattcctttgttactcccaccgtctttggtaacgattattaatgccatcatgtcccatttcccctcaccttcccccgctcccagagccgcgcccgcgcgcccgatctccaggcgcttcgctcctcctggaaccaacaacaatgatcctcaattaaccctctgccagggctgcctgctcgtgaatggggcgctcttccggctcgcgggcggcaggcgccccagcccgggcggggggccagtctccgctcccccggccggacccgcgggggctcgcaatccgcccgggcgccggctgggggtggcctcgcagctcccccgg

SEQ ID NO: 5575 - DNA, 3415 bp, Homo sapiens
cgggggcctttttgcgtgtcccgacatggcagtatggttgctgcgtgcactccgcatagcccgtgttgtgcgtggcgggctgtcgctgcaatgtgcagcccattgacactgatggatgcgccaatggttggacggacagatgttagggcggatcgcacagcgctcggcgcctgagcgggggagggccaggcagcgacccagcggcggcggccggctacgcggagacccgagttcaggccgcggcccgcagtgggagggggccgaaggaacagaggtttgcaagaacagcgaggggatggaaaggaggagaaaagcgcgaccagggagaactacacgcttccgtgtgcggcgccccgcgctgtgcacacgccgcaccgggcgcgcctaagtgggagcttcgaaggtgagctgggagccggcgggagctgaccccgtgcggcgcaacccgcctccaggcgacaggagctcagcgcggccaccagaatggtgaggccgccggcggtgtcggccaactcaccgtttcctcgcttgcaagaagcgtttcacgctccacggccgcgtctccccggcctggaggagtagcggttctggcctctgcggccgcgggcacccaacgcgcacggcgcctcagcccccgagtccgccagcccgagagccccgccgcagcccgcctcggactccctgccccgcctggggtccgtaccccacaactccgagcgctcctgcgcgcggaaaggcgctggaggcggctttatagccggggaggccagcggcggcgcatctgcatcctgggagacgtctggacccagcccaagcccgcaggctgggcgagcggagacttttgatcttaccgtgtgggtgagatcactgtctcccggtctaaaagaaaagaaagcatgctgtgaacttttgaaacaaacttgcaaaaacagtcgtagagaaaaaataaaaaggacacagggcagaaaaagagggagaaagagactaaaaaaagaaaaagataaggggagggggaaggaaggaaggagagaaggaggaagaagtctggggtttgctgctccaggagcgctcaggcagccggtgctggagcgcggggcgcccgccctcgccgggactgtcggcctcggggcctgcgagagcgccagagccccagccggcgcgcccgggcgcagggccgcctcggggatagtgggcccggaggccgcccccgcgctccagcagccgccgcccggcagcgcccggagccggccccggcgcggccgccccattcccggcctgagagctggcccagggagacgcaatcgagcccgcagcgcatcgatgcgccgccgcccgcgccgctcgggctccggctcccgctcagccgccgccgcccgggggtcgcccgcatgagctccggcccacccgcgccctcaccgccgcccgtaagtgagcccgcgtcgccccgccgcccacgccgcccagccagctccttcttgccgcggccagtcggccgggccggcccggagcctcagcgaccccgatcaccaatcaataatcaatccctctagtccagcagccccggcaggccgggcgcgggacacggcgcggcggccccctaggctctcggggggagcccctggcgggggatgggcaggggagcccggtttccttctcccgcccccgtcccgccctaggatcggcccgcgccgtggatggggggcgcggcccggctcccgggggcgaggggcggggtggagggaccctgatcatcccaaagtcaggagaggaaacttgaaggaaccccctcccacaccgacccccgggacgggcccaggaaagtttgtccggggaaaaaaaattgggggaagtggctacggcgggtcctgggggaggagctgggtggcgcggggtctgagggctgcccccacccgccccggcccgcgcccgcctcctccctggagggggcctgcccgtgggctctggcttccccgggggacgccagccccggcccggggaccacgctgggggctccggagtcggcgggtggagaggagtgcgagccgggtggggcagctggggggtggctggggacgaacgctgggtgggaataggggtggggggtaacgagcgccccgggacgggctcggcggggctggcgccgcgcccccgcgtgtgcgcacggggcggaggcggaggggcggcacccctttcgctggcggggcgggggtcccacgcgggcctggggccgggggcgggggcgcggcgcccccgcgggcgggcgattgacacgatcatctccttttcctttaagcttgcctgttgccgacgccgccgctccagccgcgccacgggcagaagactggaccgccgagccccgggccgcggcggcggctgcgcgtccccccggatgccgtgacccccggcctaggggcgggggccggggcagtaccggtccgggccgctcccgcgctcctcctcccaccgctctgcccgccctctccccgccccccagccccgaaccccgcgcacctcgtctggggacggggcgggggggggcagggccgccgctcctccccgccccctcctcctctggcctctggagcgatttgtcaaacttcccattccgccggcagcgcggtcctcctcctcctcctccacctcctcctcctctgcctcctcctcccccccgtgctcctccctccccgagcctccctcgcccgccctccttcttccctccgcacgttcggggttcgcggcggagcgcggcgcgggggggacgcggagagcctgggcgcagcagcatcctgcgggcggccgctctccgggggggaggctgagagcaggcccgcctcgcccccccgcgggcccgccgccccctccctccctgtcctcagcccggcagcggcggcggcggcggcagtggcagtcgccggagaagcatcatgccgaggaggaagcagcaggcgccccggcgcgcagcaggtacgagccgcttccccttccttctgctctcctcctcctcttcctccgctcgccccgcgcctccagcgggcgcgaccccgctcctcgccccgctcttctgcccgcactgagtaactccgggcgccgctctcctgtttgggtgcgtgcgcccgcctcgggtaccgggcgccccccggacgccccgccgcgctctgccctcttccctctcgcacccatttggggagccgctcgcggagcgcgctgagccgcgccaggtccctacctcctcagctctccggctgcagagggaatgggaagcaaccccggcctggctctttctgtgggtggcgggcggggtcacctgagttccccgggacatcttccgcgtcctccgagcggccgaccgccgggggactgcctggtgtccgccgagccagggagcgcgaacgagtgagcgagccggtcccctcgg

SEQ ID NO: 5576 - DNA, 3415 bp, Homo sapiens; identical to SEQ ID NO: 5575

SEQ ID NO: 5577 - DNA, 1592 bp, Homo sapiens
cgtgctctcctccgctgatccggccgcctacccgaggcagtctcggaaccccggaccccagccatgcgcgcagggaactgccgggccgagcgagctcaccgaagtagtcccgcgccgtgcgcgcctcgagcgcccgctccagctcccgggtgagcgcctccagccgccgctcggccgcgcttgggccgccctcccggccagggggcagcgggagtgcaggcagcgggaagggagccggccccgcaggctccggggagcgagcgggcgcggggcaggcgccgggcgggaggaagtcagcgtaggcgccggccgagccccgggagccgaggctggaaacgctggagcgggcgctgcccaccgaaggcggcccgggaccgggacgcgggtccgagcgaccggagcgcgggctgccgtggcgctggtcgtagcccaggctgatgccgctggatcgggcgctgccgccaccgccgccgccgtcggaccccgccaggctggcccgtgggctgcccgcaggctgcgcgctgagctccggaaccgccgcgcgccggggaccccgctccccgcggctcagtccgtccgccccggcctcggggccgccgctgcccttccctctgcggcccagcgcgggcgccgcctcgtctccaggcccaggccgcggcccccgccgcccccgaccgggagagccgcacccgggctccagctcccgcagggccagcccggccaggagtagggccgcctcgtccgcgcccgccctggagcgctgcatggcccggcccgccggccctggcgcgtcacctccgcctccgcttcccgccgccgctccggccgggccgccgcatcgtccgcccgaagcccggagcccgccccgggacccctgggcgcggggcggggcggggccggcgccgggccggggtcgttccggcggccacgcgcgggccgggggacgcggcgccctgctcggcggcgcgcgcggcggaggaatgtaagctcccaggcgccgggccgcgccccctcctcgccgcggcctcgcgcggggcggagggactcctttgcgggggcaggaatgcgaggaaggagacggcgctgcggcctctggaatgtggggggagtggcggcggccgcgctgcgccgggacctcggaggggcgtggaggccgggccaggacgcaggggcgggcggcggaggcaccgcggggagagcccagggtctgcggggcgcccgggccgtcgggccgctgggaagagctcggatttccgcaggctgagctggaggcagctggcgccatccgggccggagagatccaagcagtcgacagctttccccacatcccgccccatctcccttccctgcgccgccttgctctccggcgctgcagggccgacccagctcagcttggaacccacggcgcttcgcccgtcccgcgcccaggaatactgtgcgcctagcgcagatgcgtccccacgaccccctgcctggcccggggccatgtggccgcgcaccggcctctgaagcccccatctgactgctggggaaggcgcccagaactaggagcgggttggttggggactggtcctcgcgctgggtcgcttcgc

SEQ ID NO: 5578 - DNA, 903 bp, Homo sapiens
cgggttcggctggctttcagtaggcttgccggggtctctgcactctgtgtccgggatcctcaatttgcgaatagtctggggaggctgagcgcgagccaggagcggacccgggggtgggggtaagcgccacgtgcgcgccaggtccttggtgtgcccggcaggcggcgctgcgtggctgcggctggctccgagggtgcggggggcggcgacccgggagggaaaacccctgcctcttcccggggcttgctctgcccgtcctttaaactcgccctacaccctccccgactcccgtccttgcaagcgttatctgcagcctcaccggccctcgcaacggtggtggtggttggtggggggtctcgaagcttgcctctggccagccggaccccggtgggagatggaggcagaaattccggcctcctaggagaagggcgtctgctcactcccccactccccggggcttggggagggggctgggcaggggcggaagcgagctggagccgtgtttgtcgcggcgctgcggagtggaacagatggctggggaggggagagggtgcgtggcggggaggaggaggggtgcgggggccggaggatagggaacgaggaatttcgaagcctggagtctcccaggagaagcccccctccccgtcttttcccagaaaggggggcatatatgcgcctgcctttttcccggagagccctggcctctgccctgtggcagaccctgccgcgcaatcctctgccccagggcgcgcccctcacccccaaacccccgccgcgggacggggtggcggggtcaggaccgccaggagcggcccgggtcgcgagggttaatggggccgccctcccaggggcgaggaggcggcgggaaacgggctcggggtggggaacgagttctgggatcgc

SEQ ID NO: 5579 - DNA, 1592 bp, Homo sapiens; identical to SEQ ID NO: 5577

SEQ ID NO: 5580 - DNA, 382 bp, Homo sapiens
cgttttttacctttaatcgcgagacaatacgggtcagaggtcaggaaattatgtcagcaccaatgcgggcgcccacgagtgcggtggaccgatgtggaagggccgggacgcagcccgagtcccagttcccgccgtagcgatggccgatttcccagccgcggacgctgaaagcgaggactccacgccgatgacccttcggcgtaccatgtccggcgggcgcttggccaaacagcccaagactgcggaatcacactcgccactgtgtacctggacgccatctgcagacccagcgcctgcggggattccggaaacgggagagcgggcttccggaaacggtgaccaatgggaaacgtgatcagatgttactaggcgaacagtccgt

SEQ ID NO: 5581 - DNA, 665 bp, Homo sapiens
cggggaagtagggccgcgaaggcctctgggaaatgtagttcggcgcaggaagcagcggaacgattcgattcttctcagcaccaagttgcgctcccaatctctcagagctgggctcgcgggaggccgctcgtgcaaaacctaggctgagctcccctgcgcggagctgtgagccctggaacaccgtggtctgcttctcaggacgcgcaaacagtgaagccagtcccgcccgggtgagccgcgggggcctctgggaagcgtcgcccctggtgtaacggaccgagacttgtggcgctctcagccaccgacagcgccggcctcagtgccgcctctgtcccagcccgcgccggctctgccactttggcagcgttaagtgtggaatcggggcctgtgtccgcgggcttggtggtgagtcctcgggaaaccgctagctctgagcgccggactctttgtgctgggtgggagtgggggcccgcggtcctggtgccccaatctttggaggaggacgccgggcggggcgatgcctgtgcttgtggttccctgaggcagtgggagtggcgtgtgaaggactgtgagagtctggcgtgaagtgactgtcatttgccagacattcgtctggctgagtgtggccccgggatcgtgtccgtaagcggatttcgtggaggcgc

SEQ ID NO: 5582 - DNA, 764 bp, Homo sapiens
cgcgggtatcggcccaacaaggtgcagcgaacagtcgcccgctcccgcctcaactcacagcctcacattccacggtgccattgacttcctcgcacccagtcacacaggacgtggacaggcacacggggtgacagcctcgcactgaacggtaccaacctccactcgcaccggagtcacacagatggcctgcgacgagcttccggagacccacacgccactcctcagcccactcccgacctgcagaacagaactggtggaagatctccttcctgccccgaaggctcggggaatctgcactcgggtctcaccgctacccttagttggatggaacccagcccttacgggcccggaaagaagcgcctcagctgcctccgcccccggaggacacaaaggggccgccggcccaactcccgcggggtccgctgggaaacgtagtccggagtagaaaaggtcgcggcgtcgcagtgtctggcagcagcggtgcagctccgcgcagggtttgtaacacggcctcctccccaccaggtcctcccacactggcctctccccggccttccagagagcccgaaagtccggattccctgcagctccgagcctggcccggtcacagggacggggcccagcgtcacactacacgggctggtgtggaagtgcgcaggcacaagcgctctgcgcgcctcccttagcaaccagggcggggagttgagaatcgcaggttggccgcagggaaaaggtttgtgcgtgggaacgcgctagtggcgcgt

SEQ ID NO: 5583 - DNA, 1394 bp, Homo sapiens
cgatgtcaggtacgtcacaaacgcagacacaaaccgcaaagaccccagagacccgctacagccagcgtcagagtcaggcaccaccgcgcagccttctctgcggcaccatcctaatcccccgctagagaacggcacacgcgcacgcagcagccccgtgcacggaaacactactccgccagcggccaggcactcggtccaggtacgcgggggcgcggcggccgtcactcagcaaacaccacaggcagcacgcgccgcgccttggtccaggctcgcgatactggggtttcctccatccaactcacgccagggtcacggctacaggcctagatttgaacactccatccccatcgggatcctgtagccaacctccaccctcctccaaacctcccgacccctcggcaggtgcggccccacacttctcccttgctccctgaagggccccagcgttcgccccccgcgcgcttgcgcactcgaggcagaagccgatttccaaaggttccggtgaggcgtcgctgggggcggggcggggctcgcagcctccgcctgtctccgagccgagaaccaaatgaaaaataaaaaggcggaatattgtttttttaaattttggaccgcagtgtccacaggggagcaggcctggattatctttaatggcactggtcagtcacggggcggccattacaggtagaggcctgaggcgagggacactgcggcccctctggctccgtctccccggcccgactatccccgccgagacccggccccacgcgcccctcccggcccggagcagctgcgggacttgcctccgcccccccgcgcgctagcgcattcgcgacggagacaggcgctctcccgtattctggcgccgctgactcccagggctgggctatcctctgagtcgggtgaggctggggctgggagccgggcgccactgtggccgctgcttttctgagggaaaagagcgcggagtgggccaggttttgcaggccgggccaaggtggagaaaaggttcctgtggagcctcaggccggtgtgctttttttcccgggactgagcttctgcagccctgaggcctggaggcccgggcggtagtaactgtgccggaccaggttcgtgggtgcggcctgtggtgcagttggagaccgaggccccgcgcatcctcgtccgcgcttcagccacttaggctcggccgtagcgaaaaggcccaagagggaagtcagaggtgaacgccccaggatgaaggtcccctgcaaaacgctgggacctagatttggggtgggtgtctggggtctaggaggacacgctggacagttccgaaaagacacagtgggtggtcccgggcgtgggcaaccgggtgcggaactacagcgtacccggagctgcgaacccagacgcgg

SEQ ID NO: 5584 - DNA, 949 bp, Homo sapiens
cgctccagcgctcccgagtcacacctgtgcggcttattcaacgcgatgcctggacgcagcctccagagaggaggccgggattggaatacgcagccggggaatggttgcaggtggtccagctcccgcccccgccccgcccccgcccgggcctcgtgcggccccgggtgcgcaggtgaaagcccggcctcagcggcctcggccctgccatggaccccgcgcccggcgtcctagatccccgcgccgcgccgcccgcgctcctgggcaccccgcaagccgaggtgctggaggacgtgttgcgggagcagttcgggccgctgccccagctggccgctgtctgccggctcaagcggctgccctcgggcggctactcgtccactgaaaacctccagttggtgctggagcggcggcgtgtggccaacgccaaggagcgtgagcgggtgagggatccctagggtcgacgtccgttccccccttccctgctctaccaccaaacacctggtcaacacccgggggtccgctcaccgcccacccccgctcgaggcgacttcgagctcccgaggcctcccacgcccccagcttgtcaggagaatggcagtggcctccttcttctgcacctccgtgcagctgctcgttggcggccgctgcggtggccgcctcgcccgctaaccctccaggatttgtgcaggacccgggtctgggaggggacagaggaggggccctgacaacttcaaaaatgtctccctgggcaggtgctttaaaagcttcgcgcccagggggtgcgccttcatctcacaccgtaggcgctggtgggtgcttgggacgcgcagggatccccttcgctcctttttcttgctctctgcatctcggcctcgaagcacacacgagggtgaggagaaaggggggcctgacggaagtgacttttcttttttaaagtaacgaaacacgacgt

SEQ ID NO: 5585 - DNA, 1365 bp, Homo sapiens
cgctcaacagcaccgcccggagcgtccacttccccctaccccgtaaaaaaaaaaaacagggccattggttcgggtcgagagccgctttgggaagcgtctctgtcactaagcgctaccccggggtgtgcgagggagtcaagggacgcggagaccgggagcagggctgggtccccttgcagccccagcgctggcctcctgcccaccgcattcaggcgctgcgccgccctcacacccaccctctcccacctcagcagcgtgcgggggaagcctcgcgccggggtctttttcagcaagactgtcgcggtcctcggcttcaactgcaaggtaaacggtggcagagccccttcccactccagccgtgtgtgattctcacactcagtgccctctcctgcactggggcgccggcagtggcgacctaggctctccagcccccgcccagtcccccgcgtgcgggcgccgggaccgcagtacctgtgacgccgaagcccagcaggccgcagacgggagccacgcgcggccctggcacagggtaaaaacctacgctcaggtaggcgggcagccacgatgtcgggcaagcccagggcagacccccggtggcgcacagggaagcagcggtccagaaggccgggtggacgcaggcggagcccgacggctgggaggccgccggcgcgcaggggtcgggcctcgccaggatggcctcgaccgagaaaggggactcgaagcgtccgggagcgcggggcgtgttcgggccagtaggggacctgggcgccggagagcggccagagcgcggaggtcggacccgagagcccgagggagcgggtggcgggctgcctcgcggcctggggctaggcatgacgcggccgttgcccggacggacgcaaggaagggagctcgggagaagtgagaagattctgcaaaaggcagcgagcaagaccggttgtctgggaacctcctggcgctcggcgaaggctcttaaatttggcggggcggggcatggggcggcctctccccactgcggtccgggcggggcccccaaagcctgtgagcgcccgctctgtgcgaggcaaggtgggcacagcaccaaagagtgtgttccctcccttcctccgcttttaaaaatgcccaccctggggcggtcgtggggaggactctgagctcgctggtgatcctgggcgaaacacccagccaccgggctccgtctttctcctttgctcactgaagaagggatgcccgtttccccggggccttgcagaggcggagctgtgatctggagagcggtagggcagtgcctgcggtcttggcctcagctgacccgcgccgtccttgacgcagaagcctcggccagattcacctaggaccgcgcgg

SEQ ID NO: 5586 - DNA, 2638 bp, Homo sapiens
cgtcgacagcgaagtggcaggcaatgggaatctgggcgggaagcaaagaactactacgattcacatcgcgcccaagcagcagcacgcgggaacctggcacacagtaggtaggcgttcacccaacatctgtcatcggacccagcacctgggcagggagcctaggggtggagtggcggcttgggggacacaaaggcctcgccagcccccagctgcgcccctcgcaacgcggggggcgggagtttagagccagagagagggggcgaaggaatccgccctcatttgcacgtcgtctggggcccggtcaatttgcttaatcaccgctctaaatgccagcgggcagcacacaatacgcgcccattaacaggtttaaagtgtcgcagcgctcgctttaaatgagaaaagcaggcgacaaaagggggaaaaagccaagttcctcaacttgaagaatgccttgggtcgcctcgaaatcatctacgcgagtttaaaattcggagctagctccgcagaaaagctgaggccccggtgcgagggctgggggtgggaacgggggctgtgaataacccgccacgaaaactgggtttcttaggaaccagcctgcagccgcccagtgaacccggagtcggaggacaacgtcgccaacccagctccctaggccccttgccccactgccagagaaagctgaccgatttccaagaaggaaagcgagacccccccaaagcgggcacaaatccaagtttccttcggtgcaggcgaagaattctggaggccaaggaagatcccagaggtggactccaaaacctcaacccgcaagaggggaaaagttaaagtaactttactttcatccaggcactggccagcgcagcctcgcgctcggccgccagagagtagttcaactccgcaaacaagttctgcttgggatcggcgcagaaggccccatcccccactccatggccaagcccgggggcgcatcctgcgggccgcggcctcccaccctccccggcgcgcccgacgggcactcacggtgcgcgctcctccgggagacaggggtccgttggagaggtacgggctgctcaggtccgggatcatcaggaaggggtacccagggtacgggggtcctttaaagaacgcgctgtcctgaggccttctcactgcgaacaagaccaaggcgaggtgaggcccaggcccccgggactgacagcgccgcggcagggggctcgaggcgggagctggggaccccagcgccccccacgcgcgccccacgggggctgccgccaataaaggcggagggcaagggtgcgtccacccaagcaagggggacggtgggccgcccgggctgagcagcggagcgcagcgggaatcgagagtggggggctgtcccagcgggcacataccttcggcgaaatagtcccgcggcttctggaaagtgtcccggacgggctgcgggcgcctctccgcctgcggaggagacacaaaggcaagagcgggtgagcggacgcagggccgggatcccccgggggtggccgcggtgcttccttacctccgagtccgagctgctgctctggttctccgactcgttgaccagggacgacttgacctcgtctaggtcccgctgcgccgaggcgctatcgctgctcggctcctgctcctcgcccccctcgtcctggaaggggatcagctcgtcgttcgccccgaggtcgtcccctccgccggccgccccggcgctggagccgccgcctcccccgctgccgccgccgccgccgccgcccccgccgccgagctggggcatggtggggccgcgggccggggccgccgctctcggagcccctagccgcccgcgccctgcccggcccggcccggcgcccctcccgcccgcttgcgggcccgctgcgctagccgccgcaacaaagtttgacagggcgtggccccgcgggaagcgggcccggcgctgcccggccggggcgcaggcggctcggctcgggcccctccggcagcgccgagcctagggctccccaactcgccaccgccgccgcctgctccgccggggcgtcccagcccctggcccgccggggaggggcgagcggggagggagggaggagggaccgccgggctgggcaggggggccggagggaggagccccggctgcaagctgacacccgcgcgcctcgcggaacccggagagctgcggtgcgcgcgcacacacacacatacacacgcactcacactcacacgttcacactcgcatcttccaggggctgcgtctccctgcaacgtgcaccgcccccaaccccctcctgcgcctcacactgcaccctcggcggccctccccacggcctccctggagtcctggaagtcttgcgcccacccctccgcatcccctaactttctcccaaagaacctccagaactccgcgcaggttcccaccccctcccaccgtatcggcgcgcgggcgggcggcactgccccctgcgggaaagcctcggacgcacatactggccgcggggccctccccctgcctagagtccctccgagtgcgcgagctgatgcacggactaggacactggggacatctatggaaccccggaaaatgcccggcggctttccgcgcctttttcctgtggggttccaacgcgacccccgg

SEQ ID NO: 5587 - DNA, 1531 bp, Homo sapiens
cgaaagcccgtacaaaccgcacagaaaacgaataaatgcttcccgaatgtgagcgaacctacagtttggttagaaaaactcaacactgatttccgttcctccaatcacagaatccccgaggagaaggggacacgccaagcgggcctgttaataacctctaccgtataccccaaagcgttgtaaatcacatcgattattttcgactggaagccgatcggttgagactggacgtgaattccgcgactcgatcacaaaaggttaggaggaaagaggtagaaaagccaaaaggatgactaggcaggtggcccgagcggccaccccaagttaactttttagaaatcattcgtactgttcgggttatcttctctttaatattcgtggctttacttattatgatgttaagaaacgtgggctaggaatggggtgctgctttttgcccgaaacctggaggcgccggcctcccagacgctcccgggcccgggcagaggggcggtaggggcggggcgggcgggctccgggtttgggcgcgcgggcaggtggggcgtggcgggggcgtggagagcccaggcccgcggccaccgccccgctccgggccggcccaggaggagccgcgccgggctcggttataagaggccggctagcaggcgctccgctagcacccgcccgaccccggcccggagcaccgggcgcccagcgcgggtgaaggcggagccgcagggttggcccccaaagggatgctctcgcccgagcggcgagaccagccccgctcgcccctcgccgcggccgcgccgcagccgcccacggccgccgacatggccctctactgcggcgacaacttcggagtgtattcgcagcccggcctgcccccgcccgccgccaccgccgccgccccgggcgcccccccggcagccagggcgccttacgggctggccgactacgccgcgccgccggccgccgccgccaacccctacctgtggctcaacgggcccggcgtgggaggcccgccctccgccgccgccgcagccgccgccgcgtacctgggcgctccgccgccgccgccgccccccggggccgcggccgggccctttctgcagccaccgcctgccgccggcacttcggctgctctcagcggcccttcgcgcagcccgcgcccgccgcgcccgcctcgcccgccgcgcccgcggggcccggggagctgggctggctgtccatggccagccgcgaggacctgatgaagatggtgcggccgccctactcgtattcggcgctcatcgccatggccattcagagcgcgcccgagcgcaaactcactctcagccacatctaccagttcgtcgccgatagcttccccttctaccagcgcagcaaggccggctggcagaactccatccgccacaacctgtcgctcaacgactgcttcaagaaggtgccccgcgacgaggacgacccaggtgagggccgctggcaggtgcttcccagccggggagggcggacgcgggtcgcaagggccggcgcaggggtcggtgtgcgg

SEQ ID NO: 5588 - DNA, 2045 bp, Homo sapiens
cggcgtcctcgctctgtctgcattttccttcattgctctttcacgtttggaatgcccccgtctctgcagcctgcagacagcggaaaccgcgggtgcaaatgtgcaggggccgctgacatgaccggctgcagaagcccactcagggttacccgaacaggctagcgttcgggattgcacaagaggtcaggcgatgctgtgggcttccaaatttgtacagctgcgacactctgcgacgtgccaccctatccccagtggggtggggtgggggattccctccgcagtccgctgaaagcgaggcaggaatcactgcaactcctctgctcaggctgaggtcgccaccgctccgcggatgcacgcgctgcaggggcgccttccgccgcgggcacggcgcgggaagggatggggtctggtgggagtgggcaggtggcgggagaggcgcgtgtccgtgcactagaggcccccgtgcgtgacacaggccgatgagctcctgcgggctgcacccacgcggagtcacagaccgaaaaggtcagccggtggccggtgtgctaacatatatagagagacgcccgccaggcgcgccgcaggctgggacgaggctaggagggcccaggctggaggagggctgaggagggctgcgggggcgggccccggcgcagggcgcccggagcggagggggcgggcccgaggcggggcgggccgcggcgctgacgggctgtcgccgctgcactcgcctccagcccgcggtgtcgagcgcaggcggaggtacatggccccgacgggaggcgcgcggcgagcacccggagctcggctccctgcctgagcacggcagccgcgcctccgcccgcgcgtcctcgcccctccggccggcagcccgcggacatgatcgtgtagcctcctcctgggctgggatttgtttgaagattttcttcatggaagcgatgtccccccagcaggagactctagggggacagccggggcgctcctcttccctgacaggagtgtctcggctcgcgggaggcagctgcaccaagaaggtgaggacgctgagcgggggcccgtgccctccgccgccgcagcccccactgccggcgcgcgccctccgcgcccgccacagcagcgcgctaggcggacgccgcgggaatttgacgctcgaggctcgcggcccctaatgagagtcccagaacacttcccgcccttgacggccagcggcagcgccgccgcctcccgcagagcgcccgcttctccgtttctagagccttagtctctcctcgagcgacctcgcagcctccctcccgtctccatccgccgccggttctgcagcccggctcctccctcagtctaggcgcgcgggctgtagtgggcgatcgcctttccccgacccctcgccgtgcccctgggcctcccgaagtggcctgggcgagcactgactgccctttggcggtgtcagccccaaagtcagggccggcgatgtctgcccgggagcggcagccggcgctgaagaaggtaggcagcggggctgcggcgctggtgggctcggccccctcacctgcccgccgaggcgcggctgctccatagcagttttcggggggcagatatggggagtactgccccccacaccagggtcctggatgattccgggtctcccaggtgggggtcacagtttgaggggcgactgtggatgataacgctcgacactacggggacatgtaggttcggctgggcctagaaccgagcagggtgggggcgggtgggctgtggttgggggtcctgagggctgaggtgggggaccttctccctgcactggtccctggcccctgggactctggccgggctggatagggatccgggtgtcggtgtgggcgtgggggcagcgcgtgttccctgtcaaagctgggagagggatgcaggtgacaacttgtagcgttccattccgataaacacggccgctgtgctgcgggaggattccgatccgggtcaggtttcgctggaacggttccctgagcaagtgcacgtgggccgcgggctgccggcctctgccgtttcgc

SEQ ID NO: 5589 - DNA, 476 bp, Homo sapiens
cgggcgacacgccctgggagggcgggctggcggcttctccagctcggagcgcgtggaggctgcgcgtaggggtccgggacgcgggacagggactccgcgcagcccaggcgccggggaaccggggctggagtcggggatctgagcccagcggacgcctcctccgcctggaggcccggcacggaccgggacaccagggcgtccgtggccgtggctcggcccctggctgctgcgggccgcggcctccagtgggtccccaggacccttccccacggcgggtactcaccgaggctgagaggccacgccgtgctgttggggcttctcgtcgaccacattcctgggcgtcagcccgggcagagaccgcggggactggccaggccgggccaggccgggccgggggagggtcgcgctcccgggctcctgaccctcggcggcgagaggaagcggcacctgggtcacactcctcccgcgcgggccga

SEQ ID NO: 5590 - DNA, 455 bp, Homo sapiens
cgcccttgcccagcgaggaccgtgcagaagcgggaaccgggcactggagggcgcgcgcggcacgcgcatctcggctggcacctcctggctccgcggggccggaaagaacctcgaatactcggtcttaaaaggctcctagtcatcccgttccttccactcctcacagcacagatggggaaactgaggcctggagaataagcgtggcatacccagggtcaccggaagagtaatgagctgaaccagagaggaggaacgggaagcgagacttctaagcaatgcggggtggcccccgggccaccggaggaggcatggtcgggcacgtccccaagtttcggtacccgtggtggctgtgccagccgatatgagcccctccctctctaggaaggcgcaggactcggggaagcctccgcggccaggccgcctgcctacccgcagaccccgggcgccgcccgcgt

SEQ ID NO: 5591 - DNA, 749 bp, Homo sapiens
cggggacccgagcccccgggctgaggaccgcgggggaccccaggtcgggacggagcctcctctggctcgctgtgcgcgcacgcctggaaaggcgggatttaaggcagcgatgctgcgggaggctctgcagtgtcaacgagcccccgaacggttccgcctcattccctctctgtgtgcctcgcaagtctctgcttagtaaaccgtcacagcttcggcgcgcgagagtggcgttggcacgtccaaaccccggggtcctcggccaggccaggggggcgggcgtgcggcggggccgggccgggccgggcgcgcccagcgggctccgggcacacgcccctcacctgggcgaggcccggtgcgcaggcgctcagcgcgggggcagcggccgggcgcttaagcccggcgcgggcaagagttggacagttcaggggccgcgccgggccgagctgtcgcccgcgccacctccaccgccgccgctgctaccgccaccgccaccgcctgggctgcagcagatcgcgggagaacgtctgcgcgaagccccggtgcagccctggcgggaccgcagcaaccaccggagcgtgagcaacagcttcccggctggaggagccactgccccacgcgcccgcggcccgcgcgccgaggtaagctctgggcgcccagcccagaccggcgcccccggactgggcgccctctgcttgcccggcccccgccctcctccgcagagcgagcctgcacctgggcgcgccgcccga

SEQ ID NO: 5592 - DNA, 1134 bp, Homo sapiens
cgaggagggcggggcgcccggtccccagtcgcgcggccaccgcctgcccagcctggctggatttgagcccggcccgccgatcgctggccgaggcgcagctgaagcagccccccagccgcggcgcccccactttccaactccacggttcctgcggcgcgggcgcgatgcagctggcccggggtgaaggcaaggcgcggggcgcggggcgcggggcactgggagcgaggcactggcgcgggatgcccggcgcaaggtgcagggcgcgggccgctctctttccgcgtccccccacctcgccaaagtttttccacgatggtccctaccccggctgggtcagccccgtaatcctcgcctgtctcttgtctcctctttcctccccgagccgcggggctcccggggcgcgcggacccccgccaggggccgtgtaggcgcggagccccagccggcctgccttgggtccgaagaaagttgtggcttggagctagtcctccttctacgacccctgggggcgtccttccttctttttgagcccgcgatgggaaggcgctcccaccccatccccggggtctctgagacttcctggcgaggtggggcggcgcggcaggtgcagggctggggagggcctgacagccctggagagtgcccgaccccagtccgccgccgtcttctaggcggattccccagaggcaggtcccagtccccggcgcggggaggcggcgcgcttcagaggggcgcagggtgcgcgggggccgttggccctccgggcacttcccctttgcggtctccccgccctccttcggagctggtgcctgaggtcgctgggacctcagcctggcgtcttctctcgccccgagcgaggcaggtgccgtgggcggccccggctacttctgcatttcgagcgcttactttgcattcagctctaagtcggagagctctggggacagccgagagtgccagtggcctcatagggagactgagggttctgtttcacctcgggcgccgtgtgggtctgggctgtccacagcacctctgcgcctcagtgataggagaagccaagcgcgaggcctctcaacagctgcgtgcactctatttcccaggtatctggaatcccggcgcctagaacgtgtttttcgg

SEQ ID NO: 5593 - DNA, 1645 bp, Homo sapiens
cggcgctttccttccggaaaggacgctggattcagggcgcgccagtacgcgcagtagcggcccgcgagtcggcaggtgggtagccccggcgcgggaggaaggggaagttaccttcccctcggaagagggcgctggctcccccatcctgcctttataataaggccaccggaggagaggaagcagccagctgccgtctgcgctttgcaaagcatgcagttaggggagcagctcttggtgagctcagtgaacctgcctggcgcgcacttctacccgctggagagtgcgcgaggcggcagcggcgggagcgctggccacctccccagcgcggccccctctcctcagaagttggacttagacaaagcgtccaagaagttttccggcagtctctcctgcgaggcggtgagcggggagcccgcagccgccagcgcaggggcccccgcggccatgcttagtgacaccgacgccggggacgcatttgccagcgctgcggcagtggccaagccggggcccccggacggccgcaagggctccccctgcggggaggaggagctgccctccgccgctgcagccgccgccgccgccgccgccgcggctgcggccactgcgcgctactccatggacagcctgagctccgagcggtactacctccagtcccccggtcctcaggggtcggagctggctgcgccctgctcactcttcccgtaccaggcggcggctggggcgccccacggacctgtgtacccggctcctaacggggcgcgctacccctacggctccatgctgccccccggcggcttccccgcggctgtgtgcccacccgggagggcgcagttcggcccaggagccggtgcgggcagtggcgcgggcggtagcagcggcgggggcggcggcccgggcacctatcagtacagccagggggctccgctctacgggccgtaccctggagccgcagcggcgggatcttgcggaggactggggggcctgggggttccaggttctggcttccgtgcccacgtctacctgtgcaaccggcctctgtggctcaaattccaccgccaccaaactgagatgatcattacgaaacagggcaggtgagcgcagcgtggaggggcccctgggttcggggataaagggtgacgtgtggtcctggggaaggtccgggatgagggagctgaacccagttgttccgcgcggtgcttagagtgtttcaccgcgcgcaataaatctccgtagacaccgcatctccaatgcggtgtccctctgtgtcagtgccccggcggctcttgcagggtgccaatgttacggctgtacaccgcttttccctcccatcatcctcacctgaacagacctggaggaggcggaaatggaaattagggcatgtccacaagctggattcgttagatcctcctgctcggcggtatgcttgtgcatgcctgcatgccggcaaggagccacggatagggaaggctcaagagctggccacctgagcgcagtagatgggctcccgcagttttaggcgccagggtctccacggggcgtctccgggaggtgggcatgaaggctagagcgccggcctcggaagctcggtcggagtaggtggttagatctgccctggagccagacctggctcgggttcggtgcgcga

SEQ ID NO: 5594 - DNA, 4698 bp, Homo sapiens
cgcacggactcgcgttcgcatccgaagaccccacacgtcccccgcactgtccccacagcatcccacgcccgcggtgcacgctcacctgccggtagacgagccacacgcctcggcggtccagacttccgtgtcgacctccgtgggcgagcctacgcgctgggtgcccggcgcgccctcaggagtggctgggaccgcgggctggcgccgggcagggcggtgggacgcctggagccggcgggaggagcacgcccaggcgggtccgcgccgagcccgagcgagcgggcgagccgggcgggaggggccatttgtaaccgagcagacgctaccaccgccccttactcgcggggggcgggggcgggcggtcaggtgacggcggcccaccctccgccgccgagccgggtggttcctgcccgggaggagccccctggcgcgctctgattggaactcccgccgcagtggcgggggaggggggacacgtgaccgcccggccaggcggcccggcgcgccccattcgcgatgggcaccccatcttcctcctggaaaagccgggggacacagagaaggcggaggagcacgcggggtgcaggagagcctaccagcccctttagccgcagtgctggtgattccggccgctgaacccggagaggaaaggctcccacgcggccagccggccttgactgtcctctcgccctgcccttggccgcagtaccctcccctcggctgcagtaaccgccccctacacctccaggcaagggcacgctcagtgtagaccactgccacttcatagatgccagtgccacttaagagtggtgttgggttttttttttttcctttcctcctctctgcacaccagcacattgtacccgagagaaactcacggcggtgcactgcagacaccgcccagctccagggcccgaagaccctccgaccaggccccgggatgcctgaggtctcccaggtcattacgtggaggaactcaggcctgctccctgcgcaggaggaggaggcgtcgcgggagctgcagtccccgatccttcccaggaagccggccgggtggaaggggagagggccgttatcgtggtgcgaatccaactcgcagcctctgggagcacgttgctaataaaggtcaaattaaaacaactaagtggtgccggcagggacgcgccgcatggtcaggagaagcccggctattaatcatccataaggagcattgctcttctggtgtgggagaatggggctgtgcgacagccccccggagttgcgctctgctctgaaccctaagctcccccagagcaagtggattgcgcagcctattaccccacctccccacggccccctcttggggcggcaccaccctagatggcaggaattcggagaaaatgcggtgtcacgtccgccgctatgcccgcacacgcgtctgcgccaactccagcaacacgtggggaccgtgaatctgggcgtctgctctccacttaggtggttatgtgggtatacttatatgattactgattaaaaccaaattggacggagaagtctgtttctacactggattctttcaaacttctgtccaagggagttttgcgctcgatttgggcggggacgcagttttcagccaagaccgccgcagcgctcagcagagcccggggaccggtggtggtggtggcgggatggggaggaacagaggcccttgattctttggtactccactttctttccttatttagaccagtcgggcaacacgtccctcgcccaagatggcctttccaactggaacgtgactcagacaatgtggaagccaggggtccttgacccatcgtacctgggcttcgctgggcataggacaagggttgggcaggtttacctggaaagggagtttattcgtaaagcttcgggcataaacgctagatagcgaaactttgaggaagctcaaagtttacctattgtaaattggtggggggtgggggagcatcttatgtaaaaaggaacggccctattaaattagtaagtatcttattttcgtagtggacgtcttgctgcccttggtcctcccctcccccacctcatttctccaaaccaccaaggttggagaaatctcataaacaaagtataagtccgtggggggggggggggggggttacttggtgttttaaaaaaacaacaacaacaaacgacctttgtaataagaaaggtgggtacgttttcatttctaggtcttaatcttaacgttacggccacgttaaaattgaagttgattgagacaagagaatcccagagcacagcacgcagacagacaatttcacaattaaaaaatatgtacttccttctccccgctctcgtcacctccccctttccccgccattacctactcccgtttggactaggggctgggagaggaggaggatgtagtccctccgagtgcacaagggaggcggcggggccacttgttgctgcaccgccagaagagctaattccgagcggatctggcagggagttaaaacccttctcctggatgcgacgccccagagaccgaggcagacggcgagaacagattcagcgcctcgagatgtgctttccaatttgaactctggaccatctttgcttgaaatgctttgtcttgcacgtctgggaattactctgtgcgattaaacgcgtgacacacacacgcatacgcggggtcgccccgcaggggggagggtgcgtggcacaggagcctcggactttcaggggctctgcacttggggagtggtgcgagggggaccgcctcggtgtggctgctgacgtgagacaggtaactcggaaaggtcttcctccggctgccttggtaatgggaagctgtgggcaaaggtgcaggggcggtcccggagcgcacacggcgcagtccgcagtgaagggcagtggtgtggtggggcagagagactagacaagggcaggcgggttttgccgattccgagttcatccgtctacggggtcacgttctgttgagaaaatgcgcgacacccggtagggagagagtgacactgaccaagtgtccctggagggccgagccgtttgccctcgggagggggtcgcgaggcccgtcagcactcggctcccgcggaagctgtgctagcgcggcagtctcgccggcgcctggccccaccagcctttgccttcagcgtcctccggtggcatcgtccgagatttgcggagcagaagccgaggacacgagcaactcgctgtgggcttgaagtgaccacgccttagggctgtgaaaagctgccccgtggtgacttgggtacgaggaggttaataaagtgcagaattagtcttgatttttacctaaaatgaagctggtagtactgagcgcttaaatgactccgctaggaccctggaggttgtgggagcggggtgggagagggtaaatgctaggtttaggacaacacaggatatgtctaatttaaggaagctccccttctcgggccacgttctctgtagctctacccaactggaatcgcctctgcacccggggtcatctccggcattatgacacccagcgttgccctctaaactccaagtccccgcggccacatccttccgtgcctgctggcaccagcaagagtctctgcctgccctttctcctttacatggacccttttcctttcacccctagaccgcagtgcgactggcaggcacctcttcgccccctccgcgccccgcgccgacggtgggaacagcagcgacagcgcgaccgcagccttctagtgccttcgccccctcccccgcggccacacctcacccacctcacccgccaaaccccgcactccgccgccgtccctcccctgcgcgctcccggcgccaacccagccagaagcgggtggaagcccgggtccatgtgcaggtgtccttgtgcgggagtaggggagctcataggtcagcgatccgcgaccctaccctgccctcagctcggggtccacccacgtggaacccgccggcccccgcgggtacccaacaccagtctcccgggctcggctgccgttccctcgaagccccagggcgctcccacgggtcaatgaccacctcagtctttcctcaagccagggtttggccagttgggaaacctcttcgtcccctgcccacatcccctggcatctccggacaaagccactcggcttcccgccccggcatcgggaaagatgcgcgtggagagcgcctccaggcgctgggccacggtcccggtccctggccgtgcctgctgtgtgcggagctggggcggcgggtaccgcctgcgcggggcaggcaccccactcgccgttcctccagcacgggcactcgaccgccgcggcgctgcaggaaggaggccccgccgcgccggttcctccacacccacgtgcccctcgtgtgcgcgcccccggcctgcagatgctacaaggctggcgccgcctggatttccgggcggccccaccctccgcggccgctacgcctcgctccctgcattcagtctccttggcgtctccgctgcagcatccaagaccaggcgccgcctctgctagccgtgctgcccagcacgcctgagggccgctgccggcaggcctcacctcccgcccgggtcccccactcacctttccttctggacggtggggttcaagctctgcactggggctgttaagccaccgcccacgacctcctgtagggtgcagcgggagggcgttcccgaggcgc

SEQ ID NO: 5595 - DNA, 462 bp, Homo sapiens
cggctcgtaaactgattatgaaacatacgatgttaattcggagctgcatttcccagctgggcactctcgcgcgctggtccccggggcctcgccccccaccccctgcccttccctcccgcgtcctgcccccatcctccaccccccgcgctggccaccccgcctccttggcagcctctggcggcagcgcgctccactcgcctccgtgctcctctcgcccatggaattaattctggctccacttgttgctcggcccaggttggggagaggacggagggtggccgcagcgggttcctgagtgaattacccaggagggactgagcacagcaccaactagaggggggccagggggtgcgggactcgagcgagcaggaaggaggcagcgcctggcaccagggctttgactcaacagaattgagacacgtttgtaatcgctggcgtgccccgcgcacaggatcccagcga

SEQ ID NO: 5596 - DNA, 300 bp, Homo sapiens
cgctgcaaaacagccgccgggtgcagtgggccgggcgctcggccaccctggctgcgatcatcgcagcctcccaaaggatgcgggcagatgcagacggctctggcccatctgtccctaaaggcctgggactgtgcttgcgtgctccgggagggtacccgaaacctgggagctctccggcgctcccagcctcgggtatctggggctctttgtctcccaacagcactaatcctgagaacaacgcgcaccgaaggcggaggcccctgtgctttggacaagcccgccacgggcaagccagttcga

SEQ ID NO: 5597 - DNA, 554 bp, Homo sapiens
cgccggggcggggattaccttgtagcaggagcccgcagacactgtagaagcggagaacggcgctgcgtttccaaatcatggtcccttctctaaagggctggggaaggaacgagggggcaagtagatgctggtgagcggggcacgagagtgcagggctccgctggtgtcctcctcccggcgcccgccggacccaccgtccccaccgctgcggtgttcgaacccgcggactcggatcggcggcagcagaagcggcagcggcaaagcacccgcagaatggggtatcgcgaaatagtttcttctcctcctcctcctgctggtggtgcagccgcgacagcccgtcttccaggcaggggtttggagcttgccttcctctcggcgcgcacagcaagtcccagagcccgccggggctgcccgagcaggtggtgcagggatgccggggtgttggagaaggtgcgggcgagggctgcaaggagtgggtaggtcacggaggggaagggctgggggagaggaggagcaagcaagcagcactgccgctcgcgcccggggtgtctcgg

SEQ ID NO: 5598 - DNA, 1153 bp, Homo sapiens
cggcgcacacaagttgaggactgccgaggcgtctcctgcgaggtaaacacgaagtcgcttggttagtgagaagaaacccgaggtggcctctggggcagacagagcaggacctgcttctgccccttgccctcctcgtcctcctctctccagcggcggcgaccgcagtaacagcggcagtggcggctgctgccactgctctgccgctgccgagccggtcacctgggcacccgcggagccgcgccgctgctaccgccccggcggcctcccggagtgcgcggagggggcggcggaggagcgagatatccatagtaaccgaggatgcgaggggcgcccagcagcagcgagtgcctgggagccaggaggaggcccccgcgcgccggcaacccccagtgctaggcgccctgcagcccccgcgcgccgcgcctgggcccgcatcgctctcgcagtgagggtccgcccgagcggtaagccctccccggcggccaagccgacacctcccccccgcctcgccgcccaccccgggcagcagccgcggaacaatggagagcgcagccagcagccctggagacggcgttcgggggaggacgcgccgccgccgccgccgctgccgccagggcaggcgcgcgccgcgtggagccgggcgggtgcgagggcgcgcggcggggggtggggggcacgcgccgcgcggggggcgggggcagtggggggcgcgcgcgcgggcccggggagctcgcggggagagcccggcgctcggcgcagcgcggcgcggccaagctccgcgcctctcccgcccttcctcggcgcgctcgccctcgcctcgccgctcgcattcgctgggggcgcccagaaagatgcacagaggcaacggctaggggagcggaggttcaagccacatgtctgcgtcctcgggggccagagcccgccagccctcgcggatcccggctcgcggccagcccgagcggctcgggtgagtagcggcacagcggccccctcgctccgcggcccccgctcgccgagacgtggctccaagaagtggtgccgcagccggggcagaggcggaggaagccgagtcgggcaagccgggaaggctgcggagacgctttgccggggcaggtgttgcagcctcagctagcggtctctacggagggggcgg

SEQ ID NO: 5599 - DNA, 1603 bp, Homo sapiens
cggcccgcagggggtgtcccggggcgccccctgcgcgaggtcccgggaacagggcacgagggtccaggctgcccagttgcaggtgcagctgcttcggaggaggacgctgcctgcggcgccggggagctcctcgcggctggaggcgaggggaattgcatccaccacagtgtcccgcttgcgcgaggactattcacttgggccggagagagcgcgcgcgcgcaagagcgagctcgggctgtggtttgggggaggggagcgagggggcggggagcgcctcaccgcgaggacgggggcggggacggactgccaggtggggcgggcagttggggcggcccgaggacctctcccgactcaagtgggcacttgcggagccaaaagcaggggaggcgctgcagctgtgaagaggcgtgggggccgcgggaactttcctctggccggtgcgatgaaagccgggcggacgaggtggctcaacggggctgagagtggttcggccgaggcgcgggctgagccctcagcacctggcctgagcggcgtgggcagcagcctgcaccgcggacacctccaactctgccgcgtctgcgccgcactctggccgtggcagcgattttccgggcatctctgaggccgcccttagtcccacaagcacttagccgcccatttcagagcagcggcgccgaccgttttaagaggagtcagttcccgacaccgcctcccacttacttctccacatttccaccgctggagggggtgagtgccgtggacaggcgctcccgtccggggacagctcagcggcggcagtcagcccgaccctcctccgcgcgggtcgcccaaacttgaccagcagagcgagcggctcagcgcagtagccgccttcgcggcttccagttgtagaaaagcaaagcgccgggaggaagcagcagagggggggttacatgaggctggaaagtggcgggtgtacggcgcccgggatcgccgaggtccttgcgtcgccttgcggaggtgacttcgcggtggaggtcacgagcatcgtcgcagccttgacgctgggattcaggggtccccgagcgtccacggcgtggtggcgtcgggccgcgctctcctagcagtccaagggccgagtggcgcgtggccacatccacagcagcgcaggggcgccgtgggctgacggctctccccgcgcgagccgccccctcgcggcacccactccctccccgcgctcgggtctcccggaagccgaggcgcgggccacttggtgggactccgcggcccccgccccagggccggggcaacgcggcgtgctgactgggaggaccctcggcgtccgcggtctccaccacctcgccccgcggcggaggcgggcgcccagggcagggacggagcccggagcgctgcagagcccggccaagcccagccttctcccggcctggcagccgcggctcggatgccgccagttcggcgctagagggggttagtcgacaacaaaaatgcctgcaccgctcgcaggtggaggcggctcatcaggccaggaaccgaaaggagggagggatgctgtcaggctaaacttaacgccttggttaagggcgcgtcaaggaaaccgtatcgc

SEQ ID NO: 5600 - DNA, 1411 bp, Homo sapiens
cggtccccgctactcgggtggatcctgcttaccgcgagcggggaggcggttgccttccgtgcaggatttccgttgagggctcacaataagcggtctcaagcgggggcacattccccgccacttccgcggtccctcaaacaaacaaagaagccaaagtcggctgtcccaagaccaatgtaagcgcttaggaagctttgaggcgcttgagggcgaggcaggctgccgtgggcaggtgtgaacacctcagccctcgcggcgggtttggagccgcccagcgtaggaagagggcagaagtgggctcgcgtctatgcgggtattcgaaatgaaaaagagctgcaaacggcacaaaagtccgggggctaggcgcaggaaaacagagcaagggagctgccttagttctcaaacactgcatatggatgggtgttccgcggaagattattctagaccctgtgaaagaagtctccactgggcgccggccacggcattggggtgcgcgcctgctctgcgagaagggtcccccaggccgcgcgggggaacgcaggagacgcctgtccccgggggaaccagcggaggattgtttcatttcaaagtgaaaatctgcaggctttgggaaacgatattcaaaaaagtatataatctccatatgccgctcaatggaggatcctcataatttacagcggcagataaggctagagggtgtaataaaaaatctgaagccctcccctcccccctcgccgcctccccggaattgcaccttgggcagcggagcagaatccggaatgtgaacttctcccgacatatgtttcccgcagataagtaaacaatctggacgtgaaatggaaatggtaattaatgcagtaatgctgttacacctcgagtgtgcaaatcccattgactcgccgcgccacggggggtgccgggcgtacggggaccggtggcgtgcgcccaggctgcccactccctccctcctctctccctcctccctaggtccccgggcggggcgtccagaaatcccgcagggatgtggacgggctgcgggaagcaaggagctgcttaagcggcgttcgggactcccggctctcggcccttggaggactgggcgggtgctctgcgtttgcctcgacagccgcacctctcacccacctccctcggttatcaccgccgcgctagcgctagcagggcctcctcggggctcgagtgcagcccggccctgaagcacctaggagagcctgagctcgggcgacagaggcctggaggcagagggaaccctcaaacttagtgcggcgggtggccctgagtgcggcggtcaggtctttctctcctctctgttccggggccaagtgctgccgggttgtctggcgagagtttttctgaagtttctttccatcctcgcaccgaaagcgctgatcgt

SEQ ID NO: 5601 - DNA, 2629 bp, Homo sapiens
cggcagcaaacggcagagcaaaggagtcgttttctttcacctgaaagccgcgaggaggcttggagcgcctttcctcgctggggcccgagcttcctgggctttggccgggtgcgggcagaccccaccggggtcctcgtcatctcccagcccagcccgcagagcgagtaccggcagatttcaagggcgcgtgagcctggctgtcggctgggcccctgaggctcgctgggcgggggcaggccggtccaggctgtgcggggcgtttacaaaaagtgacttggagatgaactcgcccgtgcgcggctggccgccccgctataggggcgaaggcgcctgacgcaagcggaactcggtggagcccatacgaatcagaacagagcgaggctcctggcgcactagggactccaggaggcagctccgccagagacgcgggtcgtgcttcgggaaaccggggggcggggggaggggaagagcgcagaaaagaaaacccaccaaggcggggactggcctgagcggggaggggcggcgaggccggagcccctctctgttgggcggactccccatggccagaggctgagctccactcccgccggccgctccctaggggaaggggaaggagaggggagagcagcgacaggcctccagcaagcaagcgcgggcggcatccgcagtctccagaagtttgagacttggccgtaagcggactcgtgcgccccaactctttgccgcgccagcgcctggagcggagagcagaggcggcccggccgcggcgcgccggctttgtcatgatggccagctaccccgagcccgaggacgcggcgggggccctgctggccccagagaccggtcgcacagtcaaggagccagaagggccgccgccgagcccaggcaagggcggtgggggtggcggcgggacagccccggagaagccggacccggcgcagaagcccccgtactcgtacgtggcgctcatcgccatggcgatccgcgagagcgcggagaagaggctcacgctgtccggcatctaccagtacatcatcgcgaagttcccgttctacgagaagaataagaagggctggcaaaatagcatccgccacaacctcagcctcaacgagtgcttcatcaaggtgccgcgcgagggcggcggcgagcgcaagggcaactactggacgctggacccggcctgcgaagacatgttcgagaagggcaactaccggcgccgccgccgcatgaagaggcccttccggccgccgcccgcgcacttccagcccggcaaggggctcttcggggccggaggcgccgcaggcgggtgcggcgtggcgggcgccggggccgacggctacggctacctggcgccccccaagtacctgcagtctggcttcctcaacaactcgtggccgctaccgcagcctccctcacccatgccctatgcctcctgccagatggcggcagccgcagcggctgcagcagctgcggctgcagccgcgggccccggtagccctggcgcggccgctgtggtcaaggggctggcgggcccggccgcctcgtacgggccgtacacacgcgtgcagagcatggcgctgccccccggcgtagtgaactcgtacaatggcctgggaggcccgccggccgcacccccgcctccgccgcacccccacccgcatccgcacgcacaccatctgcacgcggccgccgcaccgccgcctgccccaccgcaccacggggccgccgcgccgccgccgggccagctcagccctgccagcccagccaccgccgcgcccccggcgcccgcgcccaccagtgcgccgggcctgcagttcgcttgtgcccggcagcccgagctcgccatgatgcattgctcttactgggaccacgacagcaagaccggcgcgctgcattcgcgcctcgatctctgagagcccaccgcatgccggtgcagacggatgcgaggatgcagggacgcgcgacgccggccccggtcgcagccgacgacgccgccgccagcctgacctcacaccctctgggcccgcctctggagccagcgcccagggtccctctgtgctttttcgctttcctaagctcctgtcgctcctctttgtcccctcagtttatgtcctcctgtgctcacctccctgacctctgtgaccttgcactcccctggcctgaagctgcctctctgcgcgctttctactgggctcgtctctttccggagccccagcgtctcctgcccaaattcaccgcggaaagggcccggggcggaggtgcgaccgggcgtcggcagcgcagacctcttggccttctctcacaggtcggtgcgctcgctctccgcgttccccgcccgactgccgtgcagtccatggctagacgcgccggacaggactgatggcgggaccgcgctgcccgagaaagggacggaccaatacgtgtgtttgctccgcgaaccctcttgaagctgttcagaagccgcttgccgcggggcccactaggcggggcgggggttgggacccagcgggagccggggcagcctggctccacggcctgtactcggtttacaccgcgggcgggcgcggagggaggctgcgtttcctccgctatcagtcccgtcgcttcgggcacctccgggccccggcgg

SEQ ID NO: 5602 - DNA, 1686 bp, Homo sapiens
cgacgctcccaggcagctgtcaaagtccggggttcgccggcttccaggctcgcctgacagagccaggcgttcgcttggatctagcttccttccgggcgggaggcgcggggaggtcaagctcttcaaaggaacagggtgggcaggggagtggtgccaggttaggctcctcggtcctcggtagtcagagcggagtaggaaaggcagcggggagcctcacatcccgcgcttcttccggaccccgccgcctacccggagggtacacgttccccggggagtcagagacgccctgggggagcttgaggagtgtcagcggggccttccctggagcctacaagtttccactccatccccgagctgggagacaagtcacagctcggctccctccttgaaagcaccgccgctgatccttcccccaggcaggagcagacacctgcttgtccccacggcgcgccagcgccctgctctagccgtccctgggccagagctcgaaactcacccactgcgctcccaccccggcacagacagccctcaaagttgtccgtactccccagacctcgccttctgctcagcccccggaccccgcccaggggttgagttgacgtccgcgggtggacctctctggtccgctgcgcagggaactgacttcgggaatccagggcgcacagaggccaaagaagctgcggcaagggagggtgggcaaatccagcttgagcctaggtccttgccgctttcaccctcaagcctgccctgcctccctcctgggagaagagcaaacttccccagcacccacctttagccgcgaggaggcggcgctgccggctgtccccgccaccgccgctgccgctccccacgcccagcgccagcaggagcggcacccagcacagccgcccaggcagcatcctcgcagcagccgccaacgagctgcagccgccgcctactgtccgcgccggctctcgcctcccggtgcctgccgcaccgtgggccgcctcgccgtgcccgatgggtgcgcttctagcgctgccgccgcggcgctcggcctcgggttcccgccgctgcgccgctagctcgccggcagcagccgcgctcactggcgcggacccggagcggctcaggcgctcaccccgggacggcccgtgacgtcacggagggagggaggtggctcgtgcatattcatgaacgcgggcatcggcgccgggttccgcgctccccgccccaaggccccgacccccaactttcctcagccgtctccacgctccggggccctgtccaggtccccctgcccagtcgggaccgggcccccagaggaccctggtgggcggctccggagagccctccagccccgcgcctccactccgactctcggaaaagctgccgcaagggatggagggctcccccagaaagtggccacccgaggcctgagggtcatctggggtggcgcgagggaccctgacctgccatgccctttgaactgatatctgggcggagaggactgacgggcgtcgctaagggtcttgcccttggctgggtctctgggcgttctgcgtcgactggtctggggagggcgccaggcgcacactagagcagcgcctagtggtgctaggggttgtcgggcagagtagatagccttggacctggatggcaatggcagggctccgcgtcatctccgagaagcaggggcagccgcgg

SEQ ID NO: 5603 - DNA, 1686 bp, Homo sapiens; identical to SEQ ID NO: 5602

SEQ ID NO: 5604 - DNA, 2132 bp, Homo sapiens
cggctcgaagagctggtgagcgcgaccacagggcagcttgcggacggttctttcggacaggacaagggcgagggaaacggcagaatggtgacgcacctgagtgcgcccactagacgaaagaagaccaactaagccttcgtgtagtgcgtagacaggccgacacacacacacacacacacacacacacactaacacacacgcaaagacagtgagggagcgagaggcgcatccccaggtagctgacaatgacacggccccgatccggacgcgggcttaaagccccccgacttccggagtgcccccctccccggcgacctccggagattaccgctggcgcatctctccgccctgcccggctccggcgccctcccctccccccgcagccgcagctccccgccccccgcgaacgcggctccccagtgtcctccagaacgcccgcgtggctgtcgggtttcgaaccccagggccgactctagtactcggcgcgcgcgccgccgcgtcgccgaccagcctgcggcccccgcatcaatcattaacggggcggcccgggctgcggcggcccgaggagggggatggtacggaactcgagacaggggacaactctatcccccgaagcggccgcgaaaccctagcctgggaggcccccgcccttcctcggtgcgcccgtccctccctccgcgcctcggctcgcacatccccacctcccgctccgggggcggcggcggcggaggcacccgcaccgcgcgatgcccagtcaccgctgccgcgctgccgccgcagtcagccgcgccgccgccgctgccgcagcgcgggcggccgcgcgccggtagcaggggcttggcgaggaagccgctgagcctcgcgcgctccgcgctcctggcggtcgcagcgctgcctattaattgattctcttattgatttatttaatttttaggagcggctgctcggaggcacgggtcttctcctaaacctgcagcgacgcccccggcgtgggcacaaaggctccgacggcggccggcgggggctgcccagcgcccgggagccggcgccagaggtcgcctgcgcgcgccctagccgagccccgggcaccatgccgcggcgcctgcagccccggggcgcgggcacaaaaggccctccggccccggccccggcagcttcgggggccgcccggaactcccactctgccgcctcccgggaccccccagcgtctgccaagccgctgctgcgctgggacgaggtgcccgacgacttcgtggagtgcttcatcctgtcgggctaccggcgtctgccgtgcacggcccaggagtgcctagcctcggtgctgaagcctaccaacgagacgctcaacttctggacgcacttcatcccgctgctgctgttcctgagcaagttctgccgtctgttcttcctgagcggcggcgacgtgcccttccaccacccgtggctgctaccgttgtggtgctacgcgtcgggagtgctgctgaccttcgccatgagctgcacggcgcacgtgttcagctgcctgtcgctgcgtctgcgcgccgccttcttctacctggactacgcgtccatcagctactacggcttcggcagcacggtggcctactactactacctgttgccaggcctcagcttgctggatgccagagtcatgactccatacttgcagcagcgcctgggctggcacgtggactgcacgcgccttatcgccgcctaccgcgccctggtgctgcctgtggccttcgtgctggcggtggcttgcactgtggcctgctgcaagagccgtaccgactggtgtacctacccgttcgcgctgcgcaccttcgtcttcgtcatgccgctcagcatggcctgccccattatgctcgagagctggctcttcgacctgcgtggggagaaccccacactcttcgtgcacttctaccgccgctacttctggctggtggtggccgccttcttcaacgtgagcaagatccccgagcgcatccagccgggtcttttcgacattatcggccacagccaccagctcttccacatcttcaccttcctcagcatctacgaccaggtgtactacgtagaagagggcctgcgccagttcctccaggcgccgcctgccgcacccactttctcgg

SEQ ID NO: 5605 - DNA, 2954 bp, Homo sapiens
cgcccagagcgtggtagtctgcggggccgcccacgccctccttcttggcgccaagcttgtggcccgcggcctccaagaagggcatgcggtgagctcgcgggtctcggctgcgcaccacctgtaggctctcacggatgaggccgtggcgcgagcggatccgtgaactcgccaccgcgcggggatcacgcaccaagtggatgaccttgaggtccagggccgggtctcgcagcagtggcgccaagaccgccacgtcgaagacgcgcacaccctttatgactagtgtgcggtacttgcggcactcctcctcgaaacgcgccaggcgctgtggcgggcacttcttgcacacgcggtcgtccaccaaccccacgacctccttgcggtaggcggggcagagtggtgacgagcacaccaccttgttggtggctgcgccgaagatgcccagcgtggtgaggttgcgccccccgctgcccgcggggctatacaactggaagacagagaggtcgcagcggtaaagagcgctcagcatgtcccgcgctgccccctgcagggaaacggcgtcccccggatacagtttttgccatacatgccacactggctcgtagagaaagaacacctcgggattctggttgaatagctcgccgaagaacgacgagccagagcgccacgtggtgaacacgtacaccagctgccgcttgtccccgacgcccccggtgccccgagtgccattgcctggaggggccgcaacccccgccatccctgccgcggctgcaggagccgccccgacggcggcagcgggagggcggtaaggagtgcggaggtccaaacgggcatgagcacggggcggcccggccggaggcggccctgggcgcccccagctgcctccggctgcccccgctgcggcacccagcggcccatcggggttgcactgctgcagcggctccttgtgccacttgtagtccaggaggttgagcatagtgagcaccagcagcagtgcatagcccgcgcacaacaccagcgccttcctacggaacaccttcattccgagaggggacgcgggccagcggcgtcctgggcgccggggccactgcgggagcagggcacgcggcgcggctgcaggcgcagcctggagcagccgagggagcgcgcccgggggcagagctcgctgcgggctgcggctcatcacaggcacaatccgggccggcggcgcggcggaggcagccctgcagcccgggaaggggacgcagcgggctggctgctggcgccgggactcgggccgcgactccgaggcgggcgcggcggctggtccccagcgcccaaggctggctctcccatggcagcggctccgggtaggacctgcgaggggaagcggagtgagcggatgcgccccaatctccctcccagcctcctcctcctaagtaacgcccaccctcggttctgcccggttcctccgctcacctggagccgagggcgcgcccgggagcggccccggatcaccgcccggcggactgtccggctgtcactcgttcctcgatttcgctccctctcgcttccgctgggggtccccgcaccttcgaggggtctggggagtcggccgacttatccctgggcagtttccgggcagcgggcgccctgcggctcgggaagaaaaactttcacgcggcccagagccccgctccgcgctccgccgaacccggcgcctcccggctccagcgacgtctcctccgctttctcgggaccgcagcttcctgtctcgctcaggggaacgaagccggctgggggcgatggctgggggcggcttatatgggactcagctcccggcatagcggcgcagcccctctcgctttcggcctccgtgcggcgaattttcccacctctctggcagcggtggatggggcacagcgcgaccccgcagcggcggcggcggctgcttccatcaccgggaggatgcccgggcggacagcgcaggcaacccccgccgctccgcagcctccgactggaccaaaggaccccgaacacacagctctaggcaaggaaacccaggtgtgcagcactgcccgacccgacccaacccgcccccggtaccagcgcttctggccaacgaggtatttaagcaaagaaagaccccgccgcagccgccgccgccgcgcgaaagcggcgcccaggaggatgctgctacccgactccccttacgccgggcgcccgcaacgcgctcggaccagcctctgcgcggctcctgccagccggcgcccggttggtgcgcgccgccgtctgtcgccgcggctcctcccctccgccgcgcagccctcccccttcgccggccccgcccccgcccccaacgccgagccggctcccaccgtcgctgcgcctcgggggctggagacgcgacccgctttaccgcgacgcgcgggggctgcagtccacgggtccgaaggcttagctctgcgcgcaaagcgccgggatgcgaacgcgggatctggagctcgtcggtgccgagagctgccagagagttggattctgcgtgcagctgccggactcggccccatgtttttgctctcagaaagagttggtgatgaagtttgggcagaaatcccctgtcggccgtccgctccacgcttccctcggggccgacactgccaacctctccgggcactgaggacacctctgcgccctggagcggtgggaggacgcggagcgccgttctctggcttccgacaccctgcccgccctctctagtgggtctgtggctgcgccctctcgaaggaagtaataaatctttctgaccttgggggtcagaggagacgcttcagttttccggaggggtgtgcgggcgggaccgtctttccgctttactggacctctggccggggctgctcttgtttcattgtgccccacatgcggagccccgatgctctccgcatttccgctcgcggtgctgcgtccactgtgattgacgt

SEQ ID NO: 5606 - DNA, 2954 bp, Homo sapiens; identical to SEQ ID NO: 5605

SEQ ID NO: 5607 - DNA, 885 bp, Homo sapiens
cgcccgccgcccttttgaggtcacggcgcaggagagaaggagggcgcggaaacgccggcaccggctgggaagcttcggtgctccgggtccctcttggcgagggcggagaagtcggcggcctctgcctagaattctgtgattgtagggatcgagacatcaagggcgggggtgcagaggattacaagttccctagcgcgtctcatttgcacataaatgtgctttgcctcctaaccttgtctctgttacctgtgcacctgccttccaccaaaccaaccaaccacccgtggctcaggaagaaaccagaactggggggattgtcttcccaagggggacacagttgaacgtggccggcagcctctggcctcccgggcctgggttcagacggactccggcgctgcttccaagaccgacatcgggcacctggccgccggcgcacccaggagcacgatttcatgcgtgtgcacgctctctgctcgggccaggagctctgtttcagccccactccgggctataaatccctggttccgcccagcgcagcctcggctcggagggcagcctgctagccaggtcctgggttagggatggcccacggtgcgcgcggggaccgccacactccttagcgccacgctggggccgcgcgggccggagcagggggagggggcccgatgacgtcatggaacagttggaggatttagctcgggaacccgccggggagcgggccccggggccggcgttccatttaggccgacagcgtcccgggctcggctccactttcccagacggcacggctgccttccacgtccagagcgggcctggggttctgaaggaaatcagtgcacgatcgcgaggccaggaactctggagaatgggcacgcaggcgtgcgc

SEQ ID NO: 5608 - DNA, 2174 bp, Homo sapiens
cgcgctgtgcttcccagcgctccaggggcccggcccccagctcggccccacctgggcgctctttcgctcttccgtgggtcggcgggccgtgcgggaggaactctggctgccgcgggctctgcgtcccacctgccatctcggtggctctcgcccgggccccgagtttcctgcggagctagcactccagctgagccagccggaggggcggcggcggctccgcgcgcccagagcctcagcccatgaatgggactccaccctgagcgccccctcccgggcctggggaggcggcggcgcggcggcggggggcgccccgcaagcccgcggctctgagcggccacccgcgcagcaagttgggcgagttggcagccgcctgcacctgcctcctggccccggcccctgattccgcctccggccccaagcgcccgggttgcgccctcggctgcctcgcgaggtagccccaggaggcctaggggccccgcctgcgcccctggcgccagaccatggtgggcagctccggccaggagcctcagccgccgcgagccaacatcgcctgcagccagcccccgccccacccgagcggacgcgcgggtattcgcagcgcgcgggtcacttccttcctcggccgggatgggcggcgcgggactgagtgatcggccttgcgtccggcgggtaatccccatctgatctgctgcctgtgagctgctgactgccggggcgcgcgagcctagggggcacgggcagcagcgcggcgatgacctgatcccgagcccgccagggcgccccttccttccctcccttccctcgctccctctgagcctgtgcggagaccagctcggtgcggcggccccgggtggaccatggcggggagctccagttaaaggcgtgtgggcgccgagctggagaggacaccttcggcatcgctgccttttgagggggcttatttaaactactgagtcattccagatttaggattccctaaataatcaccaactgtgcccgtctcgtgccggaaagcaagcggaaagagaaagagcgcccactcttgggaccccgcagatcgcctctcgctggtttctccccgaggggtgcttggccctcgaggatctccctccctccctcgcgccctcccccctccctcgcctcccgctctctttgcagtgctgctggccgggagttgctctcaccgcagctggaaacagctgcccccgccccgcgcccctacccagactccgggtaaccgctcccacttcgcgcctctcggaattccagaactcgggtggccggcccctggaaagccgcagccggcgcgatgcattctgtagacctcaccctgctgggacggacctcctaatcttcagaaccgcgggccgcagggagttaaattgctgccttcctctccttctctcgtgcggttggtggcttgttttctaaaggaacgttttattcactttttagtattttctaccgggggcgcgctacccgcctgggtccagactctgctttgtaaacgggttttctatgtatgtatgtgtaggtatactttggacaccttacaacgcttgcgcctctccaacagaggcacgtcttgttattttgggcatcgttcttccccttccacttggtaccccgaacgcagtgtgactaaactccccactgccccttggacgccgatcgccttggggtgcaagtttggggtgcaaacgtctacttcgcaagagggcctgggaccgccccgccccgccccccggccgccagaggttggggaagtttacatctggattttcacacattttgtcgccactgcccagactttgactaaccttgtgagcgccgggttttcgatactgcagcctcctcaaattttagcactgcctccccgcgactgccctttccctggccgcccaggtcctgccctcgccccggcggagcgcaagccggagggcgcagtagaggctggggcctgaggccctcgctgagcagctatggctgcggcgatagccagctccttgatccggcagaagcggcaggcgagggagtccaacagcgaccgagtgtcggcctccaagcgccgctccagccccagcaaagacgggcgctccctgtgcgagaggcacgtcctcggggtgttcagcaaagtgcgcttctgcagcggccgcaagaggccggtgaggcgg

SEQ ID NO: 5609 - DNA, 873 bp, Homo sapiens
cggccgggcttagcgatgcggctgagctgcccacccgcgtctgttgaatcggccaatcagcggcgcccccggacctagcgggagcgtttccatgccgaccgcggcaggcgtgcgctctccggggccgcatcgccatggcgacctgctcacctgactcgctccgggtggactcgccgcgacccctgggcgttcaggcccctgagggcccaacgggcgacggccctccagctccagctgtgcgtctccgcccgggcgaggtggggctgaccgcggccgtctgcacacgtcccctctggtccgcgcccccggcctgggagggcggactcgcccaccccacgatggccccggctttggaagggactgtttccgtgacccgttctcccaacagccgctaacaaccccctctaacgtctcctgcgcggcccgctcctgagaaccctggctcgggagagcgacgcggggtcctcggggctgcgcaggctgcggcgccctgcccacgctggcccgagggcgcggctcgctccgggtcggctcacacacctacgcttcctgccgggaggcggctgggacgcggcggggctgccccaagtgcagtcgcggcagtgttgcgtctccatcgcgggggtccttgcgggccgcgcctgccccgcccggctcccggtgcatgtggcctgcgaggcggcagaggagatgtggggatttagggtcgcacgtcgtgctcgaggtccccacgagaggtcttcccccgcgggctcctgcgcaactgcgtgaagccggcccgggaaagccaagattgtggcccaggaagaggaaggaacgcgggcgacagagctggggcttgggacgttgagggggtcggtggcagctctccgg

SEQ ID NO: 5610 - DNA, 2174 bp, Homo sapiens; identical to SEQ ID NO: 5608

SEQ ID NO: 5611 - DNA, 510 bp, Homo sapiens
cgcgcagccggagaggagggggcggcatccgggatctggcgcggcttttgccttttgcgccagcgtgagctcggttagggtctccacggccgtgctttcacccctcagggaggcgtcggtgattcggtcacagcctcagcctccgtcgctctgtgacctgcgggtattggatgattcgtagctgagactccgctacacccctgaagtggggaaatggtgagtgtgggggcagggcgtcccaaggctggggaggcctcatccgaaccggcgggaaatggcggcggcgggacggagtctgcgaacggagtctccgctgccgccgctcagccctcagtccttggtcccttccggtgagggacccgggttcatgtcggtccccgcaaggcggctttggcccagcctgcagccctacttgtgcagctctgcgcccgcagccccgcaccttccctgggctgtggggtgaggaggagctcatcgggaaaacgcctgcgtggcgtgcgaggtgcccgc

SEQ ID NO: 5612 - DNA, 511 bp, Homo sapiens
cgctctgattcggtttgggcgcaagcaaacccaggcctggccgccgggcgcctgggccgcgccaactcgctctccccctcccacgcccgtccggcacctcctggcccgccaagccccagatgcgggtgtttgttccagaaaactttcggcggcggctcgcactgagcatgctcggcggcggggcgggcctggggtccggaagctccagcgactcggcggcacccgccgctttgaggtagcgggtcccgacaggcgatggacccctcgggctcccgggggcgccccacgtgggtgctggccgggggtctcctggcagtggccctggcgctggggggccgaggctgtctcggcgccagctcacgtccccgctggcgccccctcggcgcgcagccaccccgggatccccaggtggctcctaggtctgggcccggcctgaggatccctccggggcggagcggggcggggcccgagagcagcacgcaggtaaggagggcccgaccccaggctccgg

SEQ ID NO: 5613 - DNA, 417 bp, Homo sapiens
cgccgccacctccctcctggagcagaaggggaacccgacgcctaagcggttgcgtgcgaagttcccaaccaggctcaaggagtcgcagagccggggctccgggcccgcaggacccagaagccacgcgccccgcgctccccgccccgccgctgtctgctcggccgacccacctggtgtcgcgtgcgctggcggcccgcgcggcagccaagccaaaggccgaggccgaggccgagcgcggcgcccagcagcacggcgggggccagcagggcgggcgccggccgcagcgcgtcccgccccagcagcagccgcgcgtcgctcttgcaggccgccccgccgcgggccatccggggcgctcaggctgccgccccgccgcatcccgccgcctgctgcaccgtccccgccagggcggcgacgcgg

SEQ ID NO: 5614 - DNA, 1748 bp, Homo sapiens
cgcgggtcggggagctgcacctcttgcaggctcggctctcggccccgccccctagcgtcggagcccgggagccgcggctgcagcctatctctttaaatgacagctgaggctcgggtcccagtccggggcttgacgtcagtgcctcctcccgtgctgccaggagtagttagcgccaccgtcggcgctccggcctcgcggcacgcttgcaagctgccggggcggcgagttttctttgcttcggcccctcctcccgccctccccacggagagccgagcagcagccctagagcctctcgcaagtctctctcacacttccccgccctcgccccaaaggagcagcagctccttcttgcctctccattgccgccgccgcaccggcggagctcctctctcgcgcgtctctcctccgatggagctcgggcgccgccgacgccgccgctgccccgaaccctgagcggggccgccccggtcggaggaacgcgccgcccagtccgagggcgcagagcgccaggagcacgcggagggctggggcgcgggctccgggaacgagaaagtgcagctctctcgggtcactgggccggcggcggggggactatggctctgaaggacacgggcagcggcggcagcaccatcctgcccattagcgagatggtttcctcgtccagctcgcccggcgcgtcggccgccgccgccccggggccctgcgcaccctcgcccttccctgaagtagtggagctgaacgtaggcggccaggtttatgtgaccaagcactcgacgctgctcagcgtcccggacagtactttggccagcatgttctcgccctctagtccccgtggcggcgcccggcgccggggcgagctgcccagggacagccgggcgcgcttcttcatcgaccgggacggcttccttttcaggtacgtgctggattatctgcgggacaagcaactcgcgctgccggagcacttccccgagaaggagcggctgctgcgcgaggccgagtatttccagctcaccgacttggtcaagctgctgtcgcccaaggtcaccaagcagaactctctcaacgacgagggctgccagagcgacctggaggacaacgtctcgcagggtagcagcgacgcgctgctgctgcgcggggcggcggccgccgtgccctcgggcccgggagcgcacggtggtggcggcggcggcggcgcgcaggacaagcgctcgggcttcctcacgctgggctaccggggctcctacaccaccgtgcgcgacaaccaggccgacgccaaattccggcgtgtggcgcgcatcatggtgtgcgggcgcatcgcgctggccaaggaggtcttcggggacacgctcaacgagagccgcgaccccgaccggcagccggagaagtacacgtcccgcttctacctcaagttcacctacttggagcaggcctttgatcgcctgtccgaggccggcttccacatggtggcgtgtaactcctcgggcaccgccgccttcgtcaaccagtaccgcgacgacaagatctggagcagctacaccgagtacattttcttccgtaagttcgcagccccggcgtttcccagcacccctcgccccctgctgagccgccgccagtttgagccccgctggaggccccgcgggggtgtccggggcaggcgctggttaactccttatagagagcggctctccctgcacgattcccttatgcagtagacacgatttacatttcaccgattcggatatttccgt

SEQ ID NO: 5615 - DNA, 1748 bp, Homo sapiens; identical to SEQ ID NO: 5614

SEQ ID NO: 5616 - DNA, 648 bp, Homo sapiens
cggctgtgtcgggagtaaaggttcgggctagtgtgcgtgcgggcgcgggtgaccccacctttagggaagccggcgcccaactatccaggcagtagccccggctgaccccctccctcctccttccctcctctcttccctccctccctgcgtgtctcctctgcaccggcccccgccgcggagccaggcggcagcaccgacgccgccgcagctcctgcccgcatcgcgctaacccgcgcccccggctcacacgtagccggagcgactgagccggcagccccgggcccacgctgcgcaccgtgtgcacggcggggctggctgagctgacctgcgctgggctccggcgccgcaggcggctggggagggcggcgtgggagaggacgctgagacgcaggggcggccgcgccgaggtgacaagctgcgcacctggaaagttacccggctgtctggtgaggttcgtgggccgggggtcttgggcgccggggtgtgagggcgcgcggggagggacggggtcggggtgcgcgcgtgtgcatgctgtgaatgcgttgcgcgatgtgcgcctctattccacacccagccggtctcttgcttgtgctgttcgagtgtggacgtgtgtacgcgttgcattcgctcggtgtggcagcgtttcgt

SEQ ID NO: 5617 - DNA, 863 bp, Homo sapiens
cgacccctaacgttgtaacctgtgaccgtgattaaatttcagcgatgcgagggcaaagcgctctcggcggtgcggtgtgagccacctcccggcgctgcctgtctcctccagcagctccccaagggataggctctgcccttggtggtcgaccctcaggccctcggctctcccagggcgactctgacgaggggtagggggtggtccccgggaggacccagaggaaaggcggggacaagaagggaggggaaggggaaagaggaagaggcatcatccctagcccaaccgctcccgatctccacaagagtgctcgtgaccctaaacttaacgtgaggcgcaaaagcgcccccactttcccgccttgcgcggccaggcaggcggctggagttgatggctcaccccgcgccccctgccccatccccatccgagatagggacgaggagcacgctgcagggaaagcagcgagcgccgggagaggggcgggcagaagcgctgacaaatcagcggtgggggcggagagccgaggagaaggagaaggaggaggactaggaggaggaggacggcgacgaccagaaggggcccaagagagggggcgagcgaccgagcgccgcgacgcggaagtgaggtgcgtgcgggctgcagcgcagaccccggcccggcccctccgagagcgtcctgggcgctccctcacgccttgccttcaagccttctgcctttccaccctcgtgagcggagaactgggagtggccattcgacgacaggttagcgggtttgcctcccactcccccagcctcgcgtcgccggctcacagcggcctcctctggggacagtcccccccgggtgccgcctccgcccttcctgtgcgc

SEQ ID NO: 5618 - DNA, 1288 bp, Homo sapiens
cgcctcttgcgcagccgaccccgcttcggccccggcccaggccagagaggtggccctcggagatgctgaagttactccgcgcagggggaggggtcgccaggctcctctccaatcacggtggccgctccagctatttgcatacattatgctaataacagacctcctgccccgctcccacccaagcttcccgcctcccttgggggttccccgggccggcccgcgggctgggccaaggtgaatacattatgataataaggcgggctcctgctttgccttcggaaggggggcgcgcagcagcgggagcggcaggccggacgccgggcgccgggagggggtcgggggagggacgtcgtgctcggagcgcgcgcgcactcacacactcacacacacactcacgcgagcatcgcgaagggtatttaaggatcgcgcacgcggggctgcggagatccttcgggcagccgcgacttcggcttcgcgagtagcattggttccttgggtttatttcgttttcctctctcttctccaccttagtcgcccctttcgcgctgcgctgtagcgtgctctcacagcctttttgccttgaactgaatgcaggtgggaaacaggtcggcgtgccgaaagacaccgagtaggtagaaataaggcaaactcacagaggcgcaacaggtccggtcctccgtggccagggcgagccgcggccccgcgtggcgcctcggccgttgccctcggaccctgagcggccactgttggggccctcgaaagaggtgtcggtcctctgggagtcggaagagctgtctgggtgggtttcgtcttgctttttaccccaccgccacccagtccccggacggagggtgcttttcacttccagctgggaggagagaagaaagcggggatggtgcacgcctgcgggtctggacgctgagcaaggcaggggtccgtatccgctcgtgggcttgactccaccaactagttgtgcagccacagggactgaactttggaggaatcgacctttttctttccttttaggattatttgaggtgtagagggtgggaagcgaagccgagacggccgaccccgccacgatgctgctgaagaagcacgcagggaaaggagggggccgggagcccagatccgaggacccgacccctgccgaacagcattgtgcccggaccatgcccccgtgtgccgtcctggcggccctcctgtcagtggtggccgtggtgtcttgcctgtacctgggtgtgaaaaccaacgacctccaggcgaggatcgccgctctcgaatccgc

SEQ ID NO: 5619 - DNA, 1275 bp, Homo sapiens
cgcttactccgctctgcctgctcgctcccactgtccccaagcccgccccgcccgcggcaagtgcgtgcccaggcgcagccaccggcgagatcaggagcgcagcgcccgcagcctgagggaaccggcgcagggcagcagcggctgcagctggattcgcgcgccccagcgctcagtggcggcggccgggacaccctgggcagcaccccgcaccgcagcaccccagactacgagcaatcgtgcccgtccccgccggggctggagggcgcagggccgccaccctgcaagttcgtgggcccccggccacccttatgagagaaggcgaagccgggcgaaggagcaggacgctcggcagcaggactcctccgcaagccccgcgggccctctgttcccgcgccccccgggcgcccaagaagcaaaatgcaaccaccgcgctacagctgagaggggaaggggccagcgccatccgctcgcccggaatccggtccccgcggcggctgcgcgtcccggccgcggcccctccggcccgggagtgagcagcagcaggaggagaggcagcggcccggggttggccggggctggggaggagggacgggacggagggagggcgcgggggcggggagggggccccggcggataaagatggcaatgtctctcatccaagcgtgctgcagtctggctctctcaacatggctgctttccttttgtttcgtgcatctgctctgcctggactttaccgtggccgagaaggaggaatggtacaccgccttcgtgaacatcacctacgccgagcccgcgccggaccccggggccggggcggcgggcggcggcggcgcggagctgcacacggagaagacggagtgcgggcgctacggagagcactcgcccaagcaggacgcccgcggggaggtggtcatggccagctcggcccacgaccgcctggcctgcgaccccaacaccaagttcgccgccccgacccgcggcaagaactggatagccctcatccccaagggcaactgcacgtacagggataagatccggaacgcgttcctgcagaacgcctcagccgtggtcatcttcaacgtgggctccaacaccaacgagaccatcaccatgccccacgcgggtgagtggcccagcgggcgcgggggaggggagccggcggggacggaggtgcctagagggatccagcgcctgcctccaggctccttctgggaagtccgtgcggcgcggaagacgtgtctgggttccctggaccgattaagttttgctccgcgt

SEQ ID NO: 5620 - DNA, 1071 bp, Homo sapiens
cggcgctgagtcctgcccagcgcgacccggaccgacggacgcgcagagaccctgccgggacccgccctccagccggcgcccggggagccgccggccggctctacctcccgcccgggagccgggcagggcgagaaggcagcgcgagtggcggtggcgacccccgccggggttcctgcgacgagcggtgaccagcagcgcccgcagccgcggtcccgctctccactcggacgtggccaagcggcggcggccacgacgtccggcttcccgggatcgtccggctgcgccctgggcgcatctgcgcgcctggccccgcgccccgcggagagggcgatgggtcccggtcaggactgagccccccttcccctctccccagtcccgcctggcaccccctcctctgccccgagggcgagccacggtctgcgccgccgccttcccctccggtgcccccggctcgccgtcctcccgcgccctccctccccggacccgttcccggggccaccatggccgcggccatcgctagcggcttgatccgccagaagcggcaggcgcgggagcagcactgggaccggccgtctgccagcaggaggcggagcagccccagcaagaaccgcgggctctgcaacggcaacctggtggatatcttctccaaagtgcgcatcttcggcctcaagaagcgcaggttgcggcgccaaggtctgtgggggtcatggtcgggagatgcgccccgggtcgccccctccccgcctaaacggagcttctccaggctccttccctccctcggttttcccggcccaccccggccccggcctcccttctgagcactctgggtgccgtcgcggggaccctggagtccgctgtcgggcaacctgtagccgccgagaagtgcagccgccagagatggcaagttggctgctcctcgccggcggctcctgccctccgcgtccctgcaggctgggctctgggaaacctgttccccctgagtctcggcttcccgggaggatagggactggcactggctctggaacgcggggcaccccttcctgccacacccggggtcgagccaccgctcgc

SEQ ID NO: 5621 - DNA, 694 bp, Homo sapiens
cgccagggttgtcggacagctcgatgaccaggagctcccggccctcgaagctgcgccccaccgtgtaaatcctgctgatggcggtgcactgcagccacacggacacgagcgcctcgcgcagctcggggtagcggtggtactcgaaggagatgccgtcctcttgctgcagccgccggcgccgcctcatgcccgccgcgggcgccccgggctcctgggcttcggcgcccaggagccacccgcaggcagccagtgccccgcacagagccagcagcgcgctgccccctcgcccggccatcgctgcgctccgccgccgccggccgtgccttcctacgcgggcggcctcttttgtctgcccggccctgggcttagcccgccggcgctgctgggggcggcaagttccgcaccagcctctactcgcctcaccttccccggctgaatgagtgtcagcccgcgcactggggccacccagaggagacgggcaaagccgcggctccacgggctgcactactggccgcggagcccaggggagctgcaggagaaaccactgcgaggagggggccggcggagagacgggccggcgtggatctgggagggctgctggcgttatttgctggctcggaaccacgtcaacagccaaatggcgtccgggacgacgcaggtgaaatgacagctaaggtccggggttcgggaacgt

SEQ ID NO: 5622 - DNA, 694 bp, Homo sapiens; identical to SEQ ID NO: 5621

SEQ ID NO: 5623 - DNA, 1424 bp, Homo sapiens
cgagagctcgaggcgccgcccctgccgccccgggattggcgtgaggagcctctgacgacatatattaacccgagcggccctaaagatgtagctgtacatggagatcttgctgggaaaatccgcttgctcccctcacgtcgtccagcccaggagaaccaccgccgtcaccccggagcttcctcggccaccgcgcagagccctccgagagcccgagccgcggtcttcgagctccaaggctcattcagggccccagatccttgccccgaaaggagaggatctgagaaaatggatgcactgagacctctctgaaaaccctccgagagagcgcgagaggagcgaggacacgttactcgcagctaaaatcacatttaaggaccaaaacaacaacaaccaaaaatttcattaaaacaataagcgcccaagaacccagatcgggctggtggggggaggggaagaggcgggaaggggagggtcgcacggaggtagctttgcagtgagcagtcgaccccgccgccccccggcacagctggaccggctcctccagccgcggctcagactcgcccctggattccgggttagcttcggtgccaggaccgcggcccgggcttggattcccgagactccgcgtaccagcctcgcgggagccccggcacctttgtatgagcacgagaggattctgcctccgcgcagcagcccgggaagcaggagccgaagcgcgggccgtggagcaaggcgggaaccggaggcggcggcggcggcggccaggggcgcacggtgccaggaccagctcgccgcgccccatggggagccggcggccgcagcgctgctgaggcgggcccggctggccaggcggggggacggggcccgggctgcagcagccccctctgcggctgccgggcgggcccgggcgcccgggggctggggggtggggggtgggggaggacgccgagcgctgaggcaggggcccgggccgagggcgcggcggggctgcgcgcacgctggggcgcgtggaggggcgcggagggcgaaatgagtctggtaggtggttttccccaccacccggtggtgcaccacgagggctacccgtttgccgccgccgccgccgcagctgccgccgccgccgccagccgctgcagccatgaggagaacccctacttccatggctggctcatcggccaccccgagatgtcgccccccgactacagcatggccctgtcctacagccccgagtatgccagcggcgccgccggcctggaccactcccattacgggggggtgccgccgggcgccgggcccccgggcctgggggggccgcgcccggtgaagcgccgaggcaccgccaaccgcaaggagcggcgcaggactcagagcatcaacagcgccttcgccgaactgcgcgagtgcatccccaacgtacccgccga

SEQ ID NO: 5624 - DNA, 1215 bp, Homo sapiens
cgtgcgggagggaggacaagaactcgggagtggccgaggataaagcgggggctccctccaccccacggtgcccagtttctccccgctgcacgtggtccagggtggtcgcatcacctctaaagccggtcccgccaaccgccagccccgggactgaacttgcccctccggccgcccgctccccgcaggggacaggggcggggagggagagatccagaggggggccgggggaggtggggccgccggggaggaggcgagggaaacggggagctccagggagacggcttccgagggagagtgagaggggagggcagcccgggctcggcacgctccctccctcggccgctttctctcacataagcgcaggcagagggcgcgtcagtcatgccctgcccctgcgcccgccgccgccgccgccgccgctcagcccggcgcgctctggaggatcctgcgccgcggcgctcccgggccccgccgccgccagccgccccgccgccctcctcccgcccccggcaccgccgccagcgcccccgccgcagcgcccgcggcccggctcctctcacttcggggaaggggagggaggagggggacgagggctctggcgggtttggaggggctgaacatcgcggggtgttctggtgtcccccgccccgcctctccaaaaagctacaccgacgcggaccgcggcggcgtcctccctcgccctcgcttcacctcgcgggctccgaatgcggggagctcggatgtccggtttcctgtgaggcttttacctgacacccgccgcctttccccggcactggctgggagggcgccctgcaaagttgggaacgcggagccccggacccgctcccgccgcctccggctcgcccagggggggtcgccgggaggagcccgggggagagggaccaggaggggcccgcggcctcgcaggggcgcccgcgcccccacccctgcccccgccagcggaccggtcccccacccccggtccttccaccatgcacttgctgggcttcttctctgtggcgtgttctctgctcgccgctgcgctgctcccgggtcctcgcgaggcgcccgccgccgccgccgccttcgagtccggactcgacctctcggacgcggagcccgacgcgggcgaggccacggtaggtctgcgttagggtttgcggagaacccgagagtttgcgttagggtctgcggcggacccgagaacctgcgcgg

SEQ ID NO: 5625 - DNA, 1184 bp, Homo sapiens
cgaatgttgcctccgcaccgattcaaacccgcgccgagcctcctcccattccgacaccacaagggagaagagcggagccgccgccgccgccgccgccaccaccgccaccgccaccgccgcggtccccggagcgagcgagcgaccctgccgcgcggggagcctcaccgggagccgcgctccgccagcccgccccaggccgccgccgccgccgccgctcacccaccttgccgcggcgcgccctcgctgtggccgtgaggaaccgagcccagcgctgccaagttgcctgggtctggagcgtatcgtgttacagcgcctggctccgggctcgggctgcgcgcggcggccagacatgataggctgaggctcctctgtttacacccggccgccgagggggcggtgcgccgcttaaccccttcgcgccgggccgccaccgccgcctcccgccagccccgcgcccagcgccccggctcggccgccgcctcaccccctcgcctcaccccctcgccccgctccacacacgcgggccggggcctgtgagcagccgtgcccccagcgaagacgggggaactgcactgagaacccgctcccggcaccctccgaagaccccgcggggcggcatcctcccctccacacacgcacgctcgcgagccgccccgggcagcggccgtgttcctcggcggggcttcgccggcggcttttgatcccgcctcagagctgttctccggcagcgctactttcccgtgctcacaaaagcatctctctcccaacccatgaacggatcccgacccctgctctgccaccattcatgcgtcccgcatccgaggtgtcgccttcacccacacgccccacggccccgcgaaactcggccctccagctcgcgggacgcgctgcctgccaggcgggcccggcggtacctcgggggcgggaggggtcggtcgcagggcccccagcctggcgcccgcggggcgtccgcagcgaaggggtgggtgtcgctcgtgaacgcagcagggaccagctcagcccgcgctcgcccctgggcctcggccaccgcctctccgccactttctcggcccctgcgtggaccggcccgtggcgggggctgctctgcgccctcgtccccgcagcagtcgcggacccccattaacgttgacgagtcagtgtcgcgacccggggagagaagacgg

SEQ ID NO: 5626 - DNA, 5820 bp, Homo sapiens
cggagggaaaccgggccgacgacaagggtggctatttccgggctcttcgcgcccggcccaagcgtccctgggtggggcagcccaaacggggagaggggccccgtgggccgagggcccgaggccgcagcgagcttagcgtttggccaaatctggctcgcgcgccttcccactgtcctgttagggctgtgtgacctcccggagccctacgtccccgcccaaacagctcccagcgcccctgctggcacccggggcgccctcaccccagctcctgcacccggcgcgccgcgcgcagaccggacggaggggaaagttggcaagagcgcggcgcccgcgggagaaagcgttaatgggcggccgggtgggagcagcgcgctcgctcgcccacgtcacgccggtgcgggctcggctgacgaccgcggcgcctggggacgccggcgcgctccgctcgccaggtgctccgcctggaaatgtctccattagttgtcgccggctccccgctggagcgcgcgcgccgagcttccgcgcggagccctcgcgggctgccgggagcggcccagcgccaccgcaggtaggtgaggtcccccgctcccgcccccgccccggggttccgagacccctccccccttccgaggaggcggaggctccgcgcggccgccgaggggagcgggcggcggcggctgcggcgactccccggtgcgtcccgggctgcgagctgctccccgcggccccggcagccacacggcgcgggcgggagcttccccagctcaggtagggagtgggctccgccgcacaaactttgcgaggattgctcttgcgcttaaggggacaaagtttgctacccgtcgctaggctctccagaggccgctgcgtttgctgcaagttgcgggaagcagggtgcgcgggccggcgcggggcggggggtggggggctcggagtggccaggcctgagtcctggacgcccggacggcgctccgtccagcctcaggccgtacccagggagcaagcggcgggggcgcagcgggagagaggagggagagggccgcgggcccccatggagggcggttgggaatccagagattcaccgcttgtccctgtggctccttctcctaccactggctccgagggggcctcggggctgtgaggaaatgacctgccaacctcgaggttcgccagtgcggcgtcagcgaccgtgaggcctctcaaacccacaccccagccgggtgtcccgagcggtgggcgggcacaggcgcccccaaggtctctggccccaggtctcagaaagaaaggcccttgcctggtgccccgggctcccggcttcgcctttggctggagttaacttctctgggctggaaggagctccctccggacgagctcttggtgcggggaactggtggcccccagggtaactcctgaagcaccagggctaggctggccgaagaagggtcagggcccggcctgtctccccggaggccttccatggttccgacggccaacggtaaccccgtcaaaataggcgacccgcctgcgcttcgcgttaggggctgaccatcccctgcctcccctgcggcctgctccggccctggtcctccgctcttcggagcgctccaggccagcgggagcacctcatctccccgaagctgagccggtgctgtgtactccgggagccggctgacttctggcccacctgctcacgggtgtatttagtaccgggggtccctagagggaggaaggctcagcactccgagtctatgcagacgcgttcagctgatacctgagatgctgagcgtcctatcgttggtgaaagggacactgggtgcctccgctccaggcttggccttttggtgaaggcacttggaaaatattccagtattatctatgggagaagggtggcccagtgagaatccccggtttgggcaggcgggcctaggccaggctacagggtttcagtgagatgtcccggtggtcgccaatccacaggctggattgaccctgtgtcctggaatgagtagtggggcctgggtgaggccgggcgggtcaggaggcctcctgggcagttgcgagcttcccgaggcagggtgactgtgactgggcccggaccccaggcgctggggcctgctggcgggcaggaagtggagcgtgtgtgtgcggcggcctgggaaagccgattcagaggccaggtttctgggtcacggagaaagggtcgcccgctggtggggactggagcgtcgatttatgcacacaggctggaaaggcaaaagagaacaggagaaggtggcggtggtggtcaaaggaagcccccgaaagggcccccacgtactggctgccctgggaagtggaggctgcttctcccagactctgctcagaagatgaatggccgcctgttctggggcttcggctccagttaagccccgccgggtctggaaggaaggaaatgcaccagcctcaggtctgggtgggctgagctgttgcactagagcccagaggtgcagggcataggtggctgggcccctgggccctggctctccccctcagccggcggagtgctcacagtcgccgaggccaggtccccgagtataggtgaggaaaggacaagccacagctgaatgcctcccctctgggggtctctactccccatcccagcccttggcccggctgggctcacacccctccttcagccgggcctcattacctggagagagcgagtagtttgtaaacaataaataatgggaagtagaaggatgctcgggaaaaaccagaaaactgcaaggagtggggaggagggagggtgggagaggggaggaaggagggtgggggaggggaggagcaggaggagagggaaaggggttgagagattcatttctagcgagaaaccccggtggctagtttcttattatttacaggaaggtgatattagcgattcaggtgagaaagaaagaaacgcggcctgccgcgaaatcaatacagaattcagaaacaattattaatgtcatttgactcgtgttctttatatatttctcgcggctaccgacgctaaactgtctgaataatttgcatggagcggctattcattatttccgatggtttccctctgcaagcagctcggacgtggcccgctccggtccaacgcgatcggagaactcgtattttcatctgtaaattaaagcaattacgcagcagatattatatgatgtgtactgtggtctccagatagtcatcaatcaccttcaaccgagctgtcaaaagagcaggcagatttcgtttctgggaggcaggcttgcagctggggagagggcgaggacgtcatcattaattagagggtgaccctggggcgattcacaggtctgaacccaggaatctttctgagcaagtctgcacaacgctgccttgcacggcttccttcccaacttaccacgggaggccggcccagggggcgagggcaaccggggcgagtcccggtcccggagggcgatggcgcagaaggcggggaacgggttcgggatggcccgggcgcccccttgccgcccccttgccgcctgctcactggcctccgctttgaacttgggcaaggtcccagggagggtactggccgagggagtcctggggtgggcgctcggtcccctcttccgattgctccgtgcgccccagacagaaagctgggcaaaatggacaggggagggcgcctccgccaggcacccaacgccccctccctcgcagccagccctgcggggcgccgggagggacgagcttagcgggaggggccggggcctgggttgaggaacctgctcttccgagcgcgcagggccgcccggcagtccccggcttagccgcgaggggcagggggaagccggcggagcacggccggcggaaaggggatcggggaggaaagtcggggaggcgaggtgggggcggtgggctgagcgggaacttaaaagaccgcggtggagaagatggggcgttctccgcgacactcggctgcccagaggtgcaaagccggtgggcgcacgcccggggcggccctacagccctcgggccgccagtctcagggtgtcgggctccaactaaggccccgaagcccccacgcacctgagggcattttgaccagctcttgcgggctgtcttgcggccgcagtgggttctgaaagtccattccggcgtagggtggaaaccggcgggaggcgttgctgattctcgattaaacaatagtgacgagacgcgtgcggggcgcctgcgagccccttcctgccactcggagcagagcgcgccagcgcgaggccgggccggccgcctgcgcagcgccgggctaattttaactgttgattacatcttcagcgtgtcctttcataggtctcatttgtaattgagacgaatgattacagtggggcgggaaggagcagctgctcattaattaatttctaattaaaagtgcctctcgttctcgggtgactaaagagaaacaccgttcgctgggcgatattgactcggatggaatttatttgctaacgcccggaggaatggcccctccgtccaccgcgcggccgggactgtcctggcccctcccggcctgagccgccggcgagtgaccggcgagtctgcggccaggccgggctgcgcgaggtggggctgacgtcagagcctcctccgcttcaagccgcgcacatctgacttgacgggttcgcgcgactcgtttttttttttttctttttcgtaaaatatgtatttctgtcgccgctgcgaggccgctcggtcccagagccccctcgagcctccggaatgcgaagttaaaggaatcgcggcggccaccgctgctcactttgttacccggttagaaaagtttgcggagcgcggggatggactaaccggctctcctgcttcgccctcccagcgcctagaagcctgcagctccggagcagtggccgcgccacgccggccccagcgcgcagaaccctgcaggccccgcccgtccgccccgggccgcgcccgccatgtcctacccgcagtttggatacccctactcctcggctccccaggtaagcggagccccgccccgcccaggccaccgcaggtgccggtagggcggatggggcggggacggggggtggggagtgtccgacctacgactgcctgcggcttccgagctagcaaggcctgggtcgcgcgcccctcacgcccaacccctgctccccaaacccccggggaaaggccgaggcgctaagaaaatccgacgggccgggcccgggttccctgatgtttgaaccacaaggctcaggctgtgccccaggggagtcctaggaccccaaggaacccctggggaaggaggcttggcgcgcaaatggcgtcagaggccttggaaaccctccggggaagggtgtaggtgctcggctgggccccacgtggcggaggaggccagacgcgcacaagctagtggaaaggggcgagcatcctggtgtggacggcgggaggcccgggggtactcggggcacgccctcgtgggcggcgcgcgggattggcaaggcccagggccccagcctccagcccggcttcccgccagtcctcgcggcctctctctgcagttcttgatggccaccaactccctgagcacgtgctgcgagtccggaggccgcacgctggcggactccgggcccgccgcctcggcccaggcgccggtctactgcccggtctacgagagccggctgctggccaccgcgcgccacgagctcaactcggccgcggcgctgggcgtctatgggggtccctatggcggatcgcagggctatggcaactacgtgacctacggctcggaggcgtccgccttctactcgc

SEQ ID NO: 5627 - DNA, 1233 bp, Homo sapiens
cgccggctgcgcagcccagcacaggccacaggccggggggtgggcccgggccctgcggagtgggcgggtctgagcgggttggaacgtcccgccggcttcaccgcaggccggcatctcagcctcaggccccacagcgggtctcccgtctccaccctcgcgggctctgcagggctggggctgctcctgagtttctggtaaggccttcgggagtcccagctctgcggagaccaaagcccccacatcctcggcagagcccgggcgagtgccccgcgggtggcggcggctgtggggccgtctgggattctccgcagcactgaccctgcaacctcctgtgtctgcgcttcgtggtgaggggcggcgggatgcgcgcgatccctttttgactcagccaaacggaaaagctcgcgcgtcccggctggaaggtggaggtcaggcaggacccggcaaaggcacattccaaacgaagcagaccccattcctcacctgcagagggaaggcggtgtggacggacagaaacggccctcacagccacagaaccaccgcggccacagcagcgcggcgtccggcagggagcggaccgtggtggaggcctctgagccgagcaggccacgcagacccgggaggcgctgaagcgggcgcagctgcgccctggagcaggcagaccaggccacggcggagggagaggcccggggacgcggcgcagcccctgcggagaggcacgggggcggcggggacgccctcccactggctgaaatgccagggaccggcctgggcgtggagcagccggggcgagcccgcctccaggcaccgccggctgccctaggcagggcctgcaggagtggcccggagccgggcaccgaggcaccgaggcggggacctggaggggtaggggtcggggcagggcctgccaatcaagtctacgggggtcgccgggtggtggaggtgggatgggggaaggaggctgagcaccagcctcgggcgatccaagattcctccggcctaatcccaggagggaggcagcgttggcgggtgaagccgtcaccctcccccgggaggccgcccagcagctgcccctccacgctccggggccactgcgccgggccttggtcaccacctgggccctggcccacgctcagacgaggggcagcgcgacttccccgtagccccaccccagcggctgtcgccgcagagcatgaagaggcctggctcctgcagaaacgcagcccagcgcga

SEQ ID NO: 5628 - DNA, 2865 bp, Homo sapiens
cgcctcctgccctacccgggtggatgcccgcggctctggggctctccctatgccctgactctggggagccccggctggcattggctcgcgaaggtgacctgcggacagaccagtcagagatcacgttggctggtcgcggcgcgggccacaaagctcagcggaggtggggtaggggaccaagctgtcccggcgagggaagaaactgttgcttccaaatcattgcggctggaggagccgatctgcgccccagcgtgttaggacaagggcggcgcgaggggcccaggggccaaatggggcgctgggcaggaggggctgtctcctgcaggggaggaggaatggtcccctgccagggacctggggaaaggtaatagtcaggaggggaccgggccgcaagaagcccatcctggattgcagcacgggcagccagcgcgaattcagtcaggaggtccacggggaccggtaaacgagaaggggatgcggtgaggacgccggactggcgtttctgccgcgctgacacctcgactgctccctccccgcaccgcgtcccccagcctgagacggggaagccacccagggcaccgcgctcccaaacagcggggaaaaggcgctctgggcggcggctgagtgaccgagggaccggtccggagccaggagctgggaggcgcggggatgtggtggggaggaggggagtgggggcagtgagggggctcaaatcctgcggggacgcccgcttaccctgccgttgcggtcagtctcctgcgcctcctcgacgctcaccccgcgccgcaccagcgtccgcagcagccccacgttgttggcgcaggcggcgcgcaggagggtcgccgtctccgggacgctttccgggacgccctccgggacgctctccgcgctctcgacgccgtgctcctcctcgtcctcgaaagggtagaaagagtcgtccgaggcgatgctgcgggtgtctggcagactcgagaagtcctcaaactcttcgtagtcagcggggtcctcctcgacctgcgcgccccggggtggggacggcggtggtggggtcatgcagcgcgccccgccgccctccggcccggtcccggccagcagcaccatgccggcggccggggcgcgggccgggggccggggcgcgggcaggaagagcgggacgcggggcgcgcgccgaggtccccgcttctcgcttctgcgtccccagagaagccgtggcccgcgcgctccagctcggcggaaaccggcaccaggcggctgcgctcaaagaaaaaagtctccggaggctgagcgagcccctggggtgggcgggaccgcgggggctttccgaggcggggcggggcggggcgcggggacacgccttcccccggggccttcccctcgcgccccttcctggccagagttcagagccaggcaggcgctctctcgagcgcggggactgggcacctggcagcgttgccccagagctggggacagctggcgcgggagaagcagaagcaatcactaaagaagccgaacccgagtcgcgggcggcaagcggccccgcccctccctccgccggcccgcgggatgggggcggaggtggcggcggggggacgccggggcggagccggcctccagcttcgggaacctcggacccctggagccggcctccgccgagggcgtcgggcccccggacctgggtggggccggtttctcccgccgcttcagaggagcagagcgggttttctcccttcgggggatcccgggcttcggggctgactccacccggccgcggccgcttggaggccggggaatccccggggcgcttggcgggcagaggagccgggcgcgggagcggagccgtccacctgggacctgtgcccggggagcgctgcgggccgggccactctgaactgggggcggtcggctgctgtgggggagtcccagcccggaagggaggacaatcctcagagtcccccgtctcgcggaaccggggccggccgtggcttgagggttggtcagatcctgggatggggggcggggtgttccggaacctcagggagcatctgagtgggaacggacgacgaggaactccccgtccccatgcctggcctgtgtcacgtgcggggatctgcggactcacccccggaggctgcgactgggcgctgaccccacgtctggctgcccaaaagagcagggccgcgggcgacagccgcagtccaggcccacagcccctctggcccggccttgccctctccccgtcagtcctggcgccggggatgggcggggaggaggagggcgtgtgaggatttgccacagggagcccttgacttcggggtaggaggcgtcgtgagccaatcttgggggaaggtctctgcgcaaaggcgcggaggtgcgctcgcgcccgtcgcaggtcaaagactgcggaggccaccagccctgtgtccccctagcctccttccttcctttttttcccccgatcttgacagcgtgtccaccagctgccagccggtgggaggccctcgcggccccaaggtgaacacagctaggctggcgcagccgctggggaccaggcttgaggcccacgtgccgctgggcaagctgaggggcacgagggcaccgaatccgaaacagccgtgggaggtgtaggatgaggacacgtttaaactgcgaagccgctcgagccctcgtgtcacaccgcactggcccgacccgctgtcctggtcgcctggtcttccagtgtctccagcaggagccaaagggcctgctggcggcccccgacccggcatctgcagggccccggagggtggggcgcgcgggagcaccgatttctggtgaagacgccctcgcacctgggcggctctgagcgagcagcgaactgagactcgc

SEQ ID NO: 5629 - DNA, 1154 bp, Homo sapiens
cgtgcgttcccaaggatgctcggccctctcccaacccgcggcctcctcccctctctcccgcggctgccgctgctgccgcgaaaaccaggagaagtggaacgcgcgcggcgaagcgccgctctcgcggcggcactgggcatgctccgcacccggggccggtttcggcggcggggcggacgctccctcactagccgggcgcccgggccggccgccgaggtttaggtggaggctgaggctgccgcgcgccgcgggaggagcctcgccctcggcggctgaggcggcggcggcacaggtggcgcgggccgcgcgcggggcgcagctcgggagcgctcggcgccgggcgccgcggcggccccaggctcgcgcccgcggcgacagccggctgagcggagctgcgggcgcggcggctgctctctcagcccggccggctggcggcggcgcccggagccccgaggagcccgcaggagcccgtggagcccgcggagccgggcagggggcgctgcgctcgccgagctcggaggggccgccgggccgggcgctgcgcactcgcgtcgggagccgcctctcgcccgcggcgctcgcccctgccgcccgccagcatcccttgtcccgcggccgcgctcagacaacaaaagcggaagatgctgcagttgggcaaggtcaggaccttgccctgaagccgggcggcgccgcgcacgcctcttcccggactgaggagctgtcgccggcggagggtgcatgtttgcgaggaagccgccgggcgccgcgcctttgggtgagttgcggggctgggcggccggggccgggcgcagcctcctcccggcgccgtcctcctcctcttgccgctggtgggggtggtcctgggctcccggccggcaggcggcggcggcggctgctgcggggtttctgcctgcctcggggaggaccgcgatcgcgccaggtccccctcggaagccgctgtgcctggaagggggtccggggttagtgcctttcttggagcggttaccaagtggctgccctgcgtgctccccctccctgccacccatctccccgggaggaagcgtatttagggcaacaccgacaatgctgctccccgccaccctgagaacatactcggtgcattcatgacgtccctaatatacgggaggagacgg

SEQ ID NO: 5630 - DNA, 1154 bp, Homo sapiens; identical to SEQ ID NO: 5629

SEQ ID NO: 5631 - DNA, 396 bp, Homo sapiens
cggcggtctttcgccctccccccactctccccgcccccacccccatcccttggccgctcgaacccccgaccgggagcccagagccctgccagcgccgcactgtgcgccgcgcaagtcgctcgatctccccagcggtaccggctctaagcagtaaacatctgtgcgcttctgagccagggacgcgcgtggggggtgggcgtgcacgcgggtgggccagcgcagagtgggagcttgtgggtgctttccgtcgggatttccaactcagctgcctccgagagcctaagctgagcgccgcacgtgctcgtgccatctgctgtactggacgcagtctaatagcgcagagaggtttccatccggcatccagttcgatgtgggccgtttttcccttcccagcgg

SEQ ID NO: 5632 - DNA, 438 bp, Homo sapiens
cgaggagcaggggctgcgggccgggcttttgttgctcgcggtccccgggggccgcgccgcgccgggccacgtgggggctctcgccttccgagcgggcgtcggtgggaaacctgcgcggcgagagacagggggatggggcgcttttgacgcgactgtggggtgcgggtagtcctggaggaggatgtccggccaagctcaccctgcccaggtgccggatccccagcccaggctgcggcctgctctgggctcgtgaggcgaggccgcagcgccccgacgccgggtgggcgtgtgggtggagtggagacttgggtccctcggcgcatgggagtcccgccgcctgcggtagggaaccgcctcccacccctggcccggcccgggccgggagccgtgtcccgcgttgactcggtgtaactctccagctcatttctctccacgcga

SEQ ID NO: 5633 - DNA, 438 bp, Homo sapiens; identical to SEQ ID NO: 5632

SEQ ID NO: 5634 - DNA, 411 bp, Homo sapiens
cgcgctccggctctcggggagccgccttccagacctgtctacccgggagccccctccccgcgcacttcccagacttctcctgagacccgagagcgctggttttcccccactcgcgatagtcctgggatgacagtgcgggccccctcactcgcagctcccaccacctggcggccaggggttcgcggcccgggcgggcggcgccagtgccctctggagctgggcggggagggcggggcgggcggagcgggcatggtggggtgtcgggggccgcaggcgtagcgctctcgccctggccatggagcggccggcgcccggcgaggtggtcatgagccaagccatccagccggcgcacgccactgcgcgcggcgagctgagcgcggggcagctgctcaagtggatcgacaccaccgc

SEQ ID NO: 5635 - DNA, 1137 bp, Homo sapiens
cgcgcctgccaggctcagactcacacgcacgccgcctctgtttgtacacagtgcgctcccggcggcccgctcgctcccctccagctcacgcttcattgttctccaagtcagaagccccgcagccgccgcgcggagaacagcgacagccgagcgcccggtccgcctgtctgccggtgggtctgcctgcccgcgcagcagacccggggcggccgcgggagcccgcgccccgcccgccgcgcctctgccgggacccacccgcagcggagggctgagcccgccggcggctccccggagctcacccacctccgcgcgccggagcgcaggcaaaaggggaggaaaggctcctctctttagtcaccactctcgccctctccaagaatttgtttaacaaagcgctgaggaaagagaacgtcttcttgaattctttagtaggggcggagtctgctgctgccctgcgctgccacctcggctacactgccctccgcgacgacccctgaccagccggggtcacgtccgggagacgggatcatgaagcgctcggtagccgtctggctcttggtcgggctcagcctcggtgtcccccagttcggcaaaggtaaggcgtcgggacccggacagctgggtgagggatgggctgggagtcccctgagaaacgccgcgcagggggccggaggcggtccctccggcgtgccaagggtggcgagcgccgctggcggcgcggaggaggcgtcgagtcctgggtgccccgagaaagtgcttgtaaagtctgagcagagtgcgcggggccgagcggggagaagggtgcggggtaccggggtgagatacaggaaagaggaggacggtggggagcggtagaagacagcgtccccaggaccagcgactctgtggctcactcggccactgggtctcggcgcaaaccctccctaggcagtgcgggcgatgctgactgcagacgtcgggcagggctttcgtgcgggcgggagcgggggaagccagtgcgcccgggcgtcagctagttgatgcgggaagaggctggggagctgcagggccgtccgcccccgggtgcggtgctctggcgcagggcctgggctgagccgttcgcaaacccagacccggcgctgggcgttttggccgcgg

SEQ ID NO: 5636 - DNA, 2383 bp, Homo sapiens
cggactccccaggaccgcggcgccggctggctgcctcggccccccgcggccgcgtgagctccctcttggtggtggagggcgcatttcaatctggaaactcccagcccctaatttggtcccgcagactgacgccgctcccggtggggcggtgggggtaggagggcaaaggggaggtctcctccttcttggattgaggctgcaaccaacagccccgtgagcctctattcctggctgactgcgaatccccccatcccaggtcaggggccgggaccctacagaaagacccgttctcatcctcaaccttgcggcctctgtccggcggggaagttcagctgcgggtcagttcagctgcgggtccggccaagcctggcgcgcttaggcaccctagtccctggtccgcggccgggcgaggacggagggggaggggaaggggctgctgcctcctttcccaaatccggtccctaatcgccccatcccccgccgtctactcgctttgtacaggcagtcaaaacagagctagcggccaattgacggggacgggaagcaaagccgcctagcgcctcgccccctccagccggccccccgggcccctcctctcggcgcccggaccttggccctccctctcctttcccacttctctctttgccctaacttcgcccccatcccccgctcatttcctctcgcacccgggctcgccaatccctctttccaagtccctcttccagcccggccttcctctcgggttcgccccccttctccccaatctccgtcctcttccctcccttcgccctcccccccttccttcctcttcccctcacccaaccctggttcccctcgttcctcagtcccgatctctcccttactctgtccccgcccactctgcgccggcctctcagtccgggttgagccccacgtgtggacggccgcgcccccactgacagccgccgcccgccggcccgccccgcgccccgccgggcctctaaaacccccgcgccgcgccctccaccgccgcatcttctccagcgcccagcctcccgccctctctcttgctggccgcacgccccggccccgcgcacctccgcccggctccgcagccgctacccgcgcttcgttgccctgtgggactccgagcgagcccggagggaaccctcctcttcttctgggggcgacttttgtttgcttgcctgtttctttctggtgacttttgcagctttccaatatccgtcttcggagcgcacgggaatccgccgagctctgcgtgcaggcccttttttcttttgaggttcacattttttgaaattttacgccagggcttttgtaatttcctcccccgcccgctgacggtcctggagtcgctcggggctttaggccggttatgcaacgtgtaccgctcggggctgccggctgcacctccgccgcgcctcgccgctcactgcgctagacccggcgccccgcgtctcgcttcgcgggcagtcagggggccggcgctctgtcgaggtctccagctagagcagggagcccgagcccgagggagtccccggagccgacgaagggcttattagaccctgactcttttctgaggcgcgcagattttgtctttgatcactccctctccgcgggtctacggccgcgcgctttcggcgccggcgatggggagaagacggaggctgtgtctccagctctacttcctgtggctgggctgtgtggtgctctgggcgcagggcacggccggccagcctcagcctcctccgcccaagccgccccggccccagccgccgccgcaacaggttcggtccgctacagcaggctctgaaggcgggtttctagcgcccgagtatcgcgaggagggtgccgcagtggccagccgcgtccgccggcgaggacagcaggacgtgctccgagggtaagtgggcaagcggctccgcacctagggctccggcttgggggaggggggaatcctcagtttggcggctttctggcccactccgtcccagaccctttagctggagcctagagctgcagccccctttgccagaatatccaaagacccccaggagcgcgtcccccttttccttcccaaccccgcagctcagcgggcggaaagccctctctccgggggttgggcggcgggtggttagggggtccaggggtgccgatcgcagagcgtgtgcagagctcgcgctgcgggaacaggttctgaatgtccggcggcaggcgggcctgggtccgcctgctgcaggggccagagaagcctgcttgctccccacgtcggggccgccgctcgtgagccttttgtttgaggacgtgtgcagggttcacagctcaccttctcatcgtcaacccgagcgctccaccttgcgacgcgctttccttgacacgtcgg

SEQ ID NO: 5637 - DNA, 2367 bp, Homo sapiens
cgggccggcttcccgcttcggaggttggggagggggtcgtgggtctctgcgttcccaggccaagcggccctggaggcacggactagcaggacgccgaggtggcgcgggtcgcggcctctcccgcagcagctgtcggcgagaaccaggcagggaggcgccgctgctgactgcatctcatgaaagattcaggcccggctgccgcgctgccatctcccggcaccttgcgccggaaacggtcgctctggagcccgtggccgtcggcgggcaggcttagccgctccagtccctgagaaaggcaggccacagcccgacctgccctgtggtcccatcccataatcccaacagcaagcaggctcaggctgggcacttcggggtaccaggagtaggttcggccaactggtttccaccatgaggcttcgcgcacagggttatctggccacgaggcaacgctggggagccctgtggcctgagggtgggcaaaggacaggctcccagttcccttgcgtccagcccgtctcccagcggcagccagccaggaacggcctgcggggccacaggggtggaggcgtcaccgttcgcaggcccgcagcaggatggtcgctgggggatgtgcaggcataggggttggacaaggggccccagaagtgtctgtcctgaggggttggtgtgccctttcctcaccagcccagcccctgaggagagggaagaaggcaattcccccaaccagggcaggtcgggcggttgccccaccctaacaccccctacccccaaacacagaaaacctggggtctgtcctcaaacctccctggctgccacgctctgggcagcggactctccctgccaacacgcaagaccagctccctcccgcaggctgagcagaaagaagaaaggtccaatctcaaaaccccaaactcgaccaccagcccccgtctaaacggaagtagggccagcccctcacgagtcaggtgggaaactgggcccagggagagaaagtgccccagggccaggctgggacccgctctggcttcgtccgcatgcggcagggcccctccacggaggtcccagggcgcgctccccggcctcgaggcccggccgccagccgcgcggaccccagcctacgccccgagggaggccaggacccctagccggcgggactgcgcgccgcccctctccccgcaggtcccggcgaacacctagcttcccctccccccacccttcccgcctcccggccagtgtccccgccttccccgcgggcgacgggcggcggcggcgggaggagcgggccgagccgaggaagccccggcctcgcgcgctgggatgtagcgaaccagcaggggccgaagaaccgtgcagtgccagagccagagctggatccggggccccagccggagccgaaacctgagccagagtccgcggcgggcgagcccggagcccacgagccgcagacgcagcgctgcccaggtggggtaagagacgctgggctaggggcgcagggtctccgcggtggaggggcgcagggaggtggcggccgagtcctgcgcagtttgctcctggcgtgtgtgggtccacccggcggcgcgggacagcgcaaggcgcggaaggtcaggagccttcgaggcagcgcgaggagctcgttcctgcgcccagggcacagtcatagccgccgtcaccgggtgctacctcacccaaccggcgggatcaaccctctgctttggctccgggcacctcaagagggtagcagcctcgggggcacgggccacggccccgcgaagggcacaacctgagaagcccgtggcagcccctcgcagcgtcgggtgacacagggctcccccacccccaggagaagtgggcaggagagagggccgcccgctgctccccgctgcgtccagggatggagggccccaccacccatggaattgctggcccctctgcgtggcccgggacttcagccgtggcttcgcgtcaagagggtatttttcctaaacgaaaccgcttcgttcgttcgttcgttcgttcgttcgggcagcaatgccgcagaaaagcagcagacgtcggtccgcgccctggctctcttcgccccggaccccgacgtcccgccgcagcgctcggaggtgcccccagcccaaggcagcctgctctcgccggcacaggtcgggctttttcttcccaggagagaaaccccaattcccttcgtaacgtccaataaagacattcccgcggcttctcccaggtttggttgttgacgcagggtcccggagcacgcagtcgcttctcaagaaccgggtctcggatttctgaaattgaccagcttcgtaaattggagcctattctcccgcggcaaaggcagggccccaaagccgggatcgc

SEQ ID NO: 5638 - DNA, 1235 bp, Homo sapiens
cgaagtccagccgacccttgattgtcagcatcccggttacaaggtctaaggcgaatagttgccgcacgccggcgcggttgtggctgccgaaggagtaaataatttcaccgttggggccttcatccagatccgttgcaaggacttgtaccacgcgcgtgccggagggtgcatcctccaggacgcgcgcccggtacaaggactggttgaagacaggcgcattgtcattcgcgtccagcaccttgatgtgaataggcaggctggcggagagagctggggtccctccgtccaacgccgtcagcactaactggagactaggctcccgttctcggtccagggcgcgctccaacaccagctccgcgtacttggtgctgtcctcccgcgtctgcacgcgaagcgcaaagtattcatttcggctcagctcataggtttgtaaagagttgcttcccacatcgggatcgtgcgcgctctcgagcggaaagcgcgtccccggagccacggcctcgctaatctccaatttcatttcctgggtagggaaagcaggattgttgtcgttgatgtcctggatcaccacttccacgctgaacagctccagcgggttctccactaccaactccagagttacagtgcaagagggcagtgtcccacacagctcctctcgatccagacggtcgttcacaaacatctctccggtctcccggttcacctcaaagaatcttcggctagctccagacaccacccggaacctgcgggctgagaggctaccgagatccaaaccaaggttcgcgaccacgttgcccacagcgaaacccttctctctttcctccgggatctcatagtgaatgaccgtggaagccttgttcaaggcaccaagcagaagcaaaactcccactaccctcccggtgcttaccagtccgctcctccaggcctctgggaccatctcactcaaaagcagttcctctcagcggggtccagatcgtccctgagatttcgctgagaaactttcagcgggttagcgcttgggcgctgggcgccgagtccgacatggctttctggatgccgttgatttgctcgccggctgttcagtctctgcctcatcccggggcgcagaaaggggacgggcaggggcccgatctccagcgtcttcattggccgacagcggcacacagagtcccagccaataactgcacgaagaatgagctagcgccgggctctctgagcaggacacgcgctagcgc

SEQ ID NO: 5639 - DNA, 3043 bp, Homo sapiens
cgactcaggagagctcgacacgccggatagctgcggccagccgtggccatcctggccccccgcctccgccttccccactcccgcgtgcagccgggacacgggaaaggaaagctttggaagtcaagcgccggccaaaagatgacctgcccgcgtgtctcctcgccccctcccccagccgtgtcacatggcggccccaaccaggcgggcagtgcgccccgccgcggagacccagggccgcgtcgcctgggcagtgggtgatgaaacttcccaggcgcattaccgcagagggcgcgggcggggcgcggggcgggggtgggggatcgagagctggtaccggggctcacctgttctccaggaggagggtggggacggggggaggggcgagtgcgcgccaacgccgggtgcgtgccctggggcgcttgggcgcggcgctcgtgtccccgccctcccccagccctgcgagccccccgagctgcgccgtggggtgacgggaccgagagcagttcctgtccccggccccggcgcgggggagacgtgagcgtgcacacgtacacacacagcaggggaagaggcgctccaagcggcgcccaactttctccttccctccacgggccgggtgagaaagtagccgggggctatcccgacccggcggttcttggggagggggccgaacaagaaaagggaggagatggagataacttccccggatttagcttttttgtctttgtttttgttctcaccacttccatcggatgactggagagtaaaagggaacccggagcggggtggcgagcagcgctttgagaaaatgcaggagtgtgtttggagacgcgtaaagttgcctttcaagctctggcctccgggcacgcgatgctccgcggcgggctgactcagggctgccttgggcctccctgccaccctcctggaaatgatgcaagtcctgactgtcacctggatccctgcagcccagcctggaatgcgtctggattaggggaaagacgagaaacgacactccaggtgttgcacggcccaccaaagcgggaagatagggcagttgctcagaccaaatactgtatctagtgcttctgctcctatcttcaatcgtggggttctttttaatgcaaagtgtcacaaggccaggaattcccatgtgtgctcagttggcccacagcatcattgtgcctaggaaactgcttcaatttatcaagtcctctgggctgggaatctcactgaattccaaacggcggaaagaggaaactttcccaacccgatgtgggtgtgacgcgagccaggggccccagggacactgtcccagagcacaccgtccccctttaacagcaactggagcttggattcgctcttatattgtacagtcctttcgaccattgccctggagcacccgcacacgcgcacgcatctccggccgcgctcacacacactcatacacacgcacgcaaacgcgtggccgccgccaggtcggcaactttgtccggcgctcccagcggcgctcggcttcctcctgtagtagttgagcgcaggccccgcctcccggccgtgttgtcaaaagggccggggtctcggattggtccagccgccgggacaacacctgctcgactccttcattcaagtgacaccagagcttccagggatatttgaggcaccatccctgccattgccgggcactcgcggcgctgctaacggcctggtcacatgctctccggagagctacgggagggcgctgggtaacctctatccgagccgcggccgcgaggaggagggaaaaggcgagcaaaaaggaagagtgggaggaggaggggaagcggcgaaggaggaagaggaggaggaggaagaggggagcacaaaggatccaggtctcccgacgggaggttaataccaagaaccatgtgtgccgagcggctgggccagttcatgaccctggctttggtgttggccacctttgacccggcgcgggggaccgacgccaccaacccacccgagggtccccaagacaggagctcccagcagaaaggccgcctgtccctgcagaatacaggtaagtgcatgtgcccccgcagccgggagctactgggagaggacaccgtgcacccacgcggcgcgccccaggcgtttcgccgggagccaggcgcccacccagggccacgcaaactcttgggatggcacgggacgtgcaaagggaagcgcgaggcaaggcgaggtccgcgccgggctccgagggcccggaatctgcacgtgctagcagggtgatgaaatggctggggcaggacttgttgctgtcctccccagggtcgaggggaaatgaagcagcgtctgacgctgccagcgccagcccccgcccccgaatcccgggtccggtgcaaagcgcgcttcatcccggccggcacgcgggaggcccagagggtccccggagctgggctgcgccctgcgcccggagaacttctcttcctggcctgccggcctcagtaagggtgccgcgtcttccccctcctcaaaagatgcccgacatcccagaactttgccggcgagacaaatggcattgcgaactttccccctgggggcactgctttcggaagggagcgtgagggcagcgcaaagcgtacctccgcggtgctgccgccatccccagctcctggccaggtcagcaagccaagaaatggtgacacgacccgaaccgtgcgcctcctctgctctaccggctcttggctcaccggcaagctgcaaagcagagccaggcgtgcagggcacggggctggcccttttcccagctcggaaagagaaagaaaatctgcctacagctccttcgctccacgacccctcccccgactttggggggccgtgtgaacgcggcagcggcggcgtgcgtgcgctcaccgcacgagctggaatgcacgagtgcccattagggacgccccaagtgagtgaatggcggccctgtgcggtcctgccccggcggcgcgtggggtcttacggatcctgtcgcctccacatgctggggccggcacccccaccaccccgagaccctcgc

SEQ ID NO: 5640 - DNA, 864 bp, Homo sapiens
cgcgatccaacccccaatccgcgatccaacccccaatccgtgatccaactcaaaatccccgatccaaatcccaatccgcgataccaagtctgcgatctagcccagaatccgcgatcccgcctggtccacccttcagcagcgacactggcggcctccgacctctcagacctagtgagcctcgcaaagccgcccggctcccggaagccgcaggtgcaggcgccgctgggctcgcgggttctcctggctggcccgggctgccccaggaccacggacggaaaatcgcaggcgcgcggcccaccccgccttaaggggagggcccgcctggccgtgtagcccgccccgctcctccttccgaagagagatctggtgctggcatgggcaccccgcggccaccggagtggcttcccggatgagcctggcttcggcgctgacgctctggccctgggggctgcctggctggtgtcaggtagcggaagacgcctggagagtcactcgctccttcccccacccgcccccaccgctgctcgtgccaggacgcgcagtttgcagttgcagctcaggcactggcgcgggatggcggagcttcccttggatggcgtcagggtcaccgagtgcacagcctacctggtctgagggtctgctcctcctggacacctctccggatcctgatccctggcgctgggcaatccacaggatgagactcatcggctgctggcgaagccgaccgcctgactttgctgcctgggcggctggccccgggatccgcgctgctggggacgcgggcctggtctgcggtgtccagccacttgctgcgggcgcgccacgtctaggctggtggctgcagccgcagctccgcgcctgcgg

SEQ ID NO: 5641 - DNA, 2071 bp, Homo sapiens
cgttcggccggcgccgctcctcggaggttgtgcccctggggtggctggcggcggggctcccccggcccggcccgcggcgcttctctgccgccgcctcggggtgtctctgcttcgctgcgagcccggcaccgcggcgacggcggcgcgaagagggaagcgggcggcggcggcggccgcgccaagatgcgccgggtcaccgcaggctgaggcgcccgccgtccccgccctccccctcgctcgcctccctccctcccgcctgcctccctcgctcgctcgctccttccctctccccgccttccctccgcgctcccccgcccgcccctccgcgcctcgcctcctccgccccgcgccctgcggtgctgcagctgcgggcggctccagctgcccccagatgtgggctgggcggctcgcggggaactttcgcgccggctgcgagtgcggggccccggctgcagtccggctgccatggatccgccggcgggagccgctcgccgcctgctctgccccgcgctgctgctgctgctgctgctgctgccgccgccgctcctgccgccgccgccgccgcccgcgaacgccaggctcgccgccgccgccgaccccccaggtaggtgcggcccggcccctactccccgggacccccgccggcctggccctgtcccgcgtgccccgccgccccctccccaggcgtcgtccagcctgacttgggcaaactccgcgcgccccgcccggggccaagttggccaacttcggggccgggttggtcgcgcagggggcgccccgcaccgcccccgagcgccttgggccgggggagcctcggagcactggcggctcctgagtcgcggagggtggggacggagggccgggaaaagccccgcggccaagagcgcagagtcagccccagcgggtccgaggggggagccagggcgaggcggcgccggggctcgcgtccggggacgctccggaggagccggctgccgagcgcgtagccttgggccctaaggattggttggggcgccccgcagggaatccccggagatcggagggaccctgttccacccctcccagtcctcgggcgctcggggagacggggccggcagcgggctgagcgggagctggacaggcaggacaggccgctcgtgctcggggaagccgagactccgccgctccggaggctggcggtgagggcactcgggcggcaggggcccgccgaggggtcgtggcacacgggtaagggggccaacccggaatggcttccgagcagctccacgtcctgccaaggacggtaggtgcaagggtcgggggactctctgacggggtcgtcccttcgggcacggggaggttcccaccgagccccaaccctgaacggggcagggggcagagctcttggcaggcaaggtctccggaggagggaacggctggggagtggcggagccccggagtggtggccctgttaacgccccttcccggttgcaggaaagccggggaggtgcaggctggcttctggggtcgcctggcggaatgccccttcccttcgcagtggggcggggtctgggggggcgtggcttgccggcgggtctctgaggcactggggctccgtggtctccgccgatctaacgccccttcccgttgcaggcgggcccctggggcacggagcggagcgcatcctggcggtgcccgtgcgcactgacgcccagggccgcttggtgtcccacgtggtgtcggcagctacgtccagagcaggggtacgagcccgcagggccgccccggtccggaccccgagcttccccggaggcaacgaggaggagcctggcagtcacctcttctacaatgtcacggtctttggccgagacctgcacctgcggctgcggcccaacgcccgcctcgtggcgcccggggccactatggagtggcagggcgagaagggcaccacccgcgtggagcccctgctcgggagctgtctctacgtcggagacgtggccggcctagccgaagcctcctctgtggcgctcagcaactgcgatgggctggtgagtacgcacttctctagctcctttctctccgctgctctcgc

SEQ ID NO: 5642 - DNA, 1170 bp, Homo sapiens
cgagcccgcgccaagagctacgccgagacgcgccgtcggtggggccacgcgagatgcaaccggagagtttaaaactagcccaggaccaaccccccagggatccgctcaactctccccgcagaagagtttaagtggggcagtggccgccacaggctgaggatgatttccggacgcgccccaggcgcgaccgcactactcgtcctcagttcaaagcctgagtgacttggcaccacttccccaattgttttttatttccttcgcatccctgttgtgtctaccgctttcacgtatttgagagcctaaatcatgttaagacgacttggagaaacgcccgatttgcctcccaagccacgcaaggatccacccagacgcacgcccgcgcggagacgcacgctggcacacgcgctcacacacgcgagcacacacacgcgcacactacccggttcgtgcgcgcgggtcgctgttcctgttgcattatgcaaaggtggctgggaaagcgcgttgacttacatttacatagcccatcttctccccacagtatgtgactaatacgtatcccggggaggagggagcgcggctgggggtgctaatcggaagggaacagacagtgagtgccatcttgctgggaggttccagaagcaaagcgccaacgacgacagtagcggtggcctcagctccaccagtaactgccgctggcaggagcaccacacgctctaggagtttcccgggtatcaagtatgggtccagcccgtcccagttatcctcttcccctatggcttcattcccgttgtcagtaccccgacctcagcttgcaaccttgatcttgggcttgattataaatgacgaaagaccgcggcagccttcaaagtgcgggagcgagccccgtactggtcagcgcggcggagggatctttccaggaggccccaagcccccaagcctgtggagagacttggtaacagctggcaaggcctgctccagccaccctcgctggctccttgcccctgcattcagcgcctgagggcgttattcgccctctccctgcgtcccacgcaagcggctcaaggaactcactcgatccggattccgcctcgtatgctctccaagccttcgccacctccgcaggcgctctagaaaggcgtgatggccccagctcagtgcccgccagcccga

SEQ ID NO: 5643 - DNA, 2168 bp, Homo sapiens
cgcgccacaaacggggacttaacccactgcccgatctctgtcagaggcgacccatttgcgcttctgctatcgcacctccgcccgcgttcctgcgccccaggttccccgctgcctccccgccccctgcagcgcgggagcgttgcttcgcctggcctgctggcctcctctagaccttggccaccttctccgtggcaggaagggctacatgcactgacagattttccgttggtggtggctgggtggtggcgaggcgtgtttccgggcgcgcttaaaacctagcagctctctccaagtagcagcttcccctactccgcccctaggactgaggacctagccctcgatgccccctcacttctccccgtcctaccccgccatcacctcctaacctctccagtatactctcaagcctcacacgggcgcctgtcctccctttgcattccctagctcccgggcgccccgttcggttgaagtttacgtatcttgggacctaattgctcccaattatccgcgcagcctaagtcccgcgtctgcctggctctcgccccgggagcctgaagctaccgggcagttcattgggtgtcctcggggaaaaggttcaagctgtagagatgagagaagtggggctgggggaggggagaggctccagaaggaagaccacgaacacgtgcgaagaaataaaagccaccacgtgtgcacgcgcgcgggggcccaagggcgcgagcgcggagcacgccccagggggccagggacagtggtcccctgcagcgggcatagcagggggcgcgggtactcacacgaaagcgtggtagatgaacgcccagccgcggggtctctccagcacgttgtacaggtagttctgcacccgccggtacttgacgttgcgccggcagctctggctactcgtgtaagagagcggcttccccagcaggctcatccgggccccctgcttgccccggcggctctccctcaggccaccgccgccgccaccgagcgtggccgcgcgggtgcccagcagtagcaggccgtcgcccctggcggctgccgagttcagcagcaccctgccccggccggactccacatccttcatgccgctgcccaagcgccccccgcccgccgccgccgccgctgcgccgctcttcacccagagcccggcggcgccgccctcctctcctcccgcgtggtggcggggcatggcatcaccacgggcaccgcgagggggccgccagcgcctgcggcgggggcagcggcctcatgtgcgccggcgggtttcaaggaggaagccggcggccgacggggcgcccgccagccagagacctctgagccgggggcggggaagcaggcagccagcaaaccgcccgggcttcggggcgggaaaggaggggctgcagaggaggccgaggagtcccaatttctaacagcctttagcttcgaattctaaatccggacctgtttggggcgtcactttgagagggtttctcttgctccctcattcccgcgactaccactccctccttcccaaactgcccccggggatagagtgggggagtgcggggcgctccgaggcgcgctcccacgcgcgcacacccagccccaggcttccccttccctctctccactccccacgccctgcagcgaaacggccccagaagcccctctccgaggcgcgagttcggtttggttctggcaggggctttgcagctgtccggaaggtgaagtcagccttgtgtcctgaggagaaactggagatgcaggtcgctgtgccctcccgctgctacgtcgctgcgccggatcctgccatccttccgcaaggggtgagagcgggaacagccctgccctgccttccaggtattatctagcctggaggctggagcgcaaggtaacgctccgggaagtggcactcgggtccccgcacacgggcgagtcctcagcagttcagtggacagacccgcaggacgcggctgccaagtccgcgaggcaaggaccaggcatcttcccgcgcctcactccagcctgcggactgtgactttccatcccagtatcagacaagctcgcgagtaactgaacatcctttccagtccatgggtggggtgtggaaagggcgtaaaactccaaagtggctcctccgcggtgagcgagctgccccggggctctgcctgactgcagcgcga

SEQ ID NO: 5644 - DNA, 2053 bp, Homo sapiens
cgggaagacctggaggtcggtaaaacggagcggtgcgggatgatgtctgggaacaccggcaaggtgtcataaaatgaacgccaaggcggccacaagaggacggccgggaaccgaacccagcgcccagcacggggcccttgtggccgacgtgacgtggctccgtcaggtggaaaccgtgcgatcctctcccgatccaactcacgagagataaagatgtctaaataaccacgaccgccgccgcacaccctgcagggccccgggggcggaggggaggggagcgcctcctcggcagaagcggcggcccaggcttgtttggaggttcgcaattcaccatgataaatgtaaagaccaattaaggtttgatccgtgcacacaggaggcagacggcggctgatagtggaaacaattaacgagcatgtcccctaattcctgccgcggctgctgagcacaccgcggctccccaggcgcccgccgctgccgcccccgagtcccagagcccccagtccggccctggagtggggcgtcctcctccagcgaaaaggtgcgaggagcggggccccgggtggccggggagggggcgcgccgggccgggaggcgcggagccagccgcctacggagcccaactgtttgcatcggggaccggcgggcggggcgcgcccgagtggtctcgccgggaaagggcggcgggcgctggagaaggcgcctggcgcgaagctgggcggcgccccgagggcggaggacaggtggccgcgcgaccgcagccaggtagcgaacggctcgggggctgcgcagcgcggtcccaaagctcagcccggccccgggcccagctcgctgccgcctgccacgggagcggccttgcgcggagggagggggcgcgagaccgcacccccgggcccggcgcgcctcggcctctgggctcccgctccccttccccttccggctcagcccgctgccccagacgtgacccccgcggaaggtgttggcgatgcgcgctgcccgggagcgtgtgattaatggccccgaggtcgtgggcggcgcatgcaccagccccttcttggcctggtcagggtgtgagggtatccgggagcacagcgaggtcatggcagcgggggcctccgggagcgcggcggcggaggaggaggaggaagaggagaagtaggtgacgcgggccgaagaggcttgtcccctctggccccagggctggcgccgcggcgggtcccccgccccaagcaaagtttggggctacgggcgctgcgctcaggtccctccccgcgcagttccctcggcggggtctgtgccgccgccgctgccagggcaggacaaaggctcattaacacgtgatgggaccgcgcttcataaatgggactggagcgagagggagccagagacagcgcgagcggagggagcggcagggactgcgcgagcgggacgaggcgacgggcgcccgggctggcggagacgggcggccccacgccgggccaggcggggctcgcgggaggacccagtgaagagcctgggaaggggcgaggctcgccggcggtcggagcagcggggcgccagtcccggtcgctgtcgcgggcgggcgctggagaccgggacgccggcgctcggacggactgacttgctgaccgcccgccggaggcacaccccactccaccccaccccgcctcgccagcagcccggcgccggcgccgcctcccgcacgctactccctctgccaccccttccttctccacttcttttccgcctccgcctcttcttgtctcccgcggcgccagcgccttcccttggcccgggcgggggcctcggctccctgcagagctctccgtagtcagtgggggatatttcgttctagcggacaaccagcccctgagctgggcgagaggtgccaagggagcttctgtcccgaggaccaggggatgcgaagggtaagacctggcagagttgcgtttggaaatactttttccgcctcccgccccctcgggtacgaccagtgtggtccccaagtgtccttcgtggagttcttattccgtgtgagcgaatcgtgcgtcgg

SEQ ID NO: 5645 - DNA, 1679 bp, Homo sapiens
cgccccttcccgggaagactcgttacaagtcgcgctccccgccgcccccaacctcggggtcgctctggtcgtctgtgaagcagacgtccacgtcactgtcgtcgctcttgggatccccaggctccgggggatagccgggctcggcacccgggccgtcgcccgctttggcgagcagactctggccagggtggcgggacttgacatgtcgctccaggtcccggcggcgcacaagtaccttgccgcagaactcgcagcggtagggcgtattgccctcggcgtgcagccggatgtgcttgttgagattgctggggtcgccgaagggccgcagacagactttgcacttgagtggcttgtagcccgtgtgcgtccgcatgtggatcttgagcccatacttgcgcgagtacagcttgccacagtagaggcacaggtggccggtcttgggcttacctgcgccgctgcctccgctgccgccgcccccggtgcctcccgccgccgcgacggccggtggcaacgtccccgagtccaggcgtccgcgacccttcccggcagccatctcggacagctgctgattgtgcatggcgatctctcggtcgatgctggccagcgaccccagctcggcggggcttagggcggccgctgcaggcccgctgaagtaggagatggactccggatacttcagcagcccgccgaagtgcaatttgagcgggtaataagcggtggtggccggtgagccgtagagcagctccccgttgtagactgtaaaggccggcatgacggcgggcaggtggctgcactcaccacccggataggctttgagaccgcccgggtcgaggggcggcagcgcgcagcgctcgaggggcaaccccggcgcagggggcagctgcgcataacgcgctcctggcagcgcggcggctgcgggcggggcgcgctccacgtgcttgaaggcggacgcctcttccggggggacggagagcagagggaagccgcgcagggccccagagcagggcaggccaggcggcggcggcggcggcgggtccccagcgagcaggcacttgggatggtggtggtggtgcgcgtggtggtgatggtggtgacccgcgccgcccgccgccgagttctccccgctcccggggcgcccgcacgcccggcccccgcccagcagcctgcccaaagcgaggccggctccttgcttgctgctgctctcctcccggtaggggtcgccgtgagcggccgccgccgccctcgctaggccggcgggcttgaaagctgagcgcacgccggggtagaaagccaggctgccgacccccgccgaggagccgcccacgatgccgaggaagtgcccttgtcctcgggcggctccgctcatgtccagggcacggtccagctgctccttgcccttcttgggctgcccccacttgcctggggtcggcgaggtggccgagggcgcggaagaggcctcgcgcttgatgccctcccgcgcaccgcaggcctgaactggtggcgggcccagggggtggggtcgcaaagttcctgcctgggaaggcgcggcgaaatcgggcgccgggggttttggggagagaccgaggccatcagccgctgggacggcgccttggcgagccgcgtgttcgtggtgcaggaaggcgccgcctccaccgccgctgaacacgcagtggaaacgc

SEQ ID NO: 5646 - DNA, 1474 bp, Homo sapiens
cgcgtgtcagaagtccctcccgcgcggcctcttccccctcttcctccgcagcaggaggcctgacccccgcgtcctgcacccgtgtggaccaaacgttcagcctcccccgccacaatcggacgggaactcgcgcgctttccgggctattccctgtttgtgctgagttatgggcgaatctcccaaaaaggagatatacgagtgggtcgtccaactttgaggggaaacgaggattctctttctcattttctctcctgatttctctccctacccggaccgcacttctcgaattatccccgtaaggaggaacgacgaatgccgccggtcccacgagactgccgccccccactcatgcccaaacaaggatagaatcttgtagcgaggcgacaagaaaataaataagcgggcgtttcaaaccgagtcctcgggtgtgcagacccgcagcggagtcgcgggagcgaggtgggaaatcctggccgcggcgccgggctccgcccgccggggggcgcggggcggcgggcgcatgcgcgtgcgcggtgcggccccagccctggctgccgccgcctgccgccgccgtcgcgatgcctattttagtcaaagcggctgcgggcttggggacccggcccgggcagcggagcttccggacccgccgacccgccgaggagcgcgcgtcgggctcccgtcgagcagctgagcccgtgtgccccgcgtcccgcgccccgaagctgccgctccgaactttggtcggcgctgcccaggctccccgccagggaccagccgggtaaggatgggaggcgcagctgcagccggctttccccccgcgccgggttgtgtgcggcctcgcgctcccctggctaaatcgggaagcgaaagttggatctcagcccctcggggagcaactttgtcggccctggcggcagctgcttgttctacgcgcccgggcagccgggggcgccgccctctgtccctcctcgctggccgcgccctcgaggggctcccggcccttggaggccgcccttctccccgggtctgggcgctgcggccacagagaccctcaacggtcagcggccgccgctcaggtcaggcagccccagcgtccccgggccctcggccccaccgagtgccggctcccgcgctctgcggcggcaagccccttggtgagctccgtctctgctctctccgccgagtctccggggttcctcctcgccccctgtagggccgcctcgagccgcgcagagcctgcgtgcagccgggcgcgcggtgtcgcccactccgtccccgctcggagagtagggtgggccacggcgctcactcctcacccccgcgtcccgagagcgcctggccgaggaggaccgttgccacggaccctcctcctttaaggagcgaggtcagagggccccgggagagcgccgatggctggggacccgaggtccgcgccacccacccgcaacctccttccccgagcctttgggaacgg

SEQ ID NO: 5647 - DNA, 675 bp, Homo sapiens
cggctccggcaatccccgcatcccggctgcgccggtcgtggtcggacgcccgagacgcgcggaggcacagcagaccttggcgtacaggccatgccgccgcaaacggggggcgcgcactccttcccaaagtccccagaggagacacgtacctggtggtagggggtgtaggcggctgcgaagtagggctgcggaggaccatagacttggtacataacatccagacagctcatgactctccgcagcggagacggttaagtgttttttcattaactctccttccccggagctcaggggtgctgcatgggcggcgcttggacccgcgctctggagtcatcaggcggagcaaagccagcgcgctccgcggctcggaatccagctggctcgctaccctcccactcctgcgattttactcccgaccgcgctccagggcagaagcgcctgagctcccgctagtgggcatttaaagcccatgcccggcgggcgtgctgacgccactcgggggctgcggagcgggagggggcggtggggggcggggaccggggggccaatggggagcgagggacgcttgttggaggggcagcgagtgtgtttcccggggcccacctctgacaagcatgcggccaagggtgccggagactatgcggttcccagcggatccgaggcttcgcaccgcga

SEQ ID NO: 5648 - DNA, 1133 bp, Homo sapiens
cgtcggccaccgtcgagcccccactttatccaatcagatcgcggggaaggacacgcaaacctgccgagggctcgggggctccgggctgctgctgctgccagcgtcctgggaagtgacaggcattaggacctgctggcgcggcggcggcggcggcggcagctccagccgcgcccgccacacataccttcactcgctcggtgcacacgccgcgccgcgggcagtgccgcctgcggaggcgcgctcggggcccgcaggggcagcagcggcagcctggcagcgccgccgcgccctcgggcatctggcccgcgaagtttcgcccctgccgctctccgcgccgctcgcctcacgccccccagcgcggccgccgcccgacgcgcgctcgccctgcgctcgccgcgcgccggctccgggggcggcagaagcgcgcgagggccgctgcccgcctccctgcgcagcccgcggctcctaggcaccctgcgttgctgggcccggcgggcgggggtggggcggggagcggggcgcgggccgagcgggggcgtcccggctccgcggtccccggcggctgctgcagcggctgctgcgcgcaatgatgcgggtccgcgccgcgtcccagcagcggcgctgcccctcccttcgcccagatgtgtgaatcctcctcctacaacaaatccttcatcctgctccctgccgccccctcccagggggccaactttgaggaccgcaggggctgccgcccaggcggccgcaggcggcggtgtctaggcggaaaggagcggcgcgaaagcggcggcggcggggaccggggcctcggggcgaggagtctgggcggcatgaccgcggtttgctgagctgaagtcggtcgtgctcccagagccactccgcgggagcgaaccgagtgtgtgtgtgcgcgcgcgctcgggggagaagggaccaagaggagggttagggaaggaagctggggtcatggaacaggggtgcaaccgaggcatccagagcggccggaaagcccgagtggcggagaggccagaggtggcgagaaggggcgcggcggcaccggacgcaccgcccagcacctggctcccctgggctcccgaggatctgaagggtcggagcgcggagagctacggagccga

SEQ ID NO: 5649 - DNA, 1808 bp, Homo sapiens
cgggcgggggacgtccggcagctctgcaaacgcgcagacacgcgaaccccatcgcctcgcgcgccctttggctccgctggtgcgtgtcggggatgcggccgcgcaggcgctcgctccctggcttcctggccgggtagcgggcgttcggctaccggagtccagcctaagggcccagccgaggtctccccgcgcgaggcggttgcgctaggtgagcgggtaccgcggccgcgcctcccttgtcatttactcagcggtcagaggcatcctgcgtctgggagtcccaagtgccttcggctgggtgcccctgtccgatcctcaaaaggaaagcacaaatcccgggtgcgagtctaacccaggaccgaactttcccgcgaacctgaagttaccatggggcgggagccaccttagcgccgcgtccgcccgcccctcgcaccggctaggatgctgcggaaggcaggggcgccgagaggcaagggtgaaagacgccgtccatacccccaaagcccgaacctgcatctcctctgcgaggcgcagggcgggaggaccgctgcagttgggagccggctccggacaggcaaagcgacccgacaggtgaacgcggcgggagggagcaaacgcgtaaaaaaccctgcacttacttcttcgctggcgccttccccgggaggcgttttggctgccgatgtattccataaagttcaaaatgataaaaagccaagaaatcagtcgcaagtgcatagtaacccagtaatgcttcccttcctttctcctctttcttttgattgttaattatatttaatgtttttaaaatatatgtaggtgttaggcgtatatagacagtgcccgagcagcgggacttctcctctcacatccgataggcgtgctgtgatggcaagcgaagtggggcgggtggacagggaaaccaactattgtactttcaaattatccaagcactgaactgcggcggcttcgctggggtggctggcatcgccgcgaaccggggttccaggagccgccggggcggccgcaggtagcatgttgtgcggcaactgccgcaggcgggatccgggcgggcgagcggcggcggcggcggctgcagcggcggccccttgggctcagaagctgcggcggctgcggctgcagcggcgggggcccctggagcgcaggggagcgggcgccgtcggcacagcggccatggccaaggggcggcggagagaccccgagctgcttctggcgtgcgcgagcaggagacgctccagtgttgggctgggctcccgggagcaccacataggggaggaggaggaggagggcagggaggggggagggagaggagggcagggagggggagaggaggggggatggctgtggggggcgggggggagctcgggggcggggaaggaaactgctggagcaacaaccctgagcgacctcaataactttcaatttcaagagggaaagagggagctggaaaagtacaggcgttgcgctttggcagagggacgggaagaggcgcctaaggggtcccgggtctacagcgcagcatctctggacactgcagtgacggccggagaattccagccagaagaatggggaaagcagtgcgtgcgaagagcccctccagaagggcagctctggcggggagacttgggcgcactggggctggcaggcagtgttgaggccgaagaccccccacccatcccagttcggctcctctccgcggcctcaagctaggcgcacccggctgtcggtggccgtgcgcccctgcgcccttgtgccccagcgcccccaccccatccccagcgccggcgcgc

SEQ ID NO: 5650 - DNA, 1323 bp, Homo sapiens
cggtttcggctgcggtggccgcccacccacctccccactcccgtcagcaccctttccttcccctcacctgtcctgagcaccgggccctgggggtcgggtcgcctctccctgttctcagtcctggtctcactccaggagctgtcgggacgtcgggcgcctctggaggcggacgaagaaggcggcagggtcgggggcgtcagcgggaatctcggccgccgcgggcagccgcggtctccctccccatcccagggctcgggcggccaccgcgggcggatgagtcaggcgagggggcgggtggcaaggggtgcaagcggacggagggtgggggcgcccctatgcccgcgccgggggggcaccggaggcctcggggcaggggatgcgccgctgccggtgctcacagagggccgccgccatccgggcgcagagtccaggcgcgcctgccctcggagggcaccgggcgcagcaagccgggcaggggagagggagtcgccgctcaggcggcgccgccaccgcgtccaagaaagacaaaagggaccgggaacgggaggggaaaagttttctgctcggctccagatggatcccagccccaaacctcacgccataaagccccgaagaggcgggttgggggcgggggccggggcggacttccaggggcgtggctgcgcgcctgcgaccccggaccgtgccaatctcgccgccgccccaaaacctgtgggaaaccccagtcctgccacccactcctcctggaggacgcagacaggatctgctctgcaggagcccaggccggccgatccgcgtcccggccacaaagttgcacttcgagagcccaaatcacccgcagacaaaacccatctttgggaacaaagtacccgcttgcaggcgctcttcccgggctggaaggctggcgtgcggaaacggacacacccacccgtggggcccgcctctagctaccgcgggaccaccggttaccgagccagggacccggctcccccagttctccggagcggctggggagctccagccgactcgcagtattcccggagcaggcaccgcaggaccctggctccacgcccctcggacgctttctcctcagatgccgcccggcgggccggggtccccctggcgggctgcgcgggcgctgcgcgagctaaaccaaacctggccggaaaagacgcggccaaggcccgctcggtccacgcttcccgccggcccggcaaggggttccggagaacggcttgggggggcgagaaccatgggcgggggaaatggaagacagagggaactgaagcacgggggtcttcgatgagcagtgcggatgttcga

SEQ ID NO: 5651 - DNA, 1501 bp, Homo sapiens
cgctactcgagccaatgaacgcgactgctctgacaaggcgcctctaatttcaccgaccctggcaaactgcaggagacattcagtccacgccacataaaaactattaaagtgggatcgccgcagttgaaaagcccgatcagtgcctggagattagaacgcgagcctttaaagtacacacgcacccggcaccgggaaagcccaggcgcctgtgaccctccgaaggactctgggtcagcatcctcgcgcctggaccatctagggggtcatcagaaagtaatacacgtcataagaaagatgtgggggagaccccgatgctcgcgcctctgccaggtggaggcggggtgcaggtagaagccgcgcgctggactgctggatgaactccgttacgcgcaggctccgcgccgaccccggaagggacaggcaggctcggaagggacccttggggcttggggacgtcttctagggcagagagcaccgctgcggtccgagcggcccgggccctcaggcgtggggcacccggcctccaagcgccccccggggacgcaggcgcccacgcaccgtccagctgcgcgtcctcagtacccagcgctcggcgtccccggcggagcctcgcgcactttcccggaaagtttgggggttctctcaactcaggctcccccgggagccctggggcgggggttggaagaaggggtcactcacctcgtcgcccggtccgcctcgggttcccgaagtgtctgtcccagccgcggttcagtgcgtccgtaattaagtatttattctcgttccttccagtgtcgaagtttccccttcgcgctgtgcctctggtgaaaacaggacatccccttcggccaccccacaacaaatagcgtacacaagcgggggagaagcggggcggagggagaagccggctccgagggggaggaggaaaggagaggagccaaaactccggactgcgacaggggggaaaggagaagaaaagaaaatgagagagcgcgcccagccgccgcagtcgtcactccccggcttttcccgcagctctttccccctctctaaggcagcgacaacttcacgtggacaggatggaagttttgcgcggaagccgggaacggccggagcgtgcgccgcgctgccggcagcctcgcacttgcgcagggaggtggggcgggggcgacgtcgccaccggctactgcgggctcgtgaggccgccgggggcctcgggggaggccgccagggacgcggggggcggcggcgcgcgggggacccactccgtttttatttgacctcgggtgactgcctattgtcatggtttgcgatctcgcgtggggaccgcccagggcctcggggccctggatgtcccgggtggcgccgccgtaatctccgtgccctccgcgccgcccccaccccgcccccacccgggccgactcgagcggctgcagcctccaggctgaggggagggacccgcgaccgcgctctcctccctgggccggagagccactgtcga

SEQ ID NO: 5652 - DNA, 1744 bp, Homo sapiens
cgtcctcgcggttgccctcctcccagggccgccggtggtccaggatctggccatcggggaggggcgtggtcttgccgaagtcgatgagccacacgccggcgcgatggcagtgatcgtgcacaaagaggagcgagctgccgatcacctgcgagccccgcaccgtcaggccgcggccctgcccagagacgcccttgccgggttcccgccctagccctcgcggcccgggcacccgggcagccgccgcttacctcgtgcctcctgaagaactcggatacctccagggtgtcccggatctgctgcaggcggttcagataccgcctctgcagagggtggggtgggagaggagggcaaattaactaaacgccaaatgagcccctgctaacgatgaggagccgggacccacgctgtgcttggcaaatgccgccaggaggaggacccagggccccgcccagcgtggcccagaagggaaggagcgtagagcagttgcgagccagcgcggtgagggccatggtggggacacagccgagggcactgggccagatgacaggggcagtcctcggcttcaggctccccaacacctcagggtttgggatcccgctctcaccagcacttcctcatctccttgcacaaactcttcaaagacgcgaagcacctgctctcggcttcgcgtagtcttgaagtcggtgctgcaggagccgtccgctttctggatgtgggacaggagtgtcaggggccccgggcccgccagtggggaagaggacagcgtagagcagcggtacctcccagttgcaggggacggcgaggcggtgggagagggcggaggggcaggcggggcgggagcgggggatcgggaaagacagcgcgcagtggggctgcggcggtgccagcgaagcgcgcctgcctcaccttgatgccctcgatgcggaagccgagggtggtgctggagctgatgccttcccgccactgcatgtagcgcggcttggtgacggcgcgctgcgcgtgctcctcctccgtgggagcttcaggatccaccgccagcattttcttgtacatgtccttccgcagcttgggccgctcacgggccttggtcagctcctcctctaggtaagtcctgtgggggcgcaggcagcggccagggcatgagggggcgcacacggagaccccttcgagcactcgccccgggtccccctcaagcagctgtcccggccccggacccctacttgatccccccaaccgacctggcagggcacgcatacctgacgcccattttgcagtcgagcacacaaggtccgtcgaagccatcgagcaggtcctgcagctgcaggtagctttcgccgtcgcgctccaccacgccgtggaaggcaggcacgcagccgcgcagcgcgtcagccatcagccgcgccaggcagtagcgctccggctccgagcagcgcttcaggatcagcccgctggtgcccgccgccttaaaactccctgaggaccggcatccgtcagcgccgcccagccccttcccgtcgcgggcacccgcccacccgccccactgctcaccagtgtgccctgccagctgcacccaggcgtagcgcttcttgaaagggcttatgaccggcagattgaccatggtccggatcttctgccagtggtttttctgaaagcgacagggtcaaggtctgataatcggcgtctcggcaatgcataagccctccctccactgaaacagggtctcgccacgcccccgacccaccgg

SEQ ID NO: 5653 - DNA, 1801 bp, Homo sapiens
cgcgcagcccaggacagcagcgcgcgggctacgggcgagtggagttgcaggggcccgggcggagagccgctgtcacccagggaagctctcgggactccgggcctcccgcgaagctccggacgggcgtcaccgaagccgagagtcccggccgagcccctccgcacggtgggcgccgcgcccaggcgagcgcgcgaggtcgggcggggccgggggccgcccggggagggggcggggccgggactctcgcggccgcgcgcaggggctgggaagctgcccctccggccgcgccgggcgaggggctgcgccggcccgcgaggcgcatgcgcgctgccgagcggctctcgctccctccccgcccaccgctccctcctccccctccccctcctctgcatcctcgccgctctccctctctcctcgcccgctgggtgctgaagttgggcggatggcagcaaaccggctccgctagaggaccgagccgcccagccccgctcccccggacccatcggcgcgctgcccacacctccaggcgaccgggtaagacgctgcctccaaaacaagcggtgctaagtaaatgacatcaaaatgtctgctttgcaccaatggatggatttttttcaaggtaggggggaggtgaaggaaggagggggcggagagcgcgaccgcccatgccccggcgggggcggctgcgcggcgctggggtctcagctgtggccgcggcgccctgagcgggagcgggggccgcgccgcgggtccgggaagttgaatcccgcgtcgctgcctggacgcggtccgctcgccgccctcagctgctgcagggaaccgggcgagtgtcctgcccgccggggaacgctcggccaggtcccagagttcccgcggagagcggggcgcctgctgggggcggccgggagggccgggccaggggcgcgggagaccccgcggggacgcgaggtgttgcgggttttgtgcggttggttgggaacgaggagaatgtgccatcaacagtgtccaatcgactgatcaccttgggtgctgtgtttcctcccttatctctctttacctttgggaaaatgcactgctcaggtggggaaggtgttcgaagaagaggttgcgaaaatgaatcctttgaccagcagtaaaataccggaggggtgtgtgtgtgtgtgtgtgtgtgtgtatgtgtatgtatgtatagggggtggggggtctcttttgttccttcccctccccttagtcaaaggaaagggagtcctggcgtgtgcggcgcggggtggattccacagccaccgagggggcgaggacgaggaacgcccaccaaccgcgagtcgctgcccgggtgggcgcatcggagcctcctttgctgtaggtgatggtggtctttccgtgatcgatggaatcatagtttaatctctgcctccccgccagcctccctgctgtccctcatcgagtgctgcggcagaggctgggtgcagacacggccgctttctcctcttctctctgcctccctgtctccctgaataaatgccggaggactaggggatggcggagggacagagctggactcggaagccgcgggtgggagctgctcctcgcgagcccgaggctgctggcaccttgtcgcgggcagcccgcgccagcctcgggagtccctgggctccgggagagcgagccggggtcgcctggccacaaagatgcccgcgcgcccgccctgcgtacgggacccgccctgcgccctgagccctgcgcctcgcccggagcccgggacgtcggttcacgtgggagaacccctgtcgcccggggacga

SEQ ID NO: 5654 - DNA, 1801 bp, Homo sapiens; identical to SEQ ID NO: 5653

SEQ ID NO: 5655 - DNA, 1684 bp, Homo sapiens
cgttccccccgggcgcgcgggcctcctgccgcctggagccgagctggcactggagcgcttctcctctggagcgcagaggcacccgacgccctgcggcagctcgcagcctttcccccacgaccttctagaacagccctgctctgcctccctccggtctcccgagtgcgcccgtcatcctgcctcgcgagaggtgaacgcggagaaagtaggatgaccacctacgctcccgagaaattctgggcaaagaaaggcattaccccagtccgcacgctgaaagtcgcctttcttttccttttttccccgctgtgcctgaatctcccgggacacttagacggctggagcctcccgactccaaggcgggcgacggcaaagttaaacgccagcgcgctgcggtccccgggcaccgaggcgtccccgctcccgccacccacacagggcgccaagtgccccgacccgcgagtgacgaggacgcacaggctagtgacacgacccgtagccagcactgagcgggacgacggggcccgagcgcaggagggtgcgcggggagctgaggagcgccgggggcccgggcgcggcgcgtacctgaggccgccgccgaggaggcgacggggagcagcgcggccaagagcagcagcgccgcccaggacagccggcgcggcgcgcgcagggtcgccccggcctcgggggccatcgagagcccggggtgggccggggctgggtgcttgcggctggcaggggggcgctggccggagtctggggagtgccgaggcgccgccgtcgggtccccgccgccgtccgtctgttctgcgcgctctgcgcggtgcccgccgcgcccctgccccgcggcgatcgctcccggccgcacaccggcagccgcgctccgccactgaggccgccgacctcccgccgagccttttagctgcgctcgggcgccccctgccggtgtgcggggccggggccagggccggcgggggcgacccgggcgacaggggcgacgggggcggcggggcccgggctggaggcgggcggggcgcgggacgaaggggccggagcgccccggactgacttagcggttctgaacttggggcggtcgctgtgccgggccaagtggctgaggaagttcctcccctcgtctaaccctctcattttctggctggggaagtcgcccatcgcgccgaggagtgccctttgtccccttacagaaacacctctgcgccccaagtggggactcgggccgggacccctcacccggtccgcagcgctgtagttcctgtggctagcccagtccttccacgtccctacccgcacccggcgcgcccacgtcaggggttttcagcgtccttagaccctgctccgtctggctgtcatttctagggcgcgcacgatgcgggtcgaaaaggaacccagttttcagtgtgccttgttgcccaggccaaggactcagcggacctcgcctctcccttttctgtaattgtaacactgccccaggtctccctattcctccttctccctattcctccttccagcctggaagcctcgcggccctccagatggactcggagcgcccctggaggctacagtgacctaagctctaggaaggccgggtcctggacgccgcgtgctgctgtccgccgccgaccggtgtcctcgcagagataacctggctgaactcaccgcccagcgc

SEQ ID NO: 5656 - DNA, 6657 bp, Homo sapiens
cgtgcgtgactggacggtccccgcgcggagcgaggaggctcgcagcgtcggggggagggcggcccagcagggagggcgatgcgagcctggggaggggtcagcgactcggccaggaggtgaggacagccccctaatttccgggaagggaagggcagggggccgcgtctggggggcgccgggcagggtgcggacggcgaagggggacggaagggagagaggcgctggggaagggacctctcggaggcacggggcagcgtgcgggctgcggcagcgaccccgacccgggcccccgggctttgtcgggctgagcctgcgcccgctccgccgccgccaagttcctccaactttgcccgctgcgctcggatcgcgcgccaggcctgggggcgcagcaggggctgggggcgcacgctgcgcactcggggacgcccggggttcgaggtggcggggggcttggccgcgccgctccccgggggtggtccgggtcccaagtcccccaggttcagcgcccggccgcgctcgccgcttacctgcccgcccggcctcggttccggggctgcgcccgcagccgccgccgtccttcaagctctaacttcgctcccgggattgaaattcctccccagcttcgcccatcgatctgcgcgcgcggccccgcccctcgccgcgcggccgggggggaattcaagctcgccctgccccctcccgccccccttccctccctccctccctccttctctccctccctcgctccctcgcccgcctgcgcgctcccttccaccccctcttcctccgccgcgagtccggctcggagcctctggccctccccttctctccctggcctcccgagccccctgctctcctcggctccccgcggcaacccgctccttccctctcccggcgacgcgcaggggctggggaaggaggggaggtcctagaaagcgcagggggcgtcctcgcggtccgtccccggccctccccgcccacatctaaaaggtggagggggtgggtgggtgggtggggggagtgggggcgacagctgttggctgaacaagctacccgcgactcccaccacctcaagcaaagccaaggcgttctcaggtcctcccgtcggtccgccccttatccgggagggcagggacctaggggcggagaacgcagggcgcaggccgggcctcctctgcccagccctggccccgcttccttccttcattcaccccaacctctgtgaggacttcagggggttctggagcactcttcggctcagtttcaccctgacaacctgcctgtgcggaagcccccgtccgcatgttacaggaagggaaactgagtcaagagaggcccagaatctggccctacacagcgcgtcgaaggcagagccccaggggcagcctggacccccggcaggagcctcgggactccacgctcgggccgggcaggccccggcggtgcctggacaagcccgcgttcgcagaacggccggcgcctggggaccctctccagtccccgcgcagcccgcgcgtccccgccggcgccccctccccgcttcctgtcccccgcccgcctctggttcccggcctcagtacccccggcacgctctccgctcgccgccagcagctgggcaattcaacgagcatacaaaagagttgactcaattcaaaggcagcaaatcaagataaatcctatagtgtgtggggaccggagagggaatgtgaatgaacgcccacgacgccgttcagtcctgtatggaccggcctagcccggctgcagggcctgacacgcccgggtcctagggttctccaggagccagaatcggagagtgggctctgagctgccttggctcccaggcccccagcactggcccgaatttagtaatttagagcttgtggcctccttcggctggctgggtggggctcccgtgataggggtgcagagccttgaaggggagtgctaggacgaaagccagtgcgcccccacgatttcatgcaaatactggggggcaggggccctggaaacccagcacagccccaggggccggcaggaagggcaccggtggtttggaacacctaagctgtggcctttctccctctgccccgacctggaccacggtcagagccaggccgcaggccaagagcaggtccttgtttacccaccagatagatactgcaagcctgggatgtgccaggcctgggcctgtggaacgaggccggcggtgagcggggcaccctctcctccctgcctgtctgtgaggtctccccagctgcagctccactagggagaagctggtcggcccccagagcttccttggtcacgcttggaaggtcccagtaagctaccctccagcttctggcctggccagccttgtgcagaagatgaccaccgggctccgggccccagcctatccactccgcctgccaaacataaaccccaagagaggtactggatccccatttccagcaggttcccccaggcctgtgctggccaagtgcagccgaagctctggaatgagcctcctttgccttcgcaggtgtcccccgtgtgccctgcgctgtgctgggcgcctgcccggaggagccgcgccaggacgtcctgctacttcccaggagcaggcatgatgagtccatttcctcggggtgcaaactgaggccgagggcctcttcagagcgcccttgaccggtactgcctgaccccagaggtcagttctgcggtcactcggggtctgagatccacggagaacctcagaggtcaacttgaggggcgggtaggggtacgcgcgcggggccgtgggaggcgagatcccgcaacctgaggagccaggaccccagcagagagcgaaacctggagctgggggaggggacggcagaggactggaggccgggctgcacggcaggggtcgagtcctcgcggccgccccccccccccaccccgagcggaggctgcgccgtccggctgcgaccgagtccccggagtcccggccgggtcgcccctcccccgtggccgcgccgattggcggcctgctgttacccggacgccggcgccgccgccgcgaggacatctgtccggggcccaacgccgcgctccacgccccctgcccctcccccagacccagaaccggggagaggacgcggcggtgaagctgggaggttggaacctggagggcggcggagtcccggagttaacggggcggggggcggggccggcgctggccctggggacaaagatccccacgctgcctgagggctgggctctgcagacaccgaggcaggaagaaggactccgtattccccgtcccccagatcctcaaatccactcaggctcagacctgagtgtccaggtggggtgggggagaccgaaccctcctgggccctcgaggcgcgcgaaggcgacgctgaaggggggacgccgggacgctgcttcctccctgcacacgccgcccgagctgcatccctaaacgctccaggagcttcgcgggtcccccctgccctccacaacccccgaagctgcccccagcgacctctccccgccctcagatggggccgcaggggcgggcgaatgtgttgcgctcgccgtgggttgggaggaagggcgcggattgtaggaagtccctgctcctccctgggcagcctggccccggggactcgcgctcagcccgcggcggaggactcggtcgggaatggtgctgagattgcgcgggtacggcccagggccgtgaccgggtggccaccgtgcagtttgggaagagaaaaagttcgggggggggccgacaccccgagatcgaagagggaaaatgggaggaaagcaggcggcagggagggaagagcggcggaagagggaccaggagagctgggggtccgctctgggccccggggtcccgccccactcggcagcccagcccagcccagccccgccgcgccagcttcccggaccgggagaggctagggtcaccgacgcctattaatagccgcgagcgggtccttcccgggagctccgcagcggtcggcagagcccagccaccggctggggtgggggcgggggtcccgtaacaccccctccggaggttcaagcggcgcggggcggggcgctgcgcccccccacgccggctttgcgaagtcgaggcacccacagcccactccctccccacctccgactccgagaccaggtttcagatgaagaggggttcgtctgtggttcaacttggggcgccgcggctaccccagcgcactcgaaggcgcgcccagccccctccccctctttctgcccagccggctttttgctctcagcgcgctccggaaagtttcggggtccccgcggcgcctccctagccctaggggtccggagtcctggcccttccagccgcggcgtcggggagggaagtttgtccggcccaggctcggcggccgctaacttcgggtgcgcccgcctccgaacctgggtgggtggatggggacgcccgggagccgcgggccccgagcgccgcatccagagccccgcgggcggggagactcggccctggcgcggacgccgaggtcagggcaccagggatggggtggcccgggctgcgagagccgctggggaccctgcgctgccccccgccgccccccccagagagcatcctcttccctgcctcccctaggggcggggaccctccgatcccgcagcggcgacagaggggtcccccggccccggacagccccctgcccctcaggccccttcttacctgggccggggtgcgggccccgggctggaggcactgtcgcgggcgagcagagcgcgcgcaccccggttccccgagcgcggcggcggcggcggcggcttcccctccttcctcctcctcttcctcctccgggctcgctggctccagacagccctcctccccctcccgccctgccggcccctcccggagcccgcccggctggactcggcctgcgacccggagcccagcggagccggcgggagccaggctgcggcgctcactgcgtcaagcgcggggcgagcgcggggcggcggcggcggggaccgcgcgctcggagcccggggctggccgggcaggcgggggagcggcggctccggctccgactcgggctcgggcgcgggcgcagtggtggcggccgcggcagcgccgaggttgtagcacattctttctgagcgtgatggaaggtttcatgtgggagagcgcgcggggagggatggggagggggcgggggccgcggcgggggcgaccggaggggcggggggcggggtcgctgcccgcacgtcggtgggctggggggtggccggaggggggctccggaggggaagttggagccagccgcgggggcggcgtgggaagccgagtggcggcctcgccccctcctcctggcccgccccgctcgccccctgcccccgccccaggccacccagaggctcccaggcttcggtttggaagagaagcgtccgaaggtctgggggtcgggaccctggtggcgctgggaggtgggcccctgggtggggacacggctgtgctcacaggcgcccggcaacctcgtggaagttgaccccaagtcagaccctctgtgagcgcgcgcgtccgcgagggccaaagcacagcccgcaggacgcgcgtttgcggggcggggggagagcggggcacttgggggcggggaggtggagcgagagggtcgtcgggcccctggcggccccgcgtccccagagactcgccctcccctaaggtcgccgacccctccctcccttccctccccgttgcgcgtcgccccccgcctttcggccgggaggagggggaggcgtgggagcggcccggcgccttccgattcccggaaggttcggtttagcggatttccctctcccttcatgtgcctccggaatcccagcggatccgaaatcgcgccctcgggctctgagccgaggggtcccccgtcgctccctggtggtcccgagccctcgccgagcggtctcacggcttcccagggcgtctcccgctcccacccgccccttccccagcctgcggctttcgtgtgggctaaaaattccaaaccaggctcaagagcgccctcgcccggctaagcccccgcgcgccgcttcacaaaccggccgcgtgcggagctgcggagcccgggacccccagcgcgcgctgggcgcgacactctggaccccgctgccagcgccgcgcccctccggccggggagccccacaccgtcaagagggcagggagaggggaggggaggggactactggaggggagggggctgctccccgggtgtctttcccggaggaggtcccgggacaggggtgggggtggcgcgggaggccgcagacagcgcgccccgaggatggccgggccggggatgggcgcgcggggctcctgtccggacgtgggtccaacggcctctccgcagcccagaaactccgtccagcccgcgggacggccgcccgccctccgaccccgagcctctaccacacttgttcctgcaggacggggttggggggactgagaccgtgattgaggccggggcatggaggaagtgccgccgcctgctcccgggattgctggacacgaagggtggaggccaaggacggagcccctgcctgcggctgtccagcccttagtccctgcgcgggggcgcccagacctccagggaacagggagacagagcgggccgagcccgg

SEQ ID NO: 5657 - DNA, 546 bp, Homo sapiens
cggaggcggcggggtcgcgggagggagggggccgggcttaggcgattggcagcgcgagcccgggagcccccccgtgcccccgcccgccccgcccccgccaccatctgctcgggatttggcgtcggcggctccgggcgcctccagctccggctcgggctccggctccggctccgggcgccgaccaggtccccttggcccccgccgcgcgccctccaacctgctgctgccgccgccgcgccccccaggctctgccagctacccgcgctctgagcccggggccagattcccatggaagcgccgcgatgttcgccccccggctgctggatttccagaagacgaaatacgcgaggtgagcggcggccgcggaggtccgcggggagggagggaggggcgcgcggcggcgggggccgcggaggccaccttggttctcgggccccgccgcccggagcgctagaggggatcggcggacccctgacccccgcccgagaaaaccaggacccaggcagcctcgtcttctcgctgggatggagtaaccggggcgcccgc

SEQ ID NO: 5658 - DNA, 288 bp, Homo sapiens
cgcgcggcgcactgcgggccgggaacgtgctgcgcgctgacaccgggtcagctccctgtgatgggacttcctttccaaaaacgtaggcgttttcccgggtcgcagtcgcagtcgggagactgagggttagggcgcggccgcggggtctcctgggccggggcgcggcccacgtctcaggcctctgcggctctgaccagaagccgctgcgcctttggccgcttcccacccgtcccgtccccgcaatcccaggcccagggttacagcggctcagctctcttcctctcgcga

SEQ ID NO: 5659 - DNA, 947 bp, Homo sapiens
cgtgaggccgcggtgtcagtccacactccactgtgggtggcgggttcggccccgcgaggaggcgccgctctcaaaccccacggtcccgcgcagcgaagaggcgaggcggccgcggaaggcaggcgcagcccactcttcccgagaggccccgacatctcccgggtgagtcccgaaaagcgcgcggggactccggctgagcgctgggccgtcagcaacccggctcccagagagtcacacgaaggaggggaagcggctctctctggggcttctgggaggtctggcccgggcccctcccgcagcctccggcggccagtcccgcggctctggggcgcccggaccgagcaaaggtcccggcgggcgggccctctctccgccctccccaagcgcccgccccccgccggcccagcgcaggctcctccgactccgccagcgcagggggcgcggctgccggggacccagcagcgggcgcgcgggtaagtgcgcggcgggcgcgggctgcgggatccgctccgggctccactccggatcctctttggtctgtttgggtgtcccgggccgggggcagccgaggccgcgcggcgctttctctctgggccaccctcccctcgctccttcctaggggagacgaatcgattggctgcccggccgccggaacggcaggtcccgtcgctcccctcgcctcccgcattcccggcccggtcccctcccatcaccgcgtcccgccccaactcgcagtcagcatccccttcccatcctctccccgtccccgctgccacttccttccttggatgttggaagcgcagctggtattttcgttctcccaaccccccaaaccccccctccccattcgttcatcctttgtgttccggtctcttctctgggtgctgcggaggctctcccggctcgggggcgtgtgtgcagggaggcggaccgcggaacagatacgg

SEQ ID NO: 5660 - DNA, 1313 bp, Homo sapiens
cgagaatctgccgcagggggagactccgccgccaggtcttgggaattgcctgggcgccgccaaagctcgagccggagctgtcatttggggcagcggccgggaagaggtaacgatgccagcaagaaagcagcggaggcaggaggcggccggaggagtggactggagcggacggagcctcgccgctctccagcccggagcgcctggagcgaaagccaagcgccctccgagggcgacctcccctccccgggcgcgcgcccacccgctgcagccggcagcccggcgggagaggtggcagctgcagctccgcaccggggagagcgagccccctgcgcgcgcgcccacccgccccctaggtgacccggcgtcctcgccgcgcccgctggaagtttgcaaactttctccgggggttccgccgccacgctgggaagctggggacgcggggggaggttcctggctcgccgtctccgctgccgcttgaccgcacttctggagggctccgcaccttgccaggtctctggaggcaaacacacacccccgattcataactggtccccgcgtcaggggactcgcgcgctcccacacacgcacgcacgccgggcggactcggcgccggctccacgttagcatccctccaggcgcgcggcgcggcggccaccgagcgctccggcactcacgcggcgcggggtctctagggtggcctcaggacacagccgaattccacagtctaccagcactcggggccggacttccctctggtccgccaaaatgtttacaaacacagatcaccctccagaaaaaaatgcatcgcatcttccctactccttgccctgtgacctgcccactggaccaagtaacctcgcggctgctgccgagaaccaacccctgcaaacaagtacactcccgagatggctcctgcggcaagtgcaacaaaagtggctaaatgcaaaagccccagaagtggccgagccgtatttttaggaacttaccaaacaagtgtggagaaggcaagagcggagcccgggtgaagggaccacgttggactgagcaaagattacaatacattctatttagagtgcattacatcacccccccggtgacgtcacgtgggattcctgaacttctaaatcattgcggtccgctggggagggacggagcgaggggcggggccggcgcgtcgagggggcaggccccgccccggtcccgccccgaccccgccccgcccgcgcggaccctggtgcacccgcccgggagcggcagcggcgggggcgactgcgcaagcaacagcttgcagagcccagcgccgtgtgacacgg

SEQ ID NO: 5661 - DNA, 848 bp, Homo sapiens
cgcgaagcctcgcggcttctgcgtgccctggccccgggaggataaggatttcccttccctcctacttgcgcgcggagccgagctcttgttgaggtgagggttccggaagcccacgcagctccgcaggtcggtggtggccgcggctgccctgcgggggtgagtgtgcccggccggggtcggagcccagcgtgtgcccggcagacggcggtgcccgcgcgcccctccctccgcgcccgcggtgacagcccagacaccagcccgggcgctgacagacgacttttctcacttgtcagttttctcgcttgtcagcagagctgctggtaagtgagagaaaacagaggggcgcgaaggcaggcgcggccagggagtgagcggggcgctgggcgcggggcggagccgggtgcgcggcgtccgggtcaggccccaccgcccgcgccggctcccgctttgctcagccgccgcttttctctcccttctcactttctctcctccccacccagccctccttttcacctccaaaccctttagctgcgcgctgatcgcttctgtggctttgtttgggggtagggggagaatacgaatagacccgaggtgctttctcttggagctggagtccaatcccaatccctatctctatccctatccctgtgcttatccctgggcattagcccgggaccatggctggttcccgcagctgcctccggagcgcacctggggccatggtttgccgcgatcggagtccgctctaagtcggagtctgggggcgcagaagggggagcgcgccgagaaagtgccgggcaaacgcgcgccgcgcctggctgggcatcgcgagctgggcgaggagacgg

SEQ ID NO: 5662 - DNA, 2406 bp, Homo sapiens
cgggggaggggtatacgcagtttccgtgcggaaagatggtgtctttccttcacagggctgcgcgggcacccatccccgctgcaaagcgcccgggccaggcgcggcttgctccgggtcggggcgagctcgctgccctctgcggcagacagcgatgcgcgctccccgccccagctcccggctcgcccggcggcccgcgcgccctcccggtgcagcatgcgggcgctgtgacgttctcggataaatgccgtgtaactgtgtaggcgaatgagagctaaaaataagaacggaaaatctatcattaaggtatcattgcgccagcgcagctatttgaaggctcccatggtccccggcgcctgcgtttgaagcccgccttcaggctttggggggtatttgcagaaaactcccagcagcggctcgccaaccagacctcagggtgcacggggggtggcgccggtaattatggcaactctcaaaataaaataatataaaataaagtaaccaacgttcaccaaccaccaccccatctcaccccctgtactgtcctcaggtagctggggaagccgccgggagtgcagccggatgctggaattcaatgtgacccggctgactatgcaaagactaggactggacgcttttgcagctctatttcgccacccaccttcctccttccacctcgtattagaaataaagtggggggggggggcgagcctttggaggagaaaatgacaactggcacttaaccccaggtctacagtgcgccgcggtggggcgcaaagacgcaaactcccgggatggcgagccttcggggtttcattgggttaaacgaaaattgatctgatttgctttttaacatccgagggagagaaggggagatgaggggagggagggcagggtttgagtgtgtgcgtgtgcgtgtgcgtgtgtgtgtgtctggggagggggaggaggcaccaagttgcagcctgcgcgcggctctgcgcctcggcggggctgcgtgcgtgtgtccctgtccgcgctgctgaaacgggctcttcgagggatcggcgtcacatgactccgcctgcccctcgccagcgcgcagatcgccagtccctcagtttgcccggcaccggaggagggtcgggcggcatcttccgggtactggggctctgcggagcggagaagaggttccagcggggaatggtatatctggattcaagaagccgcggctcggcgccagatcctggagtgtagatatttggggggaggggagagctagagggagcgagcgagcgagcgccagagagaggcagcgcgcagcgcgcacggacggggggctgctgcgcggagaagatgtaagcgcgtggggtctcgctggcctctgagcaccatgcagaaggggatccggctgaatgatggccacgtcgcgtccctgggactgctggcgcgcaaggacggcacgcgcaaaggctacctgagcaagcggagttcggacaacacaaaatggcaaaccaagtggttcgcgctgctgcagaacctgctcttctacttcgagagcgactcgagctcgcggccctcggggctttacctgctggagggctgcgtctgcgaccgcgcgccctcccccaagccggcgctgtcggccaaggagccgctggagaaacaggtgaggcgagcgtcgcgtcctgacctccctgcgtcccggccgcggccctgggggctcagggccttcggctggctgatggcgcttgaactttggcccctctactcttggcgccctaggcgctctctgcaccctcagcgagaggggaggcttgctcccagccaggcgagtgactgcggcgggcagagggggcagggattgagggcggggagtagatgtgggctgcggctgcccttcgccggacgagccccgtgggaggcgggtacagaggggccgacacctggagatgcagaggaagatggggtcctaaggaccagagacgatgagtctggacacacgtccagccaaaaatggtgctcccaacccccactcccaccgcccagccctaatagccccgatcgtctgttctacaccgggaacgtgtaattccccgcgcttaggcatgggaagggcaagacggaggcgtccgagcgctgccagcccttgcctcgccgcagctgagggcggagagcggtctgcgctagctcctcggagttgggctggggttatggggctacacgggtcggttcggtaccatcgagcggtggtgggctcccagctggcggccgccggagcaacaagcccaaagattcccaaggaccgctctgatgcgccggggctagggccagggctgctgcggaggcagcgggacgaagtgggcgcttctctcctcccccgccccctgcgccgccgccgccgccgcagtcgcggctatagcgctgcgc

SEQ ID NO: 5663 - DNA, 1218 bp, Homo sapiens
cggactcacgccggctctgccacgtgttgcccgcagtctccgcccgttccctccgcgttggcaacgggcactgactgcccgatacctcagcgatcgtagagactttcctaatgccgggcgcaccaccggcgggccagcggttccgttggcttccctgacacacttcctacagtcatttctttcagctgagatcttcccctttaatacctcgttaattaacgtgtaaccttttggttaaaatgtcagagctaagactaaacctgaagaaaagaatgaaaccacaggaagttcttcagacttagtcgccagcaaggttatggcccgaagcggtgcaggggcggcgcgccgggaagctactggcagagctgtgcgcactggggggtgctgcaagcgctggggagagtgtggagaggctgcgtggagctgcgcgctcggggtgggagctgcactcccaatgaagcgcgtgaagggcaagcggtgatgggttctgcgccagtggggctgggagcgtgttgggggctgtacgtggggctgcgcgcaaggtgagaactgcgcatgtgggcttggggactgcgcgcaccgaaggctgcaggcgctggggagggtgttgggggctgtgcgtggggctgccctcaccggaagctgcacgctcggggaagcgcagaggcggggtgctgcgcgcgctggggagcacgtggggggacacgcagggggacacgcagggactgcccgcgcgaatggcttcgaacgcatgcgctccaccctacatttcacagtcgccatgacgaccgggaggtccgctcgtcaacggctagtcaacggctgcggggacaagtccgttgaggctgccaggcgagtcaggcctttctggacctcgcctgactcggatgggctgtgcctgaaattgacccagctccactagggattatgaagaaacaaggagtaaacccaaagccgctgcaatcttcccgccccagcccgtctaagcggccgtacggggcctcccccgcccgggagctggaggtggaaaagtcggccctaggcggcgggaaactgccagggggcgccaggaggtcctccccggggaggatcccaaatctgaaaaagcgaaaaggcttggagctaaaggtggtggccaagacccttctcgaccccttccagttcgtccgtaattccctggcgcagctccgggaagaggtgcacgaactgcaggcgcgg

SEQ ID NO: 5664 - DNA, 1848 bp, Homo sapiens
cgcagcacgagtgccagggcgcgcatttggggggtgtcctggcggtgtggagagagaagagagagggcgcgggtgacatcacgcccgggcccccttcccctcgccgggtgggtggggcttcggcgcgccgggagggcgcggggtcaagtagggggaagaggaggagcaggcatgaatgtgtctgtgtgaagaccggggaggggcggaggaggaggaggaggaggagaaggaggaggaggaggaggaggcggcggcggcggcggcggcggcggcggagggcggggagggagcgcgcgcgtggctcgcggcgcccgggctcccccccagcccccgaccccggcccgcgacgcgccgcctcccagccgccgccgcccgcctcgcagctgggacccactccgggcttggggacccggcgggcgggagaagcgggggctcccggcgcggcctggaaggagcgagaaagcaaaagtaaggcgagcagcactccaagttttcccaacttcgccccctgcggcggcaggcgtcctgctgctcagcgcgtcccctccgagcccgagagtggctgaaagaaaagggactgggcgggggccggggcggaggaagagagagtgcgagggagcgaggagagtccggcaacatctgttaaaacttgggggaggaggagcgcggggaggaggaggaagaggaggagagaagggaaggagggagcgcgcgggaggggagcgcggagccgagggacaacttttccaccccgtgagtagtgcaggcggtgccaggtcggggcggggggcttctccacccagcacggggcaccaggccgggatgggacctttttccagaaagtcgattggatgccaggagaggcgtacggctgggggtttctttctttctctttcccctccctcccgcggttgaaccaaatcagaactgtcactcagggcttgtgagtcagaagggatcggattacacgatccccgaaactgatgccggagctgcacgagcgggagggagcgggcaggggcagcgccaccggcgcgctcgcacactcgcactcgcgcacacccgccgctcccactcacccgcgccgctctcccgccttccccgcgcgccccgcggccgcccgcgccgcaccatgcccgcggcgggcgcaccccgcgcccagcccggccgctcgcggtagccgtagccgcccgcggccgcgcggagcggggagccgccagcctgcgccccgtccgcgggtctatgggaagttcggggacttgacagccgctgccgccgcaggtacgtcccgctcgaagttctttgtttcgcggaccccgcagcccgctcctgcggccgcgcccgcgcctccggggccagaggtggtccccagcgtggggacgggatggagtgaaaatggctgtcaaaaggcgcccagatttagagagccgccggtgaggcgtccgagcaaggcttgcattcgctccctcctcctggaaggtcctttccgaagagtccgacccgcggaccggccggagacggattggagaatttcacctcccggaggggggacgaagtttgccgcagtggtggcggcgcccctcgcctccgcccccatccaaagggttcagaagaactccgcgagccccgcacgcgcctggctccttcctttgcgcggtggcgctctacggctcgggcttcgggcgcgcacggcgctcgggatgggcggaaggaggcgggaggcatggtgggtgcgcgcggggacctccgccgcgggggccgccgccgctggggcttctccagcccgggctatgcttcggagggcgggggtgtggtgtgagcggatggagagaggcgcgccttcgtcgt

SEQ ID NO: 5665 - DNA, 2119 bp, Homo sapiens
cgcgggaggcagacagcgtccccgtccttgcaaccatctcgcccgcccgactgggaagacagtgacaaagttcgggcgcagaaaaggcagggtcagggcaaccgccgagtggcagcggcagggactagactgtgtttgaccttggcaaaccccactctttctgggccggaggcatgtccacagaagggtggccagcaaggctggaagagccgaagtcctttcccaccacccatataccaccctcgggtccgcagggttgggaggcgagcccagcacgcgctctaggtgcgcaggggaagagcccagcgctgcgcgcagagccggccttggagcttgccctgggggtctgctctcctcgcccactttcagtccctctgtggggatgggtgcggcaaaagaccggcggacccctctggccgccgtctggccgctcatcagctccctgaccttggccaaacctttctctctccacacctgtctcccctctccacacttcacgccaggggcgcttcgtggattgtaactctgaagagagccctggccggagggtgccagccccgactgcgtccccaactcgtaggagtgaccttgaacacacccccactcggagcctcagtgtccccacccgccgcataggaaaaagcgcgcccgactccgggcattcccagcatcgtcccagcaagtgtgtccgagaccagatgaggggtgcgcggctgcacttaccgtcctccagagacgtgggcgcttggcggggaccaaggtggctgtgaccagcaagtgcgacgcagccaccacgagcccaaagcctatggccagcaggctgcgcacgggcagcaaggcataggacacgaaggtgaccaaaaggagctgccaaaccccttgttcggcggtcgctggccccccagcggccccggcggaaccccgggcggggccgcccagcgcgaaaggacagcagagcagcgcgaaggtgaggctgaagagcagcgccagctggccgacctgctgcagctggggcacctgcagggaccggacgttggttaccacgagcagcgccaggaagaggacgcagtgcaccgggtgtgagcccttggccaggccgggcgcgggccccggcgcgcccagcagctcggccagcgccagcgcgcccgccagcaggctgagaacggccagcgccttcagcgtggccgcctgctccagccgcagcgtgtagccgcggaacagcgcctccagctctgggcaagcgaactcctcgtcgcacgcccggagcccgcgccggcggcttgtcccggccgcccgctcggcgcccccgggctcgcccgcgccgcctccgccgccgcctccgccgcgcggcgcccccgccatctcagcgccatgcagcggccgcggccgcgggcgcgcccctcgccggcccggggcgccggggcgcgggcggcggcgccggggcgggcgggcggcgggcggcgaggcgccggggcgcggggcgcggggcgggcggagttggggcgccggctgccccgcgcgcgcgcccggagcgcgtcccctcccgcccgccgcgcctgcgcactggagcccgcccgcgccccgaccgtggtcctcggcggcgaccgcgctgcgacagccgagccccgggagccgcgaacctgggcgcgcacagcccgcgccccaactccgcgtcctgcgttcccgcccgccggaggagccgcgtgacctcgagtaccttccttgtcccctccgagcctcagtttccccaccgtgcacagtggaacccaccctcttggcgtcacctggggagtcgaaaatactgaaatcctgcgaaattccctgttgcggggcagttaatcttggaaaatatgtgccttcccccactcaataaaaccaggccactagatttgagaggggcccgcgtctgactgcgaacccagggccctcgcccctacgagacggagaatcgacgtccaagaatccccggggtcaggaggaaggtggaggcctggggcgtacgtcccttccatgcgcatgagggaccccccgcccctcggcaattcttccctaagctctagggtcgcggagaccctgtgggcgggtgcgggctgcgggagctgtgctggggaggcggcgg

SEQ ID NO: 5666 - DNA, 562 bp, Homo sapiens
cgggccgccaggagggggagggggacgcgcgccgccgggcccgccaccctgcacccggggccgctggtcggtcggggcaccctcacgctcgccccgctggcgagactggagggactcgggacatcgtaaagcactttccccagtgtctgggagcgcccgctgtacgctcagcttcacgtccctggaactggggccccttggctcccgggttcaggctccggccccaggatgcgagtgcccacccgagggggtgggaaaagttgatcctccgcaagggaggggaaggtgcaattcattttcccagacaaccaatggaatacctctcgtctctcttccctcccacctgctcacggcagaagttaggatggcgccttccatgttggcctgggtgcacacacaagtgcgtgcggaagggtggctgcaggcggaggtgacagcgaagcaatcccgcagcccgctcgacggctctttgcgtctcagacctctccctggcgtgtaagacaccgtgtgtctccgtaaaacgggaatgccacatctgacagcgcaccccttcgccctacgg

SEQ ID NO: 5667 - DNA, 1404 bp, Homo sapiens
cgcctgtcctagcgcggctctcgggggaggcagcagcgccccctgcctcccggcctggcccctgcggccgcagcttcccggctctgccagggctgccggcggctccgcttgctcagccagggctgcggctcagaggaacgcgcgccggtgccccgggttgccgcgccgctggacctcagcctgcatcccgttcccctctccctgaaaaggcaccaggaaaagagagagggagagaagagttcacagcaggtaagtctggtttgggtcacctgctactccagtgggagggtgtgctggagaccgcggtgctaagcggggatagccgggatttgggggtggctgtgggtccgaagtggaggacgagcatggtttgggagataaggaaccgtcctgagacagagaaggctcccgggagcggacagagagtgggcgaaatcggtgcgcagtaatcgcggcgccagcttcagcgcggcccctggggcgcagtcccaccccgcctcagcagctgcggagccttctgacgagcctccgcctggcagcactgcacaaagttttcctcctgagacgcgtccaggaactttgctctctccctggcttcctggttcccccaccacccctcctggtctgggcagcagagagcgtctatgaatgtgtccccggcttccgcaggctgcaggttcatttggagacgctttagtcgggaacatccggggagtacttgaccaaagggcatctgcgccctcgctcgctcctttccttgttggtctgggagaagggaaaggggcaaggaagaaggaagggaagcgtggtggtttttgttgtagcgttttggaagaggaatgggcgacgcctttttcttcgccggggaatcgcgacgttccgtctgatggaagtgtgcatccttttagatttagagggaaagttggagtcaaacagcagccacaaagctggctgtctgaaatgtggttaaggcaaaacactcgggggatctctttgtagtagtgggcttggctcgctttggaaaggccggatttgactcgtgctgggcatttaaccaggagtgcggtccccagggtgtttcctcccggcttctgcccaacgagcctggagttaatgcgttaatgggctaccctggtagcgcacgggccgttttcggcactgtttctccttctctgatgactcgagttcaacctcctgggctgagttgctttgcctccgtcacagtgcaaggagggaagttgacaggaggaggagacgccgcgctgtggcagggagctttgggatccaggggactggaagagagccgcgcgccagcagctggggccgctggtgtccgggattccgagttatggggacaggagttaaatagccgaactttcagcgatttcgcctcgagcgaagcgg

SEQ ID NO: 5668 - DNA, 819 bp, Homo sapiens
cgcgggggcggcggggtgacagtccccgtgcatgaatcagccacccctcaggctccgccccggcgggggtcggccggacgctcgccccgcataaagcgggcacccgggccgcctggagcagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggtatctggccgctccaggagcttctctccccaaccggcggagagggcgcagcgggccatggggccccgtgtaggcgccctccaagcctcgctttctccaggtccctgccgcgcgctccgctggcaggggggactcgctcccaagtttgcactttctctgcagaggcccctccgctcggaaggggacagaactccccgggatgttctttcctcctaggagctacgcctgaccactttccctctcttttgctctccttctgccccttcttcaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaagtaagtgccctgcgcgcacccaggactctcgcgctccttgcgccggcggctggtagcagcttcgccagtttcccacgtctcgc

SEQ ID NO: 5669 - DNA, 1128 bp, Homo sapiens
cgcgagggcccctagcggttcgcggcctcgggcggattcccagaacgagtgcgggccgcccggactggcagactgcgagccccgaggggcgcgggacgcagccggctcagacaaagaaaccggcgccagcggccgtccctgccgcccctctccttccctcacgcatcctcccaggaaaaacagggcacactgacggccaaaggggctggccttccccttcagacagctggacgggaggtgccctctgcggggctttgacgtccctcgcagaagagtcgcgggctcagcggtcctcgacagcgtccccgtcccgctccccggcgggcgcccctccctgtcctcccgggtgcgaaccgggcgctggccggggactccggggacgcgtgcgcccctcgccgcgcgaggtgccgccgagccagcccgagagggcggggggcgggcggggcggcgcgcgggggcgggggagcggccgggacacgtgtggcggcggcgggggggacgcggcgcccggggctttaagaaggtgtggagcggggcgggcgctttcccaggcctggccgaggggcgtcgcgcagaggcggcggcggcgcacggaggcggcagacgacgcgctctcggcgcccgcagccccggtcccgcgctcccgcggcccaaagtaactttgggagccgccgtctcccgcggaacttctcggcgggggcccgctcccaggcccgctcccgagcccgttccgctcccgtccgccttcttctcgccttctctccgcgtggctcctccgtcccggcgtctccaaaactgaatgagcgagcggcgcgtagggcgcgcggcggcggcggcggcggcggcggcatggagcgcagtggctgggcccggcagactttcctcctagcgctgttgctgggggcgacgctgagggcgcgcgcggcggctggctattacccccgcttttcgcccttctttttcctgtgcacccaccacggggagctggaaggggatggggagcagggcgaggtgctcatttccctgcatattgcgggcaaccccacctactacgttccgggacaagaataccatggtaggtaccgcagcacctccgcgctcgccgccgccgggtgcgcccgccagcgc

SEQ ID NO: 5670 - DNA, 1128 bp, Homo sapiens; identical to SEQ ID NO: 5669

SEQ ID NO: 5671 - DNA, 1128 bp, Homo sapiens; identical to SEQ ID NO: 5669

SEQ ID NO: 5672 - DNA, 1921 bp, Homo sapiens
cgggcgctgccccctgcggccccctccgccgaggcctgtgcgtggcggggttcccaggagcggcagtccgtgcggcctgggggcggccccctccccgcatcgcagcggggcgtgcaaagcgtctgcggctgtagtgtgggcgctcacttcacgtgctcggcggcgtgcgaggagcagtaatacttcttgtgggcgatgaaggtggacaggctgctgaacttgatgttgcaaagacggcagtaccggtggttgccgttgggcagcggcgccggcgtgcccttgctgggagtctggacgcccttgtccgagtaggaggggggcgccggcgggggcggcacggcctcgggcgcggcggccggggacgggggcgggccgggcggcggctcctggggctccgggccgaggccgtcccgggggccacgggacccgggctgcggggaggcggcgggggcgggagcgggcgaggggccgcggtcggccggcgtccgggcctcgacccccgggccggccaggggcgcgccgagcagcaggccgtgcgccaggcggaaatgctccagcaggtccccgcgcaccgggccgttcggggggcagtaggggcaggcggcggcgggcaggccgagcgcgccgggcggtggcgcagcggggcacgagtacttcttgtgcgccaggtaggcctcgaggctgtggaagctcacgcggcaggccgtgcactcgtggtagtcggccagcgccggtgccggggctccggggagcgggcgccgcggcttcttgctcaggtcgatggggccgtcggccgcggggccgggcgagcgcgcaggggcgaggccggggccgcttccgcttccgcttccgggccgcggcgactcgggcgcgggggcgtggccgggcggcggggggggcggggcgccggccgcgtgcagctcgtagagcttgcggcgtctgcgcgtgcgcacaggcgcggcgggagagggggccgggggcgcggccggcccagggggtcccgggggcgcggccggtcggcgcggcggcgggtcgtggcgcgaggcgcagtagtaccgcttgtgcacggtgtaggtctcgtggcggctgaagcggatgttgcaggcctcgcacagcgtgcggctggggtcgtcctccgcgtcgtccacggagctacccgggctctggctgccctcgctgccccggccgcccgcgccgtcctcgggcgtggccgcgcccccagccccctcctcgcgcgctccggggcccggggacgagcgcggcgcgtcgggttcggcgggctggccggggggcgcgcgggccgggccggggggcgccttgggcctgcgcgcggcaggcgcgtcctcgggcgcacggcggcctgaacagtagaggcgcttgtgcacgtagtagttgttgacgttgctgaaggtgatctcgcactcgaagcacgtagcgcccttgggggccccggggaagagcccggtctgcgcgccgccggcgcccgcgcccgcgccctgctgcagccggctgtgcaccagctcggacatcttggccaggatctccgaggcggggggcgccgcgtcgggcccgaacacgtactgcggaaggaacagggccccggccaggcccagctcgccgggcaccgggctggagcccggcgtggggctggacagctcggccttgaccctggccggggcggggctgcgcggcgacggcgtccgcgacggggcctggggcccaggctctccggggcccaggatgggggccgcctccggctcctccaccgcctccaccttgatgctcctgggggccgccgggggctcgctgctgcctccattctgggccagaggctccgctctggcctctccgttggtggcctcggccagggcctttctgtccagtcctggcgatggggtgggcgccaggcccaggtccgcgg

SEQ ID NO: 5673 - DNA, 2872 bp, Homo sapiens
cgggtgtcagggcgcgttgcggcctcgcgggtgggcagaggcgcgcagaaaacgcgcgggtggcgcgcgcggccacccagtgggtcccgcccgcgccgccggcgccgccgccgccgccgcacgtgcgccgccgcgagcgcgaagggcgttcggacccgcgctctgcccgcccgcctgcccgccggggccactgtggacttccaggtaacagccaagtgagaagccctccctatcaccgaaaggtgtctgcgctcctcccacgtcccctcaccaagtgccgcgaggtgcgatttcaccccaaacccacccacaaacagccaggcgacctctctaaagcggaataaaagtaaaaccaggccagacaccgggggaagccggtcgtgctaacgcgtggacagggaaaggaacgcgatcaaggcagcagtcatccctgtgcacggttatcccgaagcgtcagtagggcccaggagtttcttgactccagaaacaggagtgtcccctttccatctctctccttcctggagaagtacttctgagatgaacgctgaagtgcccaacttagacgcgagaagcgtgcacttgcccaactgagtaaataaaggtcagcagttggatcaataaagtgtgtgcttctaaccgccagatgtttttactgttgtttctcctcccgaggttgggggtgggggtgcggggaggaaggggaaaagacaacaaacaattaaaaagaagagagtaaacaaacacacatctggtgtttcgacacacattctcctccagccgaggtctctccggacgaagcaacattttgcattatccaaactaaaaatcatccgtgagccaacagcaaatctcccctctccacccctttttcccccatcacaaagcaaaatgaaagagaacaacaagtggtgatgctgggtccggaatgcgaccccaacgccgagcccaaatttgacacatgtcacactcgccccggcaagcagggcgctgcctttggggcgaaactttgtcgccaccgcgggaggagcgcggagcagagtaaagtcgcagctcggcccagcgtggaggtggctgggacagggtggggtgcggaggtgtagcgcgccagagtgagggccaagaaacttaccgcgaccggggacgccgtgggcagcgtcccgggaggtggcacccgcggcggcgaggcagaagcccccaaacaacacacccacgcgcgagtccgggcagctgctgccgcgagtggggggcgcgcccggggagggggggggccgaggaagccgcagccagcggacgcggccgccgcataaataaccggggcgggcgttcgcgggcgggctgcgggtggcgcggggctagagctagggcgaagcggcggccgcggagctgcacgcgccggcgtgtctcgcgctttctcggaggctcgcgctgtctcgcgcagccgctccccccacccggatctgtgtgtgtgtgtgtgtgtgtgtgtgtgtctgtgtgtctgtgtgtgtgaatgtgcgctggcaggcgcgcgcacccggccgcgcgcgcgtgttgttggcaatgcgaactgtacacacactgctcgcggggctgcctctcctcggaggggcggggtgggggacaggacgccgcagaggattctgaagtaccgccggaccacttgtttgttttgttttactttgcgttgttattgtcgttgttgttgttgataggtttggaaccagctggttaggatgcctttctcccccgtccacctatctccccccgttccctaacttctttaaggagggggaaacgcggggaagaatattgttcggatttgcagcggagcctcctggctgacgtcaggtccacctgctatgtaaacaacccgctggagaacttgtttgtgctacgccagaccttcccccacccccacccttctccccacctcctgctccgccttctccagctcgccccagacggcgagtcagggaagggggtggggagggaggcgagaacaaaaccgtatgctgtattggcaaagccgagttgtgtctgctgcttcttggcagtccccaaagtacgtcctctcagcagacggagctgctggcaaatgaaacaggggattccacttgaagtgcagaaagcctcgaagggatccaaagccctcggtggcagggagttaaaagtacatggtagtcggaaagggagacccgagcgtgcgttaaagcgctgattggcctttcttttcacggtgtgcgcctctgcggcctggggtggagagaggccgagtgtctttctcttcattgttgccctggttcctgtctcacttgggccaaggagttctcgggcttcctcgtggtcgcgcagcccaggtcaccggggcgcggcttggaaggaaggggccgccaagctgggacttagagagtctgaggttttcgggaagggtcctatcagtgactgaggggagcaaaagtaaccggaaagaaaggaaagaagaaacggtcagagcctgctccgcgcgcacttcaaagccgaggcgcccgcgtgggggatgcacgggcccagccgccagccctgggtcccggcttctatccaccgggtgtgacccggctgggcggcctgcttgggacccagggcggtgacaggggaaaggccgagggaggagagagcgggccccggaggggacgcacgaccggaatcttggcgaggggcttcctccggagccccagcccagaggggggccagcgctccctccccgccgtctccctccggtccctcccctgcccgcgggccgggcgactcttcgccggccgccttttccgcgcgccgcagactgagcccgctgctttgctcgcaagtcagtcgcaaagcgtggcgttccgagaggcgc

SEQ ID NO: 5674 - DNA, 2906 bp, Homo sapiens
cgcgccccgctctccctggctcgcccgggcctagggcgccgcctgcagttgcgcgcggccgcctctagatggaactttctcaccaacgcaaggcccggccggagcagctacccgggagctgggcggcgaggggctactttctctcattccggcgggtgcaggatcggggggcctgggcagtaactagtggggaggagcgctggactgtgcacgtcgagcccggcaggtttccgcatgcggcatgcgaagggaatcccgaggtttccctgcagaacccgagcacggctcccccggagtttcctgccccgcgtctgcggctccttgaatcatctcaataaaatgaccgtcccggtagccacccatgccccttcctgcgcagtgcccgcagcggaccgcgctgtgtggtacctcgagccctggggactctgttgcacgcgtccctcagaccctcgggggcggggagtggggagacaatcgccagagccgcggggcgggacaaatggcggaaccgccgcgcggcgccaggcaaactttgcaagggaaccgcgcggcttgccggctctactttaagcattcccgaaaagaaagcatgtggcgggacacttgtcatctaccatgtgttattctcggtgacgctttctggagctgtgttcaccggggacccgggctcgcgggtgctgcccgctgtgctcgggcgggcgtcgcgcctccccgcgccggtcccgggctcgccaggcagccggagccgctgggctcctccacaaccatattccttcttctaccgctcccgcttcttcccaccctctcactctgtagttgggtcctcccctttttcttgggggcggggaaggggggatgatttttaaaaatcagaactattgacatttctggtctcctcgtcgcttcaggctgaagagcggagggggatccgcgggccgagggtccccctccctgcccgcgccagggccgctgggtgacaccgaaatccagaggctcccgcccctcgggggttcctcctcccgcttcccgaggtgactggttggcgcgaagcgattggcgatcccgggcgcgatcctggccgcggctccccgcgccgcgccgggtgaatggccgcgggcggaggatcgggaggcgccgggcgcagaccaatcgcggccgccggtgggagtatttgttattcacatggaagagacttggcgcctgctaggccagctcagccccctcagcccagagatcagccacaagtgcggccgctgtgctcgcctcacgcggcggcggcggcggcggcggcggcgctgacatggagctgcgggcccccggcgggcttcctcaccgcgccctctgcggggagcagggtaagactcgccgcccggcagcagaaagcggctccgaggaaagcaagtgccgaaccacgggacaaaaagcccctggcccccaaacttccccaaaacgccctgcttgttggaaaaggagaatccccccgttttattcccctttccgttttcttctctaaaacctttcagcggacagccaggtgcaccattccttctcatatcactctagtgatttgtttttcctgagcacaagtagatggccctgcatgtccgtagtctgtgagagaaatagcgggcggaggtgacgggaatggggggagaaggagagtgggcaccagggggcgaggggctggccgggcattggagcttgattgggtgtctgttgattttacgttgcaaagaacaaggcagccacccctcttgtctgcccatgattacattacagtaaagaggttcagaaaagagggagactttacccggaactcccaaggcttggagatgtgatcccccaaaagtttagtcggcgaatgggagactgaagggtgacgggaagggggcaggcgcgctcggcgctctgactgggcgtgcggcggcaggattttaaagcgctctgcctcggatcgtctgccctgggtgacctcccggacctgccctggtggaatccggacttgccccgccgagatgacgaggtaccttcgtttcgcgaacctaacaggagggatttctgaagttagcggcttccgggatgagtcggggtaacccccgccctctgagcgtgggctggatggatgtctaaccaggatctagggaggatgggggtcgcgggggaagccgggcgcttcggggtcctcgacacccacatccccgcacggcgcacgctctgcctcgagtttgcgttctccgagttagcacggcgagcttgggatttccgtgcccctcttttgtggctttcgagaaacgccggagttccgtgtcctgctgggggttggggggatggagaaaaggtctcggggatcttgtttaaaaagcaaaggcaaacgcaccccaacagctcctcggtagctcccgcggctggcgcggccccagtttcgggcggccccgcgcggggcgtgggcgcgggcgctcgggcggccaggtgcggcgggggcggaggctgcatccccagcgcgccggaatgccccggggcgcgggaaaggcaaaagcagcctggcgctctccccacggccccagtctctatctacccagaacccggcttcaacagcccaaggaactgagaagaaaaaggaacctgcgctgggaaacaggggctcctggcgggctgagtggtcgctgttatggtagagatagaaacggagaggtagagatggaccgctcagccatgccaagcgcgaagcccatccgcccagccagaaagctcggatatcccttgagcttcgtacagttggtgaaaaaataacagaatcaccaaaaaagaaaaaaaaattcccttcgtctgacacgcgctcccttggtgcaaatgaaatgcggagggacacgcgagtcacccagttgcgcaaaaccgcacccccgcgg

SEQ ID NO: 5675 - DNA, 2906 bp, Homo sapiens; identical to SEQ ID NO: 5674

SEQ ID NO: 5676 - DNA, 1696 bp, Homo sapiens
cgaaggaggggctggcggcagtgcagcagcgaagcccgggctctcggtcctgggagcctcgtggccccggccgccgtcccccgagtccccaccacgcagttccgaactccgaacgcgagtccgcgccccgtcagcagtcagcgggggtgaggatgacgcgggccgggcgagaggcaggccaaatgcagcagccccgccgcgggccgccgggcccctgagccccgctcttcagagccagggggccccgggtgcgggccggagggcgggggccggcgcgggctctcccgccgcagccccgcgccgctccagcctatcagcggccacccaactgctccctccgaccggcccaaaatagctgcgaacgcctgcgacttgcgcgcggcccctcacttgacgctcactccggctcgctcgcccgctcgccctggccccgctccgctcgtctagagggggcggggaggaagcggcccggggaggggggaggggggagggggagagaggaagagaggaggaaggaaggaggaaagaggaagacgggcggccggaggcgcggggctgcgcggcgccggccggcgcggcgctggaaggcgccggcgttaaccccgcgaggcaggcgacggagggggagcggcgctaatacataagagcactgcatcacgctaatcttctcccagaacagtatgcgtcagcagtacattcacgttctgactgaaggacaaaaggatgagagagcagtctgcgtggctgccgcctgcaacaccgcgagcccggcgcgaggaggagacggtgggcgccgcgcgcaggggccccgctgctgctgctgccgccgctagccagcggggactatgttcctgggctccggagcgtttcccgcagccgcgacccccgctgctcacgccgctgcagcagtccgctggcggcgcggccactgagggcgccgggagccgaagccgcgaactcgctccctccgcacaaagccggagccggcggcgcgccgggggccgggcagcggcgggcggcgacgggcggttgcgcgccgccgggggctgcggccgccgccgccgccggacccgcgcccgcccccggactctctgaaggggcctgcggtgcgggcgcgaccgcgggcgccgcgcgctcctccggccggcggaccgggtccgagcgcagccgccacgccgctggtcctcgggggccggacggagcgccgccccgcgtgccggcagccggcggactggagaactgaccccccgtttttgtctcttccaccctccgagaagaggcgaggagaaagggggtgtgtgtctggggagggcgaaggcgccgcgaacacctcctcttaactctcgccgctccgcgagctcacgaccgcaatcagctgccgccggcccggagcggccgacgccgggagagggagcgcagcatccagcgagtgcggcctgggcggcttcggggcgcccccgcactccctccggcggcggcccgcagagcgggccggggccgccggagcgcactttggcgatgaagcgccttcccccgcggctggagcgagccggtgccagggtccaaggacaaagccgggaagcgctggtggcgccgctccttgggcggaggggggggcatgcacctgcatagcccgccgggccttggctctcccaggcgcgcctcaactccgcggcttcgccggctccggctccgg

SEQ ID NO: 5677 - DNA, 2054 bp, Homo sapiens
cgacggccagcgcccagagctgcaaattccgaggcggctgagcgcctccctctgagcgcgcgccgtgcgctccggtcacccatgtatgcccctctctccgccccacatcgccaccgccagggtagctccgtgcgggccgaggggacccaggggggtgtcggcaaacgttggtgcggaggagagccggcaagccgggcggcggcgggtgggagcatgtagggaggcgccccctgccccctctgccggccgctctccctcgctctagatgtcagccgcgagctccgagccagcgagagcgagccagagagggagcggcggcgggcggcgggcggcagggaggagaggaggcgaggcgagggagggaggaagggaagcagggagggcgggagggaggagaggaggacccagagagcgccaggcagctggagtttttgcagcgcttggccgggcttcaatgcacagcagcagcgagccgcggcggcagcaggcagcccgggagctccggcggcggccgagccagcggcggccccgctccctgccccctgcaaactttgcgagcagcccgcccggggggccgggggcgcgcccgggaggcccggctcggcccgcggccgagctctccgccgccgcagcgccagccgccgcagccaccaccgccgcagccccgcgcctccccggggagcagccggcggctcccgcggccccccagccccggccccagggcactgcccggcgagtgtctcggcaagggtgggggctgccgcggcgcggccggccgcgggctgccggggggcggccgccgctacccagagaggcgcgcagaggcgccgagagcgctccccggcgggtcccccgcgcactcgccgcgcccgggcagcggcccgaccgggcgagcatgggcggcgcggagtgacgccgctgtgcccgcttggcatcaaggacattcagcccgcgggggtggggacgaaggggggcagcccggcgtcgccaccgcagcccccgagagccgccgccgctgctcgggctccggggctgggtggaggaaaggggtgttcggaatcgatccccattttccgacctttttgttggacattacgcccaccttggacgccgcaagagaagctgtcaagccccgcaggctctgattcggcgccctccgcgttcctcggctgctcccggcttccctgtgcctcggtggagtatttgcgttcggggctggggctggaggaggcagccacacgcgcgcacacgcacacgttcagaggagggcgagaggcagcggcataggctccatctgcagtgtcaatgcggcgctcccgctgaaggagggaaacgcggcgcgtccaggtaaggagccggcccgccggggagtggggccgggcgggcggcgagggcagcaaggtcggacagacctgggccgacccgggagtcctcagtgtcccggagccagcccgcggcacacgcacacgcacacacgcaggcacacacacagatccacaccggcacacacggcgctcgcgcacctgcccacgtcccacctggacgcccgcggaggtgcagcggccggagcagggatttcccgggtgtgttctcctctcacgctcctggactcagacttctctttcccgggactttcggggtgggattctgtgtattcccggctctgcctcccacccggggaggttgagggagcaatttttcagctcccagcccctttcgtccctagctgggctttaaaatgggagaagtcctgagaggtttccggagacctacccagtgtcatcgcggccccgtggcctttggacaccctgggatttcaacgggagacagacccacagatattcggacgcatatttggagagagtggtggcccagcgcccggggaggaggccagataggcggttggggctgcagttctgtagggcggcgcatatgaaacagacactgcgtttccccagtaagaggcagcacaaacgcctttctgaagcgtggcactgcttccccgggaatgcgccgagatttcaggcagaaagcggcttaaagcatcgccgcgt

SEQ ID NO: 5678 - DNA, 1258 bp, Homo sapiens
cgaacaacgcagcggcgccaggcgccagggtcctcacttctgcctcctggatttcctccgcctttctgcttcaccgagggccctgtgatccgattccatcgaattaaccgctgtttaccgagggtctgctgcgcctaaggaaggcaccgggcgacgagcaaggcggggacgcagtttggggacgcaggggtccgggccccagtccagagacaggaggtcggcgcttcgacttggcacccgccgacgaattcactccaaggttcccactggcggagctcctgctacctcccccctcccctaaatgcagctcccgctaccttcccgcgcccaggggctgctgcctgagcccagctctgctcactggagggcggcggtggagagggtgctggcccagcgtcggcagctgggctcaggaccaaggtgggcgcccgccggtcctggtccccccagcctcacggtgcaggacccagggcgcggccactcgagttccccggacgctctccttcctgatgctcgctgtccctgccctggcgtccccagcccggggtcgcagcctgtcctcctctctctccccctccgccgcagcccgtcgcctccgggcagagttcatgttcagcttgggctttcgctcgggatttaggaagaggccggcggggctggagggtgcgggccggcgcgggagggcgcgggaggcggggagcggcggcctctgattggccggggcgggggagtgagcggagtttcccacaatgccccggtgcggtgcagccgcggatggatgctgcgggaaggggctgccatttgctgcccctgccagcggcgcgcggacctgcccgcgctcctgcagccgccgccgccgccgccgccagcccgcccggcccctgcagcggcgccgcctgcgctccctccgcggccgccggagcgggcgccatgaaccccagctcctcggcgggagaggagaaaggggcgacgggcggcagcagcagcagcggaagcggcgccgggagctgctgcctgggcgccgagggcggcgcggacccgcggggcgcagggtcagccgcggcggcgggggccgctgccctggacgagcccgcggccgccggccagaaggagaaggacgaagcgctggaggagaagctgaggaacttaactttccggaagcaggtctcgtacaggtaggtgcggggagccggcagccgagacaggtgcgccgcggcgggagacccactcttctacccagcaaggggcgcttccgcgg

SEQ ID NO: 5679 - DNA, 628 bp, Homo sapiens
cgcggtggcccccggttccctcccaccccaccccacgaaccggcgtctggccgccctgaaatgaatgactccgccgcgtcccggcgccgcgctcccagcgctcccctccgggacagcggccaaggtgactctgaccgcctccgggtcgcgggtcgggcctgggcaggggtccctgggccaggagagggaggccgctccgcgcttaccctccaaggccgccttccagctggtgctgccctcgtagcccgacccggatcgccgcagcagcccctcggggccgcgggcctcagcctctgcgggcgaacgcggcctgggggcggcgggggcgggcgcggggcgcgcggcgaggggcggcggcggccgggcccgcgaggggggctcccgggccggctccatgcggggcgctccgccgcgccgcgcccgcgctcctgcaccggggtgcggggcccagcccgacgcgcactcggcgctccgcgcgccctgcgggccccccaggccggcctcgggtgggctaggaccgcggcgctggcaggccggggctgagcccggctccccgcgctggagcctctgcgccgggtgccgccgcggtgcgctcagcgcctgccccgccgagccgcagcctccacgc

SEQ ID NO: 5680 - DNA, 1075 bp, Homo sapiens
cggaggctcgcccccgctaggggtcccgggggtgcgtgatcatgaaccccagagggctgggctttgatttgagtgccgatccgttaatgaggacgggaggataaggttgccgacgcagcggaaggtaggggggaagcgactcgaggacctgacgattatccccaggcaggggcttcccaagcaggcacggaaaccaacttcaccaaaccgcggagtggggactgggcccgggcggtgttcagcagggcaggggcagggccagctggcgcgcaggcatctgcagggtggagcagaataaccgtggggacccgtttctctggaggggcactgtccacttcccatatgagcctcaggatacccccgtggggcggagtctcggagacgccccaggtcacgctctcgccgccccatccctgcttgcggggggccgagcagggagggaggcccagcgcgcgctgtgtgtccgcagtgttcacgggcagcggggacgcttgcgcccgggccttcgacgcgcagtctggagagctgcggagggtgttccggggccacacattcatcatcaactgcatccaggtaggtccctctgcccttctcggggccgccgcccgtgggagggaaggtgccccgccccgatccatccacgcgggcagcggtgtcccccccgcctaccgcgtcaccggtgacgcccgcccctgcgcccgcaggtgcacggccaggtgctctacaccgcctcgcacgacggcgccctgcgcctctgggacgtgcgcgggctccgaggtgccccgcggccccctccgcccatgcgcagcctctcgcggctcttcagcaacaaggtgggctgcgccgccgcgcccctgcagccggcctgatcccgcggggcccctgcagacgccagcccagacacccagcggctcccagagcgccccgccctgctacccgcggtggtggcgcccgatggccggcgaggggcgaggagcgaggaagcccgggcgggaggagagcccgtcgcaggcgtctggtttttctttggtggccaggaggcgctgggagcgggagtgctcgccctggggaccgc

SEQ ID NO: 5681 - DNA, 5566 bp, Homo sapiens
cgaatcagtcctgccgctggactcctggccgctgcccgggccggcgtcagcttcacacaatgtcgcgtgagtctttgtgcgtgtgcgcgggggaggttcgagatgttttcctcccggtaagttcccgcgccagcaccgccccccagctccgcgggcctccccgcggcgagccgggacgcgtggtccccgcgggctcacctgaagaaggccggtccgagtagcgcgtacagtagacccacgccggccagagcatgggctgcgcgcccaggttggcgccggcttgcgagctgtccgagtccgagctcaccgacaggtcgccgccgcccaagccgcgggccttgagcgacccgtccagggggccgccggggtcgccgcctttcttggcgccaccgtgcagcgagagcgtcttggagccgccttccccgtcacccggagagtcgctgccggcggctgggagcggcccgcccgcgccgggcgcacatggcgggttctgccggggctctcgggagcccgagcccaagagctgctccgagccgcccgcgccgccgcctccctccgcaccgctcgcgccgccttcgccgccggctccgccgccccttcctcctcccgcgcccgcacagcaggtccccgcgtcctttcgccggccgaactcgggccgcaggatgttgtcgatgaagaagttggtgatgcggtgcgggtgctggtggttgccgggcgcctgcaggaccgcgggcagcatcagagcccgccggcgcccggtgtccgcttcgcccgggctgctaccgccgccgccgcccgagccgccgccggggctggattccggctgccgctgtccctccaccgccgccgctgcttcgccaggcttggggtcattctcctccatgctgttcacagtaaatcccacactggttctccggggacgcccttccaaatcagccttcggccctcccgcggcgcacacggagacccccgcgcccccaccccgccgagtcttccgagggcgtgcgcggcggccgcggccagggctgaggtcctacaagtcgccggccgcgctcggcgcggagccacctttgaatccacgaactgggttagaaacaccacgagccgccccgctcgcccagacgatgagagattcaacagagccaagtcctcgacttcgccgcgcagccggggtctagacagtcgcagtggtccggcggggacgcgggccgcctcccgggctccccgctcctctccgcgtccggccgcctcgggctccggcgccgccgcctgggccgcccggggcgagagctgcgcgcatgcaggcagcgcgttccccggcgctcacgcccgcccgggccggctccggccgccgccgccgcccggccgtccccgcccgcacgccctagccggccctcgagggtgccgggcgcccgcggtcagcgcgcccgccaccgcccgcacgcacatggaggccccctcctcgcggccgccgccccgctgcgggccggggcgccccaccggcgtgcggccgcgcccccgccgagccccgcagagctccgcggcccgagtcgcatgggtgagagacgcgaggccagggcccggccgggccgggctgggccgcccgcgctccccggccgtccgccgccctcgccgcctcggcctccgcgcgggctcggaaatttccaggccactcggcgcaacctgagacactttcactctggatttttgttcttatttttaacagagccccctcgagtgacgtcgcaggccggtctcctggacacgtgcctcgggccaatggccgcggcgccgcgcgcccacgtgacgctccggccgccgctgggtgacaggagcagcccgccgcccctcctccccttaaagcggccgcgtcccccgctccgggtgcgggagcccaggaacccggagagacccccgaccgcgtctcctgcgctcgcccgcgctttccctgtcgcttcgcggttcaggggtgtgagtcacccggcgacagccccgccaggtcaccccggggcgcgtaggtggacacgcacaggaagatcgctatttttaagatttccatattgtttaccgtggggcgaaatcccacaattccttgcacaaaatgcataaataatattaaatgagctgccgagatacaaagggacttttgtggtccgctttccttgctgatggagaggaatagtgtcactcccatttgactcggtaacccggcagcttcctgtcttaaacgcagagctggcgcgcaggacactcctcctgcagacacttattgtaagtgtgcgtgtgtgtgcgtgtgcagggaggcgcgtgcatacggccgcattccacccggggacagcgaccctcatgaaacatgcttagcgatccgaaagagcgggggaatgcagtatgcggctccatttgcgaagggagaaatccaggagcctcggaggttctaaaggaatcctttttgccaaggagaggaggggtgactgttcagctaagacttcaaaaccaagtcgcccgcccccctctaacttctctactctgattgaggagctcccagaccggtcatctcgttttctttgttttaaaatcctttaaactaattttgccggagagcagggcccatttgaaacgagaattaggaatccaacggcaagggtgggagccccagttggtttctcccctcctctctcttcatcttttctagactttccttccagctgttgtcagaatgtccaactggaagttctgtttcctcttctcttccccctcctccctcgggctccttcccatttgctcttgtctacccaccaaacacccgttgttaccccaggctcgcctgtccatcatttaaaatgcatttttatggaaatgtgtgaattcctggaaacatccgatagggcagctctgggggtgcgggagcatttgcacgccatgagtaccctcagtgcgggggaggcggggaggccgcagcctggcacggacaccctagggctgattggccctgggcagctgcaccgtgctcagcaacccagacccccgcagaggcagccagcaggttgctgccaggccctgagtgaacttggggagtctggcaagcatctccgaggcagcgtggcctgccaggccacctggggcctgaaggttgcaccctggccttgcgaagctccttccccagtgtccatcccacgtgctgtccttcccctgcaggcttcagagtgctggctgggctgggatgagaaacgacagttcccacagctgctcccaggaaaattacccccccacccaggacgggaatggtgggggaggaggtgctgggctggcctcctggccactggacgtggctctggtcagagtgtgccctctgtccggtgtgtctagggcagggtggggaagcctcttctcgctggggctggattcctccactttttcttcattggaggagtccttaccaaatgttctggctaggcacacatctgccaggggtcctccccgagtctcaaaaaatcaaaccccacagtctacctgccccccgggaaaatagggctggtgagagtttgtgggaagtcttattgacgcttacttggttttttggggggagaattttctgcaactctggaaactctgatgatcaccagtcaggaaagggagggtccaacgactctgggtctcctgaacatgatattggggggaggaggggccctgagctctttggttcctgcaaaaccatcccaggttaatggctccacctgtcccatgaaagccaattaggcggcttcctgagaagtattttctgaattcttgggactctttgcctctgactgcctcagtataaatggccccaagacgctgggcttcagccctgtgctttcctgcgacccagaccccaattcgtggctgcaacagagactctgggaagcagagcgtcacctccagggcgcctggcgggccggtgggcagagacctgccctcgcagggtctgcgggctgggccctggggttggctggaggaagaggaattcgtgggtcgctctcctggaaaggaggaaggtgagaggtggagggaggaataggagaaagagaaataaatgaagagagagataactagagggtaccgggccccccagagtggacccaaacacgaaacaactctgggaaagcggtaagaggggtcaccgttcaaagggccggggaagctgggatggggctgcagaaagttgagctgcccaggggctgggcggtgctgagttctatacacacggaactccgcaaggtgtttcaggaagcttcgagaagcgcgcatgaggaccggcctcggccgcctgccccagctgggacggcgcctcgcgctttctggggatgcggggcagtggcgtgtctctcctctgcgatgccagccccggctgccgcgctcccgcgagcccagagcctccgctttctcccccgaacgaccgccgccctcaaggtcggcctttctgtgcggatcagacgagccctctccggacattagtttctcccgggatggaaagtggggcactgacccgggaaccccgttttccctctagcttcacccaggaatcggagagcgcccgcgaccacccgcttgcggaggacggtcctccatatttctcaggctcgctgcacaaagaggggcctcggagagggcgagcaggaaagcagcttccagacgccgtgcgcttcaggacacggacgctagttttgcaaacaaaacctcagtgaagcgccccggagacaccgggcgcccggatgccgagccaggctcccgtttttatctgaaaacgaggccagagaagggtgacttttccggcccctctgcgtcccctccactcgcctcgcttctctagcttgacgtggtgacacttggaaaaatggactcaatgaaagccgttcgctcgcggcggtctcgttactcgcggggcagagacgcccaacaatccctgagagcgagatctccacctcagccaaagcaggcctggccagccctgcgccctcggctgggagccgagccccgcagccaagccccaggcgccgggcggggaattggggccgataggagagcaacaccttccccggggcgagcagagagccaccgtcggctcctggggctgacgttccgacccggcctgtagacaaaggccgaaacgaaggggcgcggggagcaggggtggggcgggcggggccaacgggcggacattgcgtgtctgcgctctcctctgggcgaaggaggaccggcctacaggcccaccgggcgagctcggggacggggtctgggaggctgggtctagggtctgagacttcttcagaataacccccggaaggagggggttaaatgcggcagcggcgggcctgaaaagggccaggagcgtcgtaggaactggggtgcacaggccctcgcgtgcccagcgcttcgcctttccccgccccaggcctgccaggggcgcgcgtggcgcgggcagagcctggtgggtgggttggcgcggacagaagctctgccggggagcggggaggggggggcagtcgcattgcacgtcctggttctgccccgatcgctggagaagcgc

SEQ ID NO: 5682 - DNA, 5566 bp, Homo sapiens; identical to SEQ ID NO: 5681

SEQ ID NO: 5683 - DNA, 1164 bp, Homo sapiens
cgaacgcctggaccccagcgagcgggcggttccctggcggcggtgaccaccgttgtgctcgctgcctccacgcggcgcccgtcaaccccacgtgctcgcagccgcgcggcggggccgggcgcccggagctgacctcagcccccaggacagaaagggtggccaaacgcagacctggcaaccccccgagtcggcgaccacagattgctggtggctgcgccacggtttcgggagggtcagcccctcgctgggttctcagggcactaagaaaagaggggcatgcgagcctggaagctggagagagtccggggctccccagagcgggtgggacgccgcgtccccaggactccgcgccacgcgtactttctccaccccgacacccactgccactcccacagcggagcgaggggccccgccgagggcgagcgtaccccgtgcggctgagatgcccggaacgcctccccgcgccccggcttccccagaaggggccacagtcggcccgcgagtccccgggcgggggctgagccgcagtgccaaccaaggcgaggtcaccttggcccgcgcgcctttcattccagggcccctccggcagagaggtgactgcaggtcaccgccagccgggcccttactccccgcctccgccgtcccggcccccacaccccggaacctccccggcggagcctgcgagcccgggaacgcggtcccagccagagtggaagggatagcgcgggaacccggcagagagaaaaagcgggaactgggcgccgccgcttcacgatcgggaggagattccctcccggcccctcctggatcccactccggggaccgtttcggggctagagcccaggctgggagagtccctgggcgcatccaccgccccttccaacttccttcttctcatcctcagttcgggtggcagtggccacccgccgggtctgcaggtggaggggagtttgcgcgcaaaacttacggtcggcggcggccacccctccgcgggaggcggtcagactctggagccacacggccagagtcagcacgagcagggctttgctctccatctcggggcgcgtccctctggaggagctgcaaggcgcggaccgactgatgagccggctgagccggaggctggagagggctggagccgcggtttggcgctgagcaagtcgc

SEQ ID NO: 5684 - DNA, 1495 bp, Homo sapiens
cggcgcgcactctacatcgcttgccctgtgccccaaaacgccgaagctaacttcccacgcggcctcttgctcgaccacccacttctgcgctgccaggcacaccgaggggaccggctctccctccaggcggcccattccagcgtttcccgctagagggcacacggcccccgtgcaaagcgcttatggcgcggggcacgcgcgcacgcagcctcgactcctatagcccaggtcccactcccgggctgggctcagccgctaaggcgctggggaggggccgtgccagggagcgaagcgctcccgggactctgggagggtgcggccgggactgctgtcccttgccctgagctctgggcgtaggcgcccggtaggactcggcgcccaggtgagcggcggcccccaggaggggaagcaccgcgcgactcaacgggcgctcagagcgcagggcgaagaggacgggcgagggagagggggagggagaggccacggcatccgaggaggaggaggagtaggaggagcaggaggaggatcgtggggcccgggccgcgctgcgcacccacctgggctctggctgcccgccgcggactccggcttcttgccggagcctcgctccttcttcttgcccttccctttgcctctgccttctttgcgctcggacatctcgccggagacggagcgctctacgcggacggctctcggcgcaggcgagtttggtccaagggctcggatcgggtttgggaaaagtttgtccctcgagggggagagcgagcggccgcgctgaggcgctcgcgctgcgcgggggcgtctcccgttgcctgcagggagcgcggcgcggacgcggcgggcggtccggccacctggaacgggcgctcgccctggctctcggggctgctcctgtcgccccgggaagtcgtcgatgggtcccaccgctggcggctcgcgtcctggcctctgcccggcgccctcgcaacccgatcggggagaggttatcaccgtcctgctcacgctcccatcgtccggcagccgccgccgctcagctcctggcctccgcgcgagcccggagttccaacaagtttcggggaactcctcgccggctctttttcaattgccccgcagccacccacctcccgcccgcaggttggaggcaggcgcctccttcgcaccctcccctggcctcgccccctccctcttccccaccacacccccaccccgaggcgcggacacgccaccgggaggagcctgggctcggcgctcccgggcgcagccccttttcctcccgcgctggccgggcggggggtggcggcgcggctgccgggaacccccgacaggggtcgctggacgctgcgcggagaccgaggccagcgccccggagacccgggaacccaggcggagacccgaggctctcgctgcccgctcccctccgcagccaggcagcgcctgggagggctgctccgtcccattccacgcggaaaaggacggcgcagagaaaagtttgcga

SEQ ID NO: 5685 - DNA, 352 bp, Homo sapiens
cgccgccgctggtgggtggcggcggtccgggtgctttctggattgcgcagtaaagaggcatcttgggagatggggccaaggttttagggggtgccactcgcgaacggttcatccgctagactaggggggctctttggctgtgcgtctggccagaactggccttgacgatggaagtttctggaaccaaagcgttgctttctctcccttgtgttatagctggagctgcgggagcgcctgccctgcccggagcccgcggtcccctctcggctgccccgcggtggcgtcacgcgcccctcccggagcaagcccggtgcgcagggccgggggcgtgggcggctgctgccagaggcgc

SEQ ID NO: 5686 - DNA, 1141 bp, Homo sapiens
cggggaccaggcggtgtgccgctcgggcagttagtgggccgggcgagcctgcggggctggaggggacgcggggctgggaggctggggagctgggggctgactccgggcgggcggggcggggcagggacctgccggcctggggcgggcgcaccagacgagctctccgcccgcaggcccccagcgcccagccgcgtcccggctgcgtcccgccggtcccgccccgccccgccccgcagagccgccgccagtagtgggagacgtgcgctgagaggcgggggctgcgctcggcggaacagcagccctcgggcggagagcggggccggggtccgagagcaggtgatgccaagagctgagcgggactcgtgagcgcgcggttcagcacctaccagggcgtcccgtaaaaaacctcgccttcgcctgtctctgggaaccataggtaagctttgggctttcgaggtgcagttctaggtagagctccgtgctgggaggtgggaagggggcttgaccctggggactcaggcagtctggggacagttccaccaggggccggtgcctagaattggtgagggaggcacctcaggggctgggggagaaggagcgagcgctcttcgcccctctctggcacccagcggcgcgcctgctggccggaaaggcagcgagaagtccgttctccctgtcctgcccccggcgacttgcggcccgggtgggagtccgcaggctccgggtccccagcgccgctggccagggcgcgggcaaagtttgcctctccgcgtccagccggttctttcgctcccgcagcgccgcaggtgccgcctgtcctcgccttcctgctgcaatcgccccaccatggactccccgatccagatcttccgcggggagccgggccctacctgcgccccgagcgcctgcctgccccccaacagcagcgcctggtttcccggctgggccgagcccgacagcaacggcagcgccggctcggaggacgcgcagctggagcccgcgcacatctccccggccatcccggtcatcatcacggcggtctactccgtagtgttcgtcgtgggcttggtgggcaactcgctggtcatgttcgtgatcatccggtgagcgcggggacagcgcagcgctgggggctgggcgg

SEQ ID NO: 5687 - DNA, 3297 bp, Homo sapiens
cgagacggacaggaatcgaggagattcccctgtagcgctctccaccttccggacagaaatcctgtagaccacgttcacttctccactccgtgcatcgcccgtggcccgtgggcagcagctgctcccctgggatccccctcgcctgtccgcgagctctcgcacggccgcgtccctgctgctggggtcgctcgctggccctggctgctcgccaggattttcctttgatgctgtcaagtccgggaagctcacgatgcacctcagtgcccgcgcgccgcctctcccaaagccccttccccactcactcccccacaagcgtggagggagatggggtaggtcgcggcgcctatagaccccctcccggcgcccactctctctcttccacttctctagcagcggtagggccgcagcgcacgcaaacctttccccaaaacgcccaccccactctcagctagccgcttctctcagggctcctccgcccgagctgggtgtggggatcgccgcgcacacagagacgggaaagccaccccggtcccggagcgccgcttccctagaggcccctggcccgtccgctcccccagcgctggaggacagccgcgcacacagaccctcccctccaacgcccaccgcggtccccagctgcagcctgcacctccacttcccgcccccagtctcccgccctccgccccctgctttccagtctccgcagtccgggcgcccagacttgtttcgacttcccagggcagctccgagggtgcggaagatcaagtgcccgggtttgttccaggaaaatcccggcggcgcctgcacgttaactgccctggcgcaggcgaagggtggagggcacttctctgttcattcggttttcaagagcgtgaacagaggctccgagtgaacgcccatacctagtcggtcttctagggtccacgcgtggggcgtccacttcctcaccctgcccctcggtgcccctgccctggttgcacttctcctaaaaggaggcgctacgattccaggaggctctgtctccttacccttcccagcggcgctcaaaccaccagccccgggcgcccaaccccttccttgtcctctccctatcccgtgagaaagccgacgcttccacccgcctggtctttccgaaatacgcttcgggtggtcaatgcgatttctagggtctaaagactagactcccgcgttccccaccaagacaccgacgcgaagccgcagaggtggaatcgcggacgccctggcaggcccgggacatattgatcctggtggcgcgatgcccctcttcgcacgcggacgcactcgcagccccactcccccaaactcgcactgcgggaaggaacccccgactcgcaccggctcccgccccgcagcaacggcgacaccctgaggtccggacgagcggcgcgcccctcccagcctcggccactttccagcacgaagcctcagggcgagcccgagacgaagaaagagagttcgaggaactgggatactcacgagcccaccgtccaccctgccggccggggaggaagccccggccggctcgcctccgtccgccgtgcgcatgcgtcccgcgggtgccttctcaatattgcagcgcggagggctgccctctctacgtcggcgattgctcaccgcgcctttcgcctttctccggctctcggtctttgctctagccctcttctcccggcctcttcctccccttgctctgcctcctccccgccccctcactccttttacccggccgggcaatcccacgtctcgcctccctccagcggcggcgcactccaccgccgcgggtgctaggggtacccccgaggccccacgcggggcgcgacctccaccccggccgcagccccactgctccagccccgcattagcaagtcccaagagtgtggatgcgaagccaggcgcgcgtagagggcgtccgcgaagccctctgtgtcatcgcctcccctcggcgcgcggggccgagcgagactagagtgtgctggactgcgtgctcggacctcgtgaatgaagggagcgggaggaaggagcgggggtgggcggcaggcatggagggggcgcttggtccccagagcttcgcgtctgtggactgcgcgtctctggagggcagccccctaccttctccccggcccggggcgcctctctgagctctgtccccgccccaccccggcgcagcctaggcctccggtcttcccgccctggaaagcggccctcgccccctcccagctagccagagcgcggaggccccacccagcaaccgagcgggggataagggggggaactaacccctgactccagatcccgctgagaccctcggcagtcgccctccgcgtccccttctccagggactccggagtccggggaaaggagtagaccagggggcagcgggagggggaacccagccgcccagctctccggactcgcagcaccgcgtgtccccgtagcccgcagcgtcccttcgggagtgggacccggtggggccgcggggttagttccctggagcccggagggctaagctgaagctggaaactgacctgacacaaaaataacatcacgtcatttcctcccttgcctgccgagagggcaggggagtgggagagcgagcgctgggagcaggcggaggcgcgtttgggggaggctcggagtaggcggaggagagcgacacgctgagagtttgaaaggcagcctcggggaagagcgagggctccctcccgttttcttggaccatggaaaggaaatggcccaggaaaaagtagcttggagtgtcttcccgcggggaggggcggtgtcccgggagccgccaatgtcccgtcctaggacttgcccagccacgtcccggccttcccgaccttgccaccctccctactgctagccccagcggagcgggtcagttggggttaggaagaatcgggagaggctggtgtcctggggaggctgggtgtggggcgtagtggagaccacggtactcaccggcataggcgagctctgcccagcggtggcgtcttcttccctgggcttggctaccggatgggggggcctcagcggacgaccccccgagggtcggccgggcagtgccagcgccgccccgagcaggagcgagaggcggcccggcagctcctcgtgccccctcgagagccgggcggccggcagggcgggaagcaggggggagaagtccaggcgcctccggggagcctcgggagggggtcgccggagaaggtgagagaagaaccttgcgaggctggaaagcgggctagaaaggaggccgaacagcttcggggcggcgggcga

SEQ ID NO: 5688 - DNA, 2213 bp, Homo sapiens
cgaaggcgacgggtccaggacctgcagaaaccgctgcggtttggggcggtcggggacccacggcttcctggggcggctctgaacaggccttggggcgcagcgtccgctttctaaagaagcctgggatcgggtcctgcctcgctgcaagtcacgcttcccgtgagtccacaagtgcaaaaccagaaaagaatgtttcgcccaaataattaaagagcggtggcccccgcgggggcagcggaggcggtcagcagggtccccgtccccggggagaagtgcccacgatccaagggctgtctgctctaggaacttcttaaagaattacagacactgagagcattcggggtctggtaggaagtgcagtgtatctcccagctttagggtaactaggacagcatgaatcttttaccttgtggtagaataaacggctagcgcctcgatgtggcgcgctcgacttttcctcacagagcctaaaagtcacgctcaaccaaactgcagcgttcccgcctcagctgggcaccggcctggaagcggcctggaatcagactggactcgaggaggtaagacctcggcagcgcgaggttaaccacaggcctcacccgcggcctccagcccggccccaccgcagccggcggcagacaccccaaactctccacacgccgccctcagcgaggcgcctcggggaaagcagcgtgaggcagtgagccgaggggcggggccaggaggacgccccgcccccgagcccgccccgccggagggtttgattaatgaccctctaagccgcctcagcccccggcgtagcctctccggtgggccaggtcctccgcccgacctgccttagccggtcggagcacacacgcctggccgcggggcgcccgcataaaagtcacagccagcggaggttggaaacagccgtcgacttgggcatcggccggacgaggatggagtgaccagcgcggccctggccacacaggccctgctccacgcccctcgcccgccctcacgacggagcggagctccactcagccgctccaggaaaggtgaggggcccgtcagacgcgtactgcgcagctctcgggctcggaacggtggcgggtgccgtaccccgaggtgaggctaagggtcccccgctcctcgggcagaaatcccccctggcgtgaaaggccgagggcggctggtgagccgtggttttccgcggcgtcggcgagaaggagccgcgccacctctcgtgcgtgccgggttggataaagtcacccaagcgcgaacgagtgctgatcctgagctgtgcttccgagatctttcttcccgggtagagtagaccttttgcttaatttgcccctgaaaagcaaagccggcactgcgcctcttcttatccttctaggaagcccaagaactccggagttccgcaactctccccagacgtccggaagcaaatcgcgtcccaggcaaaacgagctcgcttgagagcgcccttagccccgttgggctgctggtgggcgcacggggagaaccagggggctgcgcctctcgggttaagcccgaccgccccccggcctcaccgcaccttcggtcctttgcagcgcgcgcggcgcgggaagctgccatggaccgcggccgcccagcgggcagccccctcagcgccagcgccgagcccgcgcccctggccgccgccatccgcgactcgcgtcccgggcggaccgggccggggccggcgggccctgggggcggctcgcgttccgggagcgggcggccggcggcggcgaatgcggcgcgggagcgcagccgggtgcagaccctgcggcacgctttcctggagctgcagcgcacgctgccgtccgtgccgcccgacaccaagctgtccaagctggacgtgctgctgctggccaccacctacatcgcgcatctcacccgcagcctgcaggacgacgccgaggcgccggcggacgccgggttgggcgccctgcgcggcgatggctacctgcacccggtcaaggtaagcgggcggggcgcaccgcggggctggggccgagaccaggacaccttgatctgccctgccagtcaccgtcttgggtagatgctctaattccttttcgggtgaggcgggaagccgaccgggagaacgacctcggcccgcgagggtactggtggcaaggtccccgccgcgaaagccggctccttcgcggttcacaggtggctggagaggcgtttaaagccgg

SEQ ID NO: 5689 - DNA, 363 bp, Homo sapiens
cgcgggggtcaccgcgcccgcgaacgcagagtccacacgtggattcccgcgcctgtgatgccccgacccgtcccgggtccccgcacagacaatgccgcgcgtccttcccgcagccactccgggacccgcgccccgcgccgcccggacgtccccctgcgtctgccggggacactcaccgacaccaggaactccagcgtgcccacatagtcccgctcggtcttctggagctcgctgagcacgcacacgcgcaggcgaagctgcttctccaggtccttggcgctctcggcgcggctgtctccgcggctgtcctcgctcatggtcggcggcggtgcgcagcgcggcgctgcccgccgtgctgagcgc

SEQ ID NO: 5690 - DNA, 960 bp, Homo sapiens
cgtagaaaacgctgcaggggccaggcgtccgagacaccccgcggggcagtgggcaccaggcccaggctccggctgcagagcggaggggcgtcgggcccaggaaaggggctgtgggtgggggtacgggggagacccgaggggtgctgggaagagggctcccctctccagcgccagccctggtgtcgctgtgcactcggagccgcgcgaagggcgcccctcgacccggaggcacaggagcgtttagagaggaaagaaagaaaaagccaccgctggctcgaatttctggaagccggagccgggttttttgccctaaacaccgaggcagaacccctcttagcgctgccccggcctctctgttacccattttcggtttgcttttggaagaaccggttcctcagccccccgtcgccgcagttgtgacacaagtaagtgcagccgcgctgcccggggcccgccagggtcccccgcgcccgctccccaccgtggctcgcggcggccgcgctcccgccccgccccgctcggccgccccgccggcttctgcctccagttgggttgccgtgacgaggagacgttgttgtgaaactaaatctgaccctgagttcccaggcggcggccgagagcccgcggctgctgatgcccctgggccccaccccggggcaggagggcggcgatcggcgcccgggaagcggctgaggggcgccgcgactctcagcgagcgccgcccgagccccagcccgcccgggcagcctccgaggcctagggcgccgccgccaggtacgcgaaagtcacctggaagggagctgggtgcgcgcaataatggggccttgagccgtggccggcaggggagaggtgcagccgcccaaggcccgtggcgtcgggcgctgcacgtggagggatgtgtcaagggccggtttgttttccttcggggaggtggtaactgattgggacgtcgggggacgg

SEQ ID NO: 5691 - DNA, 1404 bp, Homo sapiens
cgcccgtccctcccaggcccggtgggaccagacccgaagccaaccctcgccaggcgtcaggtgtagaccccaggccaggccagagcagttcctgggtcttcggaccgggatgcccgccctgcccctcctcctggccccgcccggtctgtcacagggggaggcctcggcctcgcattccgggcagcgaacttcgccggccgaggttagccccgtgcgggggcctcccgcgggaccgaccgccaagcggcattgtccgtcccgggcgcccgcccggttccagacgcaggtcctgcggccgccccgtgacaagcacactgacgggccactgtcctttgacgagtgctaaaaagttcgtttgttttgaacgtcaattttcaagtgatcttcacgaggtttcccctcccggttccttcgctgctgcctcgcccgcactcggtccccagtaggtgctcaagaaacgtccagcaaacggcagcgcaggcgagtctgctctgcgcgctggcgcgtttcactgcccacggatggcgggcgacctcacgggatccccggttcgcaggatccccgcccccgaggctgcctctgggccgggaggggttaccccagaggggcgtccactctcgacggcgggggccggggcgccgcgggcaggggagggcgcagcctccaagcagccccagcctggcctagaccccgcgcctagcgagccggccggccaggcccacaccccccacctgccgcccgccccaggggaagggtccccccgacgacgcccgagcccccctcttcctcggagggccggaggccggcgcccattggccggccctgggcgacgccccgcccctccgacgccacgggccaatgagcgcgcgctgtcagctcatcagccgggctggctgggcggctcgggagcccgagcggtggcggagcggcgagcagcgagcagcgcctgcgggagcggccggtcggtcgggtccccgcgccccgcacgcccgcacgcccagcggggcccgcattgagcatgggcgcggcggccgtgcgctggcacttgtgcgtgctgctggccctgggcacacgcgggcggctggccgggggcagcgggctcccaggtaagcccccgaccgaggtggggggcggcgggcgcggggggctcgggcggccgaggcgcggtcccggagggcttcttccccgcggatcccgagctcgccccgcgcggccccgcgccccctgcctctttgcaaagtaacttctagggccggcccggggcgccccctccccgcagcccgggcggccggggctcctgagtccggcggggccgcaccaggggtgggtgggccggggccccgggaggggaagcgcgagcgcgggagcgaggaagaaaggcggcggttcccggggaccccgcgt

SEQ ID NO: 5692 - DNA, 1247 bp, Homo sapiens
cggggggcaggccgcgagagggagaggatcccgggagcagacgaagaagtggagcagctaaagtctgcgtcagaagaggttggggactgcgagaggagaggctggggcctgcaggggagcgcagcagcttttagcatcgatccaaactctaaagactcgtggcctttgcctgacctcgagggtcgggaatagacgcctgtctttgtggagagcgatacccaaccgagaaaatggggctgttccgagctgggccctgcgcctggcccagggcgaggcttctctggctccgggctggcccctgaggggcgcaaacggcaggcctggcggttggggccgaggagggagggtaccaccgccccgaggcagcacgcagcctgcagcagaggcgcctgctccaagctgtctcttgggggcgccgccgccgcttccctcctccggggccgctcgctcccaggaaagtggaggcggctggcgaggaccgagagccggggccgcgctgcggagggaccacacctccgggagttcgagggggaccctggcgcggcgggccagcctttgctccccggccacgggccggcagcgcccgccttcccccggtcagcgcttgcggcccgcgccgcgcgcaccgcccggcaaccccgcgcgcgtcccgcgggggcgctgcgtcttcctgccacaccggcgcaccgcggcccctctcccccacacctccggcccgcaccacccggctctcctcccaccctccccacccctcctctgccctccctccccattcctcccctcccggcgaggggcgggagggggcgtggcggggccggggtttgtgtggctgggacccggctcctcgcactccgagtccgcccgaggagccgggccccggccgctgtccagccgctccgtgccccgcgcgtcctgcgccgccgccaccgcctcctggggagacgcagccacttgcccgccatggatactcccagggtcctgctctcggccgtcttcctcatcagttttctgtgggatttgcccggtttccagcaggcttccatctcatcctcctcgtcgtccgccgagctgggttccaccaagggcatgcgaagccgcaaggaaggcaagatgcagcgggcgccgcgcgacagtgacgcgggccgggagggccaggaaccacagccgcggcctcaggacgaaccccgggctcagcagccccgggcgcaggagccgccaggcaggggtccgcgcgtggtgccccacga

SEQ ID NO: 5693 - DNA, 1861 bp, Homo sapiens
cgctcattgggcgacgtggggaaacaagctccagcccccgaagcgcgaccaaaaggagaaatcaagttcccaccgccagggcgggggagggaagctgggtgccggcaggcgctccgccggagacgagactcctcccggccccagaagcgccccgccagggccagagagggcgagcgtggcgggagggaagcctctgtcccccagcggccaggcgacccgaagccgagcgccgtgtcacacgtaccccgcctcgccctgcttgcggcactcccgtgtaactcctatgaaaatgtcctcccgtccctgacgccccgcggtgcaacctccacccctcaacgaggagggggtcgccgcaggactgggaatccagtggccggcgtcccagcattttcggacgcgttccgtgcctcccccagtatccccttgagggatcgcctactgcgattccacgtagtgtcggttacctcgccctagccgcagggagcatcaaacaaaagaacttttgcaaacttttctctctggacactcgcgggtctcttaaatctggcccccatctccccagaacttgcatgcagtcaaacaggaaagctggcgcgggggggatggtgtgcggaggaagggaccccgaagtttccaggtcatccctggtctcgaggagcgcgcggagtggagccgttccctcgcgggcccgacccaggctcccccctcctgccaccctttcccctccgtccttcccagaccacgcagcaagacccgccgagggcgaagaagttgggagtgacttcaggggcctctgcggctagaccaaaccgcaattctcggtgcccccattcccgcggaccgcggggtaacgccagcgagcagcgcttttctgaggaagggaagagggggaaagggtgaccggacgagcgcatttgtcccagcggatctccggtgtatacttggggactgggggttccccaggtggcgctcccctattccctgcgggctcctctcgtagcttcaaacaccctaaacggcgcgcgcatcctccgcctggcccactcaccgactccgccgacacgcaggccaccaagcccaaggtgagcaggatccacgcgcgccgcatattccccagggaccggctgctcccagccgctgcttgcaaccagggcaaaacgaagcctcctgcccagcgctcggcgcagcccgcgcacacgaatccggagcagagtaccgcagcgattgcggctcaggctcggggactcgggctcggggctcgggggcgctcgcttcctcctcctgcgcctgctcccgccgcccgcagctgcgccccgggaacgcggcgccctctcacttgttggtttctgcactcccgacacggagttggtgctccgggaaggctgctctctgaagctcttcttgctctgctgtggttttgctcctccgcggactcctttcccgtgccgaggttcagtttctggttttaaggaataaattcgctggcttgaaagggagctacggcagaagtttaggggcagagcggcgggagcgcgcgatccgcgcggctggagctccgggggtatctggagagcagcgcgtccaagcggggccactggctccgcggctgcgcccctcctcctcccgcgccgcgcctccctccccgggtcctcctccttctcctcctcttcttttcctctggctccctccctcctgagcctgcttctccgggctcccctgggcgactggggagaggaggcggcagtgtgactcccagataaacccgggagaaattcctacaggattacacgccgattggcagctccgaggaccagtgggcgccgcggctccgcgctgtggctgcgccggctctgctcaccgg

SEQ ID NO: 5694 - DNA, 3044 bp, Homo sapiens
cgccgagggggaggggctggaagatggcggcggacgcacacccacccgaccgcgacagagcttaggcccctagcccgcgccgccgcccgctgctcgcagccactgtgggcagccctgctctgtcccgcgttgctggtagagccgccccgcggaggcgtgggaccagggtggcgtccgcatcccctgccagcgcgccttcgcccgggtccgtccagggagcacctgtgcacggccatattggattctgtgccccagtcactgcctcagcgcggcgggaaaggagagggtacgcacagagcctgggttcagccccagtcccgctggggccccggagccaagatgaccagcgaggaaatccggaaaggcgccaaggaaaatcacaccgcctaaggctcgccaccctcacctcagccggccttggcgccctccctccccgacacacacccctgctctcagacacccctaaaacagcccgggcggccggcgctggccgcagccctcgtggcctgggcgccgccagcgggagggagggcggcgaactggggcgcgcaggcggccgcagggcagtgggcgagggggcggagggcagggagagaggcgggaatatggagccaggtccttacttgagcacggactgctccttctcctcttctttcttctgcctatccatgacggccaggatgattttcctctcctcctccgtgaggtggctgaggtcaggcatctcgggctgcagaggcggctgagaggccgccgggatgggagccaggcggccccggggcccgacaggagccgacatgtttggtggagccgaaccaccctagggaagcggggaggcaactccactggcagcggcggcaccggcgcggcggctggggcagcctccagcgctgggacaaatacatacaaatcaatggccttcaatccaaggcgacagcccccctcccccaagaaaagcagggggaggggagggcgagcgcgtggggaaggagggctgaggagtgcgcttcgggaaatgtttcttcttcccgggggcgaagggctgtgaagtgagcggttcaagggaaaggggaactggaggccgggacgcggagtgcgcggagaggcgggggagggtggtggagtaaggtggcggggacagctaagggtggggtgactggagggagcaggcgggagggcgacaggcggaccggggcgcgagtgtgtccggccgcggtcagggccgggagcgcgcgcgccgcctcggaggggaaggggtgcctgcgaacaagcccccggggaactcgcttcgagcgcccggaggcggagtactgccggcccgaggggcacccaggcgggagccgagagggtcgtgaggaagcgaggacggtttcccggagaagcaactcatccgtcccgccggctgacgcatcacagggctcccgcgcgccacagagggagaactcctccaggcacacccgggagcgggccgcggggccggaaacccccgcggagaccccaaccccacccaccccacccccggctagagtggagaagcgaaagcggagaagatatgacgggggctagcggcggagagtcccggggccagggcccttcggctgccaacgcccggatccaggcgagctccgacgtgcagcggggtctggcgccggcccctcctcatcacgcgcccggcccagggtcgctcagccgccgccaccgccgccgccccttgggtcgatggagtcggcgcggaaggcccgcgcgccctgcgccgccgccgctcagtgccgccgccagcacctcctccgcccctccgcctcccgggctcatcccgcgggggcggcgtcacctcctcgctgcccaggcccgggcaccgcgggcgccccgcgggcggcagccgcccctcccgagcgcgatctccaggctgggtccggggccgggcggggagggaggagagactgagcgtgaagggagagggcgcccgagttttcggggacggaagtgtggagaataggagcgtgtgagggggcgcccgaggtgtcgggggcgggggaagagtatgagcaggggtgggggcaggggtgccaggtgtagcaggtagggaggtagaggcggcgagtgggggcgcccgagggaccggggcggggcggggagcgtaagggtggcaaggcgcccgagagtcagggctggagctgaaggtgggtgacagggagggggcgcccaggtgtcaggacctgaggagaaagagtgcgcgtagcgggagggccccgaagtgtcggggcgggatcctggaaggagggagaacgtgaggagggaggaagggtccctggggtgtcagggatgggggccaggaaaggggcagagagctggaggcccacaagtggggatagcgggggagggaggttggagcgagtggggaacgcaggtggtgtcgagggcggggacagggcgaggggagcggggcgtgaggaagttgtgggaaaccgcgctggacgctgagaatgtgcggaaggatcctgaggggaggacgcgagacagcgcgaggagagacgaggagagttagggttggccgggagggtgcgaagatgaagcgaccactggaggctgtgagggtgaaaggagcaagaatcgtctagagacgggctgggccggtgctggggccaaaggcttctgtctgtcaggccctttttggcgctcactctagaaagaagaggcggagacgcgaagagatcgggttagagtcagattttcgaagcacggagatgggttcaatgaaaggacgaggaaagacgagaaaccagcggccggagaacggaggtggccgccgccgtcctttgctctgctcggggctgggcgccgcccggagagccctcccggagggggcggggcggggccgggtgaacagagctgggcgggctcgccagctcttccaggcgccctgggcaagcaatgtgggtgactgagctcgggtgtgtgtgcctgtgtgtgtgtgtgtgtgtgtgtgtgtgtacgtacacaagtgagcgtgtgtgcgcaccccacccagccttccacacgcgcgc

SEQ ID NO: 5695 - DNA, 1603 bp, Homo sapiens
cgacttgatctctgcgagcgtgcctgtttcggaaggtgtctcttgacccgccgtgtcctctaagcaccatcgggacccccgggcacccgggggctcagggccatgcactcccctgcgcgcccaccgccttgaactcacagcttccgcgctgggaagtgactggcggcccctcccagggaggactccgcgcgccaccagggccagacaccacccgaatccccgctcggctgagcgtcctggcggcgtgagccggacccgcccgaagtcccaggacacgacctgccagccaccagcccgcgcccgcagggcagagacgcacggccgcccgccgcagaggcgcgaacttttacacctactttttgtttcgcttcgggtttggtgtggctctggcaccgcccaggatcgggaccctgacgctctgattttccaccgcgtggggaagttacctccctcgccccgaggtctcgaccgcccagcttttctgagaagtttctaccctggttactaaaagtggttcccaagagtagtcccacgtcaatcgcacaaagcaatgacaacaacaataataagcgtctaaaggagcgggactgcccctccggctggacgacagcgccggggactcgcagcgtgcgcgggtcggaattaaaaaagcagcccgggagcgcgagggctgagcggggcaagcatgggctgctcctcgcagcctctctcctgcccgaggctcgggctggccgtctgtctgtctatgactgtctagttgtcccttcgactgctcaggcaaagtttgagacatctaggggaccgggagcggatctcccctagccccgccacccacccaccgctttcccgtcccgcgcaccccgctcctgggcaataatcccaccaactcccggccccgcgcgcaaacttacgtttgatctgccggggtttgctttgctttcgccgggacatctcggcggcggctgctgccgctggggctcccgcggtgcccgcggtcgcggctgccgctccctcggctcccgccgccgccgccgccgccgccgccgctggccaggctcggcccgccgccggccggactccaggtgctccgggcgctgggctcctccgggagccgcggattcacgttcggagatgagcaagcaaatgagagaagagagacgggggcacagagagtgtgacagtgaggaggggagggggagaggagagcgacggggggagaatgggaatgtacaagcgaacggtcagggagagagaaaaggggaaagagaagagaaaaataacacggaaagaaggaagagaaggagggagggacgggagagcgagcagcgaggagagggggagcgcgggggcgcagggcgcgggaggaggagcgcgctcgctcgcccctcgccccggcgtgcgggacggatactccggcgccgccgccgccgctccgggccgcgcagctcctgttctgcggcgggaggcggcgaggcgcgcgagggaggggcgcgccggggctgtggggaggggagactattccatcagccaaaggaggattggctgcatccaaatccagtccggatgcaaactacggccccggccttggtcgggcgaagtgcgg

SEQ ID NO: 5696 - DNA, 1365 bp, Homo sapiens
cggtctgcatctccatcggaaagtgcgcttgccacatcccttcggatcacttcgtcctcccgagagcgttctgccttctacagctcggaaagaaagaaatcttagctgtgaagtgaccgtggagaaagcgcaggaagcgacacaattggttagggaggcagagagtgtgagcgggcgcaccccttgcctggggaccgcgctcgcgggcggggacggagcatcccagtggctgcacccgccgctccgcgctcctgcctggcgtcgccaaccccgcggcggccgctggaattccagagctgccaggcgctcccagccggtctcggcaaacttttccccagcccacgtgctaaccaagcggctcgcttcccgagcccgggatggagcaccgcgcctagggaggccgcgccgcccgagacgtgcgcacggtaggcaacccacaccaaggcagccgcagctgcggcgcttgggtacaccgccgtggactccaaatggcctaagagcgttcttttagccctgcgctctcagtgcctttagagttctttcctttccccggagcgccggcacaacgcattatgccgctgggtcggagcttagggctcggcagaggttgctaattcactgattataatcaccttcctctccaactcgtccgcagctgcccgctctggattaagccgctccgcggctcgtgctaggcagtgggttcgcttcctccttccctctcttctttaaattgggacgtgcgaaggcgcagctgcctccccggggctctctccatcccccacacaccctgttttcgcttcttgtctctcaggttcgtggcggagagatgctgatcgcgctgaactgaccggtgcggcccgggggtgagtggcgagtctccctctgagtcctccccagcagcgcggccggcgccggctctttgggcgaaccctccagttcctagactttgagaggcgtctctcccccgcccgaccgcccagatgcagtttcgccttttctcctttgccctcatcattctgaactgcatggattacagccactgccaaggcaaccgatggagacgcagtaagcgaggtgggtccctctctgccaaaggtgcgtggtgggcttcaggggtggcgtgtggaggcgctcactcacgccctggctccgggggctcagatggtcagggctgtgctctccaccccagcttttgcgggtccccagtccccacctttaggaccctggagctctacaaaacactctgttttctgtaccctggaggcgcggggagccggagcgagacgcgctgggagctcggcgagccgggcgccaatcgggcgctcagggctaagtcgtgcggtccgcactcatgttcgccgc

SEQ ID NO: 5697 - DNA, 419 bp, Homo sapiens
cgtggcgggcgctgcccacccggcggagccgagcggcgtgcagaggctacaagtgccgtagctggtgattgggggactttctccgggaaccgtgccgggagagcgcgcggtgctggagccgcaccgggtggccgaagcagaaggtgagtggcggggagtgggatggggtggaggctttgaatgcaagggtgagagccctggagcctagcagagctggagcgcatatccccgctctctctccttcgtctccgagtactaggcggacacatccgtacctcgaatgcctcagtgggcgcagagttcaccagaaatggatagccggattcctcggcgcctgctgggggcaccgctgccaggtgcttggggctcgctctcccggctttgctcgcacagggcgcatccagaggtcgcctccccga

SEQ ID NO: 5698 - DNA, 3675 bp, Homo sapiens
cgcagcgaggccggctgcgcggccgccgcgtgggtcggagtccagtgccccctggtggcgccgaggcgggcaggcggcttccggaccgcgcggaggcccgacggctgtgactcaggggtggcgccgctgccagggcggcgggaggcctgactggggttccgtcgtgggctgagccacggcgcaattaattaccagctgctgggaatccttgtcgcccgctcgcggtgactcacccggcagccaggctcacttgccgagcgcgggggccttggtttccaaaatgaatctggggagagtgcctgctcggggtagggctccccgctccctcgccccagggcgcccgcagacccagcgaggacctgacggctcagacgtagcccacagcgcgggctccccttccctggtgggcacccgtgatccctgaaagtggggtgcagagcgtcccagctgggaggcctcggtgaatcactggggtcccagaccctctgggcccggggtccctgaggccagggagcccgagcaccgctccagggggcgacccacagaagggactggtctcctggagcccgcgagctgcccgagggttaggtctgattccccagccaccccttggccagctgctagcctgccgccaggcaactctttcccatctccatcccttccttggctggggtcaggagaggaagaggagcccaggggtctctgaggcttgggtctgtccttttggagctccagggctccaggcgggattcaggaagccgaaggtcaaggaaaagcccctcgatagcctaaagggagagggcggggagggggaggaggtaaaggaggccaaaatgggaaggagataaagcctggagagggctcatctggaagcagggaataggtgcgccccagcccgagcctcgtgttcctaccccaggtggtctcgagggggctatcgcgtggctcagggctgcatccacggcgcaccttgcgcccagctgtggggaaccaaagagtgattatatatatcaaagagtgattatatatatatatatatatatatatatgtgtgtgtgtgtgtgtgtgtgtgtgtgtgtgtgtgtgtgtgtgtattttttttttttccttcagtaaagcaacagagaggttactgggtcgggggattgcgatgtctttccccgctgtcctgactccaaaagtggcggcccatgctgtccttagcgctctccagggaaacgactcgggtctgcaggtgctggcccaagcgggctgtgccgctgggaggcgagggggccgaggcagccctcgggaccccaccactccacgaggccatgtccctggccaatgacacgctcccgcgccgggtggctaggtggggggtggggggtggggaagacttcgtgaaccgctgctgccgctctcctgtgtgcccatggccccctccccttctgctccccactctctgcccaatctgcctgaagctgtcagcctgccatctctggctgaatcccgttttcctcctccaaccccgagtccctcaaactctccacccgccagggctgcttgcgctcttggggagcggggctagaaggacccaagaagccgcgtttatcctcccatcccccgccaaaacccgccggcggctccgcccccgccccctccctggcggctcaggccgcccctcccgggctccctccgcgtgcgccctgcgccgcgctgggtctgcagcgggagctgccacagcagcctcgccagctggctggggaccaggcgggaggtggcgcgccctggaggctgcgggagggagggagggagggaggcccggcctcggcgtagcccggcccccgctccccgaggccctcccgccggagcggggctgccaagcgcacacacacacacacacacacacgcacatacacacgcgcacacacacattcgggctcccaacggcgcgcacgcacgtagcgcccggggcagaccagcgcggcggccgcctcccgggacgcccggacgccggagggccccgacccccgcgcggctcatgcgcccgcgtccgccccgctgctccgcgaggcccgcgggacccctcccgccgccgccgccgcgcccgccgcccccggaggagcgggctggccgaccgccaccgcgccgtcccccggccgcccccgaagccgctccatcgcggtccctgccgtcctggggccgcgccccgctcccgcgccttgggggttgagccgagcaaacttcgcgcaccggccgacgcccggcggggaccccgctgcgcacccgcgcgcccgggtgggcgctgggcgcgcggacctttggggagcgggctgcccctcccgctgcacctgctcggccccctccccgcttgcaggggactccagagacaccgccacttcgcaaacttttcctccccaccaccgagagggggcgaggaggggtaaaaggggaagcaggttccgctgggcgcgcggacctgcaggctccttgctgggcaccgccacccgcgagctggacccacaggggtaccgggccccgcggccgccctccggccgctttctggctccggttcccgtccctgcgtttcccgcgggagcggggggcggggtgcggagggcagcaaggcccgcgcggtacccagcggggccgccctgcatggccctgcgcagtggggcgggctgcttcggccgggtctggcgcagggtgtcggggttcccggacgcctggccccggcgctcgagcagcctcctgtgcctgtccgccttctcggctgagcccgggcccgcgccgcccctgccccgccagccgcctcgcggtggcggtggctgtggcggccccagcggagggggccccccccagcctccccgccccccgcctccccgctgctgctgctgctgctgccgccgccgcttacaacttggaggcggcggcggcggcggcggaggaggaggcggcggcggccgccgggcgctgcagtgggacgcgcgcggctgtgagcctgcgggacatgccccccgcgccggctccttgctggcggccatgaagaggcagaacgtgcggactctgtccctcatcgtctgcaccttcacctacctgctggtgggcgccgccgtgttcgacgccctcgagtcggaccacgagatgcgcgaggaggagaaactcaaagccgaggagatccggatcaaggggaagtacaacatcagcagcgaggactaccggcagctggagctggtgatcctgcagtcggaaccgcaccgcgccggcgtccagtggaaattcgccggctccttctactttgcgatcacggtcatcaccaccataggtaagggctgggcgcgccgctgggctcccgcgccccgggaggagtccggggaggcggctgagcgcgccgcgccgggctgggtgcagggcgtcgagggttaaacgcagcctcccttgggggccttcccgcagcgccccctcctctctagggagccccccctccgcggcgcctccgagcctcacccttcggggaccccacccggtgctctccaccgcgctggtgtctgggccgggcgtgcgagccccgagcgagtgtgcctgagccgggagggcggaggcgccacttttgcgaagagagtggagcgctaagaataatcccatagcagacacccacccacccaccgccccggcgcgggctgggctgcgcgg

SEQ ID NO: 5699 - DNA, 3675 bp, Homo sapiens; identical to SEQ ID NO: 5698

SEQ ID NO: 5700 - DNA, 3378 bp, Homo sapiens
cgggccgggccggcgaggggggctccggccgagacgcgaggcgcgtcacgggacccggcggcgggagcggacggcgagcgagcgagcgagcgggcgggcgggcgggcgggagggaggtggcggccggggctgcccaagatggggccggagccgcgggccaggcgcggaggagacggaaggggcgggcagggccgcgcgggcgcggtgcgggcgccctctcccggcagtcagcggcagcgcgccggccctccgccttccgccactgcggccccgcgccggccgcctgggcctggagccccgcggcgtccccggaggacgggctccgcgccccacgacccactcccggaggcggggtcgggccgaccgggggcggaggacgccgcaggaggctgctcggaccccgggcgcttgctaggccctccctggggcccttcatgccaggccccgcggctgtgtccgcaagcgcagatggtctcgggactcgggccaccctgacgccgcagacccagcacgctgcggaccgggcacgttggatctcgggacaagtgcggagggtcgggggctggaagggatccgagagcagagcccgcgtccccatttcacggacgcggccaccgaggtccgagaggggccggagcctgcgggagagggaagggcctccgagggctccacaacttggctgcgccccctccctagcccgggatccggatgagtgctgcctgaggccgaggcgacgaatcgccctctatccgcccctgcgcgggaccccggcaggaacaagcgcccgtccctgggatcggaggcggcaaaccccaggctcgagccccccagcgcagcgcccacccgcggagccgcgcgcctctctggcgcatccctgggcttcgcggctcggccctcagccgccgggtctcccgggccagccttctgccccccagatcgaggcgcaacaagtctgaaagcagcgccaaggagcagctagcgagccgaagggagggcgtggggcgccgggcgctccgggatccccgaacgcgcgcaacgtccgcctccggggaccgggcgcgggcggcaggcgagcgggactgactcggcgggctgcgcacacccccttccaaggccccgactgtgcgcggacgggggcgcgcccaggaacccccgccccctccttcgcctgcttgaccttgctgggtactcaaagccggactcggcggcaccccggcgtgcgggcgcagagtttcgctgccgcccacgggagggagcggctcgacctccctcgttgcctcctcggcagccggggtcgcagacgagtggaaggcatgagggttctaggagacgtgacagtcgcctccccagaccccacacaccgtataccacctccctcccagatagaaaagggacccagctcccctttcccccgcctccgcccgcgcggcctctgctgttcccccgcggcggctctcgctccgagggggcgtgtgtttgtgtctgtggggagagtaccgagggtctccgtgggttcccaggatggagcgggagagcagacctcccagctccctccccaacacaaacgacaagcggctcctctggggcgggagtgcaggccccctacccgcccacacgccttcctgcctttcaactactccggagttgcagcccaggaatctgcgccccagacccggaggaagaacggggaggtcgcggcggggacgggtgctgaaagagggctggcttagggctcttcgggtcccagcctaggcgcctgcgctccaagaaacttagaagcccaaaataaaagtggaaaggggtaaggtgcccagcggcctggggctggggtgccagattaggcgttctcttcaggctgccggggagtggccaagcaggagccgccgcggccaggaggagggacgcgggctcggagccgcagcctccgtcaagccctcccggtcgcatcgcttcgcggtgattctcagctccgccgccccctcccgaggccggaggagctctctacctcgcccagggggccgcggggacctagggagagggctcctggccgggtccagagctcccagcctccccaggagggggcgggggccgtgctcgttcctcgaggcagctccgcgcggctccaagctagcgcggcgacggtggagggccggcggcctctgctcaccggcgacgcggacccgggagtgctcggcgcccgggagtgctcggcgcttggagcggagacggcatagggccggcccaaagttgagagcggcttatccgcgcggcctgtccgacccagtggaaaggtagacaaggagggaagagccaggcgttcgcgtgggggtggggggcgcaaaaatagccctccgcccgaagtgggggagagtacctccagggagtctccactgccaatgccaggtctacaggcgagggcttctacgagcgagggcttcgagaaggagtctggggttttctcctgcctgccccgagctctgtgcgtggggggaggacgtctcgggcccttacaatgtctgtagggggccctggacgtgattagcaggagggggacacgctcgggggctctccggagcctgctgcgtctatgtgtggctgttgggggccatggggggctcccttagacccccgccagcgtctgtgtgtgctgggggtacagcgggaacgccctccccagcctgccctgtgcatgtgatgaagaggggtgccaggctgtggtgtgtggatggggaggaggcggcggcgccgaggagcctctcctgcgtccagggtcgccccctcctcagcctgcccaatgcgggctcgcggggacctgccacattccatcgccaccgctggagaaggcagggggctgagggggtagggggtgggggtccaaactcctgagctctgagcgcaaaacctcggagctgcgaagccccaaacggcgaagttaggaagtctgggcgcccgcccctcccccgaccccctcccaccctcgctgcgcccccacccgccgcgcccccagccccccgccggagccttccttaccttccccagcagcagcggccccgccggcgaggactcgatccggcgagttgcaaatccccgcgagcgcctcgcgtcgccggcggctgagccgggcgcccgaccggaggtggggggggctcctccagccgccgccgcccccggcccgctctgggcctcgccgggacgccccctggagagcacccgccggcgcacgcaggccccctcccgttcccccgcgcctgctggagccccccgggcgcccggagggtccggatgcccgcgctgcggacgatgctggcgcgcgggcccgggccgggccaggacgcggcgcggccgcctgtgctcccggctctccggctccgcgctcgc

SEQ ID NO: 5701 - DNA, 1108 bp, Homo sapiens
cgggggtcccgactcctcccaggcccgtctccaactccacactgccacccgctcggcgcccacccaccctctccagaggcgcatggaccccgccggccgggccaggccacggcggctgcgggccacagcgacccctccgggacaggacgggtgcgggccctccccacccgcaggcccgccggcagcccccgcccgcgcccctgcccggcgcccctcccgccggcccggccggggtctcaccgcgtcggcgctgagctgggctaagatggcgaaggtggagagccggtcacagaggcagcgcgtccggagggcgtcgaggggcaccgtgcggcagccgcgccacgaccagggcccgagctgcgggggggcggaggaggagggtctgggggcgggcgggacacgggagggagacaggcggagcgtcagcggcggcggggacgcgggcgccccggcccccgagcggcggctccgcgccccggccccggccccggcccgccgccccgcacctgcgcccgcagccgcgcgcccgtccgcccgccgccgccaggccccgcggcccgggcgcccatgccgcgctctgcgcccgccgccgccgccgccgagagccgcggagcgcagcccgagggagcgccgggcgggggagccgagcgatcgggggcggggcggggggcgagagctggcccggggcccggcagtcgcccgccccgcgcccccgccgcccccagctcctccggggcccgcgcccccggcccgcgcgggaaggagggggaggcccggaggggcgcgtgggcgcacgtggagcggggagggtgcgagccgggtgtggcctgggggcgcggggcgggttcggagcgcggcgagggtccgctccggagctctccggccccgcggcccagggcgccggctggagctgacgaccttgggaccgctccatcccccacatccacctcccccgggcctcatcacccctggtgcctgcggctcatctcctgggacagacacagccttccccgcggggaggcttgccgctggaaacttccctctgcggtctgacccagccgcccgctgtctacgggccgcgactgccccgcttttcatctgagcacgc

SEQ ID NO: 5702 - DNA, 1700 bp, Homo sapiens
cgaacatccacacgcacacacacactcgggagcgcacggacgagctgccttctccaaggccactcaaacgtcccaaccactctcgggcgcgcaagtccaagcgcgggagccaggacttaccgccaagacgctctgggcgaggaaccccacggtcactgtccccagcagcagccacctgcatgggaaagggaggaagagagacgtgaacgtgcgggcccggcttgtcagtccccgagagttacaccgaagggtccatgcgcgcgtgacccacggggaccaggcagaaagtcgcttaccgccgtagggcagggccggccaccgcgcgctggtctctccccatgctggcggttcgtccactctgggccccggtcagtcccacttagcctagaggcgacagacaaagcgagtttagcgcaggatgagggaggcagcccatcctcaccgccggtctcggtccgcgagacgcggggacagcgcggtgcgcggcccgcatgcaggggtgaccggagggccgtcccccccacgacccggaaagaaggagagcctcccgttaggcccctgtgggtgctccttggccgaggagctcggtcttcgctctcccaccctccccctttctactcccaagcaggagagcgtgcagccctagcctgcacaaggcgctccaagtcggtgctctcgggccagggtctgggcgccgctcgggggtcgctctcacctcgggctcggcttcaggggctgctgcccgaacgcattggcccttccagaagcacccgccggcggcacaccggcagggcggccggccttgctgggctctctgggcgccggccccgggggctcgggcggcccctttcggtcctcggcctggatccgcgaacgcgcgggcgcgaggggttgggacgcgggagcctcttgagtgcggagcgcggagccctggtgtcccggcgcactgcagccacactcccgggccgcgcgctcccgccgcctcttacccgcgccgcagggtcctcccctttgaggcgccgcccgcgcaccgccgggggggagggggcagcgccaacaaattggggagctcggcccgccgcgctcaggtctccgcttggagccgccgcacccgggacggtgcgtagcgctggaagtccggccttccgagagctagctgtccgccgcggcccccgcacgccgggcagccgtccctcgccgcctcgggcgcgccaccatggggccccggctcagcgtctggctgctgctgctgcccgccgcccttctgctccacgaggagcacagccgggccgctgcgaaggtgagttcccggccagctccgctcccggcgtcccgccccgagcttgggcgccccgagaggcccctttgtccgcgcctggacccgtccgcctgcccctcgggggtcgcgcgtggcacggccaggtgcattctctgggccggggttcgttgggggtccctgtaggctacgatcgcgcattggtggaccgagcctcctttgttatggtatgggtactggagagttaaggaattcctccggggaagggaggagaaacagcccgcgctgtggcggggtgagggtgcctgggagccggcgggatttgaacccgcgtcgcgggtatgctcggcagctgggcgccttcacccgtcccgggtgcgcgagggagttgggggctggagggccgggagcgcccaccccgcgc

SEQ ID NO: 5703 - DNA, 692 bp, Homo sapiens
cgacccgcgaccgcacatcctgcagagacccggcctcgcccctgcatccttcgtagatcccgccctgtgaccacacccctcgcccttcataggcactggcccgcggccgtgcacgccccgcttttattggctccgctccgtgaccacgcccccgcaaccttgatagactccacccccgaggacccttctcaggagcacagtgaccccgcctccacagggtccgctccgccacactgacccttccgtgtcgctcgcgggaccccacccctgtccgcctgctccggtgcccatggggaagcctggtgccaggggtcaccagtcagtccaattcaccgcccgactggtgggacaaggacaggtcagcgggtcacaggccggaagtgagactcgcccggccgctctgggacgcgggaagaccgaggcctcggtggttcccctctctcccgcctggctccctcaggagaaggagcggctaaggtaggacccgacaccgcggtcgtacccgccttcttttctgtcccagagtacagcctgggatctccaggggggagactgaatgagtgctgtcgaggaccggcgagagtctggaacgttcgcgccttcgtaggagaacgaggaggtgacggacagggaacggggagcggccgttgggtgggacgcctgagaccctcgggaaatggccgggtcgccga

SEQ ID NO: 5704 - DNA, 1924 bp, Homo sapiens
cggcggagtaaattgaacgttattctccgatcaaacaggagcttcgggtccacctgtttggaagctcccaggcggcttggaggggtccggccttcgggcgcgacccgcaggggttgccttgcccggctcgcggaacggacgtttacccgtcgcagccacgaacccaccaacgacaccaagcactggccgggcagaccaggcgtcgtggaggcgccccagccccccagccccccgcaacgacgcgtcccaggggtgcgcagtgcttggcgcggtgaccggacccggccgccttcccgaccgcgcagagcgagaggccacaccctggatcccaggccgggtccctgcggttctgggagggaggtcccggacgcctcccagatctcgggcttctgtaaccccgaggccgggttttaaaatcacggctcttccgagttacacggagagtccgtggtcaagggtcaagggcggccttcgaccctcgggatcgtcttcttgagaaatggctgagagctaagcctagagctgcgcagggaagggagccaaagagctggcgccgagcgcgaagggccgggaggcgcggggaggccccttacccgccccactgtcctgcccgccaatgacgccgatgacagcgacagcgtcggccgagtgcttcccctgctccgggtcgtccaggcaccgggtcctccttcagcactcgcagcacgcactgaagaagacgctacggaagtctccgttttccagactcgggggaattaggaaacgcgcccggcgaccctcgggcagtagcaccgggccaggtttgctttcggaaccgctgacgccactcgccgcctttcccgcctgggcctctcgcgggtcgcaggggtggaagcccgacctgggccagggcccggatttcttcctcccggcctctgcgccgccgcccccggtgccaggacgcgctttgctctcgccgagacccagacgcgccgaaagcctcgcgcgggcagttccccgccccacgccccgggctgcgcgttctcccgcgaagcctctgccgagtgcgcgcgacggcgccgccggactcccccggaccgcgctcccgcgcacgcctgaccggagcaccccgcttcacgggggcgttctgcgcgtccttcctccccggtgcgatttccgttctttttcctctcgcggtccccaggagcccaggcacccctcgacgccgctgccggcggaaccgggaaccctccccggggctccctgcgggcccgaagccgccttcccgaggcggcggagttgggcagctccgggccccgcgccgccccgcgccgccccgcggagccggagtttctctccggagtctggacacagctctccgcttcgtcgccgcgcactggaccccggtagcgtggagcctgcccgggaagctgggctgcgccggcctggggcgaaggtccaaggggcgcgggggccgggacgcggggctgtggcgacgaccggccctctgcgaacgctcaggccggcgggtccggggccacaggctgggagtggagctggcggccactggggagtagagaggacgcccaggaacaggtgcaccagggtcccggcggctgggccgagggtcgcaagcagaggggaccggcggctgccagcaagtcccaagcagatgcctccggcggggcagccgcattttacagcgcccattccgcgtacatcgagtatccaaaacgagtaaaatcggtttatacgttggaatgtagcttatgattccaaaatctcatctccaggctgcctagatcacacggccccgtttcattcatttttactgaataacggtcgttggacaatttagagaagcagcagaaaccacgagaaaaacagtggagtcaaacggcggtaaggaccgacaaggctggcggggacattgagcaaacggcgg

SEQ ID NO: 5705 - DNA, 1991 bp, Homo sapiens
cgctcagcctccatccacggagggcgaagacaaaaagcgccccaggcgcgcagggaaaccgcgcaacgctgtgtccattgcagcgacttttccagaaaaacaaacaaggctttccgacaggttacccgcgtaagcagcagccggccgagcctccctttcccgctaacctagcagccagcgctgccgccctccaagatcctttctaatttaagtgcaactcagcaaggagggagagtcagagattctggggacgctcgaggaaatcgaaccccgaaaccctctgctcccaaggcgcggtcggagatttttgggaccccaaagcggagagaattccttaattctctgctagaagagcggggctagagatccctgggattcccttggagtcgaaccctcccctctagcctcacctcggagggcgggagcgaagatcctgaagactcctctagcgcaataaaccctcccaattctgttggaacgcgggctctgggatcgcggggaagcccagaggggcgaaccccggaattccctgccctgagagcgggatcagggatctcagggacccgggagcagagggaacccccgcaactccgccgaaacacagggtgagagatcgtggggaaccccgagccgagcgaagcccgcaactctgcccggcgggcgggatcagacgcgtctccggcgctcccagaccggcgatgtagcgtggccgggagcccaggaccccaagcgccgccgctgtcggcaagtaccgccgcatctctccacaacccaggacccgcatggcaacggccatgctggggggacttcattcaagaaactcgggccccgccgggagcggtggcccacgcctgtaatcccagcactttgggaggccgaggcgggtggatcacctgaggtcaggagctcgagaccggcctgaccaatatggtgaaacccccgtctctactaaaaatacaaaaattagccgggcatggtggtgtgcgcctgtagtcccagctacttgggaggctgaggcaggagaattgcttgaacccgggaagcggaggttgcagtgagccaagatcgcgccactacactgcagcctgggcaaccgagcgagactccatctaaaaaaaaaaaaaaaaaaaaaaactaaggctgaacccgggctcccgcacgcccgcacccacctgcgcggccatcacgcgctgcctctcggcgatcaggttgcacttcttgcactggcagtcgcgccacatgcagaagcgcttgtggcccttgagcggcgaggcgtagccgtggttcctgcagcgtgcgcacttgggcagccgcggggacttcttgctcccggcacccaggtccgacgccccggagccggagccgcctcctctgctgctgcccccggcgctcgagccgctggccgcccccactagcgccccagacgctttgccaaagcccccggctctgccctgcggcggtaccccgggggcgtgaggggcttccgacggtgtagagggcttgctgaatgcctcgtcgttgggcatggtgcccctaggagaagtgcgagcactctggccccctctctcgcctggagactgctgcgagggatgaacccgacggacagcgacgctccggaggaggaggcgcaggagacgtgtgcgctgcagccggaggcgcagctggagtggcgaggtctgggcacgccacgcccggagtggtggggggttgtgccttttcttttggcgcgcgcgcgactcagaactttcggatacttttcagaacattcccgggactgcctgggagggagcgtggccacgcccaccgccccccgactccagccaccgctctccagctgcttgcaaacttgcaccggctgcaagcatccagggctttgctgcagggtccctgcaagcgcaccgagagatacagagcggcctgggaatcgcgtggcacccctcgccccgctctcggaggcgccaagacccggttgccaaagcacggtgcaccga

SEQ ID NO: 5706 - DNA, 1667 bp, Homo sapiens
cgaccccaccgtagtgagtgtgcgcacgtgggttttaattttgtcctgtctcaactccgttgtctccctgctcaatctgacacgttccgaacccttcaacctgggaaggcacctggcgatactgacgcacagtcccgtcgtttggctgcccggaggcgccttccctgcgggcgcgagtgccactcgcgctgggtccagactcagccggcttctcccgggagaggaagccccggcctggcggagagtaggaaggaaagccccgacaggcccacgtcccaaaactttgcctccagtcctcccaagtggagctgcagctggcactccgaagttgcccccgcgcccggccaaactcccgcacctcagacgctcttacctggcttggcgagctgcgcctgcagagccccgggctgcggctcggcagtccaacgcagcgcggcggccgcggccaactcggcagcagggcgcggcggctgcggctgcgacggctgagaggctggcggcggctgcggggcggcgacggcgtcccccggcggcgggggccctggcagagcgcgcagcgagtcggggatgaggctctccaagctctcgttggcctgctgccggcgcagcgccacctgcgcagccatgacccgctgccgctcgatgatgaggatgcacttctcgcaggtgcagtccttgaagcggcagtaacgcttgtggcccttgagccaggacaggacgccatggttgcggcagcgcgcgcacttgggcgtgcgctgcaggggcgcccgtggcggctgcgacaccgggccgcccatgtacaggtagggggagccgtagccgttcatgccccgggctcccgaatgagttggcagcctggctgcgggagagggccagggagcgctggacggcggggctgcgaggcccgctcaggggcggcctccgggcgacgcggcccttggtcccgcagccccggtggtcgtgtgtgctccggggcggccggaggtgccgcagtcgtctctccagctcccttcgcgctcacagctcggcctcccagctcacgcccagccaacgccgacgcgggcctctgccttgggcgcgcagccgggtcggcacgtcctccttcgcggaggcgctgcggcggctgcaaggagccggcgacagctctgattaaggtctgagccagctcttctgcagctccctcgtgagccggccggacccaacacctccgccgccctcccccaacccctcctccttcccaccgccacccccgcccctggggtccctgtctccttgcactccccgccccacgccttcctcctcctttgcgcccctcgggtgcctgcacttcaccttccttgccacctgcagccaggccactctcgcgggggcgctcgcggccccctcctccaagccctctccgctaccccagcccgcggctggagactgcggcgctccagaacgcggcggtgctcgcggggcggagaaggggaggaccagcgggagtgagggtgggggtgcctgtaagcgagtgaggtggccgctccgcttctctctcttctcctccctccagtccagatctggccgcgtttttccgagcccaaggccgcttttatcccgacatttggccgcagaagctcagctccgggagaactcgaacctacgggagtgttgcggttgcaccccgg

SEQ ID NO: 5707 - DNA, 433 bp, Homo sapiens
cggtcttctgcagcctcgggcgcctcaccttgctgaggccgctttcggcttcctctgacccaggctgggcgggaaaggtcgggccgcccccgcctggctcagatcgctggctcacccggcgggcgcgcgcagttgcattcagcgcagcgccactggcttcagtctgcagactgcgctccccttcctagtactgtccgctcaggccccggagctttacgtcctctgattggccggttgtcaggcggtgtgaatactgattggccgaggcacgctggcagggagccctccgcctcccgcggtctacactcttctctctgaagcgctccgccagagtccgcctaccgggccttcggtgcagccggctcgcctgtccagaatctaaacccgaggtatgacggtgcctgcaagagagaagtcaccatttatctcgcgg

SEQ ID NO: 5708 - DNA, 896 bp, Homo sapiens
cggctccacaccctggcgggcggcgtacggagcgtcccggcccccggcaccagccagcgtcggagtgggtaggactggagatggcagcctccggtccaggggaagcgggactccacggaagggctgggaagagggtaggaagagggggcgggggcgggaactgttccgccccctccccctctgtctactttcattggccaagggcttcctggccccaacccacctcccgcctccagggcgccgcttaaagtgtgcggagcaggtgccttgggtggagccacaactttgcgcgagtgtcttggttgagcgcagcgcccattcattgcccgcgagcgtccatccatctgtccggccgactgtccagcgaaaggggctccaggccgggcgcagccgccacccgggggaccgaggccaggagaggggccaagagcgcggctgacccttgcgggccggggcaggggacggtggccgcggccatgcagtcctgtgccagggcgtgggggctgcgcctgggccgcggggtcgggggcggccgccgcctggctgggggatcggggccgtgctgggcgccgcggagccgggacagcagcagtggcggcggggacagcgccgcggctggggcctcgcgcctcctggagcgccttctgcccagacacgacgacttcgctcggaggcacatcggccctggggacaaagaccagagagagatgctgcagaccttggggctggcggtaaggacctccacccggccctccgcggcctcccctccgccctgcccgggctctgcctgcgcggcctcccggctcctaccctgagctctgctgcgctccgcgtggtccccgcaccctgggtcccgggccgtggcgtggaagcaaattcgtgcctttggtcctcgt

SEQ ID NO: 5709 - DNA, 1494 bp, Homo sapiens
cgagcggcccaggagcgagtttaaaaccccgcacaggcctgctcggccgcgtcccctgattggccaaggcgcgcccgccgccccgccggtcgcaggcgtcacggcagccccagcagcctgggccccgccaccgcctccgcggcagccccggtcggcgcaagtgcggcgcgcgctgggggagggggcgcggcggagcgctaggctggcgtcgggccaccgcgggattaagtttctcagtcacgcgtgagtgtctgtgcgttttgatccgaagctcctcgccgggtcgttacttcagaagagaagacagtgagcgtgggcgaggcgaggcatccagaggccccggcgacccctgctccccagtcctccgccccctcgcgtcgcggccctgggcgggcgccgcgagccgggtaagcggcgcttgagccccggcccagaggccgaggcgcgcccccgcgccctgcgcgcgcgccggcggggaaggtgcgcgggcgccctgggctcggcgcttgggggtgggggtgggggcggggatgggggtgggggtgggggtgggggtaggggtggcggcgggccgtggggcggtggggcggtgcgcttgccccaccccgcgcggcccggcgcttcgcggaagccgctgctgtggcttttttaaaaggatggggtctagaagtttcctttgctactcgcaagtctccactccccccagccccgcggtggataatcctagacctttcagcacccccgccacccctttcttttgctctcgctgactaagaggtttaaaagtttttccttttccttgacccagaggggcacagtcttggtgtcggggggctgggggtggggtgttagcctgggggcccggagcgcagaccaggcctccagggcgcgggagcctgttgctctcccctgcaggggccgctcccggacgccccatccgccgttacgtggtcccgggatgtgcgggttgcggtagagagtgggcagcaatgctcctggtcctgcgttctcgccttagccgcggggaccccgaggcgagccgctaattggtaccggtgccccgtccctcacccctggcaccggcgcccttttaaccgccgctcccgttggtgggagcacgttggtcttgtctctcccttagtctcctcaccccccgcgctgatgggcgtctttgtctgcgatttggcagccccaggatgccggatgttaccagggaagcgatgtttgggagacgctttgtgtcttgcggagttgcgcgtttgttgggtggtgatggtgtacatttttgtttgcgttctttgcagaggcacaaaggctgggctattcttgcctgcagtcacatggaaatcaagcggagactgcgggggaggagaagtggccaggcgccggcgggaggtagaggccgctccgtagtcactgggggcgagtgggggcccctggagacctctactgcgcggtgcggcttttgaggtgctccgcttgggaagaccccgg

SEQ ID NO: 5710 - DNA, 828 bp, Homo sapiens
cggaggccacgagtcatcagcccggacggtgaaacctacccctcccctgcgtcccacgtccggatgggagaatcccagcttcctacggcgcatcggggaacaacttcagagcagcacgcgagcagagcccccagcgctcccacgctcacgctcacgaccctcctcccaaccgcgcggcacaaggaggcacttacgcggagccaacctgacagctcccgccggggtggaaacccgcggtctcctcgcaccggcatttcggacacaggtcccgcgtaggcgcgcagctccggaccccgcttctgcttctgctcctgctcctactcctcctgggcaccaccggacagtgctctgacccgcagcccaaccgccggggtgccgacccgcggggacccacccctttgtccctcctcccgcggcggcggcggcgtcagcccgcccccgacccgagcgtggcgcctccgcgctggccgcccggcccgggaaactgtcaaattggccgctaccacccacgcgcctgccggggaagggctcgccggcgccgcgccttcgaggctcctgcggcgaaccgcgtcacgcgcgactcctggccgggggcgggaggcggcggcggcggcaggagaagcccaaggcccgagcggcccgcagcccccacgcctgcacccctccacccccgccagcccgatggttcgctccgcggcgtgcactggagcaagcaggtcccgctccgagcgcgcgcgctctgggaagtgctgcaagtttggagacctggagtgagctccgggcgctgctggcccgactgtccgcggtgtttccccggtgaggtcgcgg

SEQ ID NO: 5711 - DNA, 2705 bp, Homo sapiens
cggggttgttcgtctatttaaataccttccgttccagcaaaggctgagactcgccagctctgcccggcctgaccagggcgccctctccccgtcgggtggtttgggcggttccgggcccggcgtctctcaccccgctggtctccccacgcccgccgggtcccctaggagtgcactagcaccgagtgcaaggagccgcccttgctttcggccgaggtaggggctgtgggctccagcagagaggcaacgggcgaggccgcggccgcggagcacacggtggatggcgccggaggctgctgcgaagccgcggggacagtgagccccggctgcagcgcggacacgggcggcagcgcaggcgtgggcttgatgggcaccggcatggcaggcaggctctggcttgccgagtggcacagggacttgaccgggaccccgaaggccccatactccgggcctacagggactccggctgcggctgcggcggccgcggcggcggccaccgaatccatgacgccaacgtgcggccacacggagctgacgacgttgccaagctggccgggcacggggtagcccaggtggtgcatgacggacgccaagggcagccctccagcctgcagcacgcccttgtagtcccggccaataatgttctcaatggcaaaggggtgcttgaagcctgacgtggacgccgcggccgcggcggcagcggcggcggccgagcccagcccgtagggtgggaactgagacaggcgtcccacgctgcccaccgcggctgccgcggccgccgccgccgccgccgccacggccgccgcctcctgcatcttgccggggtgagacggctgctgaggctgcgactgctggggcggttgctgcgggggctgtgacgggaggtgcggaggcggctgcggagcagtaggcggttgctgatggaaatagtgtaccatgtgcggcggcggcgggggcggcggcggcggcggctggggtgggtggtggtgatggtggtggtgtgcggcagcgtggtgatgatggtggtggtgggggtggtggtggtgatgggggtgaaggtgccctcccggaccggcgcccggcgcgctcttggtgcttcccgcgtgcaagtgagtatggtcggcgcgcagcaccttgaagcgcttgcgacgccgcaggaagctgccgttctcgaacatgtccccgcagtcggggtgcagcgcccagaagctacccttgccaggctggtcgggcctccgcggaatcttgatgaagcagtcgttgaaggagaggttgtggcgcaggctgttctgccagcgctgtgtgtgctcgcggtagtaggggaagcgctccatgatgaacttgtagatgtcgctcagcggcagcatcttctcggccgagtgctggattgccatggcggtcagcgagatgtaagagtagggcggtttttggtcgctgtacgagctcttccccggccgcggcatcgcccccggctcctccaccgccctccggcccgcactggaccacagaatctctccgcactccgttcctggggcctggctgcccccactaattcccactcggcccctccagtcccgccactttgccctctcgccctccaggccctctctgcttctctctcctgccttctccgaattgcctggtgtctccgaccttggcctttcgggcctactcagctctcggaagctggcaacttctggccccgacggttgccgactggcgcgcacagtcgcgggcggagtgcaccaggtttaccgccgccttctctgcgtcttcccccgggtggccaaagactgagtgctggagctggctgcagaggagagtggcaaggggccgtgtttcctcccggcctctttgctttttctaggtccgagggaaacccagaccaagatggctgggaggaaggtctgggcagtagagactctggccctttaaatctgagtttgcgcctgctgtcctggaggccagtgacagcaggacttccagtgccctggacgcaggcccctggccaggcacttagccagaccgcgctggagttctccttttcctggagtgaaaaatcagggtaaggagagagaagattggcttctagggcgcctctcttttctccgaggctcgcagcgtcgccggggttagaagagacgcgcagccctaggctgtcgctgaggagaaaaaactttggtggtttctgaagcggcagcgcccgcaggttctgctgaggagtgtggggcgcaggactctgggagcgagcggcgggctggagagggcgtctgcgaatgctgggtgagtgctggccggggaggctcagccgtccgcgccgcagctgccgcctttctcccgggcttgtcttgaggaggagaggcgacggcagtggcagcgacgcgctctcctggctgcgttttgtaatggtccccgagacgccgagacccccgcagctagcgcttcgagactatcacatgaccgaggctgagggactcagccgccgccgccgcgtctgtagctgaagaaggggcaagaaggcgccgtgcctcgcccccgcccccttttccacctcgtttcgggcgctctccacccatcgcgttcaccactcgctcggcagcccccagccacctcccggtgcggcgggtggcgcaggctgttcgccgggagggggcacagctccgggtgcatttcccgcagctgcgccccacccgggccaccaagcacgg

SEQ ID NO: 5712 - DNA, 704 bp, Homo sapiens
cggtaggggtcgtggaagggcagcgccagccaggcgccatgcagctcgcgcatgaagtccagcatctcctgggagctgccgtcggctgacacgaagaccacttcgaagggcgcgggccgccgcgcctcggccaccagcgccgtatagaagtcgcagagcagcggcgtgaagtcgcggctcggcgcgcaccgggccgccgcgaagtacagtgccaccaccttgttctgcagcgccgcctcggcctccaccgtcgcgcccttacaggtcaccaggtgccgctcgcccagaatgtcaaccatggcgcagacacgcagccacctgagacccgaggacacctgcaggaggatgatcacctgcggggaggcggcggcgagcgccgcggtgccccgcctctgtccgcaccaccgggcgctggacctctcaagacctgccccagatgcgcccacaccttggccaggcctcgcctgtggctggagcaattgtgttcgcgccgacaatgagacactcagacaccagagaccccagatacctgggcgacagcgcggcacccgcctctgggagcggggccagccaggcaacctcaagccctcaggtctctgcaccctcccccaactgcgccccgcccacactcctgcgccctcccaccactgcgccccgcccacattccccgcaagctccccaactgcgccccgcccacattccgc

SEQ ID NO: 5713 - DNA, 950 bp, Homo sapiens
cgtgcaaccccaagcagcggtctcccgggccggggctgcgcggccgccgctgtgctggcttttaacggtgggagggcaccatcctcttgctctgctctcgttctccagaaggctgtcccggggcccccactctccgtcccgctccggggacagtggctcgcctgctatgcgcggcagcccgcgccggggccggcaccagcagcgcccgggcggatgcagcgagcccacggaggggcatgcttccacgcaccaagtataaccgcttcaggaatgactcggtgacatcggtcgatgaccttctccacagcctgtcggtgagcggcggcggaggcaaggtttcggcggcgcgcgcgaccccggcggcggctccctacttggtgtccggcgaggcgctgcgcaaggcgcccgacgatgggcccggcagcctgggccacctgctccacaaggtgtcccacctgaaactctccagctcgggcctccgcggcctgtcgtcggccgcccgggagcgggcgggcgcgcggctctcgggcagctgcagcgcgcccagcctggccgccccggacggcagtgcgccctcggcgccccgcgccccggccatgagcgccgccaggaagggccggcccggcgacgagccgctgcccaggccccctcggggggcgccgcacgccagcgaccaggtgctggggcccggagtcacctacgtggtcaaggtgggtgcgggcgcgggccgccctgggggctgggggttctggggccagttcggggcagactccttcattccctgaagcccggggtgcggggcgctcccgcgactgtcacgttagaggcaagcaaatgcgcactccttagcaatcagctcgcttgacagcggtgaggagggaactacaaatgcgcttttcccgcatccattgggaaaaggtttaccactcgggtggcccgctccgtcccgg

SEQ ID NO: 5714 - DNA, 4861 bp, Homo sapiens
cgcggcctttgcccctcctcctcccgacctttccggggctacctaaaagccgatcaagccgccggttttctagctgttcccatttctttaccgcccccttcctctgccccgcctgcctctgtgccctccgtcacgtcacagcccgctggctctcacgcctcttttggtctctctgcgcacatctcggtggcgtctctggtgccctcacatcactgtctggaatcttgtttggcccacgccgtctgcctctgccccttctctcacctgtgtcgtttgatccctccgactctcgtctctgggggtcttgcctcccgaactctccggctctctccttccagggcgtgcgctccgctcagtctccctcggtctcggtcggccggcctctttcacgtggccccctcctttttggcctcccttccgcctccctcccttctgggtccctccctccggctcagcctaggggttgggggcggcggcgcggggcggggcggggcggggcggtgacgcggggctggccgggcaagaggcgcggcggcgtggggagggggcgcagtcccgggttcgaccggccgagccccgcgcgccccgcccgcgccctgcgcctccgcccggccggccggcgggggagggggcatgagccggcgcccgcgcgccgccccgagctgcgggccggcctagagccccgcgcgggccccgcgccggagccaagccgtcgccgccgccgccgccaaaccgcgggcgcagcagtgggcgccgcgatgcagcggccgggggagccgggcgccgcgcgcttcggcccgcccgagggctgcgcggaccaccggccgcaccgctatcgcagcttcatgattgaggagatcctcacggagccacccgggcccaagggcgccgcgcccgcagccgccgctgccgcggcgggcgagctgctgaagttcggcgtgcaggcgctgctggcggcgcggcccttccacagccacctgggtacgtgtggcggccgcggggtcgcgggccgggcttggcgggagacagcgagctgaaccgcgggggcgccccgagcctcctccggcatcgaagcagccccgggaagctgctctgggagcgcaggttctgggaccgtctctcggagccctccaggcgggaggcggagggtgcaagctccaggcctcacagaaaccaggcctcgtgcccgcgggccgcccggggagggtgttcgctctttccttcactgcttcccttcggcctccagcccggggaccccgagtgagcatccccagtgcaggcgcactgccaggctacggactctcgtgggtggaagcgacctcaggccacgggcgcctgggcttcgccgcagagggatggccgggagtggccgcggctgcccaacccagggaagtcggacctctggggaggaggcctgcgctcccgagggctgggtgctgacgcgggcccaagccggcccggagtccccgggagctccagcgggcgaggaacgcggccttggccgcagtgcggacctgcttcggccttgccttggggccagaggcctgactgtgagcagctgcctggctgtcccttctggtttcaggtcggctgggcctctgcagggcttgaacggcctgcgcagaccttttcagcttctgccctttcttctaatttggcggggcctgctctgccctgatggtgctgtctccatcgcactccaccctcgtcttgtctttccctatctcgctttccaaccgtctgccggtcggcctccctcgcttctctcattggggtcggcctgcctcccatctcccaccttttccctacgggtcctctgccccacatttacctgcgccttgccctgccctttccgactccagccaggctaggactcgcacctcagtgacaggcctgtcggggaagggaggctcctacgctgtagccgggaccccagcccttcaagtcgccttccctgcacccccccacctcctagtcggtgctccctagcctggagacggcagggccagcgcgctccttctaagtccagctgggactcggccattcggctacctttcgtctccatctgctctgttgctactaattcgtttgaagcgggcacacaatcattttaggactgaagaaaatggaaacatctgcatggggaagcgtctgaaaatagaaaacgtgaacaataatttccaggttctcagggtactttggaatttccgggaagcacccaactccggcccagatgactcctggccaccgcatggctgttgtgccacgcacggaagagcaaatgtgcacgctccgtgcatgttctttttctaacgcagcaaggctgatttggttggagcaaacgccatcttcttaggaccagctgccgttttctttttggtttctactttccccgaaagacaagacacactccgagtttctcgcagctgcaaacatgttcatcaggaaccccgagatctcagaggcagctgaggcctggggaactccaggacagaacacggacagggtcgaggagatactccctcccaaatctggggaacggcaacgttgaggagggtctccatctgcgccaccggcgccgaccggcagggcgtggaggttttgcgctgggaggcactggccaagcgcgagcacccccgcggcacgtggtgcggcagtccctggggcagaggagcgcggccgtagctcacccgggtcctcattctctttcttcgcagccgtgctgaaggccgagcaggcggcggtgttcaagttcccactggcgccgctgggctgttcagggctgagctctgcgttgctggcggcagggcccgggctgcccggcgccgcgggtgcgccacacctgccgctcgagttgcagctccgcgggaagctggaggcggcaggccctggggagccaggcaccaaagccaagaaggggcgtcggagccgcactgtgttcaccgagctgcagctgatgggcctggagaaacgcttcgagaagcagaagtacctttccacgccggacaggtagggcggtacaaggctggggccagcgggctgtgggagtgtggtcacttgccttgctgagggtgcgccctgctctttccagaatagatcttgctgagtccctgggcctgagccagttgcaggtgaagacgtggtaccagaatcggaggatgaagtggaagaaaatagtgagtgtgcctggtggcttcccacccctcagcttcctgggccatgccccggtgcatgcagagctgctctcctctttctccccactgagactctgcccaaccccccgattccctcggtgcctggtacgcaccggaatcctctcagttttttctgccccttgggtaagccaacatttcgtcctttcccgcggcaccttcaggcctcctggcagtcttatgctccccaggccgggccgctccccaggcggcatttggacaaatggccgccatttcccgggacatttccccaccatttcctcatatggaccctgcactccttagtcctacctgggttcaagtctcctcgggggtccccagtccacgtgctggctcacccaggtgctggcggtcccccgtgcaggtgctgcagggcggcggcctggagtctcccaccaagcccaaggggcggcccaagaagaactcaattccaacgagcgagcagcttactgagcaggagcgcgccaaggatgcagagaaaccggcggaggtgccgggcgagcccagcgacaggagccgcgaggactgagggcggtatacggtgcggggcctgggatgcccgcgccacccgcagccccctcactcggcggaaacccgcgagccggcccttccgcgtccaagaagtttacttcctaagcctttttattatgatcttgaatgcggacaattggggccaaacgaggaaggacacagacccaaaagccagacccaggtcccagcgcgcttctgggctctaacctgggagactcgcatccagcccggcggaagctacagtctctaccctgagctccgtggcgcagagcgctccacgcgtattcacgccccgctcctcgcctgcacccccaccccgtctggggcctgccctcccggccggggagcctccaggcacacacccgcttctggacgtcggggacccagcggttgggctcaggccacaacggcctgagattgccccggggcaacccgtcggctcggcctggaggccgggtccccgatgtcgctggggcccctaccccctcttgcgaagacggtgactttttttccaataaaatattttatgacacaatcgggctcggtggagcagcttctgaatccgcagggggtgagggtgggggtgggggtgggctcggcaagataagcggaacgcgggcagttgcttcttaaacttcctttcctccggctctgtcgaaggcagctgtgctcttcaccatcaagcccgggctaggcacggcgggcggctcggtggctgcaggatcctaggaatcgcttccactctgggcgtgaggggccagtctgaactccacctcctctcccttgccagccagagagtcgctggcaggagcggtctggccgcaccgcgggtgcccaaaggagcgggagccagaggtccgccgcagagctcgctccggaagtggcccggacagagagccgcctcggttgttgtttcggtttcctgggacttgaaggaccagttcgtgcggtccttgagatggtcttcaccaaccctttatgaggcggatgggaagtcgaggacgcaaggtttggacagagcccccccaccagcgcggtagcccgcccgcgggtccttgcagcagcaatggctccccagagttctcacattttccgcaggatactcagggcggcggcgc

SEQ ID NO: 5715 - DNA, 999 bp, Homo sapiens
cgctgggagccggggcgcgcccctgcctttcgcgtcaggagaaccacctccgcctccggagggagtccgtccccgtgagggccgctcccagccccggctcgccgtctgaagacagcagttccgggaaccgcgacgacagcatcgaactggagatcaggaagttttggtggaaaaggccaaggagtggtgtgcacgcggagcccgggacccgggcggggacagagcgggagcgcgggcgcagcccgttagcgccggcggcagagtctcagccagaggctgcgaggggcccaacaggccgccaaaggtgcttctggccagagatgccacagcgcgcacctaggcaggaggcacaggggacctttcacaggggctgcgggagctggcgcttccccgccctaggccgggagctgagaggggctctagcgcccaggccgactgcgccctgaccgggagccactgcgcccagcgcagcccgagggcgctgagctcggaggatgcggcgcggggcgggggtctcgggagcaacagagactgggatccgagggcccggcccgcgctgctgcccacgcagcgcttccactttggaaagagtgtctcccgcgcggcgggccggcctctccagcgcgcacctggggctgcctctgcagggccacccccgcctccagggaggcccacgctcgccggcgaggaaggatggtgagccctggcccagcgggaaggctggaggaacgcaggctcggaggaaaaagccttttagacctgggccatcaacgaaggtctctatagggactaccaggaccgggacgccgtgggcagaggcgccatgccttctgcgccacctccctggggaccgcgcgttagctcgtggtgcagggccgagccctggggctgtgagcgcgcgtcccgtcttcgtgcgctggtggaaagcggggtgtccgtgcgtgcgtctgcgagcgtgtgtcggctgtaaccgcagggagcgcaaacaggccgttacgc

SEQ ID NO: 5716 - DNA, 1750 bp, Homo sapiens
cgcgcacgcattccagaggccacccagaccatgctccgccgcctgggcgcccaagctgcagtcgccctctgtgtgcaggcagcagctgcctggcaacctccgagcccgctcgcgctcccagcatcgcagaaccagggccaggtgtcccagtggctgcagccaagccaggcattctgcccagcggcggctgcacaggagcagaaccgagaacccgccgctcaaccccacacggggtgactgccgagtgcccatgccagcggccccaatccccctcaggtggaggagtgggcgggaggcacgacctgggggccctcaggctgggcgcgctggcgatcccgaggccgaccaggccatgcacctccagcccgcctgggcacccaagctgcagccgccttctgtgtgcaggcagcagcctccaggcaactctcgagcccgcccgcactccccacatctcagaaccagggccagatgtccctgtggctgcggccaagccaggcggtctgtcctgcagcagctgcacaggggcgggaaccggccctcagccccatccccggtggttgcagagggcccctggctagaggtctcgagctctggcagaggaggagccgggtgggggcagggtctggcgggctctcaggccaggggcactcgcgatccagaggccgcccaggccatgctccaccacctgggcgcccagctacaggcgccaggcaactcccaagctggctggcgcgcccagcctcgcagaaccggggctagatgtcgctgtggctgcggccaagccaggcggtctgcccgcggcggctgcaccggggcaggaaccgaccctcagccccatccccggtggctgcggagagcccctgccagcggccccatctctcttcggaggaggagaggagcgggagtcacggccaggcgggccctcaggcgggaagggatgcgcgcctgcgattccgggatgtcctgcgcgagcccaggagaacccgcaagccagcggcgcctgcgcccgagctgcagccgccctctgccgtccacgcgagctcgagagcggctcccggagtccgggctagcgccgagctgcaggcgcgcgcctaaccgctttgctgggctcacgcggtctgagaggtcggagcgcccaactgctggcacgcgagtaacggcttagttaagctcactcggtctgagaggtcggaggctgcgagtgtcgctgctgaaggctgtggtggaccgggctggatcgcggattctgagctacatcgcggggttgggggtggatcttgggtttgggggtggattgctggtttggtggtggatcttggatttaggggtggatagcggggtggggagggggatcgcggatttggaacttggtcggggtggaaaggccacgaggagccgcggcggctcagtagcgggtggttggcgtctgagaagtcgccaccatgaggaaactcttcagtttcgggagacgcctgggccaggcgctcctgagctccatggaccaagagtacgcgggtcgggggtaccacatcggggactgggaactgcggaagatccacagggtggccatcaagggcgacgccgcggaggtggagcgctgcctgactcgcaggttccgggacttggatgcccgcgacagaaaggacaggtagcgggggctcagcccgcggtgggagggggcccccaggccctgtttgcccgcagcgcctgaggcgggggccttggaggtcgccgggccctggagccgcga

SEQ ID NO: 5717 - DNA, 391 bp, Homo sapiens
cggtgctggagcgaggatgcgcagaccgaggcagggaggcgggggtgcgggaggctccgcggctgcgcgggcgcgtgctggtggcctcggcggaggctcagtcccggcccgcgcccgcggcgcccccgctgcggcccgagcggcctggctgcgggatctgtgcgcacggatggcgcggccgccccggcagcacccgggggtctgggcgtcgctgctcctgctgctactgacggggcccgccgcctgcgcagccagccccgcggacgacggtgcgggcccggggggccggggaccccggggacgcgcgcggggggacacgggcgccgacgaggcggtgccgcgccacgactcctcctacggcaccttcgcgggggagttctacgacctgcgc

SEQ ID NO: 5718 - DNA, 817 bp, Homo sapiens
cgcgcgccgttccctccggagttcccgagctgctgaggagtctggattgtgtctgtccccagtgtcagatgaaagggcgctgaggctcttggccgctgccccgcgcccagctccgcgcacgcccctctgcgagtccggccgcccagcgcctcttcccgcccgagccgccgcctgcgctccggggcagccgctctgtctccagcgcgatgtggcctcgcctggccttttgttgctggggtctggcgctcgtttcgggctgggcgacctttcagcagatgtccccgtcgcgcaatttcagcttccgcctcttccccgagaccgcgcccggggcccccgggagtatccccgcgccgcccgctcctggcgacgaagcggcggggagcagagtggagcggctgggccaggcgttccggcgacgcgtgcggctgctgcgggagctcagcgagcgcctggagcttgtcttcctggtggatgattcgtccagcgtgggcgaagtcaacttccgcagcgagctcatgttcgtccgcaagctgctgtccgacttccccgtggtgcccacggccacgcgcgtggccatcgtgaccttctcgtccaagaactacgtggtgccgcgcgtcgattacatctccacccgccgcgcgcgccagcacaagtgcgcgctgctcctccaagagatccctgccatctcctaccgaggtggcggcacctacaccaagggcgccttccagcaagccgcggtaaggcgcccgcccctcccgacccgggccctagtccccgggcccttcgacccaccgctgcctgcccgtctctatcccgg

SEQ ID NO: 5719 - DNA, 814 bp, Homo sapiens
cggagcacgggttacgtgccctaggctccgggaaccagccctcactggccgagggtccgcggggccgccaggagggctccccaggttcctcccagggatggagcagctacgccttccgagtgtgcccattccaccgatggagcaaagtgaggctctcagctcgcccggatgtctctgcgccgctcgcggggcagctctcgcacagacacgcccgcaagcccccgacccgcccgccacccgcgcccagacacccgcgagcctctggggccgcagggacggtgcagcgcccgccgaggcgccctcacctacctgtgatcactgccggagacctctggcccccctccgctcgcagccacacttgcagcgtgaacgcgtcccggggcagctcgaggtcggcccggaggcgcagctgctcgcctcgcccgctgaaatagagcgcccggctcggcgggctcggctcctcggtggcgcccctcgcctcccgctgctgccgccgccgggggacgcgcacggcttcccaggcaccgcccggcggcggcggcggcggcggcgaggcgcggcggccgcgggccgcccgggtggcgcaggtggccgggccggcggcggggcgcgggggtcggccggcccgcgggtctctccgggcccggcggggacgctcggccagcccgcagcccagcgcggcgctcagcagccccaggtgcagcacccaactccagagccgcatgtccgacggttccccccgcccccccttcgcccctgcaccgccacccggagctgccagctttgggagcctcggcgcctcgactttcttcgc

SEQ ID NO: 5720 - DNA, 1429 bp, Homo sapiens
cgcgagggaaggaccactaaacccaaagacgcgcgtgcccgtgtgttcacacagacgtgtgcttcggcgcctgcacacggccggcgcgcaggcatgcggacgcctacacgaatacataggcatgttttattgacgcatctggggcactttctttcaaagaaagtaaggaatgaaaatccaatctgagagtcaccagggttcatctggaggtcgcccaaggggcagaaaaaatttgtaatgacgctagagtgtttgtccttggtgcaactccactctcgggagggctggatacaatacgtttggaaagctcgaggggctgccttaggatctgggggcggggggtggggtactcagcaactcttgccgcgggctgctcaagaaacgtggaaacacaccctgcgactttccactcccccatacatataggcacgcgattccgtcgccacctctcggaccagcagcccacgtccaacgctgggccgaccccagatacacaggcagtcgggattcccgcccggtgcgcttgtctattcatccctctgcgtcaggctgggacgcgctccgtctgtaaaaggctcaaacgcatctcccgccgcggggcgggatctaggggcccaggccccggggtccagaggcgggtaactttgctaatctcccccagcggcggggaacgtcgcgcaaccgctgagccctgtccgccgagactaaacaagcagaggaacaggctgtaaacacacatcctgacacgtgagtgacatttacgcggtgcgagaagctgcagccaagggaaaggcaaggggtggggggagcgggcaccgacaggtacggaaccttcgcaggcgccggaaacggcggcccctcgacctccccctcccccagaaagtggcaacgaatgcctaagtcccccgaacctgccttttgtgggaggtgacaggtgaacggaattcaggtctggccactctcgccgctgcctacctccccaccatctgcttcctcgcagacaagcagacccggcgcataatgaggtagcagcctccagccggccaccgtgactaactcagaacaaaagcgctccctccacgcctcctccaacaaaggggccaccagccccggcgctccccgaaggctgcggggctcccggctgccggctgcggagctgccgcgcgcaaacttcccggggctcccggggctgccggcgccacggagccggggccgcggagggaggaagcgcaagccgcccggagaaagtgaggccagacccggcgggggagaggggagggagccgggcggccgcggaaggagggtgattgatcagtgcgcggtgcccggcgctctgtcccgttattagaggcggccaaagcagggccacgcaataacctcagaatcgccaactaattgacgctgcaggcaactacttcattgtgcgcgc

SEQ ID NO: 5721 - DNA, 7708 bp, Homo sapiens
cggaggggaaagcgagtcccggaaacaggcgcagcttgtggcgagggtccggtggccgagctgaatcccggggctccgggagacccggtccctgcgggggaggccttttccgaagccgttattggcgggggagtagagaaaaggggaaagaaggggagtggagaaaaagggaaaggagccggccctaagtagcgaggccgaggccggccagaggcaagggcagggggcggcggcgggggaggcagccgtggggcccaggtttggccggcgccccgaaccccctcactcccgcccccagtgcccgggggcgggtcgagattccccaggatcggatccggggaggagcgaggggccgaggggagggggaggacccgggctttctctctccttttttttttttttcctctcaattaggccgattcaatggagctaaagagctcgtaaaatcatgaataatttactcgtgatctgttattaacccatcgggtttcgagctcttgtcgctgggactgaacctgtaatcaaatctgacttcgcctcattttactaaagacgagattgtaggttcaattgtctaaataatggattggaatcaaatcagtaattacgccgccaggcacacacacacaaaaagctggggctgggggaggccgggcgtccggccggtccgcgcgggactcccgcggccgcggcgcgcaaacccaggcgcaaagtgcgcggcccgggcccctcgcccgctcctgccgccgttttcgcacccccagcccgctggcagcccctcccggggtagggggaggtttccgttccaccggggcccgggcccgaggggctgcgggaagaggccgctgcggccccgccccggaaggactttccgaccccgcggcccgcggctctgctgtaagcccagcgcccggcgccccgacggcgccccctccccactcggcccccagctcgccgcccttcagtaaggtgccgccgcgcctcggagggactgtccccagagcaagaggctttgcaaggggtcgtcgtggctgggccacaggatgtgggacactgccacaaacaagctcgtgtccccgtggtcggaaccctgcacgcacacgcacacgacccgcgcccgcacaccccgtccgcgatcgcaccctccagggtccccgctttccagtcctagctgccccgcggcccacactgcggccatttctctcctgccagtgcgggaggggagggaagggcggacgccagatctaggaagactgggctgggccccgagaggccggggagatgccctctttccccaacctagtcccgggagccccgaaagagccagccgcatagccaccgccggcgcaccgaacgccgtttctctcaggactaggagccccggccaaggtcggagaggagggcacgggaacaaacacgacacacacagagacagagatagagagaaaggacggagagaacggaaaggaaaaaaagagagagggaggccagagagaaagtgagatggctgaatggagggtgtctcttgtagaggttaaacaaggcttgaaattcagcctccagcccacctcgctggggcaaacggcggctgaacagcaaaaagcagaaataaatctctgtaccttctactctctttttgcacaatcctaaaaccggcgccgaacctccgtgcccaggaaaacaatacagctccccagccaccaggtgccctggagccgagccccgcgaggtgcttccgagtggaagttgacccacttgataaatagaagcggcttggtgttgggggagccggtctgaactcggttttgtctttttttggggggtggtaggagaggagggatggaagttccagagagctacatctgtggtagtgccttcagcaaatcttaaatccgcgccaccgaccggcctaccgctgcttcaccatttaccaaactgggggctgcgttttcctcccagttccgcacacagggacacacgccccatgatcctccaagcgatttcgttggagcgaacacccgcccctcatttccctctctattcaactcagattctttaagatgaaaataactgacttcttcccgccgtagcaccctctgcacagtcttgggtttgtttttgtttttgcttttttctgcttgtgcattagactaaagggaaaaggaagaagaacacaaaatctccaaatctaattctgttgcaaacgaaagaaagaaaataattgcacataaactctagttcggaagcccggagagtcataaacctttccgggccttgcagacttcgggcagatgttgacggctcatttgccggaactcagaacctctgcagctgtcctgagcagggaggggcgcgggagggggcagagcttctccgggaatggcctggggttcaaagatgccggaaatccgaaccaagccccccacctcaccccaccccaccccaccccggcgcgaggccaggcctgctccggtctcgtccccgcccggggggctcgcttccgagggtcacggccctcaccccagcaggcgccaggaaactcggaggaaaaagtccgggaaaactgagacctgtctttaaaggaggatcgggccgagcaaaaggaaccgcagcctttgctttcctgagttccccaagcccgagttccccaagcctgccgcccttgggacatttcacgaggtcaggccgcactccaggccgagctcggcgccccgggccacagccagccctttctcttgggaccctcgccgccctgcctcgttccttcgctgccccagttcccggccctcagccgcgccaacccaaaacctgtttggcgtcagcgccgccttgctttctccatccctgccacttcctgcctagcaaagtggggcaaaggcccaaaccaaaaagccatctccaaaaaaacaatttatcagagacaaggccctgcacccggagcagcaagggaccactgcaccctctcctcccgctccagccgaggacgcacagtctggaagcccagggggctaatgtcccttctgcgaggccgtccggtgcttaaggctcgctatttgcccagcacacagagattcaatccagctcccggccgtcgaggccgcacactttcccccaaccctatgggggcgcttcgtgcgccgcgcactcaccagcgttgtaggccgccagatccgcaccggggcccgggctcttacgtttcctcggccgccccttctgcacagtgcccacgccattgtagtagggaagacccagagggttggcccctgctgcgcccagccccgcgctcttggccgccgcggctgcagcggccgccgctgccacgtcggcatggttgaagtgtgcggggtactcgccctgcagcagcgcctcgaagtgcaagcggcagtagaccaggctgtccttcatgccgaagtggtcgcccgtggtcagcatcttgttacacgtggtgcacgtgaagcagttgaggtgataaaccaagtcccgagcgcgcatcaccatctccgaggccgagatgcccaggtggcagcgggcgcagcgctgcacagagaagcgcctgtagggaccatggagggaggggctgtgggaacacacggttgggtaccccccttttcctcctccaggtgccgctgctgctgcggggggcaatcccctcctcaagacgaacaacccggcctttatttggaggatgggggggagagagaactagattttgacccaggcctggtcctgtcctaaaatagtttcccttaacacacttatgcctacagagacttctacttcacccagagtctccgcaagccctaggaaagcctttacctgggagtggagggagacacttaccacttaccccctcctcaacctttactcctccctccaaaccagcgcctgggaatcctactgacttttataatttggaagaaacacagagacagggaaagagagagagacacagacgtagagacagagacagagagaatatacatagaccctaatcctaaaactggggagaaggagaaacagagaacttggagtctactagtgattctggttctttgatcttggccacctttcattcccattttctcaaaagacctggaaatgcacccactcccacagctctctttccagctgtgtttcactccagcttgggctgcctaggtttgggggtgcctgtttctataacctcggattaactcaagaaacttcaaagagagaggggagcaaggatcccaactcaagcttttttgtggtctaagctccgagcaggagggcagcttctgctttttttctggttctcctacttcgtagacctttccaagagctccccaaattgctgctttaaaaggttatcacccaacttgtggtggcttggagaacttggggggggagcgggggagtcctgagtagtgaaccctctcctgggactaaacggaaaggagagggccaaactgtaagactgtgcctgagattggggggaggggtcctgaggggcagttgggtgggggggctacctgtagtagtcttccttgcagtagatgctaccgtccttgctgaaacaggtgagctccgactccaggttgagcttgcactcgcagcacttgaggcagcgcatgtgccactgcttgtccaccgccagcaggtagtagcggtccgagatcttgcccccgcagccggcgcacagcgcggcgcggtcactgctgatggacggcatggtctgcgaagggagggaggcggaagacagcagcgcctgcgtcagccagcggcccctccgccgccgggaaaccggcacccacaactccctctgtggccttggctaccctgaacgcggagggggctgccaggacatgcggcgcgcttccccccaccccaaaaggcccatttccatttctgggcggttcagaacccaggcctgcctgcgcagccctcgccagccacgggcccaggccgggctcctggcctaaatggctctggtgcttacctctcttccttccagtcctccctgtcctttcccccaaaatgctcgggctgtgtttagggaccaggacagctactccagtcaagccctccaagagctttccctaaactgcttcttaaatgagccacccgggggataaggtgaccattaagtcaccctccacacagaatcctctttggagagacagcggagttcctgggccccagctccagtgatccctggatccttagaccagaggttaaggccaggacaagtcagccaacttctggctcctctgccacacgggctggggccctcttgggtccggggatgaggtaagtggggtgcagggacaccctcaaagtccgtgggtgaaggacaggttcaacccaaatacttccctatccaaactgaccagcagagaaggtctaaccgaagaagcgctcagaggccgggaggacactggcgccgctgctcctgctcccggagcagagaagcttctcccgtgctccccacctccgcggcctcctaaaggtcacttctgggcccgctggtcgggcagtgtctgctcgtctggcccccagggaggcctgaggcgaggaactggctatttggggctgggcccgcggagccaggtgtagagatccaaatggagtctccttcggcgagggccaggccggagcctgaactcccagccctggcctggctaagtctgaccagtcaagggtctggggacgcgatcaacgacaaatgttggccccgaagacttcggcctctgaaactgcgctgggggttgaggaggatccccgattgccggaaagctgggagcggcccaagccggctggagccccaatgctcccagctggttcgcccttccctggcgccgctcgcggcgccgccagcaaccggagccgagaggtggaggagagcgcggggctgtcgaccccggcaccgggcaaggtgagaagggagccgccccgggccgcggatgggacttcgcttccagttcggaagaaacgctctcctctacccccagggccgagatttcggtttcaaccttgtttcccttctgcgtcccagcagccgggtttcccccgaaccgggagccaccggccttgcattctgaccgaggatccccagcacccagtcccgtgcggcacgaaggacgctccccaaacttcggggagcagaggcgctgactggcccggccccatcccagctctcagccccgaccccacagccgcgcgcctaccgtctcggtgtcgccgcggtcgatggcggagctgatggcgggagcctcgctcttggccctgcggtccatctcgtcgatgaccccgtgcacctcggggcccgacagactgtggaacagcatcgcggcgggaccggcggggccgggggcgcggctcctccgagggagggcttgccccccgcctcagctgcctggcgctcctggcgctaacgggcccggtgcatcgccaccgcggccccggccccgcccgagctcggctgagcccccaggccgggctccgggccccgggcgctcgcggggcaggacgcctcccgccgaggcgcaggggcagctacattgcggggcgcctgggcgacggcgccaaagccagggtcacaagggcacgggacaagcggggcggggggagcaggagactaggacagaggtcggcgcccgccgcgggcgctttcacgccgcgggcatcgcccgcccggcttcagcgcccggggcgcaaagcaagggcgcaaactctgcccgaggcggcgacggctgcggtcggggttcaccctgaagccgctaggtgtccgcggcggcccagctgcctggacccctcccctccctggggtgcgcccccagcccaaggcgaccctcttgggcgctgagtcggcgactggagtaggggtttctccgaagcctgcgagccgagtcgagccaccgggagaattgaagaggaggaggaagaggaggaggaggaggcggaggaggaggtggaggaggagaaaaaagaggaggagcagagtgggaggaggagccgccggccgcgggcccagccgcgcgcaatgctctccaagcgcgcgcctagcccagccccggctctgcagtccgcgccagcgcaagcctccgcgccttttctacagccgcgcctgacatcacgtcctgccgccgtgccattggccgctcggcgccccaggccctggcagcgcgtgctccgggaaggcgggagacccaagagggaggggagaggcaagaggagcagaggagagtcgagatggtgggagctggtgggcgaggctggagggcgggggtgggggggaggcagggaggagggagagcgcggggtttggagtttttaagatacgaacagcttcctgcgatatcttcagaaaggaaaattaaaccctctatcctaagaaggcgcagcaaggggatgctcgtctcactgcggtctcccctcggcctggagccgcggcctcaggcacccgcctgggaggcccgggaaggcaggcctgtggcagagttgcaagagccttcggccggccgtttcccatcgagctccgccttcggcccgggctctgcacagcgggctgcaggcggccgtgcaagcctcctgggtacccggcagagcctgagtggcgagaccggcgagagctgtgactcccggggaggggggccagccagcatatccacgctccaagcccgctagggcccaatctgcagcccagcgtgtagcttctcgctcttcccgg

SEQ ID NO: 5722 - DNA, 3969 bp, Homo sapiens
cgtcccttctgcgagccgcgcgcgtctgcgatgcgcaggctgccctggacccttcggggactggggggactcccttgggaagttaagggggacaccctaagtgtgctttgcaaatcgtattttctgatgtgaaaaccggcatgcgcggtgcggccgcacggggagagcgcgtgcctgggggtggggggcatcgcccaggaaagcggagtcaccccgggcggaaagcgacccccgcagaaagcgccgcgcgggcgccgctgcgtgttcgccgcccacagccgcagccaaagagacgcaggcggccccacgcggcctggttcaccgccgcctgcagtgtccgcggcgcggggcgccccgaggctgggctcaccgtcctctccgcgtccttgaagatctcccgggcctcctcgaaggagcactgctcctccttgcactccctctccagggagcccggccgcagctcctccaggaacgcgttggcgcgccggcgccggtgcaggacgccgtgggcttcctcctgggttacgaagactgggaaatgcgagttccgtgaagcgcccaccgcgtgccccgcccagtgcctcggagaccgccccacggcccacgcggcgggggcatcgcaggttcccgcccgtcctggaggaggggagcggcgctgctcgcgggcctggctgggtgtcctccctgccgtgctcccgggtcagccacccccgtcgcccatccttcccggcctggcctctctgcttccgggggctgatcccgagggcgcgctcgggggcacgcgcggaagccgggccgaagggggctgcgggcgccgccgcgtaaacgtgaggctgcgggtcgatgccggcgaggagaaggcggcgcggccccgggtgccgggcaaccccctggggcccacgtgaaccgcgcgtggaaatccgtacagccgcccgcggaaatccaaatccctcgtctccacccgcaccgcgtctccggcggccagatccgccttccccaggcctccgtcctggtccgaggcgcggcccctgcccggctcccccgacagcgagccccgggcttcctcgccagctcttggcggtcctgggcttctgccgccttccccgcctccgcttggggcccctctgtcccccgcgacccctgagagctccagacctcgcgcggatcctcctggggccggtcctgagagcacagccccccgccgcagctcctggcccctccgtaaccccgacggttacttgtggacaaacaggaccgccgttttgcccatgggaagacggggctggtgagggccagagacgcccagggcgaggcaaccccgtgcgctcagctccgagcaggccgctcttcaggacgccctacagccgaggggaccgtcacccgggagcgccgtgagctgtgggcaccacgcggtggtggagagtgacccccgccccggggcggccgtgctgcccgaacctgcctcagcccgcgaggggagacgggcctgggggcaggcgggagagggaggccccgggaggaggcgagcggggctgagaggacgcgcgggaggggctctggagaggccgcaggaggcgcgttccggagggacgacctttgctgggaggacgaggcctcaggtggacgctgtgggccggtgggcaggagcccgagttctgcaggagcggcctaaattggttactgagcgcggaagaagggacggaaggtgagcgctactgggccacgtggggccgagagaaaggccactgcctgttttctttaaaatcagtttcacacgtcgacgcccctagagaactggtctggtttggaaggaggctgaggatgcaggcggggacaccaaagaatcgggctcaaggaggtgggaactcacggactccgagtcctcacaggaggtgccctgggcggcaggagtgggaggggaggcccatgtccctgcagtccccgacacccacgctcccgggacacccacgacccccgggacacccacacccccgggacacccacgccccccggacacccacgcccctgggacactcacacttctgggatacccacgcccccgggacacccacactcccgggacacccacgcccccgggacacccacactcccgggacaccctcgcctccggaacacccacactcccgggacaccctcgcctccggaacacccacactcccgggacatccactcccccgggacacccacactcccgggacacccacgcccccgggacacccacacccctgggacacccacgctcccgggacacccacgcccccgggacacccacgctcccgggacaccctcgcctccggaacacccacactcccgggacaccctcgcctccggaacacccacactcccgggacacccactcccccgggacacccacactcccgggacacccacgcccccgggacacccacacccctgggacacccacactcccgggacaccctcgcctctggaacacccacactcccgggacacccacgacccccgggacacccacacccccgggacactcacacttctgggataccctcgcctctggaacacccacactcccgggacacccacgcccccgggacacccacactcctgggacaccctcgcctccgggacacccacactcccgggacacccactcccccgggacacccacactcccgggacacccacgcccccgggacacccacgctcccgggacaccctcgcctccgggacacccacgctcctgggacaccctcgcctccggaacacccacactcccgggacacccactcccccgggacacccacactcccgggacacccacacccccgggacacccacacccccgggacacccacactcccgggacaccctcgcctccggaacacccacactcccgggacaccctcgcctccggaacacccacactcccgggacacccacaacccccgggacacccacgcccccgggacacccacactcccgggacaccctcgcctccggaacacccacactcccgggacaccctcgcctccggaacacccacactcccgggacacccacgcccctgggacacccacactcccgggacaccctcgcctccggaacacccacactcccgggacaccctcacctccggaacacccacactcccgggacacccacgcccccgggacacccacactcccgggacaccctcgcctccggaacacccacactcccgggacaccctcacctccggaacacccacactcccgggacacccacgcccccgggacacccacacccccgggacacccacgcccctgggacactcacacttctgggataccctcgcctccggaacacccacgcccccgggacacccacgcccccgggacacccacgcccccgggacacgcacactcccgggacaccctcgcctccggaacacccacactcccgggacacccacactcccgggacacccacgcccccgggacacccacactcccgggacacccacgcccccgggacacccacactcccgggacacccacgcccccgggacacccacgctcccgggacacccacgcccccgggacacccacactcccgggacaccctcgcctccgggacacccacactcccgggacacccactcccccgggacacccacactcccgggacaccctcgcctccgggacacccacactcccgggacacccactcccccgggacacccacactcccgggacacccacgcccccgggacacccacactcccgggacaccctcgcctccgggacacccacactcccgggacacccactcccccgggacacccacactcccgggacaccctcgcctccgggacacccacactcccgggacacccacgcccccgggacacccacactcccgggacacccacgcccccgggacacccacactcctgggacacccacgcccccgggacacccacactcccgg

SEQ ID NO: 5723 - DNA, 2490 bp, Homo sapiens
cgtgaatccgagcctcggccacggtcgccactcgcccttacccacttccacgctgtagtgcgaccagccacccgcgtggcattcgccacgacccagctgggttcacagacaggagctgcctcctcccactgcaggcgggtgacccaaggcccccactgccctatacctgcccagatcgcggggcactcgggctccgcagctctctggccgcgctcggggtccggggagccgggctgcggctggggggcctggaggatgagggcgaagactcgagctggactgcggagagggtgccggcgcgggccgggcttggggggaggacacgaccgggcctccgcccccggataccgcacgcgccgatatagaggggccggcccccggccccggcgcggcgggttggcgcagggcggggtggcggctgaggggcccgggtcccaggtgcgcctcggagcggccccggcggcggtgcgggggggaacagggaggcaggatggggggcggggaggcgggaggggggagccgaggcccccgcgccgccagccccgcgcccccgcctccccgtccccggcccgagcggccgtcatcgcgggcgggcggcgctgcgcccgggtgcggctcctcgccggcggcggcggcgcggccgagaggtgcgggctccgcgcgggcgggacgcggggcgctgctcgcaggagcgaccaggtgggcgccgggccgaccgcagccgccgtcgcgccccctctcgcgtcccgggccctggctcttcgcgcttccctcctccggacttcgcctctccgcccgaggtcgctccctcgcctcgggctcggcttcccggagcccgccgacccccgcccgaggtctccccgcccgacgtcccggtggcagcggcggctcgggctgcgcctcccgttgccgtcgctgctgcggctttgtctcccccggggagggggtcccggcggctctgcgttttcgggctctcggtcccggcgccgtcgttttccgcctcctgcggcccgggcccccgtctgggtccgaccctgcggggcctcgccttggcgcttgggctcctgcccggcaggtttccgcgcgtcccctgtccccgaccctcgggctgggcgcttccgcctccaggttttctctccgtgtttctgtagctccccggcctcgtctctccggggctcctctcgtctcggcgtctctgtctgtcgtctatcgttgtgtctctggctctgcgtcagtctctcttgggttttctcttcgggcctccgctgtctctccgagtctctgatccaatcccccacccctcgtttctctctctctctctctctctcgtctctctctctctctctctctctctctgtctccctgtctctctccatccctccctgtgtctcgtccccgccgggttctctctagctgggcgtctcagtgtctgtgtctctggcactctcggactggcctcgtgtctgcgcccggtggcgtcggtcgttgtctctcgccagagtttcttcccatctctggctcccccggactctgtctctgcctccttcgtctctgtcgggttcccagaacacccgggccgggcgccccagcgctcctgggtcccctggcgtcttccccgcggctgagcccatctctttttctcagaatcggggttttgttctcagacaaacgaatcccaatcgaagcgcatcgaacccgagggccccagatcgggcgcgacggggtccgcgcgggaggagccccccggacggggcgggagcgtggggcctggcaggggaaggccgggcgcggggactgcaccggacccaccccgggacgctgcgcggggcgctcggtgggtgccggcggcagcgcctgggcacagagaggggattacgcgacgggccggcgacagcggctggggcggcggccgcggggaccccaggctgccggtctccgccggccctccctgacccgctgtccctccgcaggcggacgccgcgggcatggactattcgtacgacgaggacctggacgagctgtgccccgtgtgcggggacaaggtgtccggctaccactacggactgctcacgtgtgagagctgcaaggtgagcggcgagcgcgcggcaggggtgcggcagacgggcgctgcggggcctcgctgactctcagctcccgcagggcttcttcaagcgcacggtgcagaacaacaagcactacacgtgcaccgagagccagagctgcaagatcgacaagacgcagcgcaagcgctgtcccttctgccgcttccagaaatgcctgacggtggggatgcgcctggaaggtgcgcgccgcgcgggcctcgacccctgaccccccacagcctgagggggtagggggtgggggtgggagaggggctgaggggatagtaccattggccttcgcgaaggcccctcgtgcgacattagggcccagtcgctgcaagagaaccgggcgctggcgctgggtgggcctcgggcggggaagggacgc

SEQ ID NO: 5724 - DNA, 5370 bp, Homo sapiens
cggccggcccagcgcaggattccgggacaacggatggcaactgggggccgtccggaggctcccaggaccccatcagtgcccgctgggctgggctggtccgccccagccccaagacgcgcagctctcggaacccttggagctgcccggcccagccgcgcacagagccggcggcagagcgggcgcgggccgggcccggcagggggctgaccgggctcgagtgccgggcggtggcggggaaggaggacgagaagcgcttactgttggtagtcttgtttgcagtacagtttccgatcccggaagtagcagctggtggtgagggcttgctgacacgccgcgcactgcaaacactcctcgtgccaggacgactcgttgactcgcatcaggaagcggtcggagatgggccgctggcagccctcgcagacggcgggatgcgggcagtcggagcctgtagcgcacagggcgaaagcccggccgtcagcgccgcccggcccagccccggcgtcccggtcgcaccgggcccacagccctcggccccgagggctcgggccgcccgggatcaccgcctgccgcctgcgctccccggaccgccgcgccaggggccgggcggccccggctagtccgtcccagtcctcgggctccggcgtggagaggccgcgggcctcgagccttggctcggcgctgtgctctccccttctccggagaatccgcgctccgtgttaagacaaatgacaacgagcacggcgcagggtggccggctgggaccaagacaggcgaggtgaggctggggcgctcgctggctgacacgccccacggtggcgttcgtggtcttctatccccgatctccccaaaatctgtggtttgagtgaccagggagacgtttttctcttagaatctcccccaccccaggtgaccttgcgcctctcccaagctcgccaaggtgattgctaggtcctccatcacccctgccacccgccacctaccacatcggagtggcagctctagaacctaagcctggaaaggatggtgggtggcgactggagctgtcctgtcccctcaggacgcctgccggaggcgtacttgcggccctctggcgatcactccaggagtcctgtctctgcctcctccccatgtcctgcaaacccatttcctttatccgttggccccaacgcccgtgtccacagccggacgacgccccatcccacgcccgagaccactcgggcgttccgaccccgcactcacccagcagcacccccagagtggcgggcccggggcgcagggcgtgctcctccatcttgatgccgtccaacatcttggcgcagtccgtctgcccgcgagggaagcacctctccagcgactcgggacctgttgctatatccatgggacgcggggcgcgctgcggaccccgccggccgggctgctcgcccgccggcccgtccacccgctctccgccgccgcggccctggaaccggggaggcgcggcccccgcagggcaggggttgcgccggcccccggcgatcgtggagcggcgacgcgctggccccgggccccggcgtcgtgcgggcgggccggggcggctgcagcccgcgccgcgctctcccggacacttgcagccacgcgcgccggctcctctgtcacctgcttgtcagtcccggaacccggcggcggcggctgctgcagacggagccgcggggaggaggcggcggcggcggtggcggtggcggcggcggcaggcgggggagggggtgggggtgcaggggcggccccgcgggccgcggggggggcgcgcggcgcagcggggtcccgggcggggcgcagcgggccgcggggctccgggcgcgctccccgcgctactccagtgccatggtgcgcccgctgagccgccgggtttagagctggggctggcggcggagggatacgggccgcctcacctcccgaaacttcctgacatttgaaccccgcggccggtatccctgcgccgggatgcgccgccggctccacgtcaaatagtgccgtcccgcccccccgcgcgccccggggctccgcgcccctggcccgcgccccgcgccgcgcctggccccgagctcaggccccggctccccggcccggccgccccgcgggcccctcgcagaagttttgatcgtcttcgaaacaaatccctctgctccacccccttgaaaaattgatttgggagttggggagcgaaggctttcttttttctcctctgccttctttattattaatattttgtaaagctccagcgctacgaggagtggccccgagcgaggccagactgcgcggacggcagggagcgcggcggctccgccaggggacggcgccggccgggagtggccgcttgggaacccccgactgtcggccgaggtaggtcgcgggggctgagtcggagtcccccgggcggcggcgcctgctcggggccgcttggtccgcggagagggccggctcccaggaacgaaggacgggggcgggcagaaggcgaggacggctggccctggactcgtgcaaggggggcccaggcccaggaacggggagtgagcctggagtgtgggtgaggggtctgggaaagctccgggcctggcagagattgggcgggggactgagccgatgggaggttggggccccgggatcgagaatgggggacactgggacgacaaggaaggtcaggcctgggttcaggcgaccgagagtttagaggacaactaaggctggaaaaggggtccccgggcaggggcaggagcagtgggcaagacccgggcctcctagggtttgcagtgaggggcgctaggagggagtggtggccccagggtagcggctctgaagaaattaggttggctgccaagatcggggtcctttggcgggtcgggtgcccggccaggggtcgctgggacgcgcggatcaaggacagtgctctagccagcctgggcaaagtggacctcggcaacgggacgcgaaagctggcgagatggagctgccgacttccgcgccagccgggcctggcacccgcgtccggtgcgagaggccacagcgtcggaccggctgtctgcggcccgtggtccccaccgacgcgcggctcaccggggagcaggggggcggttgcggcccggggtagcggcgggctgaccccccgcgatccgctgcggggcggccccggcccctcccggagcgaggcagcggcgcggagccgggcgggggcggagggcatggggggcgggtcccctgacctcgctggaggcgaaagggcggatcggatttggaacctgcgggaggcttggtcagaagtggccccctgcgccgcggggccccgcggaggggcccggctttgtggaggattagaggctcccgccctaccctacctgcgtgtgtgtcggtgggtatctgtgtgtgtctgtgcgtgtcgggcccccgcctctgcggctcttgcctccgtgtgctccttggctctgcacacacggtatgtgtgtccctgcaaccttccagactcccaggggtgaatctgtggatctgtgtctgagtcccctgcacccgtgtgtatgtgaatgtgtgggtccttcgtgcctgtgtctggggtgtgtgtccgcatcatttcatgcgggggcctaagtctttgtgcgtgtctcagcctctgtgttgtgtctgcgatccttttctgtatgggtgtctctgtcagctttgcgtatctgtgcttatctccggggttctgaatgcttctgtgtgctcgcgtgtctcctagcgtgtgtgtgtgtgtgtgtgtttgtgtgtggtggggggctttgtgccttcgtgtatttctaggcgcctttgtgtggctaggtcggggagagtggacagtcaatgtggagtttctctcccacatctcggtcccctctttgcttgacctggaaaccccaggcctggacccgcgaagttgggctgggcctgagccgccttctccgggcatctggggcgggggcgcggctgctgcagggagaagccgggcgggcaaggcttcggcgcacagagccagagtcccgaggcgcggagcgcggctcggggccggcgggcggaccaggcactttctgccctctgctggtcgcggtccatccctgcaaccggggctgggcgactgcctgcaggcgagagtcctcgttccaggcccagaccctctccctctccttcagggtgcacatggtaatactctctcgtcacaggccctgcacccccaactcctggcgcaaggctccatcccctccccaccttccctgtgcctggcctctcctaccctacagctctcctttccccctccttggctgaatgagggcccctgcgatccagtctcccaggcttctctaactcgggttggcgtccagtgccgatctggggccgctggctgtgcccagaggcgcattccccggaccactcgaaggcctggtctcaaggcaggaggacttgtgggaagtaccccctccgtgccgcgtctggtctgtccgggtgcgcatgcattctcagcgcctcttccgcgctcctgccagtcatatcccacgccaccaaggcggatatagggtggtctgccgccatgcggcccgcgcccagataggggcgctggctcggtggacgccagagcctggctgccttctctggtctggggtggggctgctgagtccacaccccttgggcccctctgcatgccttccccgctgtccattcattccccctacacacacacacacacacacacacacacacacacacacacacacacacacacacacacacaccctccctataggccccgttccttgccctttgtcctcactcctcgtgtcccgtgctcccagctgagttggccggtctcgggtccttcgcacgcagacgcgcaggggtcccagatctctccagcacaatcggggctcccgcgcctctccaccgcttcccttgccgaagaagcgaagaagcggccgactggacggcacagcaggggccgaggcccagagccggctcctgcccgcaggcggcgaacggcaccttgctccgccaggcccctgcgggtgtgatccgtgacccgcagattctcccgggcgcctctggcccatgacgcgggggctgctcgctccacgcaggcggcttcgggatgctctcccgctcagatttcagcggcagaaacagcctcggattctctctacctgggggaaagactgagtcgggggctcggaatcactggaagaagcgagaatggaaagggaggctctggagcgggggtcccggctccttccagtctgcggacgccccagctccattgagccccgccctagtccccccgctcctcttcttagggccttgcaccctctcctctgcgctacccgcctccctcgagcacgg

SEQ ID NO: 5725 - DNA, 3120 bp, Homo sapiens
cggacggaccggcggacgctgcgggcccggccgggctgataggaaccatctgcgttgtcttaggccgcccttcggcccactgtccctctgaactcggccggttcccgcgggccgtttgatgcttgcagggtcacagacccccgcacacaaatcaccgccgcggggctgggggtggggcggaggcgctgaaacctaatccgcagagtttgctccgccgccgcctccttgctccttccctcgctcgctcgacgccccccacccacccctttccaaacaaggcttatttttcttgccaaaaaaacaaagttggtatcaagtgtttcgagggagaaagtctctcccccacccctgacctggaaggaagggccggttgccgactgagccgggattgcagagggggctccaggagaggacgggcgggaggtgagctcagggcttctggctccatcggtccccttccccgctctcgcctgcccgtcccatacttaatggcagcgaatcccatggtccccggccatgtcctgtccctctactcgtcctgcccggaaagggtttcctccatcggagctcccggtccctatgctgtcagagatggaagcatcacttcctgctccttctccctccccataaaacagtccttgcctgtcgcttttacgaggtgacaccctgctctcagcccgatcctccctgcgcccggagcctgggctcggcgcgcaggagactgcgtgcactctggcgtccccgacctctgccagggcgcacggggactccagagcggatcctctacgagttctaataggaggccagggagccgggacatcagagacaaattcctccgaagtccccctccggttccactgactggagcctttgggctgaaaccccacgagctccccacccccatgtccatgaggggagcaaaacggagcccccgggggcacgcaggcttcgtttctgggtgttggttttgcttttggttttttcagccggtgcagtgacccggaacagcgcggccgcttctccgacgcccgcggctccccactgcgccgaggcgagcgccacggctaaagcccaagcctcggcgcccgctgcgcctgccggagttctgcttgtccgagcaggcagcggggctcaggcacggcggcgacgtcgaagggccagtcggcagacagggctgggtctctgcggccagagcgccgcaggaaagccctgcaaacggtgggacgagggtggcggcggcggcggcggaggtggcgagaaaggcgccacgggcctggcggagaagagggtttccgtgggggtggaacaaaggaattcaccctcggaagaaaggggccgagcatgcagccgggaatggccaaccctggagacctgcaggagtgcgagcgctgcgacattagtcccagggatccaacgaaatctgccccgccgagggccccagcctggcatctccattcggcctctctcttctggtcaatcccgctttaatgggggtggtgggtgtgcacccggagtgccacctttcctgggaagaggggacagagcaggacccgtgctctcggtcagaggaggcaaacacatcccactaaccctccccccattcatcctctagtcgtggggtcactgtccccattttccagacgctgccaattaaggcacccgcaaaaccaccccttcccccgcccccacggcaacgctccggctcctgaggcccaagcgcgctcggaaacgaaaagcgtcagggggctacagggccggagccccctcttcccgccgtcctcggaaggggtggaggggacacggttgtaaggtgctcggcttcttttctgtgcttgacatgaataaggggattaggatggcaagtttccgtcgttcactccgtgggacaaagggccccgcggtttgagcggcacagcctctgattaaacgacagagccctgtcactcagcaccatcctaggtacttgtgttcgtgacataatcttattagaagataaaaccggcgaaatccttttcataatgaaaagttacatttaatggccggactctccccccacctccctccccggagcctgctcgcctttccccgttgctgttggatatggctcgcctataattggcatttaaagcaccaagtccgggagaaaaacggggtttagggtttttgtaatccccctaaactgtctttgttcgaaatctccacagatacaagtctgttaagagtaaatatttgtggattgatacaaccacatttcccccctgcaaaccaaatccaaaaaaaaaaaaacaagataaaaaaaaacctgccactcgccgccctcgggctggggcgcaggagggagggggctggggtcggccctagcatccgcgccgggaactcggctttcgggccgcctggttgcctccaggagctgagggacttcgcacgtttctcaggcgggaaaagggtcttagattctcccccgcaacccctaattttctgttctctcaataaacaaacctcccgaacttgctgcttttggccagcccgagggggtcggcaggagggcttggggaggggcgagggctgtgctcaacaaggaatgaaaatgccagctctccccgccagtcttactccctccagcgggagcctgcagtggctccaaggagaatcactggctctttctggaccgcgtaaggccccacctggcggggcaccccgaccccagcccaagagagcccccgagccaccaagggtccccgaaacgctgagaagcccgaaagctgctgcagggccctggactccgggcttcagcctagcgcgtcccaggatcgaattcctccataaatcagctgctgggtgaaagggctgcgctttagaaagggcaggaccgtgtgcgcgtattagagcgcgcggttcccaaatccgggctaaacccctggtgacaccgaaattcatcaaccgccgctggtgcccgcggctcggctgcggagcccaggagcctatgcatggtgtcatcccactcccagtaaagaacatgctgcacgaaccgccgagaggtgggcctggaggggtgcgcgggtggaggccgctgaaagccgccccatccgcgtgtccggacgtcgaaggaagctctcccgc

SEQ ID NO: 5726 - DNA, 3120 bp, Homo sapiens; identical to SEQ ID NO: 5725

SEQ ID NO: 5727 - DNA, 7861 bp, Homo sapiens
cggattttcggcacgggttgggaggagcctagaggcggggtgagctccaggctcgggcggcttagagtcccggctcagggggcgtccaggccaggagtgtccgccgctctcagcccgggtggaagcggcgacggccggacgcccgagtcctacccgcgaccagcgcccctcgccggcccttgcgcccctctgccccagcccgcgcgtacctcccacatgaggttgttgttcttgcagatgtccacgtgctccggggcgatcacgcggccggtgaaggggcccatctcggttcccgccttgatccacgtcttggagaagatgccgaggccctcgccagggatggagctctgagcgatgatcacctccgcaggcagcaccaggctggacagcttctgcacttctgcggcggcggggccaggaaaaccggtcagagcccgaggcagccgaggcccggcccttccttccccgccgggaccccggcttcggtcctgcccagaccagccaaacccaagtcggccccaaatccagagaagccacccgggtgtggaggaagtcggatgtgcggaggctcaacgacctctcctctgtttgcaacctggagaccctccgtgccctggaaagcgagtggtgcgttggggatcatttttagaagtgggtttttagtctctccgcgaattctcaaagcattcgcaacttcttccatcctctgccccggataagtttaagaattaatgagccaacggcagcgagcggttttatgcacagggaaactgaggccaggtcctgcaaggaggtgaaggccaaccggagactctttcgcctagtcggcttccgggagcccactgtgtgtccaggctctgggcactggcagaggagccgggccgtgatcagcgctggggacagacctcgggctggcaggtgttggaggtgccaaagaagcaccggcagcagctggccaggctctgcgctcgctgtgtgaccccgggcgcgcccgagtccctctctgctcccaggccctggggtgccagggagggcggcgcccgggctcagacaaaccccgatgtcatctctctgggcggggaggagccgcggcggcccccagctccccgagggttcccctgtcgggcatctgcggcagggctggaagcggcgaggcgcacaagggcggcctccatgtcttacaaggttcccctctaagctacctgggaaaatacccggcgagcgggccggctgaaaggggggggttaaacggtgtccattgcggcgcggcgggcaatttgtcacgctgttaaagtgatcgcattcattcggctccattcgaaagaaattgctaattctaaattcattagccctggaagaatgctgtagcagtaaattgtagctcaatgcggaggggacttgtttaaaaggggccgaggaattccccttacaaaaaagggggattagatggttgacatagcgtgaatggaagtggaattagtcttcacggtaaattaagagaggaacagaaatcgtaaagggggaaaagagggcgacgcgcagagatgccagagccagggaaagatattgtttgcgggttgatgaatgaggaataagaacttgagacatcttaaagaaaagaaacttttctcgctctctctttctctccctcgctctccccgcggctttttctccccgcccgccctccctccaccccctccccagccccggctgccttttaaagttcttggtttaagtgggaactttcgtgggtcaagcccaagttaactaaatgaatttaaaaccccttctttttgagtcaactgctattacacgcctagtaaggctgtaaatgccgggaacccgccagctcaagcgcaggaggggaagggaggggccggcgggggcgtcggggccgagcgacggggtcgccggggtcggtccttgagccgggtgggctgcggagctgcttggtggctcgcgtcctggtttggcccatggggaaactgaggtgcaccgagcgccgggagagcccaggttggcgcgagtagcagcgaggccgggtatcccagccgcgtctcgcgcatcgccaggacgggaatgggggtcgccgggaggagggattgcgccgggctccgacggctggactcaccgccggagaaggactgcgccagcacctcggcggtgaaggctgtcttggggctggcgtggtggctcttgtcctcgaagagctgctccccgagcacgttgcgccagcggccgtacaggaagctgtgcaggatgtcggaggtgataacctcggccagcgccagtcccggcgccttcagcccggtcttgagcaccagggcctcagccgggagcacggagcccatcatgggcggcccggagctccccggcgccgggggacggccgggccgacgggggaggtgggcgggcgagaggggagcccaaggggcgagaggagagcgctgcgatggagaaggaaccagagcagggggaggacggagaggaggaggacgcaggagggagcgggaggtgagggggcgactgggaggaaagcgaacgagggggagaggggaagagagatggtgaaatctgtagagatggcaaaggcggcgcggagggtggagagacgcgggtggaggcggaggcgggtgcggggggtgcagggtgggtgagaggcgggtggttgcagggaagcggcagcaaggggctcaggcgcgcgctagcctctcgcacactcggccggggccgtcttccccttggcaaaatctcagcgcctttataggagccgcagtgaccctcctaattggttattaatgaccccctgacgtcggaggacagacttgttgtacccggctgggctcgaggagccttcgtcgcgagagcgcgaggggcgggggcgcgcggaccgctccaaacagtacccctccactcctctctccccttcctggtccttcctcccccctcctgtttttccttctctccccgtgggaagcgcagggcagggagggaggctcagccggctctgaggagaggaggggacggagaaggggagggggtgcggcgaggctctctaggactccagggaccaggctagacaagaggggacgcctggcttcgggccccgcgctcccctcaggcctgatctatgttcaccggcctggcccagcccggcgttcacctttactttgctgccccggctggccggcccagccctgcaccgctctccctccccggccagagcccgcgtcctcttccctctccggccctgcactccccgggccgccacagtcgccccgagctcgcgcgcagccctagttgccacgcggatcccctgctcagactgcgctgctgaagccggcgcttcgcttcatacgggccgcgccaactcggtcgctgtgcacggtcgggtgcgaaactcctccgcgggctcacggggctgccgaggcggggccgcagcggccgtcggggctggggctggtcccggcctgagacagcttcatggaaggccaggctcccggcccttgcggggccaggtcgggggtcgagatgggcggacaggaatcgccctggcagcctgtctctgggaaaagaatttcctacgggatatagggggattgaaaggggtcccgagacccttcctaggtgggagcaggcgtgcctgagagcgaagtccctcagaaactgcaggcagctccgcgagaggcctcagtgcgggttcggcttgcggcccggctttccggctccttgctgagctgcaacctcgggaagccggtggcgttgcggcgccccttccttcttgcctcctagttctttctttctcctctgcctctctcttctttcccttcctctcctctattcctcctgcccatcatcccaggagcagacttgctttgcggcggtttcgaggcacctcggagcccagcgatcccctctcccgaagcaggtagctgctgagcccagcggaaggccccgcttcctgcaggcttcgcggctccccagtgtcagcctcaagcctcggaccccaggccctgacatgctgggtgagggagctcaccccacctgccgcacttctggctcccatcaccagcctacaatttcagatgccgctaacagaggtgcctggaccctctcggcgtgggtcaggctcacggattagtctccgctggactgtgtggactccctagaccttctcctcagcgcggaggacttgggtggaagaacagcgagctgacctcccatgagcgagaccctgtccaaacgcctgttggcatagacgcccctccaccacccggacgcgccttggctaagagggtctcacacctggcgtccagactccagacccctggtccccagttcctgccagtagtctccggcatcccccgtccccgttgggacgcaaagggaggaaggcggcggtagctggccttcagaccctgcgtccgggtccgcccgaggctggagcccaaggaagggcacacctggcagaaggcaggaccgttgggcagggcgccagcagagggcagcgctgctgaggagggaggtgggttagggtcgccgaaccctccactcatttttcgacgcagcttgtgggtcgcatcggctccctggccagagctcgagtctgagggggcgtatggagtccgatggctcctgcaggggagcctcaccggggcctacttcttggcttctgggaagacctaggtggagaggacaaagtgctaggagcgagggagacgacgtcggggagcgctgccaggagccaagcgctgcggcagctcccaagccccgaaagcgacctcagttcctccaggacaccaaagggggataaggactgctgtgtgtcctgtggactgcccctttcctctctgggcctcggtgtccctgtctgtgcaatggtttgagttggactttgtgaactgaggtttctttgcttggtctctctttgggtaagatcactttaccccacgacaaccccgaggattttgccctctccagggccacgtcccactgcgggaagccctcaggtctgtgcatcctccgtgctggggtgcagcgtttgggtcctgaaccccggcttagagttagaggcttggattccgctggcgcagtgaccacgggctcggactgcggccagggagtcccattcctctcctccggacccgcaagcccggagagcagtactgggagccgggcagaagcggagcgcagaacgtcctcccagctggtgcgcccaaatctccaccgcgctcacattttgtgcttctagtctagcggcaaaacccacctggacccccgcccggggaaaaaggagcccgtaggtagcgcccagtctcaaggtgcattgaaatagggagcaagaccctgtgctcacatctccccgggaggagatttcgaggggaaacattccgggctttcccagcggatgacccgtgttattttgtcattttccgcggggcccaggcgcggaatgtgctcgcgcaaaagccccctcccctcggccgggccggagctctcaggctccgtcgcccccctcgcccgctggccgccacttggcgatctctttaatattcatgggcgttaatagagaggccctcagtatatcggtccattgtgggcggctcgtaggacttgaataggcctcggccccctttcttcggcgcggcttcccgaggggccgggccaggagtgaatggccccgcttcccgctccgcgccccctccccctttcagggagaacatctttatcctcttctccgctgccgccgccgcccgggcccccattcacgcggccccggctccgggcggaacgaatcaatttgccgcggctcttcggaggtcatcctcgccgcccgggtgccctcttcccctgagcccacgggagtggagagagggccgccgcggcaggccgacggccccacggagggacattgaaggggaagtggaggagaagagcaggggcgacccggaggggtggctgggccggggcgggcaagacagtctcagggcccggcagccgcccggggttggctaatttctagttgttgccccgctcagggcggagcgccgaggggaaggaggccgcggcccaagcccggaggtccgttcgtcctccccttgaggcaccagcgcgcgtcccttcggcccggctgaggcacctatgagaacgggggcgtgtgggacagcccagggccccgcacgacgctttcgttctcgccggtgcgccggggcttagctccgggagagccaggtcccgacagtgcgcttcagggggacgctcggaagggcggccggcttcgcggctcctgcgccctcgctctggggcccgggcctgggtgcgggggaggggggtgcgagtcggtcaggcggggccaaagcgcacgggtccccgccctgcccgccccgccggccctcagaggcgcagaaagaagcccattgtccgccgagaaatacatttttgggggccgagtgaaagcccgtctttcttttgaactttagaagaaagtctcctgttctcgcccctcggagggagagatttgtcccccctcccgggagctccgcgcgcctcctcctcccgaaacatctgccgggggaaaatccaccctggagggcagatcgcgctcgctttaagcctggcgaactcattaaaaagatattagcggcgggggcaggtcccgcgcaggtatcgatcggccggaatgagcccgaggaagaaaaggcgaagaatgcgcccgcgccgcgctcagacgcccacccgccccgcccagcccctgcgccccagccccgcatagggagaggggcccccgcgccgcctcgcactgtctgtgagtcccgcggcccgcggtccagccgcccccacccgggctcctcggcacagcccctcggcaaccctcccctgccggtgctgcgctccgtcctggcttcccctgcgcgcaggttcccggccgctcccctcctccgcccgctgccgtcgcgcgcccagcatccgcgtctctcttctccccctctccttctcttcctccttccccagcgctcccctctttcgctggcgctccgactccctctccagcttcgcacaccctctccgcttcctcctcgcacgtctctctctggctttctgagcctcaatctttcgcagtggcccaggaaattccttcctcgcgtggggcccgcgccgctcccctccccccacccccgttccccgtaagacggttcagggttccagggcgcccccgccggcgcgtacaaaggcgcggctggctgccaaggcgggtgggggcgaggccgaaaaaaacggtttcaacagacgtgactcggggccaggcctgcgcggggctgccggcggagtggcggcctcggctcagtgaatggggacagcggccccctctcccaccccacccctgtcccctcccaatgtaattagctttcaaggctcgggagagacaaaggcgcgccccggggcgcccacgtggagtgcgtaggcgcgaagtcggcgccccgaccggcaggtgactggcacgcgagtctccccaggcgcccaggggcggaggaggggaagcccctcccctgcgcctctcgaacccccttccatcgcccacaccccggtccccaggccagcgatgccagcgccacagcccaggctgatcaaggcggcgggaacgacgggagagacgccggggacaccaggagaccgggcggtgggagagacagaggcgcaggcttctggaagcagagggggcgagacaggggtcgggggagactgaggcaaggcgatgccgaggtggagggagcagatgaaaggccgagtcggagacgcaggggtacaaagactcggagatgaaggaagcagagggggagaggcacggcttccgaaagagcgg

SEQ ID NO: 5728 - DNA, 1434 bp, Homo sapiens
cggccccgcggcgaggggcccagacgaaggaaacgccgccccaggggcgcgcgggcggagatggagtggcccaggctgggggagcggggagcagggtcgccaccgctgcgccggcccgcgacgcctgcccttgcccgccctgctccccgccgcctccctgggcgactcgggtcccgcgcggcgcccgcccagcccggggctccggaccgaggagggggaggaggaggaggaggaggagccgcgccaaggcggccggcgggcgcacttacgccggtgctgcggtccagcgtcccgccgccggccgccgagagcttggtggtgttgaggcccaccagcgagggcagcgtctgggacatccagttagtgatcatggccatggtgctcagcacgaccccgatcttgagcagcggcaccgacatcgcgcctcgagctgcctccagcgcccgctccgagctggcaccggctcccgcgcccaggcggccttcaggcggcgggcaccgcggcgggcaggggcgcctggctgtgtccccgcgccccctcggcccgccgccgcccgcccgccgccgccgccgccccgcgcgccccggccatcgccgcgccttccccgggcgccagggaaggtggccaggtggcctctgcccgccgcgccctgcgcctcgcgccgcccgccctgcgccctgccttgcccggctgcgtccctccgggctcctccgccgccaccgggaagcgccgtccggctctgagcgctgcgcgggctgcgcgcgggggccgcggccgggaggcggggctcggccgggcgggaccgacgcaatccgcccaggaaatgggtggatttttcctctcgctcggctccccgccgccccctggctgctggcagcgaggtctgcaaactccagtccgcccaggagttgggatcagggtgacatgaggagacggacacaccaccacccccagatcataaaatacccggcggcggcgcggggactccagctgggggcacggcccgcggccctcccgtcccggggcttctcccatcctcacgccggggcatccctctccgatccccgcagagggtccgctttggggcaaaggttgccggcagagagacggcgccgtcctgcctactggagcccttttccgcggtgattcgagggtcccagccagcctgggccgtcgcctgaaacccagcaggcagggcaggctccgaaaagcagccagactcgcgagggcctccagcgccaggggggcgtcggggcatcggtggagagctaaaggcgcccctgcgatcccagggcagccgcggtgccctaaggccttgcttgggaggaagggagccaaccggcactcctgacacctgcacagcaaggcgggggctggggtggtctgccgtggcccgcggtgcgcagtgagggccctgggagggcgcacacccgg

SEQ ID NO: 5729 - DNA, 5053 bp, Homo sapiens
cggtccggcaccttgcggttccggtacgcagccctcggcgccacactcaccccttctgcgtttcgggttgagctcccgccgaccatctgctgctcccgaggccaaacctcagcggcgggaggaccctgctgccttctcgacccctctcccgggaaccttagccctcctggcgtgtgctccagctcaggcctctgcctctgggccgctccggcgcaggaagctgcggggccgggacgaacgctggcgggaagccctgacctgggccctcccttaccggtgcccgccctcgggccgggcacgcggggcggcctctgggcaccgcaggtcccggcgcaaaggcgctcagagtccgcagtggcccgggctggtctccgcgacccccggccccgccccgccccgcggccccgccccccggccgctccgccctccgctcggccagaggctccgggccccagggcggcccgcgggcgcagcgcccagcagcacccggagtcgcttggacgccggttcggggctattgcggggtggcgtcgctgggcccgggaaagttcgggactggagagtggcgacgccgggcggcgggacccatggaggcgcgcggggagctgggcccggcccgggagtcggcgggaggcgacctgctgctagcactgctggcgcggagggcggacctgcgccgaggtgggtgcccgggccgagtggctgcaccggggagaccaggagatcctcaggcctttccgggcctggccgcggaggctggcaggagctagaggatctgggcgggagtgggcgcgaggaccccggaacgtccgcgcctgggcgcctcagcctgtatttgttgcagggcccctggcctgggttgtcagggagtgagtgaggttgtggcactgcgctgctccggccagggagctctcgggggtccagggtgggcttaggagacctctgcagcccggagccagctccctgggctggaggaggcgcagggagcagtggcggggcagtgaccacgggacaggagggtccccaagaaggccgccccagccggactctttccacgttccagcggaacagagtcagatgcaggggccaaggtcgagctgaactccgaccgtcggtctccccgaagtcaggtttcagcgtctgcgcccacagacacccgctcggtttatccccgctcagggcccgtctgtaggaaaaagcctctcttctccaggccccccagcttcctggtggcaccactctagctcccagcactttggttcttagggaacctgggcagttctcctcgactcccgggccagctggagccgcaggatggggaaggaggccccggagccagtggggagtgagagggaccggccggcgggaagggggttacatccaggctgtgggggctcgcggttccctacttatttatttatttttcgacggttcctgggaggggttggccgcgggggctggggggcggagagagggagggaggaaggaggactgcgcgcccgcgctcgggagagctggccggagcgggcgggctggcgtccaggctccgccgaccccgccatccctgacacaggagcccccgccagggctggagtcgccatgcagcgtaaggctggggtcgcgggcgcggcgcggggtgggctggggcggcttttgcccgacgcgggcgccggcggcgagctgcggccgaggcgctgtccggtccgcggtgctgaatccgcgctgtgtcggcctgtcgggccgccccgctccgagccgggtcctcgcctgcgatcgctgcccacgatggggaccccgggcgcgcagcgggtcctcgacgctccgcacccggagctgcggttttgccggatgcggggcgcattcatcgccggtttcccgccactgcgtggggaggcgcagcccagttttttccgccggaggtcgagggagccccttcctggtgtctctcacccactgggagatgggctggagccggcggggtccacagccagggaggcgggtgcaatatgtcagtaaatcccggtcccttcagcgggcactcctctcttccagagactttttctaagtgaagagggagtcctcagcccttgacacctggaaaacccgctcacagactcgaggctcccacagggcacccttggacctccccagtgtggttcctccagggggcctgcagtaccgaagtggggtgtggggggcagaagcagcgggaagccagacgtttgagtaactctgacggtgttgggggcacccacgcctgacacaaaggcagtggatcggcttgtccagtccactcataagtaattttgcggctgcccaatgatggggaaggcattgatatttaccccggaggcctgcagacagggccaccaggcagggcagccacatttgcgaggagtccctagaaagagtggccatgacgcttaacatgaaggagacccgatggggtgccccagctccaggtgatggtgaagacccgtttccctatgtttcctgccgggcttcagagagcagatccccctggggtggggttttcatttgagctccacatgcacccttcttggcactggcaacattttgtaattgagtattcagcctcgtgaaatggcctgggctgctttcttgctcacacacatttttagaccgatgtcagtttccccttagctcctgacataggatgcggtgcctgcacactcccggaacttgcggggccacttaagctggctggggaagagggtgtgtagggaaaggaggacccctcggcagccctgagtcctgtgggccggaggggagactggctcgcgttggggtgggaaggtggcttcactgcctcctggtctacgaggtgacccagaacttcctcgtgcccacagagatcccgctgtgcgctggctgtgaccagcacatcctggaccgcttcatcctcaaggctctggaccgccactggcacagcaagtgtctcaagtgcagcgactgccacacgccactggccgagcgctgcttcagccgaggggagagcgtttactgcaaggacgactttttcaagtgagccccgaaacctcacctcagtgtgggagcggagggcacgcctgccccagggactcctcccctcacaatcaccaaggccaggccctcgaagcctgcgtctctcgcaatcccagcccactcctgtcacccaggcagggcaccctgtggcctggccaaattaagggtggggcctctccatgggtgctccctgggtggctgggcctggctgggacatcagcaagtattatttggaaaaaaaagcaatttattacctaaatcacagaagcagtcattagagaagatacacccctatttgtaggattctactggacttagttcctccgaaattggtgatgttttagttcctaatgctggcacccagcggctctggcccagtggccttcatggctccagctgtggggtgtgagggactggccccagatgggtcctctccctccggattcaccttcccagatccagcatgggtcctgcaggcaatggcggctgggctccccgaggtctttctgagattgaggttcccttctcagtgggagtgggcagctctgccccggcggccaggctggcgaccaccctgcagggccggacagagccttcctccggggccgccttcccaggcagccgcttgcctctctccaacccgctcggggcgaaatgagcctcgcgcttccgcgctgagcccggccctgtgcgtcccgcaggcgcttcgggaccaagtgcgccgcgtgccagctgggcatcccgcccacgcaggtggtgcgccgcgcccaggacttcgtgtaccacctgcactgctttgcctgcgtcgtgtgcaagcggcagctggccacgggcgacgagttctacctcatggaggacagccggctcgtgtgcaaggcggactacgaaaccgccaagcagcgaggtcagccgaggggacgacgctcccacctttcctggtctgaaaaaaatggggctgaggccacgcccaggggggcgtccggggaaattctctccccaagcgctcactaagggggcctgggctagggcggtgtaggcagcaggaagccgaggccgggaacggcggagtcacggacagacccgcgtcccgaaccgcttcgttcggtccgaagtgtgcggcttttcgcccctggtcggaattatcgccctaaattcttggccgcgaaggctgggccatacccacacccttagaataaaggggagcccgcggggaaatcagggtgcttggagaagggagccaaggctgaaggcgggggcgccgtggaggtgcgattttagggaaggcgccgcccccgcccccgcggcagaacccgccctccgccggcgccccctccaccccagcccgggtgctgcccgtttttgccaatcgctcccagcgcccgcgccttccgagaagcctgtggggcgggatgggggtgggcacctgaggccccgacgtccccgcgccggccggggtgggagggctgggggtccggccggggccggaggggctgccgcgcctcaccgctcgcccgccgcgcagaggccgaggccacggccaagcggccgcgcacgaccatcaccgccaagcagctggagacgctgaagagcgcttacaacacctcgcccaagccggcgcgccacgtgcgcgagcagctctcgtccgagacgggcctggacatgcgcgtggtgcaggtcagcgctcgcccctgcttccctcccgcccgcggccttgggggcccccgcagagccgggcggccgctcaccccgccccgcccccaggtttggttccagaaccgccgggccaaggagaagaggctgaagaaggacgccggccggcagcgctgggggcagtatttccgcaacatgaagcgctcccgcggcggctccaagtcggacaaggacagcgttcaggaggggcaggacagcgacgctgaggtctccttccccggtaggcggagggatcgcggagctcggggggggacgagcgcgcgtcggcggggtcgcaggggtcccagggagcccgcgg

SEQ ID NO: 5730 - DNA, 6343 bp, Homo sapiens
cggcagggcgggacggggctgcggctcaccatggaatagccgtacacgtgaatcttcttgtcctgactctggtgggagatgcgcccgccgcccagacactcacagtcgcagccttgcttctgcatgtcgcccgacactttgtcgtagatgtccgctgggatgggagggcggcctcaggacgtgccctggccgcccttggaggccgcgggaggaactcccagccgaaggggtctgaaatcccagctctgaacagccccttccccaggagagacgaagccccttgaggctgggacagggatgaatgagcgaaggagggtggaaccggggagggcgcgggaactgggagactgctggggagggtgtcaggccgtgtcacgcccttcccgcccaggacctcagcctgggtcaaacctagcaggggcaggactcggagcagagcgcagtccgctacggcccgcagccccgcccccgccccgccagccccgcccctgcctcgtcagccccgtctccgtcccgccagccccgcccccgcctcgccaggcgtgcccctggcatgcccgcaggtcccgccctcaccatggtactcagcccacttgtagccgcgcacgatctccttgctctctgcagccggagccccggagcggggagccgagtggactcggatcagcacatacttgaagacgccgtcggagtcgatgtccacatcaggaatgagagcgaggtccgccaccgccatgttcctcctcccggagtcccctcctcccacccgacccgggggccgcttgtactgcgggaggcgggctctgcgagagcgacgaccaatcccgtcggggaatgcttcccaaggcccagcgcctcagccaattgtaccgccgaccgaggcacgtgctgaccaatcgcaatccagttccttgccgccttgcggctccgccagccccgcttaaaggaaacgtggaatcgggaatgggtggtgatgaaatccagccaacggagaagttcctctccagcggggtccggtggcacccttggaacggggcagttaggcggcccgcgaggctggggcaacgagggaggcctgagggacttgccagccctgacctcctgtcccgcacgtagtccgaagaccaccctccccgtggcccccaccgcccaaaggcctccctctctccccctcccaccgcccgaaggcctcccccctccccgctctccaccgcccgaaggcctcgctctccaccccctccaccgcccgaaggactccctctcttccccgtccaccgcccgaaggcctctccctttctcctctccaccgaccgaaggcttccgtccccaaccccgctaccggtacaaggaggcaacggcagccgctacattcaagttctattttacttggttcgaaagctcttgccccctggaaattattccggtccaggggcgttcccggccggccctcaggggtggggccgaatgcagaggccctggggtagggggcgcggggcgcggcggcgggtgggcaagcgggacgcctggccggtgcagacgcgcggggacgagatgggcgtgccgggtgcgaaagcaggagcggaggcgggggtgcccaatttctctcacttggtgccccctcccctggctccgaagtagggctggggactccaggagggcccttgcgtttggcctccacccctctcccgcataccccaccctccagagagctctgggcgcggaccagggtgcacttgggggacaggtggaggccgggccgccgggcttgcgcctccacgcccgcagtacggcgtgcggccagagcgggtgtgcggggacctctcgggacaggtcaagccccctcgggtgggcttccacgcttaccaactagctctctccctcacctgctcgcaccacgctttgccctccaggctcccacctgggaacgccccgtcccttggtccttcctctcctagccaggtgtcagctctggccaggcccaggtgctctgcttcccctgttcaggtcccctgccccttcggctgggagacttgcatatcggcctgaagacctccctgcggtttttcccagctcctgcagggcccagactgcagcggctggaggcgaagggacggcagggcgcgtggcgtggttagtgtgctggctccgaccagcgggaacgcactgcgcaccgtccgccctgcccaccgcctcggcgggacgcgctcgcgcacacggacgcacagaggtcgaccagggtgttctccagcgaggaggcaacacagccgcgggaggcggggcggggcgtgtttaaagtgacagactgggctttggttacgtcgggcttctggacgaggggaaaccggagtcggggaggctccagcgagagccccgcggaccgacggggaccggatctctacgggtggggtctgtgcagtagtgacccctccgagtgaaggcagagctcggcggtcctcaggcccaccccgcctcccagcggggagcaccgagggcgaggaccgacttcttctggggatcctcgagggcgagctgggagagggaggaggcccggaggagggagaggggttgctgggggtgggaaggcgaagggcctgtgaggaacactacggggacgaagggccggggggtgggggcctgggcggagctggaggccgaactgagcggagcttggaaggctggggaattagaggcggggcctagaagaagtcggggtggggccctggcggggctcgggggcggccctgggtgggccgggcggggcctgagtgggcagggcagggttcgggccagcgcctgggctaggcctggtgggcccggcgcctcacatgatgtcgtccagcaggttggcgctggccacccagtcgagcgcgcgcggctcggaggcggccatgatcatgcacatgaaggggcggccggtgcgccggtccgtggggtagatggtggtgggcgtgaagcgcctgttggcctcgacgaactcgcaaagctgctcgtagacgcgcgggaactcgtggcgcaggaagacgccgcgcagccgcagctcgcgctggatgtggatgaaggccacctcgcgcgcgcgccggcccgcctcgccgtcctgatccaggcccgccgtgcccggcggtggcgtcaggatcagcgtctccatgtcgggctcgcggctccgcgccgggggcggccgcgcggggctgccggccgccagcgctaccttggcgaacttgcgcactgttggcccgtggctgcgtggcgcgggcgcgggcagggccggtgtccccggtggcgcggtgccgggtcccacggccacggacacgctgagcaggaagcactctgccggttcgtagaggcgcccagcggccgccagctcgcgcgcgtagctgcccaggggcgccgcgtgtgtggccagctcacgcagcgataggtaggtgggggatagcagcagcccctccaggccaaagcgcaggaagttgtcggccgagcctggacttgggaagcccaggaagagcacgccgcggccgcgcgacaggaagccgacacgcgcgatgcgcgagaaagcgcggtgcaccgggccgctgtcgcggcaaaactgcagtacgtggcggcacacgctgcccacgcggccgtacacgcagcgcgccttgtgggcgtcccagtcctcgcggcggcacaggcgcgagcagtagtaggtgtagcagctgtggcaggacttgaagtagaggcaggcgttgaacatggtctcggtgcgccggcagcgcgcattggagcaggtcatcaggtcgtcctcgtcggcgctgggttcgggggacgcgtcggccgcctctcccggggccgcgggctcctcggcgctgccggccgaggcggggggcgagcgtggcggcgccagcgcgggggccccggagcccgcgggccgcgagtccagcagtcggcgcagttgggggcccaggcagtcggccgcgggctctgaggcctggccggcggtgggtcgcgagtcgatgaccaggtccgtgatgagctcgtccagctgctctaggctccgctggcggccagaggtggggccgtcgggggccgcgtggggaggtggccgcgtgcggcccccgggcaactcccaggccctggcgctcgggcgctcggtggcgcgcaggtcattgtcagtgatggtgatctcgggcgtcacgtaccagttgcggcccaggccctcgcccgcgcggcccttctccgtcagcgacgtctcggacagggacagtgcggcgtagcgtctgggagaggtggacaggttcacgacgacgggcgggcgccggccttcgggggacacgcctcgcggctcccgcacctcgcgccccagcaggttctcgtagctgcggccgcggcccaacgggtcttctcggcgcggccccggggccagaatgttgtcccaggagcgcgagtagtggcggctgtcggtggccagccggggcggactggtgccggtgccgccgtgccaggaggcgagcaacgggtcggggtcagagggcggcaccacttgcagggtgcggtacggtcgcgggccccagtccgcccaggccgggctgctgcgcgggtgcgggtacgtccgagccaggacgtcacgctcgcggtaccttccgaagtcctccgtgtaaaaggggcgggcggtggagtgggcccggggctcctcggggacatagcggggcccgtagggcaggccgtaggctcgtggagcctccccatagtaggagcgggagggcggttcctggattgggaaggtgcgcacctctcctgcgtagtagccgcccatgcgccttggactgggccccgagagctcctcggacggatagggcctggggtagtaggcgtcgaaggttgggccgggactggctgcaaagctgccccggaagccttggggctcctctgtatagaagaactgggtggggcccggcggggtggtgaagggcagactgcggcgctcggcgtagtcccggggcccaggcaggggcccgtcgcagtagaacgcccggggatccgcacagtatgagtcgctgggcgtcggggtgcgcgacagcgccatgtggcggggcccgggcaccgtgaggccgtggaactgcggggcggggcgggcccagtgcgcggcctcggtgggcccgcaggaccgcgagccccgggtggcgtgctggagcactgcgtcgtctggcttgatgtccaggcggcagcgcacgtggggggcgggacccgcgggtggctcgggcggtgcgcagcggcccgcggcggcgcacaggggcgcgacgcggccggggccgccccgctgcggctgcaacttgatgggatgcagctcgttggcaagggcgcggagcgccgggtacgcgggctcccggcgcggcgatgcctcggcccgcgccgcacgctgggcctcccgccctcggcggggcaacaccggcggcgaggcgggcgcgggcgtcaggcccgggggcgcgcggggcgcactcttggagcgggcgcggcggcgtggctcggcttcgcgggtccgggcgcgcggcacagcggactccggcggcggtggctccggcagggtctccatggccggcccgtccagcgcctccaggaagtcgaagctgcggcagtggcgcttgttgaaaggcgcgggctcagcaggccgggccacggatcgctcacatggcgagcacttggacgcgggtcccggggtcgccaccttgatgtcctggtacacggtcgacaccagcaggtccggagggtccgtacgggtcatcttaaaagaggtccccaggctggcggctccagctcacactgccttgcggggcttttgccctggggggagacgcgggtcagggcggccccctccgcagcccaggccccgctactcccccacgctggcccggcttacctggggcgcagcgggcggagcagccctggctgcgggcctgggccgagaacgcgggcgcttcctccatgccggggtcagaagcacctgcgggaggaacccagctgtccaggcgcccgtcctgcccgtccccccgtcctctccctgcgatggggcgggcgggccagaaaggcttagccgtggttgtggttcccgcggcgggagctcccgcgtgaagctccagggcctcccctcccccgactagtgacggcggggtcggctcgggtggacccctttccgggtggggtaggggagtgggggcgtggtcctggggctgcgccctctggtgtccgcagttggaaggacgggccgcatttgggccttatttataggtgttgccccaggagacgtcagtgactgcgcccccgtcacagcgcccactgcagagcgacccctccgatcgcgcacagtggaaggcga

SEQ ID NO: 5731 - DNA, 1089 bp, Homo sapiens
cgctgaggggccgcactcacccgcgcaggtaccagcaggcagccctggcgtccgcgggaggcggccgggggcgggggtccctcggtgcccatcgccgcccctgcggctgggtccgcgctccgggccggccgagctcaacgccaggaccccgtccgagcctcccagggccccgccaggcgccgcgtccgcgcccgcgcccctctgccggctccggctcgggctccaccggggcgcagggctggggaaccggagctccgcccgccgacccggagcaccgcccacgcagacccgccccgggcgagggaggggccgggcgcgcacccgcggggagggcggcgagcggggatcagccgaagtcgggagaggggcgcttccacggggcgggaaactggcgcgcgactctgggggaagtgcaggatggggggacaggggcgctcccgcgggggtggatgggggaccatagcggggctggcggggcaggggccggcgcacgaggctggaggaggggagcgcgcgcttctacccgggctgggtcgccgaggtccgcggcgcatcgtggcggcggtgggcggaggggggcggggggcacctcttctcccttgtggcgcaggtgggcgcgctctggaccggcttgacgacccctccccgccgccccacctccctggccaaaggttctcagcttctaatcagggacatttctagtccacagcctcgaagccatgggttctccccggccctctgaagccgccacacctgtgccagccggccgcgtcctcagacctttccccgcggagtcttcccagcacttggagacgcagcgcagggccccgaggacggcctggcccggagaaaagataccgaagctccaactttccccaaccccgctcccctcctccttccaccctcccttcccgcccccaaagctcgggggtcctatccctcctccggtccgcggagtctcccgaaccctgcggggacccggcgctcggcggtgccctcctggggcgcacggggctggggcgggagcgaggagaccaggtggggaggggaccccagatctcagacgccaggggagacggcgtttcccgc

SEQ ID NO: 5732 - DNA, 1020 bp, Homo sapiens
cgcagagatcgcagagaccaaggaggcgcccgcggctgcagagctgcagagcgggatctcttcgagctgtctgtgtccgggcagccggcgcgcaactgagccagaggacagcgcatcctttcggcgcgggccggcagggcccctgcggtcggcaagctggctccccgggtggccaccgggacccccgagcccaatggcgggggcggcggcaaaatcgacaacactgtagagatcacccccacctccaacggagtaagtgcccgagccccaggtggcgacgccatcctctcccagcacccccgcccccgcggagcgtctggcattttcctcctgcgcatccctcgcccctgactgccttcctagccctccctcccacctgccccctgcccttgctctgcggtttcctccgcttcacccttctcctgccaccccctgccccccaacagcaggtcgggaccctcggagatgcggtgcccacggagcagctgcagggtgagcgggagcgcgagcgggagggggagggagacgcgggcggcgacggactgggcagcagcctgtcgctggccgtgcccccaggccccctcagctttgaggcgctgctcgcccaggtgggggcgctgggcggcggccagcagctgcagctcggcctctgctgcctgccggtgctcttcgtggctctgggcatggcctcggaccccatcttcacgctggcgcccccgctgcattgccactacggggccttcccccctaatgcctctggctgggagcagcctcccaatgccagcggcgtcagcgtcgccagcgctgccctagcagccagcgccgccagccgtgtcgccaccagtaccgacccctcgtgcagcggcttcgccccgccggacttcaaccattgcctcaaggattgggactataatggccttcctgtgctcaccaccaacgccatcggccaggtgaggcggccaggcgggccgcgggtctgggggcgggcagagagcggcgagggcggggcctcacgcccgc

SEQ ID NO: 5733 - DNA, 6343 bp, Homo sapiens; identical to SEQ ID NO: 5730

SEQ ID NO: 5734 - DNA, 1109 bp, Homo sapiens
cgacatagggtggcgtgcagggagcgtgctttggcaccaggcgggcgcgagggggcagggcgcacgcccgggacacgccttagggaaaccgctcctgggcttggtagctgaacttagacgtcgagtgcagcccgcccggtgcgcgcggcgtcttactgccagatctcggaaatcagctgccagggtggggccgcgttttggcgacggccactcggccacccctgccgctcccgcctctcccaagagatttttctagcgggttaatttcctgtccgggtaaaccctttggtgagtccctcgcccctccctccccgcccctcccctctccatccctgctgtcccggctccccagtccgtccgcgccgcgctccatcgcccccgcacgcccgggcgcacgccctccccgcccgggccgccctctggctccccgcgcccggcagccagtgcctcaccgcgccgtcccgcgccagggctcgctccgagagccgcttccttctcgccgcggccggcgcgggccccccggccatgcgcccccgagccccagcctgcgccgccgcggcgctcgggctctgcagccttctgctgctgctcgcgcccgggcacgcgtgccccgcgggctgcgcctgcaccgacccgcacaccgtggactgccgcgaccgcgggctgcccagcgtgccagaccctttccccctggacgtgcgcaagctgctggtggccggcaaccgcatccagcggatccccgaggacttcttcatcttctacggcgacctggtctacctggacttcaggaacaactcgctgcgctcgctggaggagggcacgttcagcggctcggccaagctcgtgttcctcgacctcagctacaacaacttgacccagctgggcgccggcgccttccgctcggccgggaggctggtgaagcttagcctggctaacaacaacctggtgggcgtgcacgaggacgccttcgagaccctggagtcgctgcaggtgctggagctcaacgacaacaacctgcgcagcctcagcgtggccgccctggccgcgctgcccgcgctgcgctccctgcgtctggacgggaacccctggctgtgcgactgtgacttcgc

SEQ ID NO: 5735 - DNA, 1109 bp, Homo sapiens; identical to SEQ ID NO: 5734

SEQ ID NO: 5736 - DNA, 1384 bp, Homo sapiens
cggaagggacccgccggctgcgcctcgctcaggctggccggggccggtgtgaccgtgtgaccccgtgcacactgcgctcgggttttcgtgaatgacagcagcctgcaactcccagccggagagcagcggtggccaccgccgggcggaaagggttacaagccagaatgcaaagcgatttcgccccgggtgtgggggaccccgggtccccggccacctccgaggccgggcgtgctctgctcgccttcctccgccctgggcgccggggcgatcctaccttgcgctccaagctgggggttctccatgttcgtcgccgccgagtcccccgccgccgaggcgctggccgcggctcccgggcccgggccggggccgccgccgccgctcagttccgccagtctccggttggtggccgtgagttcggctcgcaggttggtcacctcctggctggccgactggaccgccccatcgatgcggagcgcgagctgcttattgtcttccatcatgctcaggattttggcctgggggcgagagaggtgacaaagagctgcatgatgcgcggggggcgcgcggccgggcacccccggctctacctgttgtgtcctccgcggcccggcttcgcccgcgccccgacccccaggcaccggcagcgccggttcctccggcacaggaatgacagcggcgcctccagccctagccgcggcggtggcgaggcggcggggggaggaggcggaggagaaaaaagaggaggagaaggaggaggaggagcagcgatcgccgagaccccggcgggcgggcgccgagagctgctccaagaaggacaccgcgcgccaccaggcactctttaaatggagcctaccattcgccgccggctcgggagggggtctcggtcggaggctgggggcacccttggcctcccgcgcccccgtacttcggagacacaccccccgggggggcggaggcggcggacggcagtcgggagggggccaaggtggcgcccctggcgaggggcaggggtcgcctggaccgaggccggccctctgtcccctcccttgagcggtggggcagcccccgccctggagaactggtgccccgagccgtgctaaggttggggaggtgctgggtgctcggaagagagggtgcttggaaagggggcctcagaggggagccggggtggatctccatggaagggagacgcttgcgccagctcaggagtggagttcgtgctccaccggttccttaaactgcgagtacgaaatccccagaggggagctgagctggtgccccgcgtgcctctcactctccaccccccacccgcaggccagacctgcgctgcccaccccaggagggagcgcctatcttcctcggcgtgggccgctggtgctcccgc

SEQ ID NO: 5737 - DNA, 1384 bp, Homo sapiens; identical to SEQ ID NO: 5736

SEQ ID NO: 5738 - DNA, 835 bp, Homo sapiens
cgtgaagccggcgccactcagtccctcccgctaactgcccatcctctccggccattgcctcccgagtgcccatcgagtgcccgtgggtcagcgagcggggccgctggaggaaggggcgggtgtgcccagggctggcggcgggcccggggtccctgggaggaaagggccgctcgctcagccccctcccggagcccagagacggccccggcggcgcgggcacacaggggcacatagcgcggggcggagggagggggtggcggcaccgtccgtggagggcgcgggctcgcttagccttccgcaccggcgctccctcgcgcggtgccccttccgcacactcacacgcactcattcccacagctacacactccagcacctgcaggcacaaacgcttgcagggacacaccacgacacagacacccaagcacacacaggtatcggctcatagactcgtccctgagtcacacacaggtatcggctcaaaggcacaggcaggctcatagactggtccctgagtcacacatagcccagactcagatgcacacacacagatgggaacgctcgcctgcacgtgcacagacacacggacacacccgcacaccaccgcggggttccgagcacacacgcgccccggcagacgctcacagacacacgcagggccgggagcgcacacacacagacacaggctcatatagacagactcggtcctaaaaatacgcactcgcagaggcaaaggctagcgcacaagcacgcacagacacaccgacaggcggcccccggacaccgcgctccctgccgcactcacggcccacgcaagggctcacacacggcctcacgg

SEQ ID NO: 5739 - DNA, 2248 bp, Homo sapiens
cggttcccgggtcagtctcccgctgccaccgccgtccagccagcgcccgccgcgtgggagccgcgaggccaggctccgcagacggcgggctcccggtctcgctgctcccggcgggcgcgtctcctccagctggtccggccgctgggctgccgccgtctcccagctcgcggtgccagctctcgcgctccacgcctggctcccgggctccgtgccctcgcagtagaagggactggggccggcggggcgggtggggacgtctgggaagcgaggagagtcctcgttctccgggcgtccccctacaatggggccagggtccccttccccgccccccgcgcaggtgtgagcgcgcgagtgtgcgcctcggcaagtgtgagtgtgaagtgtgtgtgcgcgggggagtgcgcggagggagcgcgggcggcgggcggcgcgggaggcgggaggcagggcgcaggggagggggctgggagggagagtgtgcgcgcgtgcaactccactccggggctttgtgcgagcccgggcgatagcatcggcggcggctggaggaggagcggccggagacgcgtgcagcccgcccgccagagcccggcagccggggcaggtgggagcccgcgcgggagccgagccgacgcgagtcggagccggagccgagtccgagcggagtccgggcggagcccaggagcctcgctcgcgggcagcccgtgggcggcagccaggcggggcgggcgccggcggggcggccccccagtaagatgtgcgcggcgccgcggggcgccccccacttgcagcggcgctcgggagccgggcggctgggccaggcggcgccttcggggctgctgcgcgcccgcgcctagagctgccgccccagggagcccgccacggccgcgccccgggcacgctcggcggcgcccaacgatgaccgctccctggcggcgcctccggagtctggtttgggaatactgggccgggctcctcgtgtgcgccttctggatcccggactcgcgcgggatgccccacgtcatccggatcggtaagcgctccctggagccgggggtctccgtgcgcccgggagggggcgggaatgagggggcctcccaacgcgttccggagagattttcctaacctctctccgagctgctgagccgatcggtgaccaccaggagctcctccctgtgaggacaaagttccagagtcggggtcacgggccttacttattggggaggaggccgccgggccgcagtgggcgaggggcccttggcgcgctcctgggaggtcagacctggcacagtgtggcgaaggtttccagtgcgatcccgagtcgagggcgcatttcgcggtgactgccagcatgaaccgcagccgaccgagttctgcgatcgggcttctccgcagagtggggaccctggggaaggcgccaacttctctcctctgcccacctcactccccgcgggcccttcgtccccacctctggcatagctcgagcagccgcagcgaggtcgcagggcacagattcgcatgacgagggcagccggtcttctctcctggtggtcgcccttggcctcggtggtaccggttcagccccgtgccatggggcgggggttgggggagcaggaccccgctgcccgctgcagctggtccctcggggccaaggcctctctcccgcctggggcagtgcaggtagagggaagggacgatggaggccgcccagtgcggcccgggcaggcggcccagggacgccagcggtttttaaagttagcccgaattcctccgcagctggcggcggctggcggggctgcgcgcggctttccggggctccggcttctccgcgtctcttctcgccggagactcttactccggtctttaactttgttgtggccgcccaaggcaccctgcaggcctgagcgccgcgcatgtcccgggccgacgaccggcagggctgggcctggccgggctaagacggagcctccatcaccgcaggccctgcgcccgccaccaggccggacacctgggccgcctgggttcactcggcgccagcaccagcgcctggcaccaggcgagccggactccgccgagccagggccaccttcctcctctacagctcttcttcagggcggaccttgggctgccagcggcgtgaaagaggtgccggaaccggtgtcgggcttggtttccgtacttgagattttcctaggaggcggtcagaaacccagcgggtgggtctcctcctgggcggccgcccgggagccgg

SEQ ID NO: 5740 - DNA, 3541 bp, Homo sapiens
cgaggctggacagctcccggcctgcacgccggatttctggagagcccgagccccttccctgagcccatccttctcctctcccggggcgtgatcccaccacgaccacagccgatgagccgttcaagctgggagaaggagcgagaaggctgcagcggcgcaggtcagatacccctgggcccaacgtccacccccaactagcgcccttgccagcagcgttttccccggagccacagtctccacctcgagatcttctccttctggaaccccggagcgcggccgggtaccaggggctcgcgtaggactgtagaaccgctgccgcccgccgtcccagccccagctgcccgcgcggtactcacctgggcctcagtgcccgggagaaggtgtgcccgcgcgaggcgtgaagccagagtccgtccgactccgcccgcaccggacgcgctctcagggcagaggaggtcggcggagttgtgacgctgggactagaggaaggagaaggaaagccgagacgggccgggcagacgcgccgaggagcgcccagtgcacgctggcagccgcgggaggcgaggcgggcgcggtgagcagtcgcgccggaaccgagccgcgaatccgcgccgcctcgcgctcgcagccgccaggacccgcgggaatcctggtccgccggcagcggtactgaggagggaggggcgcggggctgagccgcttctcggagcccgagcgcctcccggagccggcaatccctgctgcccgggcgggatgcgggcgggaattcagctcgcgtggaatgtgggaccggccgggctcggagtctccagcgctgggggaaagcggggcccacacagccaggacgagagggggtgcggtcccagggccacccccgcgccactccccacgtggcggccgcgcccccggggcgtgagtgtgtacgcggacggtaggggggccgtgaatgaagccccagcggccaatcagcacggccggcgcgcgggaccccgggagcgacgcccaatggagagctctgggcggccgggcagggtggcgggcgggcgcgcggggcgggggccgggcaggggaggcgggaggcagctccgcgggcagccaatgggcggcgggcggggtggggctccggagcgccgagcgggtcggggctttaagccggcggagcgaggcggcggggcccgcagacggagcggagcggcggcggcggcgcggcgcagggcgcggggcggcatggccaccaccgcgcagtacctgccgcggggccccggtggcggagccgggggcaccgggccgcttatgcacccggacgccgcggcggcggcggcggcggcggcggccgcggagcgattgcatgcaggggccgcgtaccgcgaagtgcagaagctgatgcaccacgagtggctgggcgcgggcgcgggccaccccgtgggcctagcgcacccccagtggctacccacgggaggaggcggcggcggcgattgggccggcggcccgcacctagaacacggcaaggcaggcggcggcggcaccggccgagccgacgacggcggcggcggcggaggtttccacgcgcgcctggtgcaccagggggcggcccacgcgggcgcggcatgggcgcagggcagcacagcgcaccacttgggcccggccatgtcgccctcgcccggggccagcgggggccaccagccccagccgctcgggctgtacgcgcaggcggcctacccggggggcggcggcggcggcctggccgggatgctggcggcgggcggtggcggcgcggggccgggcctgcaccacgcgctgcacgaggatggccacgaggcgcagctggagccgtcgccgccgccgcatctgggcgcccacggacacgcacacggacatgcacacgcgggcggcctgcacgcggcggcggcgcacctgcacccgggcgcgggcggcggcggctcatcggtgggcgagcactcggacgaggatgcgcccagctcggacgacctggagcagttcgccaagcagttcaagcagcggcgcatcaagctgggctttacgcaggccgacgtggggctggcgctgggcacgctctacggtaacgtgttctcgcagaccaccatctgccgcttcgaggccctgcagctgagcttcaagaacatgtgcaagctcaagccgctgctcaacaagtggctggaggagaccgactcgtccagcggcagccccaccaacctggacaagatcgcggcgcagggccgcaagcgcaagaagcgcacgtccatcgaggtgggggtcaaaggcgcgctcgagagccactttctcaagtgccccaagccctcggcgcacgagatcaccggcttggcagacagcctgcagctggagaaggaggtggtgcgcgtctggttctgcaaccggcggcagaaggagaagcgcatgacccctgcggccggcgcgggccacccgcccatggacgatgtatacgcgcctggggagctagggcctggcgggggcggcgcatcgccaccctccgcgcccccaccgcccccgccggcggcgctgcaccaccaccaccaccacacactgcccggctcagtgcagtgaccccgcgggccgggcccccgccggcgcgctgcagggcgcgggcgcgcagcccgcccgcgcggcctggactctttttgttcggttgctttggattttacaaaaaaaaaaaaaagcccagaaactttcgaacaaaaccaaacacccggacgaccctctccggtgagcggcgaagacagcccggtaggctgcgtcgcccgagccccgggagagaggagcgaagatccggaactcgccaactcaccccgggcatcctgcccgccgcctgctctctgcccccatcccctcgacgacccccgcccctgcccccccgggctgttcggggccggatcccggcagcggcctccccaaagcgacaggtaacgcagtgcggggttagggattccccgggagagaggacgaagcgaggagagttctccatcccctctccccgcgtggactcctgagcctgcgggtccagggtggggggctgtcactttattcgctacacgcctcttctctcctataaggatgcgccccaccccgctttcccctttctccgggcttggttttttacggtttttatttattcgtggagcctctcggctcctggggtccttctaactccgcccgcgcccttaatttaaatcgcagtatactgtatttatcggggccccggaggggaggtcgcgagagccgcgtctgtgtataaaagcaggaaatagccaaagctttaatctagcctaatttatttttccccttatatttccctaccctaccctccccccaaaaaaaagcaaaaaaaaaaaaaaaaaactaacaaaaaaaattcgagtgttcatttttcgtttcgtttcatccgagccccggcttggttcccggccacgccggaggggtctgcgctcccacacacccagacgggaaggggcttctgccctgctgcagaccgaccgccgcatagcgcggcccctgctccccgcgg

SEQ ID NO: 5741 - DNA, 1513 bp, Homo sapiens
cgcaagaacggcccagcgaaccctgtgtaggggaggcgccgaggattggagaggctctgctaagggccccgctgggcggaaggcgcgcgctccctcccatgggaaagacagatgtggggctaatgaaagggaggccgagaggcgcggggacggccggggagacgggggcgtggcggggagaggaaagctcccggagaaagccgatcggaccaccgcaagcgaggcatgcagcggagtccggaggaggaaggcgccggggactggggcagggccagggcgggacgggggtggggggtgtggggggtaccacaggcagttggacccgagggtcctgagctgaaactcaacacccgcctttggaaggatcgtccctctttctcctccgccccttcccttcccctcccctttcccctccctcctttctcttaatccccaggacggagccctgcgcgggagaggagagggcctgaggggaggagaaaggaacagcactgagaggggccaggagcccaggaaggggagggaagggcagccgcgggccaggggtgagcctgcgggccacgcgcgacccccggagccttcgcagccctctcagtgtccccactcccagcccaggcgagtccacaggacccgggcccctgctcctccctcgccttctctttgctccttcttttgctttgtggcctttctttcccttcccagagacacctgggagctgcccccaagctttggggcgccccgcggggccctgccaagggtgcgtgtgagagagggcggcggagccggcgccgggtgccaggggccgagggtgggagcgggagctcgtggccctgcgccctggagccgaggactggaagggggctgggcccctccgccgcctgggcgcaggccgcgcgtcgggaaggcagtcccgcctgttccaggggtgcctgcgtgctggttgctgctgcccggggcgaggcgccgtagcggcgacctcagacccccgggcgcgctgagtgagtgcgcgcgtgaaaaccgccgcaccgccgggggtgcgagtgtctgggccgaagcggccactccagcgacccagccccacggccacgctctcgggggcctttggctccaggcaacttggggcaagcgtctcagttctcgctctcccttcctcccagcggggtcgccgcagaccccagccctgggagcaccgctctgcagcgcggccggcgggtggagacggttggcccctaaactcgctcgtccagcccaaccgccccggcggcttctcccagccctcgaggctctcctgagcggcctggagaggcgtcgagcgcagcccagcgcccgcctgctcacccgccccggcccgggaagggaattttcggatcctgcgagcccggggcgcccccgcggcctagggcgggcagctcccggggcctggccgagccggtggcgcccgggaggccgcggggacagcacgcagcgcgcgcccttggatgccgtcccgcagcgacgccccggcccgccccgc

SEQ ID NO: 5742 - DNA, 3541 bp, Homo sapiens; identical to SEQ ID NO: 5740

SEQ ID NO: 5743 - DNA, 558 bp, Homo sapiens
cgtgcctggctctcggaaagtgcggacgagacggtgtgggtgggctaggagttatttgcaagggtgcttgcaaaccgtgaagcctagaggagaacgggagaaggatggaaccgagcggagaggggaggtgtatggtaagaaccccgctcgccccgggttgaaggggagctgtgggtcggcggtcaacgcttgaaggagaggggttccgggtggcgggaggcggctggggacccgcgcaggccagcgtgccggcccctcccagcccatcgctgccgccgccggggctgctccaagggagccaagcggagtgggagcgggtctgcgcgtctctgctctgcgcgcaggggcgggggggcccaggacggggcgccctttcccacccacatgctgatctaggatctccaagcggctcggcccaggacaccgcctggaaacccagccgcgtgggagagggcgaccccacctccaacccccttgctgtgcgccggcccagcccctagaagtcagcggacggcggaggaggtggcccggcctctcttggtggtcctgcgctctcgg

SEQ ID NO: 5744 - DNA, 7244 bp, Homo sapiens
cgcatctgctgggccgcctcgggttcccgagtcctcgtggctacacccttggcttctgcgggatccccggtccggagtggggaaatctcacggtgacctggcctcaagcgagaaggatacctgggccaccgccccctcaaaagctaggcagatttgtatagtttatttcgttttcggtttaatagaatttcccgaaaactttgtccaaaggagctctgggagcaggcgcctggcggcccctgcgcggaatccggcggttgtcggcgctcttcccccgaccccatggctcacctacccaggtgcagccggggctagacatacttggcctcggaacctccaggtgttggaaggtggggtctgggtcctgcgctcctagaggacatattatccctgaagcactcccttatcctcacttcacgcgggagaccctcgcgggggctgacacccttctctctcctaaacccattcacagactccagcaagtggcattttctgggagcgagtaaccagctttttatcgctatcatagaccttgtccgtgtcggagcgccctcgcgccggggcctggtgaactttctggaagctctccgcccggtcctccagcgaatcacccccacccactcctccctccagcctcagcctcccggtgggcatcttccagggctcttccggggcgccaggttctgcggtcttcgggtgggggcccgttagtcgcaccgtccttcccccacccccattcctgggctcagaagctgatagactgacaagacgcggcccagtagtcgtgccaggcggaatgggctgcgtcctgaggccgcgacgacccgggccgagtctgcgcgcccagattcccgccggcctggaggttcgaaagagcaacgcagagacgcacggtcaagagtggagggagaacgacaggaacgctcattttcctcattatttaaacgaattttctttattctgaaggagagagagaaaagtagagaacaaaaacgagagtgacagaacattagaaattagagggaaaaacagaattagagggaaaaacagaactttagaaattagaggggaaaagacacagagataaaatcagagctacagaaaccgagggcgactcgcccgagggccgcggcattaattccagatgtttgaaaggcaacagcctttcaaaaaggaaacaaaatctgaaacctgttacctcttctgcagaacgagctgttcctcagggccgtgacatcaagacaagacgagaataaggcgaaagttaaaactgaaaactgtccgagggggcctcccagcagtgactttgtctcttgccgggaaggtcggacagaccgatgcgcgtcctgagtttaagagaatctgcggagacacagaggccactttttactttcgtttagaaaagaaaaaaaaaggggggggggctatttgttcatttgcaataacgacaaaaagaatcccaccaccacggaaaagaaatcgagatgctgaaaagtgaggaaaagagagctcaaaaggggctgagggacgcgaaaagaggggcggggagaggaaaggctcagggcgcgagggacgtggcgggcaccgacaggaagtgcaatctcatttctcttcgctgagcttctctttaaacacgaaaatcttcataaaccacacttaccctccaggatgactatcgtatcaggacttttaaaataaagtaactgagctttaaggagacaggaggaaaaaaccaaagcagcccccaactaccccaaactcgtcggatttgggagcgcgccgaaacatagcaggaagaaggcaggaaaaatcgtcctggcatttatgccttgaacaccctcccttccccacccccgcacccttgtcccgcccctaccccgaccgcagtaattgaattgtcacctgccccccatcccgcctcagggctccagagccacttgggaagctcggctttgccaagcgccccaggccagtaagagcggtgcagccgagccggcgccccagaagccgagaggttacacaagtctacgcagagaggcgcaccggacacggtaattaggagcaattcacacgctctcgggcgcacggaaactacttgtcaggaaattttcaacgctcctcctcgcccacttttttccactcctttcctggcgcgccccctcccctcccagaggcacgcagtggagcttttggagtttcgaatctttcggacactgcagaatgcggggctccccgggcgcgggcccggccaatcagagcgccgtctgcctcccctggccaatggcaggcgccacattgttgtccaattctgtctaatggagccctaaggaccaacaatagagcgggcgagcggctcattgagagtctggcagcgccgggcaactgggccccggctgcgcgcagcgtccggcgcgcaccgcgaggggacccggcacggcgagagtcaggtcgcgggttccaaccacgcggcccgcagacgagcctccgacccggatttctgaagggagggttggactgcgctgcgttctgaggggtccggaagttcggacatggtgactgaaggagggtgacgtggtcagataaggggccgggggcaaagggaagcggccaagagctccagcgtcgccagtggagccgggaggcgcgtgcagcgccagcggaggaggaggatcccggagcccaaggcaggtagttgagggccgcagggagagcagtgggtggagacctggtctgcggcccctgttgaggaggcctgggccccgtgggccttagggacgcccgaagggtctgggagaggaggcaacgctcatagagaggaggtctgggactctcggacggagacacaaggactctgtcgcgggctctggcagggacggggaacgcgggaagcagaggagaccgcggcagaagcggggagctgggcctgcttgggccttatggggctgcggcgtgggagggactctggtgtccgtttatggccagttgcgaaggcgactcccctggcttggtgcggcctgctgggccatccgtgtcctaggaccccaactctgagatcagaacgcaggagcctgcgctcgagaggggtcccctgggaccccaagacggggagggcgtgtctgacgactctgtccctaaacccggaggggaggggagggcagtgtgaggtggtcttcgagaaagatccccctcccgaaatgcctaacttttcgcaggatacgtcttccgccccgactactactccagactgcgaagctaaaaaactgcaccacaggttttacccaatcccctcccccagcatttgcctgtggggttttttcttacacattcccctctcccaggcgcggcccctggatcccggacacccagatcagctgcttttcactgttttccttgcccatgaagctcatctttgggctgggtttgcctatacagaaagtttctttggccgaatttttctctttaatacttcccagtcctaagctaaattccacatacattttgtctctcactctctggaggccctcaccgtggaacttttggcgctcacatttttacgggtcccagagccactgggcctaactttgcccaagttgtttcctcgtcctcactctgcttcctaaagctattctttctgttgttgatttttctctccaaagcttctgccccaaactgcattaaaaataaacaaacaaaaagaaacaaaactccggcccaaccggccttcacatctgcgccttcacatctctctcctcttcacccttccaccaaactgaccgttttgctccgggttttcctgttttgcccttggcatcagcctaacttctgggccaaaactgtcgctctaatcccagtcccgtcaaacgagcatttctctcacccgtctcaccccaattaggctaagctttggggtatcatcttaacttttccaaattctcattacagccatctgaatcagtgactttcacactttacatgtctctttattttttccagcggaatcactaattcagacaaaatcttacccctagcgtgtatatcaggtctaagagcagccatggccagactggggtgaaggtgctagggctcacaaggaggttccgactgcacctcctcccagcaattctggcccctctagcccagcctccgcggcccaaatttccctctccagcttgggttcctcaaggcggcgctttggcctagcgcgcggtgtgctcctcaccaggtctctcccctctcccaccttctttcccgtcaggtcctgtcatggagctgcgctcggagctgcccagcgtgcccggcgcggcgacggcggcggcggcaacagcgacggggccgcctgtggcgtcggtggcgtcggtggcggcagccgcggcggccgctgcatcgctaccggtgagcgtggcaggcggcttgctgcgggggccgccactgttgctgcgggcagccgagaagtacccgcggacccccaagtgcgcgcgctgtcgcaaccatggcgtggtgtcggccctcaagggccacaaacgctactgtcgctggaaggactgcctgtgcgccaagtgcacgctcatcgcggagcgccagcgtgtcatggcggcgcaggtggcgctgcgcaggcagcaggcgcaggaggagaacgaggcgcgcgagctgcagctgctctacggcactgccgaggggctggcgctggccgccgccaacggcatcatccccccgaggcccgcctacgaggtcttcggttcagtgtgcgccgccgacggcgggggacctggagcgggagcgcccgcggggaccggaggcggagcagctggcgcagggggctcaggtgagagcgcggccaggccgcaggtaggggcagcaggatcgtagctctggggcacggggcccaggggcttgtctcggttcagaaagagtagaacccccgtgtccagtcgccgcgactgctagggttcaccgctcgcccagcctcgggtatggagcgtgggtacagaaactctcctttctcccgcttctggagcatttgcactttacccctttctcctgcatcgggccgaaatgtacacgctttaatttttttactcgcctctacccaaacgcaggcaggtccctgcttctttgcttcgtcttctccccaggtggaaacctgcgcatcttcgttcgctctgcgcttctccacaggccctttccctctgctccttcccaactcccttaaggaatccccccccctttaactgacaccctaggttttgagacgccctaggttctgagacgccctagtttcttttccccttctcgcgttcctaacgccctctggacaaccgcttgctgcgccctccctccttctagtttcttccgcaccctccctggtttctcaggtctgctttcctatgtcttttcctcttcgcttcctactgcctgcctagcaccaccctctttttctggacccccgtggctttttgtggggagggaagaaattaggccagagccgttgagggaaaggagggatccgctctaaacttgggagggaagaacttctcaggtctcaattttggaaagggtggattagaaacaggggctgtacttctgcctgtagagaagcttgggacctcctagataaccaaggcgcctttccttacaggctgcactgccagggcaggcattttctatacagtgggctcttctgtacagcgtggttaggcagaagttatgttgtctcttgtttgaaccctggacctggccacttctccacggcagggcaggactggaagggcagttaagggtggaggtgttggggcacagacgtggggaaagcagcactgaacatcgagtttacagggcacaggtagttggggttctgaggagtacagaaagagagggagccctggggtcagggctgtaggggctcagagcggaaggaatgctagagcaaaaagaaagaggggcactggagcctagtgaataagggctgtggggctgagggagaggaaactgagatccaaagggccgaggtgctgtgactgctgtcttctagctaaccgctcctcacgacacgttttctcccctcccagaggccaagttgcagaagtttgacctgtttcctaagacgctgctgcaggcaggccgcccgggcagcccgctgccgccgccggtgaagcccttatcacccgacggcgcagactcggggcccgggacgtcgtccccagaggtgcggcccggctcaggctcggagaacggcgatggcgagtccttttctggttcgcccctagctcgggcctccaaagaggcaggtggcagctgcccaggcagcgctggccctggcggcggcggcgaggaggacagcccgggctccgctagccctctgggctctgaatccggttcagaggctgacaaagaagagggtgaggccgcgccggcgccagggctgggcggaggctcgggtccacggcagcggacgccgctggatatcttgacacgcgtgttcccaggccaccggcgaggcgtcctggagctggtgttgcagggctgcggcggcgacgtggtgcaggccatcgagcaggtgctgaaccaccaccgtgggggcctggcggccggcctgggccctgcggcgcccccagataaggccgccgtgggtgctgcagcagctgcagacgacgcgtggcccagccgcgtcgacgccgccgccgccgccgccgccgccgccggggggcctgggctgcctgcgccgctgcaggcggggcccgccgcacctccgcaccacagacccttgctggccggcgccatggcgcctggggcgctgggctcgctgagcagccgctcggccttctcgccgctgcagcccaacgccagtcacttcggtgccgacgcgggcgcctacccgctgggcgcgccgctcggcctcagccccctgcgcctggcctactccgcggcggcggcgcacagccgcggtctggccttcatggcgccctactccactgccggcttggtgcccacgctcggcttccgcccacccatggactacgcctttagcgatctcatgcgtgaccgctcggccgccgctgctgcggcggtgcacaaggagccgacctacggcggcggcctgtacgggcctatggtcaacggcgctccggagaagcagtagggcgaggggcctggcagccggccggtccccaaacaggaaccccagccctgttcccgcgggccatcgacccctcttcgcccagcgctctctctgcgccctggctgggcgt

SEQ ID NO: 5745 - DNA, 824 bp, Homo sapiens
cggagccgctaggagtgagcatcccctctccgggatacccagctccgcggcgtctcccgcgcgccctggccccacacggacctgccagccccagggaacaaaagcggagcccgctcgccctctactgcagccggaggatgagtcgagagggctgagcggagagtgtggtcctcggcggctggaggtaggagaatatgttgcgcccgcccgccgcggcgtgagaggctcgaggtgggcgcgccggggtaggggcggccgcgggcgcctgtccgtctagtgggcgctgcccggacctggcgaggtggtggtctgcaacactgtgcccgcactgcctactgtgggtcgggcgccgagctctcgcggccgcgagggagcctcctgggtgggaactggaggcagtgggggaaaagtctggagccagaagccaggcagcggctgccgcggcggctgtggagggctgcctgcggcacttggcggcgcgcgtctcaccgcgaagagcgggaaggcggcggctgcagtgtgcgcaaagttttgggtggcgcgcaaaggcgcaggcgagggccgccgcacagagccgcccaagttgtggccggagcgccagggcgacccctgggaaccccccaagcggaatcccccgagacaagcggctcttgctccctgacaccccagtcgaggccgagttgacgcgcagccatttaacccttcctgtcccggggaaacaacttcatccgcgtcgacgactggactctggctggctgggcagcgtcgagacttccggggggttcagtcctgtggtcttgagcatttcctcgctcagtccgcgt

SEQ ID NO: 5746 - DNA, 824 bp, Homo sapiens; identical to SEQ ID NO: 5745

SEQ ID NO: 5747 - DNA, 1415 bp, Homo sapiens
cgtccaaaatgacttcgggcgccccacttaaagagacgccttggttcaggtagcccgctggggtcgaaggccccattttcccccgatctatcgggcttcgcggcggaagtcttcgttcaggcaggggatgccctaggagggaaggaggcgacggtgcccaaggacgtcggaagccggggatctccgcttccctcgggccccggctaggttaccagtgctggcccgcggcgcgggtgcccagttgcgcctgggacactgcgggcacggctgtggcggcaacggcagcggccgccgcgtcgccgacgcccggcaggactgagcgcacggagcggcggaactcctcgttcctccacgtgtagagcagcggattgagcgcggacagggcgcagcacaggagccagctggccgcctgcactccccagggcaccggcagcgagaagccgctggccaggctcacccacaccagtggctgcgtggccagcaggaagacgcagcagagcagcagcaccgacaggccgctgagacgccgctgtgcccgccgcgggtgcagcgcgggcggcaggggctgggcctgcgccgggtgcgcggcgccaccggggcccggcgcgtgctgggcgcccgggaaggcggcggcggcggcggcgcagccgggcaactggtgcagcaggtggaagttgagcacgctgacccgcttgacgctgacacgcacgcggcgcacgatgcccaggtagcagtgcagcagcagagctgtctgcgccagcagcgccgcggcggccagcagcgccgggtagtggactcgcggtggcgcggcgccgggccgcggtgcccagggcgggagcagcagcacgaggcccagggcgagcgcccaggacagcgccagcatgcccgccgtgtggcgcctctggtacagcgcctggtaggtggcgggcgcccgggtgatgagcaggtagcggttcagggccacgaggcagtgggagaggagggacaccgtgagtccgaggcccagcagcccaccccgtagcaggcggtagctgcccccagcgccgtcccagtctgcggggggctccgcagagccggtgggcaggagcccgagcaccgcctcctgcggcatccagagggcgcagacgctgaggtcggcggcgcagccgttcacgatgaaggcgttgctggtggtctgcagctttcggaaggacgacacgagatagatgaccatgccgttggccagcgtgcccccgatggccaggcccgaatacaggagtgacaccgggatgcgccggcccgcccacgactcctcttcctcgcagagcagcagcagcgagccaccggtggtggaggaggtggatgtggaggaggagttggtcattctggccaactcttcacacctccctcgctagcgtcggcttctggcagcgcgg

SEQ ID NO: 5748 - DNA, 1415 bp, Homo sapiens; identical to SEQ ID NO: 5747

SEQ ID NO: 5749 - DNA, 3039 bp, Homo sapiens
cgggcgctcacaggcggcgcgggcagcgcgagccccggagccccggaggcctgtgcgccctgagccggcatggaccccgagcactgcgcgcctttccgcgtggggcctgcacccggcccctatgtggcctcgggggacgagcctccgggcccgcagggaacccccgccgctgcgcctcacctgcaccccgcgccgccccgcggcccgcggctgacccgctttccggcctgcgggcccctggagccctacctcccagagccggccaagccgcccgccaagtacctgcaggacctcgggcccggcccggccctcaacggcggccacttctacgagggccccgcggaaggtaacgcgcggcgcggggcgtagcgcgcagcccgaccctctcttcttcttccttacccgggcccacccgggccttcctgcttatctctcccgctcgcctatttctcaactttttgcccctctcgcctttcgccacggcttccacggaagccgggttggcgctggcccgggccaggcaaaggccagtgtggggcgggagggtgaaccaccgttcctcggcggcgggaatggaaggcgggaggtcgagggaaggtgcagtggcgacggcccggagtccagtcggggcccgaaagcagttggacctgggaaggagagagcatgctctgccgaagttggactggaactgccacctaccctgaagcccagacccggccgagggctgtggagccacactgagacctgacgaagaagcgcggcttttgtgtctggcgccctttgagggccctgaggctgggcctcaacctagagtggtcaaatcggggtcggctggggactgcggcctggtcttggcccgtctctcctccccgggcctagccttcacaggaagggtgctgcctgtgcggcagactggcacagtctggccgcgactggtcgtgcaatgccagggctgtcctcaagacggaataactgtattcttatttctcatactaagctggcctccctgccgttatgcactatgatagccgcccttctggcagtcttggcttccccgcgctggatcatcaccgctgggcagtcaggagcagccctgggcagcctaaccccctggcgccgcgggctcacgggccggtgccctgtgctaaggccggctggaccgcgccggcatccgagaatgcgcctgaaggcaggggcctggcaggctgatcggcagctctgcggccgtccgccgcaccctatgacctgtaaggcgtctcggcttccgcactgcacccaccttatctgcgctgccatatcccgcagcctaggcccagaactggatcctccaagatccgcctcaaccccctgccgccgcccggctggcgcctcgcgggcctccacggagtggccgggcatctccggctttcgcccagccggggcggtgggaatgtgtaggggagggcggggaggtgtgtgtgggtcaacggaggaaatgaacgagtccgcggagcttcgtgtctgtgccctttgaaagaggctttcctgataaaaaccacagttgggacttaatgagaagcagttggcctggctcctctgatcccagccagacggcagaggccgcgcagtgcggtgagcaccgccagagacaggtacccggcctggctcagcgctccgcgtcgggcaggagccacccccccaggcccgcgtccctgctaggcgcgccgcatccggcaccgacagctcgggcccccggaccacaccggtgccgcgcgaactgcagagagcgctggtgcggaacgagcggccgggagaaacccagcaccccgggatccgacggcaagggtggccttgacaacgaaataccgagaaagaaaaccaaagaaagcgagcgacaaccaagaaaaggggaagggaaattgaacaaaacaacggagagcgcggcgagaacgagagggtaaatggcagtcggcgagctgggatgaactaaaatgaataaatgaggaacgaacgaataaaaaaagcaggagcaagatcgaacgaaacggataactagagaagggggaaaggacaaagagggagggagcagactaaacaaaagaaaacggagcatgtttaaagcgtagaatatatcaaaatgagaacaagggggtaagaaaattaacgatttcagttgaacggaggacaggccaaacgaaagggaggcaggcgggtgcgagcagagcctggtagagatcctggcggccgctagcctctggcgctcttgccggtgttcaacgggctgccagcgtccctgcggcagagcggacctcggcgcagcgcggcgcgcggtggagcctggctgcttgaggacagtcagcccccagggccgcacagcctacttggtgggaagtggcgggcgaagagggaacccgccttatttcccggtttttaaaataaccggctcggagcgtttccagtccacacgagtgagcgcgcagctgcgccccatctgcggcgcgatctttcacgaggctgggcagttgcgcgccccagagcctggcgcacctcgctcttctcccgcctgcagtccgccgcccgcgcagccccaggccgccctttgctgagagcgcccagccttgctctgaacccaggctgcgtgctggcgctgccagccactctcgcgccgtccgcgcttggctagtctgtcccgagtttggctctgacgtcgaaacacgccctcggcaagagactcctactagagttttgcccgctgccgctgaggccctgagccggatgacccggccgatcgccaaagtcgaggagagtcccaagttcttagacccgggctgaggcttctgggccaacgctgagaacccccaagaagggcaccgaggcctcaccggggtcctgcccacggcgtttatgtccactctggctttgagtcttcggcgggagctgcaggagcctgggcctcagcgagttctgcaggtcgcttagtgaccccacagtggccggaggaaacagtgcggcgcgggacaaggctgcagcgaaatgtgaaagccaaggctggtcccgcgg

SEQ ID NO: 5750 - DNA, 1277 bp, Homo sapiens
cgcgcccctggggagcggcccacccatagtactgcgagcatccagcatcgcttcagagcacggcgcacacaggcataaatgcagcagaggcctctcgacccgccaggacggcgccccctccagatgggcaccacacgcacgtcccctgtctcagccattccgttccccagatgcgcttcccacgagggaggaagggctctctgctagctccgaatccagcgaggaccagccccaggactgagaattaaatattcatctcgggcgtgacagttctgcttcgcttgccaatgttactgtcaaggtcacaggcctgaggccgagcggctggggctggggtctccagctgcgtaagaggctcccagtggaactgcgccctgggcgcgcagtttcaagccgcggatgggccggacaggccccctccggttctccgcgggcgcttgcctccgcagctaagcccaatttcctccggagttcttgggcccttctgagcaccagaagctgaagcccggtgtccaacccgtgcgtacgccgctggggaccccgatgcgcgaaggagagcgggccccggggctccgtcgccaggcaacggcggctggagcggcgagaggagcccgggacgagcgcagggtcgggcggatgcgggggcagcgccgcctcacaccttggtcctcagccctccctggctggggcggggccagaacagggaaagttgcagtggccggcccggtaaagccaggcggggcgcggccagcgactcacctgtcacgcgtgggtagtcgcgcagactcggcccgtgcactccggccgagcagctgcgatccccgacgggtcgcggacgcacagctcctcccccgggccacaggcccccggctggggctggggcgacccggagctgcgcgccggcgcacgcgactccgctcgctcctcactccctgcctcaccaccagtcccaacctggctcccgcccgccgcgcgctcggggctcaggggagcggcgcggggacccaggtcccacggcggagagagcgcgcgggattgcgaagactggggccgagtgccgccctccctgcgccctggcagcgccggctctgcggagcagaacggagctgggcggagcgctgcgcgcactgttccctcgctttccgaaaggccaccctggcggcggggcgccgtgacgcaggcttgactcacgcgcgggccggcgtcaatgcgaggctctcgggcagcgagcgaggctctgatggccgacgtaggcggagagggtgggcgtggggcgg

SEQ ID NO: 5751 - DNA, 2394 bp, Homo sapiens
cgctgtaaatgcgctaatatcccggctgccagcgcatggcgagcgcctcccacgcccatccgtaggagcggcgtcccggccgcccctccgttcccagcctgccctgcccccgcctccttcccctcctcggccatggccacctctggacgcctgagcttcaccgtgcgcagccttctagatttacccgagcaggacgcgcaacacctgccgaggcgggagccagaaccacgcgccccccagcccgacccctgcgccgcctggctggattcggagcgcggccactacccttgtaagtgcgtggtggattgcggtgcggggtgggaggtaggaggcgtggggcagcagaatcaagggcccagcccacgaggggccggaaagccgaaatcccagcccagagtctagatttcctcagtcttggaaacgggagccctgtcctcgaacccctaacgcattcatcccggtcggcacatcctaagagcagatccctgcctggcactggtgctccgagatttggggtttctgtgtctgacgatttctagaggtcggaataattgaaatttaaaacgcgccgccacctgccgcccccaccccaccccccgccccctctccatgcctgaaaacacggccacgatctccaggcctccgtctgggatggccagtgttggcgagtttacccccaccccgttcccactcagggctccgcaaacctcggcacactgcagtgcagtcgacctggaggaggccggcgctggtgacccagcttgtgataaactggtcggccagcgcaactaccggtgcggacatgttaagagggccccggggtgggttttttcggggcacgatctcaggcccgctgatgaccgctgtggtatgaatgaggtcaccgcattcggagaggtggatgtccagatgtggactcaggaaatggcctcatcccgaaagtctcgggctagtgggcgtgccctctggccagtgcctccacgcccgcgccagaagggcagcaggccctcgtagggtccggcgtctcacccacccgtgtctcctttgctgtccctagcctcggacgagagcagcctggagaccagcccgccagactcgtcgcagcggccgtccgctaggcccgcgtctccgggctcggacgccgagaaaaggaagaagcggcgggtgctattctccaaggcgcagacgctggagttggagcggcgcttccggcagcagcggtacctgtctgcgcccgagcgcgagcagctggcgagcctgcttcgcctcacgcccacgcaggtcaagatctggttccagaatcatcgctacaagctgaagcgcgctcgcgctccaggggcggcggagtcgcctgacctggcagcatccgccgagctgcacgccgcgcccggcctgctgcgtcgcgtggtggtgccggtgcttgttcgcgacgggcagccgtgcggcggcggcggcggtggcgaggtgggaaccgccgcggcccaggagaagtgcggcgcccctccagccgccgcctgccctctgccgggctaccctgccttcggtcccggctcggcgcttggcctcttccccgcctaccagcacttagcatcccccgccctggtctcctggaactggtgaggccgcagggcggcacctggggctaccctcgactttggagcgcgctctgcgattggagcagggccggagccgaacgcctggaacgctctccgtccgcctccctgcagccccatctccttgggcgccagggtccctggcgcgccctcatcagccgtcgcgcaagcacacacgagggacgtgtgccagagccccctccctcaccttccctccaccgccagccccagagttagattttatgcttgggccttatttgtatatttttaaatagcgatttgtataggaagcaagttatttttttaaaaaatagagtatttttcctcgtagttcgagaataaaatgtgtggggttgggtcccctgcgcgcctgcggggaacgtaggcgggagtcgtgccccccagaccggtgttcgcatcgctggctcgccccttgactggctaagtggggcccggccccagctggatcgaagggcgggttgcagtcccgacacggctttaggaagatacctgggggatggaggggtggtgatgtcagggttgggcgcgggaagaaaaggagaggaggaagctgaggcaactttgggattcttgtcagcgggaggcgtcactggccccagagtgactccgactctccgctgggctcccagagctgctggcgtttcgaataccgaaaagtcaaccctgtggaccacgacagggcagaaggagtttctccggagatgagccggcgaggccaggtgcggggcgcgctgcaccggagcagcccaggccgggccgc

SEQ ID NO: 5752 - DNA, 1627 bp, Homo sapiens
cgctccgggtctggagggaggggaggctctccggaaaggggtggcgagagacccccgccacgactcccaagcttcttcgcgcgcgctggaggggacacggtgggcgcctaattctcggcgtagcagtaggtcccataggctgcctgttggggcctggggaagccgaaactgcgcactccgggatccgggagccccccgcagcgcggcctcggcgtggtgattgggaagcgcacactgccgtcagccagccagccgccgtcgcactggtctagccccgaaaacttccaggcggcgtagaggtgcccaaccttggccaccacggcgccgcgtcgccggcacgccgcgtgggcttcagacagcgtcagccgcccgggcacgaagaacacttggcctggggaccacagcgggtcaccgaccgagggcagggtgggcggagaggggcggctgacacccaggaggcggagttggggtgcgggaccgcagaggtgctggatcgagcttgggtaagaggagttgggggatcgaggcaaaagtgcagggagggtttggagaggtgagctggagcctgggcgggcgggcgggctgatgggggggcggtgccttggagggacccggagaccctgccctgatctcaagctgaggtccactcctcgtcccccacatttttcagacccctccccaagaccctgccttcgtcccgcgcctcacccgccagcgcggaggtgaagcagaaggcgtcgtagcggtcgcgcatccggtcgcggggtccgtagctgcggatcccgggccggcctcggccgccgcacggggcgcgtgcggtgagcacagggtagcgcacggagccctcgagcagccagcccgcgttacaccagtccagaccctcggtccaagctggcgggagacggcggaggtcggggataagaggcgtcataggcaggagccagactgagctcgcctggcgccctctctcgggcccctgagacagctccgcggggcttgggaagtgctgggttcggccgctcaccctggtagagctgggagtaggtggccaggcgtccgtcctgctcctcgcacgcctgcttcgcctcgtagtaattgaactggtaccggccccggctgggttggtacggaaacaccacacctagggggtggcggggatcctggggagggccagcggatgggagcggagggggaggaagggcggcgcggcctgggagagggagctggggtccccaggggtgcggaggagatactgggaaggagccctgggagacccaggcgaggcggacccgctgctacacaggaatggggcgggagcggaagggcctcaccctccaagctcaaggtcagcgccacgctctcgtcctcgatgccgttgatgagctcgcagcggtaccggccctcgtcctccaggcgcacgcccgcgatgaccagggaggcgtctagtcgatgccccctccgcatcctggcgcgccctcccaggggcccatacccccgggcgtgcagtccgttggtgatgaggatcagcgtttcccggagctccccaggctccaccttgctccagcgcaccttgtagctgggaggcgtggtgcccaggacgcagggcagcgtggccgtggccccacga

SEQ ID NO: 5753 - DNA, 271 bp, Homo sapiens
cggcccgcggagtcagcgctcctcccgcgccgacctcgggctccgggcggccgccggggggcgccgggcgcatccttcgctgccaactccccgcccgtgcccccgctcgcgcctgggccccgccgcactccagcagaagccattacagagaacaaactaccttcttgtctccgagatgggtccccggggaggaaggcaaattgcctgcctcgtgcataataagccaggcgtggagagcagcgcggaggaggccgcggcagccaccgagcgg

SEQ ID NO: 5754 - DNA, 884 bp, Homo sapiens
cgtagcattttggcgaattccttcacgtccctggtgaagctgcttcgataaacccgaaatatatgctgcagcgtctcccactgctggtcgctgaacgtgccctgggaccaaggcttcagagagcggacggtgtccgagtcgttgctccagctgtgcgtctgcagctcccccagccacgccaagccgtcggtgcgcgtccagctgctattggcgaaggacgagatctggaggcagcggagggggaaaagcctttgcgggactgggagagaatgaagattggaggcgtgtagcaagtggccgggagagcagccagcataaagagaaggaagaaagaaacaagaggagatgagcttcaggaggcggctgatgccagcgaactctgtgccgcgctgcctctccccggagccagggagcagcgagttttctacctagatcgcgccagtgcgtcccgggtctcaccagtccccatcaggcgttgccctccccgtccctacccagctccctctctccgccctcccgcgagtgcactcaagcgccctcgttccacccaccttcagcgcttccccaagcctggaggagcgcccagagcagcagaaacagcaggcaccccatatcgcccggcgtggggacctcgcggagcgccgctgcgcgccgccctctgacctgcgcactcttctcccccgccgctcagctcacgtccctttccgctgggtgccagccaattcccaagcccagaccccggcagccctcctcgctgggcttgccggcggtttgctgcttctgccgaagggcgccctcgcccttagctgtgcgagctgcaaagaggtcggggtcccaggaatcctggcgccgccgctcacttcagtaggtttcacaaccggcgt

SEQ ID NO: 5755 - DNA, 1007 bp, Homo sapiens
cgcgggcttggccctaacccagcacgcggaggcttccctctccccagccttagcgaaagggcggcgggtgggaatcacccgttaccttggcaactccctcctgccgtctgctcacaacagtttgaattacacccctgccaggcagtcaccagtccgatttctttcctttctagctctcgttttccctctcagcgctcaggctgggggcggcgtcggtgccagtctagtccagggcgaagcttccagggccggctcgggccgggctgcgggacccgccgtggagcgcaaagtgcctgaagcccccgcgcgcattcggccctgtcttcaaaggccccttagaaatgcaagaggccaggcgcagaaacacacacggacggcagttttatgagaaaatgcagataaagagcccggcggtagggccatatgttccccataatctccaaagccgtcacttcaattagagcctcccctgagttctaatgcccaatcctgagtaaacaagccgctctgaaagaagaactcggtttccaattaaaagtgtactaacatttctccttcctttaattcccgcggagcaaagccccgcgcgggcggaggcgaggccaggtcgcggcgaggtcgtcccgggtccgcgccgccccgcgccgccgcgcgttcccaggtgacgtcaggcgggcccgggattagggcccaccctgcgctccccgcgccgcgccgcagagttaattaaaagtaatgccacggtaaatccaaaggctctccgctggcggagccgcgccttcgggccagcctgcgagagagggctttccgaggcaggtgctggggatttatttgtgtgtgagtgtgagtgtgtgtgtgtgtgtccgcgcgagcgcacgtgtgagcgcttgtgctgaaagggagagtcccctggattttttggagaccgagattgccttccctctttcgctcatgcctccagccctcctcgcacatgcactagtgaagaaacgcacggacaccgtcgc

SEQ ID NO: 5756 - DNA, 2191 bp, Homo sapiens
cgccgcgccctgctcggcctcacccacccggtggcgcttgggcccgccctagtcccccacccccaccccagggcaccacctaccagggccccgccccgcctcagccccacgtgcggggccccaccccggcgctagcggccctttaaacacccccacccttacacattaccccccccccacccggacggcagccgaatagggacaaaactcatggcgtacagccagtttcctccgcggagcacgtcctgtgctgctccagccgttggggctctccaccccgggccacagcctcctggcgccccccgggccgaggcagccgggccgaggagtgtcggtgtggtccggctacggggcggggccggcgggagctccggtcgccgccgccgccgctgctgcctccgcctgcctcttgggccgcccgctcgcccgccgctgggtgcgctgcacgcggggggcagccgtggtgcagaggttcatgcagcggcggcggcggcggcggctgctgctgctgccgccgcggaggcagacagaccgggcgctgccaccgccgccctcccccggctccatgccgccgccgctgccgcctcctcctctccggcgaggggcggggggctccggcccggggtgggcaccattcctcgcagcgccgctcccctccctgccctccgcccgggcgctggagccggcgagggcacccgccgcctcctaggagtgcaccctccgcgcgccctgccggagcgagggggcgggcgtgggcggacgtcggggcagcggggaccccgcgcggctgcaagaggagggggcttccccaaggatgcccggcggctccccgctcctaggtgcgagctgagtctgaccgggagcgagcggcgcgtcgccatgccggcgtgacgggcgcccccggctgcccgcgcgggcccccgcgctgccccacgccgcgccgtgccggcaccgggctgcaggatgggctgtatccaaagcatcacctgcaaggcgcggatccggcgcgagaacatcgtggtgtacgatgtgtgcgccaccatcgaccagtgccccacgcgcatcgaggagacctcgcccatcgtcctgcgctacaagaccccctacttcaaagcctccgcccgcgtggtcatgccccccatcccccgccacgagacctgggtggtgggctggattcaggcgtgcaatcagatggagttcttcaacacctacagcgacctgggcatgtaagcgactcgccgcgcggcacgggagcggactctgggcccccagctctgcttgccaccttgacccccctccccagctccttcctactgctgtccccatcgtctttctaaaccttcctcccgcctcctctcccacctccctcctccctacgcttttgtttcagtgacagggcgggtgtagggaggctccttgcgaaggcattttctcgtggtttgcttctgacttcccagaaacgcgaggagaaaggtgcggggcgggaagaacgcgacaaggagggttcgagaggcggaggtggggatggctggcgagtgcctggcgagtttcagggcgccgtctgtgctttgtggggctccccgggaagagtttgggggaaaccatagaggagtggagtggagtgccgggggcgcatgggctgtgccgcgcgtcctttggagaaaccggagcgggcttggaagagcaggtcccgggcatccgagcgggagttggtagttctgtccttgccctcgcgactgttgaagtttcgaacccttgtcccccgggccagggagcccggaggcgtttccgtctggaaccacaagccggacacagttgcctctctgtttccgcgccccctggaccagttctggtggggagctggaaggcaccgagtgcgtcccggccaagaagggcggatagccttgtgcgagcagcgttcggctggcgcggcgcggggtgtttcttatgctaaaggaaaggatggatctcttgtctgtctagggtccttactttttaaaactttcctaattgcggcactggaagggattcccctggcgcccaccgccgaattctatcggcgagctgggagctctccaactttcagcagcgccggttggtgcgcgccgggcttggctgctgcggtgaagaccaaggatcgccgcggctcctcaaccgccaggggccgcaggctacgggcggtcgcgtccgg

SEQ ID NO: 5757 - DNA, 859 bp, Homo sapiens
cggcgcgctacgcagggaggctgcccggggctggcgcgcaccgagggggtgggggtcgagcccggggcggacccctcccccgactccccgactggaggacagggaggaaatggctttgtatcgcacgatgaaaggcaggcaggagggccaccaggcggggggtggcaggggacggaggatgcccagagctggaggaccccgcccgccccacggacaccgccactctgccccccattccactctgccccccattccaccgcagcgcctggtccatccaccctctggctcccgctgcccgtccacgttccaacggcccgcagcggggtcgccccactgccgcatccttactccgcgccctgcgcgcttacctgcccacgaagttctcgagcaccgagctcttgccggcgctctggccgcccaccacggcgatctgcggcagctccagcaggcagctctgtcccagcgccgaaaacgcgtcctgcagacggttcaccagcgggatcagctcctccatctcccggttccccatcttgcccgaggggccggcgaccagctggtccctgctcgcctctacgacctgacagggagtaggggccgcgctgccctggctgctgctgctgcgccgggctcagccagccaggtcctggcgcagacgtcggagcccgccgccagcccgccgcttggctctgacagctaacgacccgcagcgcgcctgcgcgggcgggcaggggcgtggcctatctccgcgacgccccgcccccgccccgcggctgccccgccccgggcttcccatcggaccaccaggccaggcgcgcacgcactgcagcccagctgcggccagatgccacggcctctgcgt

SEQ ID NO: 5758 - DNA, 791 bp, Homo sapiens
cgcgcgactgcagccctggggggcgcgcccggaaccgaaatggctcaagagacttgaggaccggcgcgtctcctttctccggccccagtccccaactcccgccacagcgcagagggggcagtgcggtgggagggggggagttgtggggctggggctccggcctggccggtgaagccccaggacccgtccgcttggggttaaggcaaggggtgcggcacgaggagcgcagggagccccgagtcccaggcgcagacccagctgcggacccgccgtacagccctggtgttgcaagcgtggaccgtgggcgtaaggccccggcgggaggcactcggcccggccgcggccgggtctgcagggtcctggcgcagcggatcccggcgcgccctggcccgcggcccgcagggttcagacggggccgagacagccaagcccggttcgctcgcgccaggcgctggagccaaggctgacgggcggttctgaatcatgtttggaggagcggcgcggcccccagggctccgctgagacgcgctgcagggctgtccgggccctccctcggcgacgcggccagcagcccgcgccgcgtcctcagcggcggcaaaaactaggagtcccggggctctgccgggcgccggcactggagggcaagagatgctggcttcccccggggctcatcaccccggggttccacagcacttacgtgggatggggaccccggagtagaccacggacggaaaggaacggtggtttcattctctgcaaaagaaatcctcgcgcgcacacgggtgccccgg

SEQ ID NO: 5759 - DNA, 586 bp, Homo sapiens
cgggctgcgcgctccgagctgcacgggcaggcattttccccggctttgttttacaaggtggggagagcggggctggacgcgggagggggcgggggggggagcgtgagaagaaacgaaatcgcgggaaggaggggacaccggcgggctgggcagagggcgaggcggaggccaagttgggcttgggcgccgccgcccccgcgcgcgcctgctgccgggcccgggtcacccggagagcgcgggcgacccgggtcccgcgcctgcccgccgccgccgccgccgccgccgccgccacgcgctcagccccgggctgctcgctggcccggccccggcacggcgcggcgcgggggcggtgggtgcagccccagctgccgtgcgccccggcgtctttgtgcgcgagcctcgttcagcccctcttcgcatgtctttgtgtgtctccccccgcaatgccctccgtgccccgcggggggtgtgtggcacggtccgggcgcccgcagctctgcagccctccgctgctctcccttcccggctcgctcctgtcgccccttgccggctcgtttccctcctttcggaactccctcctcttcgc

SEQ ID NO: 5760 - DNA, 1678 bp, Homo sapiens
cgggaccgacggcggcgcttctccttcgcctcccgccggcaggagaggacggggcgggagaggaaggggttagttgtggttgtagccgccactccccggcgcccgggacccgggacgcccagtcgggccctgcagagggtgtcctacctgggcaccagcggcccctcgcctccagccagggcaccgaaggcgcgcccggcgggatgcagcgaactgcctcctgccccgggacagtggagcggcagaaggtccaaccttccggttcgcccacgcccgcaaggtggaaaaagtggggtgaaatcggggaaatttagcgaaattggggcgaaagaagagagaccaaagcgtgttactcacgtgccagatggcgaagaagatgagcgcagcgcacagcaccagagacagcatgtagcagaacgcagcgaaagtgaaggccatggccggcggaccccaatcccaccacacacgccaagaagcccctaggagcccgatgcctccctagaggaccgcactccctccaaggagccgcgtctgcacgctcctctccaggctagtgcccaggagggcgcacagctagcgaagcgactcgagggtcagcgaataagcgctggattcccgcaggctccggcgaccccagacccggccctccggcgaagacaggaaaacgtgtgtcgagagtcgctggagggaaccgtccgcaaatcgaagaagaaaccaaatcagcagcgaacacctgcaaattagtgccaagctgtgagcccctcgagaccaacacgacaagcgatgcgacgactccacggaggaccgagggaggaggtcccattcgccccaggaagagctctctgcttttctccactaaaccgctgaggagagacgagcgctccgctccggaccctcccgcgccaccggggcgcaaacggatagtgtccagcgaggtgcccgagcggcctccgagctcctcccaaatcccagagccgggcagcgctctttcccgagagaaggagtctttaggtagccgggaggaggtaggtcccgttggtcctgcgccccagacgcggcttccagcgcagccgtgcgctccgaggcgcgcccgtccccaaccgtgactccggccagccggcctccgcaacccaagtgtcccggaaaccgggggtcggaccggggcgagcactggctccacccaacgggccaactccagcccgggtggctgcagcagtgggtttcaggccaaacgctgtagctcgctccacctgctgctgccgctgccgccgccgccgccgccgcctttgccactgcgagaactgtagcggtgcgacccgggattccctcctctcggcgccccaccctcgactcctgttccgctgagcgcgccctccccggcgggcggagactgcagcgccgggggctgaggaaaggtgggtggcgaagcgccgccgggcgcttggtggccgctgccgccgccactgcagctgtgcacgcccgcctctcggaggaaacttgaagccagcagtacaagcagggctggaggccgagcggaggtggggcgggaccggttggagcagggactctttaaacacgtgcgtctggaggaggtgggaagctgcggaagggtatggtgtgtgcctcgcgcctaaacgccgcagccgcccctcccggttcttgcagtttcgcctatcgg

SEQ ID NO: 5761 - DNA, 1600 bp, Homo sapiens
cgagacggagttagcatctgaccagcgaccaacagtggaccggcgaggcgggctcctaattagagcgagattcccagaagctggacagcccctgtatttatgggagcatgcggcgcagctggcagtgacccccaggaaacctcggcagcagccgccgccgcgggtgtggtgacctcgggcccgccgcctacctggagcgtttcggcggcgcctggttcagaaccaccggggcggacagctccctggagctgcacgcggactgcggaaggggacagtgagcgggatcggcccgcactccgtccgcgggcccggaccgctggaagcacccgggtccccctcccctcctgttccccggtcccgccctccccctcccgcgctgcgcgtggcggtcccgggctgcgcgtccctgtaggaggagaccggcactgccgccggcggccctccccctaaccgccagccccggccgcgcgccccgccccgccccgcggaggagggtgggggcgttccccgcgccgggcccgcccagctcccccgcggctgtccgggccgggctccccattggccggcgggcgggaggtgaggggcggcagggcccgcctctggcggctcgcgcccgggaaggtcggcagccgagcgccggaggccgtggagagggcgggcagggaggcggcgggcgccgaggagacgcagcggcggcggtggtggcggtggtggcggcggtggcggcggcggcgcctggtctcggccgcagcctctgcgtcccgcccgctctgggtcgcccctgccagccccgcgcgcggctcgcctcccgccgcggcccgcagcctgcggcgcccgagctccgagggcgcttccccgggcgctgggcccgaggcggccaagacggcgggccggccgggcacggggcggcgggcgctgtgctgcgggctgcgctggtggggggcggcgggccgcggcgcgggcccagggcccggcgtgtgcggctgggaggcactgtgggggcgggcgcgcgggcggcggccggggccatggccgagggcggcgggggcgcgcggaggagggcgccggcgctgctcgaggctgcccgcgcgcgctacgagagcctgcacatctcggacgacgtgttcggcgagtccggcccggacagcggcgggaaccccttctacagcacctcggccgcctcgcgctcctcctcggccgcctcctcggacgacgagcgcgagcccccgggacccccaggggccgccccgccaccgccccgcgccccggacgcacaggagccggaggaggacgaggccggcgcgggctggagcgcagcgctgcgggaccgcccgcccccgcgcttcgaggataccggcggtaaggggctgcccgcgggtggatgtcgggggcggcgctggaaccgggcgcgggggaggcgtgggtgctggggcgggcgagtccagactctccgtgggctggcttgtgggtgtctctccggaaacaaatgaggctgcaggagcggtgatcggtctgactgctcctgggggctccgaacccgtgggtggagagggtaaggcggaggccgtggccagcacttttccagtgacaatgtcgtcgg

SEQ ID NO: 5762 - DNA, 2394 bp, Homo sapiens; identical to SEQ ID NO: 5751

SEQ ID NO: 5763 - DNA, 1160 bp, Homo sapiens
cgcaggatccgctcctcgatggacgtgagccccaccggcccgctggtgagatcctccacggagcgcgaccatttcagatcctccttaatcgcctcgtccaccaccaagtacttgagctgccggagctgggggctgatgtcggacagtctccgggggctgacgtccggtgacctcctcatgccactgcggtcgcaggcgccacgggcaggtgggtgggcagggggagcatggacagagaggaggggattcgtgaggagcagatcccagggcgagagcaagagcgcggccggggccctccgggggcgagcgccgcggcagagcccgcgctcctcccttcccgccgccactcacccacttccccgggcagctgtccccagtgccctatcctgggcgtctcggggcagtgcgggttggggcgagtggcgagggaaagaatgactgaaacttcccgagcagctccaccgcgcgcgccgcccttccccgagcctcagactgcccagtgtcccagctgcaaagggctaccccggcgctccggcctcccgcccgccggctcgctcacccacgcccggggcgctactcacacggcaatgctcttgcccctgggtgcgccgctgggaaactctcgaatccccataggcaaagacagagtgggaccggcagctcccagacttgaggcggaggggccgcgggccggagctccctgcagccgctagcctgggaagactggagtgcgctgcccaccgagggtctgcgccgcgccggccgccccgggccgctttgtgcgcgcccgcgcggtctgtacccgagcgcctccgcggcgtgcggcacgatgcaggcgcggcggttcagcccggtgactccaggccggcccgcgcgctcgccgcaacgacccggcagccgaggcagcgccgcgccccacgcccgtcaccgtcgccgccgccctagcacaccgcaggcgtgagtctcgccgcgaccgggagagccctcccagctgtgcgctctcgaggcacctggtcgggcggggaggcgtcgggtcggggcgcacaggggccaggcgggggcgctgctgcccacttcccgcctcccgggcgtgcgctccgccccggagcccgcacctcgcgcccgcgctccgcctggaagccttggggcaccggacgcgc

SEQ ID NO: 5764 - DNA, 588 bp, Homo sapiens
cgcaggcggcggcgctctgcactgcggagccgcgtcctgggggagcagtacccccagccccggcgccccgcagccagacagcccccctcagggtggcagcattccccggctagggtgcagggacccccggggcgaggcggccgcgcattaccttccactttggtaagggtcaggaccggactgttgcaggcgctgagcggggccacccgggccgagtgcttcttcatgatgagccggccgcctgcaggagcgctgccgccgatcgcctacatcctggggccggctggagcgcgtctctcccgggcccgtggccgacgcggccctctgccgccggggagcaccagcggctcgcccctctcagtcccggcctccccggctgcccgccgggctccggttgccgcgttgctcactgcggcggccgccctgcagcgcacatcctccccggccgcgcagccactccacacacacgcgcgcacagcctcctacttggaggttgctgcaaactccaacgtcacgtacaagtgcactccctgctcccaccccgcagctcacctgctccgccctcctccccgggacgcccagccccgc

SEQ ID NO: 5765 - DNA, 878 bp, Homo sapiens
cgggaggcgaaaacgaaatccacccccttgcgcccatttctgccagaggtttgcaggacgtgtctcaacctggcatcccgagtccagaacaaaagccacgggggctgcggcatgggcagggggaaggcgcgcggtggctgacgcggggcaggggccctggcgagcgcgggaggggcggtcagcagccgctcgcggggctggactgggagccccgtgcgactccgggtctggcgcctgggtcgggggtggttcccgggcctccctcgggggtcgccgaggcccggcctcgatagccctgcggctgctgcgagcgcctcccgagctcccgccccgcggtgctcgctccaggagcgggcgcggcgctgtgtccctttacctgcgcgcagagggtcgtccggtgaagccatggcggcgggttaggggcaaacgagcgtccgagcggggctggcaggcctccggggcgcgggaggaccgtgggaccacggggatgaaaagtcctgcggttccgacgcgcctggagcaaaccgtggctctgcgcgcccctgccctcctccgccttcccctcccttcttcttctcctccttcgcttcttccacgagctcacttcctgctttggcaattagcaaagccccttcgctgcgcgtccctcggtacctccctccagaggcgcggggcgggagccggggtgccgcgacccggggctgggacgcaaggcggggccccgagtgtcccgggcgtccccagcgcccagagcgcgcgtcctgcccggtacccacgtccccctgggcgggtcctagcggggggctgacacgactgccgcccgggacagactgcgagcgaaggactggccttaagaaacggctgcagtcgcgggtcgc

SEQ ID NO: 5766 - DNA, 561 bp, Homo sapiens
cgagtgggcgcgaacttctacagcagcgtcaagcagcaggactacagcgccagcgtctggcttcggaggaaagacaagctggagcacgtaagggcgactcgctcccgggggcctcggccaggcacctgccgcatgcaccctccccgtggtggtggcatgagcgcgcgcggggcgcggggggcaggcgaggggatcctggcaggcgccgacgtcctaggtcggattcgggggcttctctgcctgcagtttcttgccttaatgaccgggctgcggggaggggagggcaggttccctttcaggctcttggtccctgccgacccgacctgcccacctgcgtctcccggtagggttcatttgcacggggttctggaggtgcctgtgcagagtgagcacgaaggggaagtgccaccagcgtggctccgagcaacctggcgttgcatggtagtgggctttagagcggcgtttgcccgcgtctttgggggctgttttactcagtccaaaaactagcaaattaacgaatgagtaaagttggcgccgctagcgaccagcgtggacccgcgc

SEQ ID NO: 5767 - DNA, 1235 bp, Homo sapiens
cgagctgagctgtccgcgaggctgcggcaggaggcctcgtcctcccgggcagggtccctcctggaggctcccccggtctctcccagacgcacccgcgccgcgtccttgttccccgggagcagcctccctccagccgccggtcctgggagcttcaccgtccaaacgggagctgagtttgcaagcggccaggcggcggtgcggctggtgctgctgctgatgtcagagccagaaagcagttgtgattggatctaattagacgctgctgcagcaaatagacaagctccctgcgtgattggcttcaaagtggctggtgccaaacaactagcagaggcgcaaaagtagcctccctgcgctgggagcccagagcaggaggcagagcccgcgggaagctcggagcactcaggacgccgcgcgcccttccccgccctccctgaccagggagcagctcgctccaggcgcccagccgaggcccccagcccagtgggagcaagtcatagagaacaattcgagagacagagagacggagcgcgctttcctgctcagtcctgaaaagtgagccgctcccgggtttgcaacctcaagcttcgcagcagcggcggcggcggctgccgggaaggaggcaggtgcaggtgcaggagggaggcggctctgggctccgcgcctgggtctcggccatggcctcggtcctggggagcggcagagggtctggagggctgagcagtcaactcaaatgcaagtccaagaggaggaggaggcggaggtccaagcggaaaggtaaggaccgcgtggcgcgccggcccctgccccccttcacccccggcttctccaccccggcctctcatggggtctccgggcttgtccgttgtgagcagcttcactttggggtgctggcgggatggctgctccgtgcagggcgctcgggagttcagatcccgtggaaatgtctggggcctcctcttgcccagaggggacagtgagcagccacgctgcgacatgtttgagggacccggacgaagtggggcgagggcggcgaggagctccccggggaccccgcgcgtctccgggccccgcagtccccagtggccggccgggctggcactgccttccaccctccggaggccatctcgtctcccagtgccaaaggaattacccaaaaacgggggaacgagccctcgcgccagctactcccatccaaactgtcccggaggaagggataggcgaagccctgcgatcgc

SEQ ID NO: 5768 - DNA, 5964 bp, Homo sapiens
cgcggtggctggttgcagctcacgtctccacgactcctgcagaaggaaattacgttctccccttcccccccgcacccctacccctaccccaagcccccgggaagccctgcgctggcaccagggcaagcgcctgtcggctcccgggagctaagcgaggccgcgcggtctgggacgcaaatgggagggagcagccgctgtcgccctgcggggccagggccactgggtaggcgcagcgcgggccaagagtgggaggctcagggcaggggatccgcactcggggccattcctgccgcggcgcgccctgcgcttcagcagtgcacagggtggggacccctcgaggacagtggtgcgccgacgggtctctcggcccctccctttccacaggccccgctgtgtggtgaaggagccagaagaggcgacttgggtgttgagacccggggccaaaccgtggagagtgtctggagcccacactccagatttctggacgccgcagtcagtccagcaggttctacctggagccgcctcggggctcaaccgggaggcagcggggtgcaggcgagagggttaatgcgcccggttcggttggtttgaggagtctctgctttcagcgacccacagggcagagagcccagggctccggcttgatgtccccaacagctggggactggagagctggaggggtcgcagactcaggctagagtttaaagtgcgccgcgcggcgagtcgctggactcttctgggtctcacgtggctcctgtgtcacatggagtgacaggccggcggaaggcgctttagtcgtcgcccagcgttctccaaggtgtaaggaggcaggatcttcccatactggcggcgcagggggcctcacggctgcggacgcccgccctggatctctcagctcggcagatcctttgggtggagaggcgctctccagggtcgcggcgaaggagagcggcttctcggcacgtccctccgtatttcttctagatcagctccggccccaccgtccaggagagggcccgcctgaggacctctgtctgtgccgcgcgtggtcagccccggtcccctcactccatggctggcccctagcccttcagagcggacacctctccttagggatgcagggcgaggaagggcgggtggagctgcgaacccacggggacctggaggacctcttggccccctggagaggggtactatgagagggattcatgggacacagatttgggggactgggtaattttaccccctttggcaaccataaaaaccctgagcaaacgtgtccattcgctatttcgcagaaatatacaatgcaggcccacacaggcatctctgcgaggccccctagttaagggcgcagcgttcttcggaagctcttggtcttgctaccagggcgtcaccggcttttccgcactggggacatttcgtttgggctctgcgcagccgttgcacctaaggccctgggagctccgcgttcctccccaggcgcccgggacaaagtgcccgagggctccgcagacgtccagccctgcccggggctcacggccgccggggctctccaacggaccgtcgagggccacgttttgctggggtgtgagcgacgattcttttcccgccctatgaggcccgccactagctaggtgccccatgagacgccgtggcgagcacggctacctggcagctcgcccgggcagccccaacttaatttcctgcccctcggggcacctttccctcgaatagctctcctcggcccctccagccctgcccaaggggcctggaaatgttcgcagcttcaagaaaggctctatttaagcacaggatggggtggggcgggcggggccaagattgccctggggattgaatttatctccgctcccagcgatccccggcggataaagcgcaagtttgtgcacacggtcgactgagccattggaaacccagctcacgaaccgcagccagggaaacgggagtttgcccagttgtccttgcggaggggtgtgcggaaacgcccgcgatgggaactttctgcagatcatgtatggagggagctcacaaaaaggaggaaggggagcgcggtggggaggaggccgcgtgggcgtggaaggtcccagggtcctgggggtgcccgcctgcttaggcgcagggaatggcgcggagctggctggggaaggagccgatcacgtcccgcaggctaattggcttaagaaattttgcaagcgctggaaaaggtcgttgaaggagttcgctgcacgcgcacgcacacacatacacacacacacaaaatcttaaaaaaaaaaaaaaaaaaaaaaaaaaaagagcgccgagcatgcgcacagagaggatgccatattggaatgagctgtagtgggagccggaggaccggagcgggcgcgcgagggaggcggcgggcggggagcgagcgggcaagggcgggcgagcgagcaagcgagcgaggccggtgccctcccgggcggcgaccggggcctgggtccacgccgagggcaggacgaacttcaccaggtaggacgccgcgccggctgctgtccccggcgcccaggctggccggagagcagcccttcggcccgcaggttgagtgcgctggtcaggggctttttccagcctaggaaaaaaaaggaaaaaaaaaaaaaggaaggaagcctgagggagctggggttggaggtggcgggtgggggaaggctggggagggtgcaggggagcgaaagagaagggcaggagaagaaagcgactgcacttgagcgaagcttcaaactcctctgtgcgctccaggttgtcatttttgcttcccgggtccccttcgcctgcgtctccgggctcggaaaagccgagccgtgcgggagtccgtccggagttgcaaagtgtcctccttccccgggcgcagcctgtcccctcccgccgcccaccttcctcgtttctgcactcattttagcgacgcagccgccgctgctacctaccccgcgctcccgcgtctcctccgcgctggggtctcccctttcttttggtttgggtgggagaaaaagatggtgaggacggggaatcggagaccggcatgggggtaaaaatcgtgcagacattcggaatcgctcccttggaaacatttgcctgagcaactgaaataaaattggcagtagtagttttggagcgtgctccagcgaggatggtctttttgttcattattttctctttaaagtaatatcctgtcacttaggggctttccggttgtctcctcttattcgaccccctttcaaaattgctgacttgagctggttctggagtttattttttaatatgcgtgcgtgggtatgtgtatgtgtgtgtatgttttgcagaaatccgccaaaatgcaactgtaggaactgcgagatgtatttattgattttgaccaggggcggtgggaaggggctggagggagctgggggatcctggagggtgggaagtggctgattctcggtggccggacactcatccagagcctgatccgtactcgtgttttcttggaagcgccacaactgcggggaaggagtctttagaaaccgtgccagtttcaatatggcgggctaaggtggcttttaaaaactgaaaataaaggttttgaggtgggaaaaaacccagctgaagtttccaccccttagtttcgactctctttggctaccccaggaagcgctttagcgaattaagtggggaaaaaaagaaggaatgggctgtccggttttttttttccgtggttagagtctgtgtgtcaagtccattgctaggggggaaagggatggagaagtgcccctggcccggaccagggcaccgaaacgcaactgtcgtgtgtgcctgtggattagtgtgcaggcctgcgtgtgcgcagtttttttgggtgtgtgtgtcaaagagaaccaccccgaatgtgtgtgtgcgtcttggaaccagaccctgccatgatttgacgtgacaaactgcggacacgtggtgtaaagtacatgagggcagagggagtgatttattttgtctttctaggagacgagctagctctcgccttgtgtgtgctggatcctgcgcgggtagatccccgagtaggtggggcgaggaggtgcttattaaaaggactaactgtcccgggtattgggtgcaatcgggctgcagacgccagccggatttcgtgtgtgcagggggcgcgctgcacttaatagtgggctcctgctttcctccacgccgctctggggtgggaggtgggggaccgggaccgaagcttggagaagaccaaagtggtggtggtggtggtggggtggggcagaagggcgggagcgcgcggctctgggagacaagcacgtagggtcgaggcgaggggttgccttccttacttttgggtttcgcgctctagggaaggtgggggatggggacagcgtttggggaagaaattgtcccttgctcggcttaggaaccctctcggcgcatcggagaggggcatcttcttgtcttggcgggcatggaggccgggcagtcgccgggggatgtgagtgggcggcgaagtgcgggggaaaggtcggcgttccagggcggggaggatctgggagtggagttcggagacaaaatcggggtcaggcagaggagccagagggaaagccagcaaacgcgagctcgggtgagagccaccggaatgcgggaacgcagcttagccgggaacagggttcccgacaggggtcgcccgtggccaggacgcggccgctgaacagaggtcgcgcggcggttcctgcccgagggacctcgtgggcgggggccacacggaggccgcgcacggtccccggggctggcgggggcaggtgggaggacctcctccgggcccgcgaacctgatctggcagcggccaggtgcctggaagcgtttttaaatgatagggttacaaagacatgttggccaggtttgtagttagcgcagcaacgtggtttgcaggagcgcagaacgaggctagacagggtcactcggacgccgtgctgtcagtgggtgggggccgggagcaagcggcactggcttggagaccccgcggcaggtgacccctcccacctgggcagcgaggctgaacgatggcgacacgccggccaggacgcgtccgtggctcctccagcctgcgtttgggcgcgccctcccggggccggctttcccatgggccccgcgaggtggggagcagcctaaaatggctctgtgctgcgaagctgcagtttcagccgcgaacccctccccttgtcctcctgacgtcgccgctgacaagcgcaatttgctccaaggccccgaaacccgcgattttgcacgaggccgtgccgtggaagcggatgtacagttgattacaaagaacattccacagggttctcgaagggcccaagtttttccttctggtggggaggagggaggagccgagactgggcaggagcccggccgaccaccgctctggcacctaggggctcggggcgcaccagtagctggggctggggacctggatgcgcgaaaagccgagggagttcccggggacgcggatggggaccattcggggcaatagccacggacaccggtgctcgtggttgatggcgtttgtggtgtccgagaatcccgggacgacgctggaaagcctgggagaccgttctcaaacttctggagaccagctcgcagtttcgctttcggaattttcaggatctttgggcctttaaagttgggtgggattccaagaaggcaaggcgaggctcgtggccctgacgatcggccgcccgacttctcgctcaccccagccttctctaccttgtctccctgaaccttgccgaaccgagccgggtttggggttccggggccccgcgcaccaaccccagccgcgtcctgagggctcccgcagcacagccgcggctgatccgaggccattggtgggaaaccaatttagacgaggccgacccctcttggatctggctcggttgccgc

SEQ ID NO: 5769 - DNA, 5964 bp, Homo sapiens; identical to SEQ ID NO: 5768

SEQ ID NO: 5770 - DNA, 5964 bp, Homo sapiens; identical to SEQ ID NO: 5768

SEQ ID NO: 5771 - DNA, 703 bp, Homo sapiens
cgcttggggacctccgtgctgggcatcccgcacgctttggacgcgcgcagcctcaccgggagcgaactttgtctcgcctgcgggtgccacggagaggggctgggaagccgagccagctctggcggcgactgggggcgtccctggctttctgggggggcgggggcgcgcattgttgtccaggatcgggcggcgggcggtggcggcggcggtggcgcgcggtggccgcctagcacccgacctagcagcgcgccggggactggctcggggcgcgctgggcgcaccatgcggcgggccgggcgcgggcgaggggcgggccggcggcggggctcactggcgccgggccaggctcggcgcgagaggcgcgagcgggctatgggctgacgccgagggcccgcggcgggggcggcggcggggacggggcgggggctcgccagctgcgggcgccaaggccgcctagtaggccaagggccttcgcccgggcgaatgggacgcccgttccggggtaccagccgcttgcagccagaagttcctcggatcccttggaagcgcaaaaaataaaaggtaatgtgtctttgtttcccggtcgcggtggcagggaggcgactgacggcagcccttcgccttccgtgttttcacgctgggccggggaaaagggacgcgccgctgcttctttactgggggcctggagtcgtttatttcgcgt

SEQ ID NO: 5772 - DNA, 1315 bp, Homo sapiens
cgtgggcgtccgggggattcgcgggcactcgggacgaggcgagggcgcagaaaacttggagcccaatcagcacggagttgagcttccgcgccccaaccttcaggtgaccccgcgcggcggcggcggcagcagcagtggcagcggcgaccggagcccgcagcagctccgagcgcctccgggaggacaggcggcgagctcggcgaatcgtcatctgccagccgatcgcggcgctccgcgggccggggccgggagcccggggcgagcccgaacgcggcttcttctccgcccgccgcggagactctgccgggtgggctgcgggcgcccctcgctgccgcctgtgaacgctgtgggtgcgcggggctgcggccacggcggcggtggcggcggcggcgggagccgcgagtcggggccgcccgggctgtgcttcgccccggcagcagcggtggcggcggcgcctgtggctcaggatgcggccggggggcgcactgctcgccctgctcgccagcctgctgctgctgctgctgctgcgcctgctctggtgcccggcagacgcgcccggccgcgccaggtaacccacccacccgccggccgcgccccgcgccgcgcgccccgcctggcgcccccggacccccaagccgcccatcgcttcccctcgggcgcggagacttttggccgcggcggggagcagcccacgggcggcgacggcctgagagtggagtgggggagggggtcgcagggaggcgaccctccgaccggtggacggcggctggggagcagagggaccggtcagggctgcgggggctctagcgcgcatcgctgtgggcgaggcagctgtggagcgggacctgccgtcgggttccgcatcaggatctcatgctccccattctggtccttgctgtctcttccttcccgccctaaggctcttccaactctggggctggggacctggcctgggagccggggagtgcgagatctccctgccaggcaaggagcgcgactcccagcctttcagccaacagctcccggcggggtgtagcaacttaagttttctccccggctgtgcaggattctggtggaggaaagcagggaggccacccacggcacccccgcagcgctgaggacgctccggagcccggcgaccgcggtaccgcgcgccactaacaggtacagcggcgcccagcgcgggcggactggggctcgggagctgcgagccgggcatggggcgcggctgcaccggcttggactcgttgggagtaggcaggctgggacggcgcgagtgagtgtaagagtgtgcgtgtgtttgaagagggcgcgg

SEQ ID NO: 5773 - DNA, 1316 bp, Homo sapiens
cggggtctcccgaggtcgtttcgccgtccaggatggagcaggtctggcccctggaagggcgcgcgggctgcttggggacgggggcgccttttctcgcgcttcgcggtttcctctctcctactgcaggcagcgcgcgtttgcagcgttttgggaccgaactgatgcttctgggaaacgaaactaaacctctctgaagtttccagctcgggctttttttgtttcccgctatccggcgtggcccagtccgggcgcggaacgagggcggggccgtggccaccgcggcggaaacgacccgggccgggggcgggcggcgaggacaagggggctctgtgcggcacccgcccagcttgcgccctggggactgcggccgggcggcggggctggacgggagtggacggggctgggcgcgggctgggcgcgctgggccggccaggcggcgcgctgaccgcggtctccgtgcgtcccgcaggcggggagctcgcaccgccgcgcccgggccgcgagtgatgataacctaagaggccggcgcgggcgggcgtgagcggcggaggagccgggcgcggcgacacgcggccatggagcgggagccggcggggaccgaggagcccgggcctccgggacggcggaggcgccgagagggcaggacgcgcacggtgcgctccaacctgctgccgcccccgggcgccgaggaccctgcggctggcgcggccaagggcgagcggcgacggcggcgcgggtgtgcccagcacctggccgacaaccggctcaagactaccaagtacacgctgctgtccttcctgcccaagaacctgttcgagcagttccaccgcccggccaacgtgtactttgtcttcatcgcgctgctcaacttcgtgccggcggtgaacgccttccagcccggcctggcactggcgccggtgctcttcatcctggccatcacggccttcagggacctgtgggaggactacagccgccaccgctccgaccacaagatcaaccacctgggctgcctggtcttcagcaggtgagttgggcgggcgggcgagcgagcgcgcggtggcgcagggcagggcgccccgggaacttggtgttgggcacagtgattggcaggggctgggtgcttagaaggcagctccactcagggtggagggcccggctgcgcgggacccggtgccgaccgaagccacagcgccgccaaggcctctctgtgcctccgccgcagctaaaggggcgccctggatgcggggacgcgtggggatcccctgtcactccgtgtcggggccagaatgatcccaaggctagaaaccgacggccgc

SEQ ID NO: 5774 - DNA, 1110 bp, Homo sapiens
cgcccaccccggctcggagcgtggccaggagagtcggcatcgtagaaagcgctgcgggaagcgggccccctcccgcccacccggactcacgatcttcagcaggtccagtccactcccctgattcatgtctctccatgtgcctctcccgggaaggggcgaggagggccagctggagcaacccgggagaagtctgggaggactggcaggtctcccccgcccttccccactggcttttcggaagcagagaaaaatggaagccgaggcagagccaggaaaaggcgcaaaggggcagggtccccggcgccaggagaggagcagagggtgggcaggcgacgaggggaggaggtgcgaggctagagatccctgcagtggaggcgccgggagaacccgaggtcggtgccctgcccggcggctcacaaaggaaggagaaggcgccgcgctctcgctacctgtgcggcggctccgagcgcccccgcgggagccacgttctctagcagttccatctggatctcctgcgccaccgccgccgccgctgtgggaggcgacttggacatgtccctttggaccattggcgaaaagtcggctcggagcgaagcagccagcccccggcggcgggtcccctcctcctcgcccccgcctccccgcgctctgatcggctctgggggccgcccagggctcaggcccggccgttctcggcgcagcgccccgcagcgccccgggactcggcgccctgctgccaggcgctcagtgcgcgggacggggccggggcatcgggcgaagcgagccgctcgggaggcgggacgcgggggcgcggctgcggtgcctgggagaggggagccctcagcggggcagccggggccgggagagcgggcgcagcgcggcggggatcggagccgcgggcgccgggaaaggtcctcgccaggaggggagggaactccgggagcgcgagccagggggaggcgcgtcggaaagcgagagtgacaagcagcctacaagccgaaaagttcctcgcgggaggcgcgcgccgcgtgggctccgactcagccgctgcgcgtcgccgtggcacacaggctgaaaagtttgcgaagccacagaagccaggcccggcgc

SEQ ID NO: 5775 - DNA, 1655 bp, Homo sapiens
cgggtttcccatcggcgaactgaaactggtccgtgaagaagtggcaaagtaacataactcctgcagcggccaggtcggccttcgggaacctcgccatgccgccgccgccacctccctaccccacccgccagtccttcgccggtgctcgggggctcccgatgcaataggcacgaccgggccaaacgctgcggatcggtctcggtaggacccggaggcctttgtaaatgtcgctgcgatttcacagtagggaaccgagaagaggaagaagcgaacgcgagtaggagcgcagcgctcttcggacctctgaggctctctttgcaacttgccacactcgcagccctcacccgacactgaacaacaaccgcggggaggagaggccacttgcagccgaggctcgcaaactgtcggttccactcgggcagcgccaacccggtgcccgcggacggtgacttccgagccccagcgatgcgctccactgggttcaaaacagatctaattccacagccagcgccgctgcctgccccagatccactagggctggtcggctctgcaggaactttcctctgtctagggatggccccggcaggaggtttaggtttgcgggaaggaggttgatgacgaaaccctcccgacaagttttgcttcttttcttcgcccgacgcagggcgcgcgtcctttctcgcagccggaggaatgggcagctccaaagagctgagccctgggaaggttagggctgcagcagtctgaggtccgaagccaggaaaaaaatgtgtttaaaaaaaaaaaaaaaaaagaggaagaagaaaggaaaagggtggagtgggagggagtcacgctggaacctatcgggagagggttcctccgggctcaggaggaggtggccccaagcccccgcggagccccaggagtttggtggcggaggaggcgctgccgtcgccacgctcccccgcgctccttctccacactttgaggagggaaggcagctcgcaatttgccagatctgccgccgcaccctcctccctcctccctccgccctccccttcgctcctccaggcttctcccaccttcctccctgaaaccggcagcccgcacagacctgtccaatggctgcactttcctcggggctggctgaggagtcgcggccaacagattaagccgggggagcctagcgaaggggagggagagggccactccagccccgtgcgccccaggcagccggctgccccagagcgcggggagaggggacaggccggggagctatcgggggagcgcggggcggtacctccgcgccgccggggcgccatcctcgcagcctgctcgcacgccctgggcagctccgccaactgcgccccacacccacctggctcccgggccgccttcgcgcccgactgcggggggcgatcgcgccccgccccgaccctggcggggtctccctgggcacgaaagggttaaccacagctcgccccttcgcggaggctggttctggtagtggctagggagtggagaaagcaaaccagagccggttcggttaccgactctgcgaagccccctcgaccccagcccagcgcgggagggtggcggaaggtggtgcaccgcagcgtggtccccgccgctgccgccgcggctttgcaaagtgtcagcgggggcgaaagcga

SEQ ID NO: 5776 - DNA, 1655 bp, Homo sapiens; identical to SEQ ID NO: 5775

SEQ ID NO: 5777 - DNA, 304 bp, Homo sapiens
cgcggtgggcagggttccaggaggcagctcccgctcggcgatagcccccggggcgcaactccccgcaggacgcgcacctgccaggacagccactaagaggatgcggaggttgggggccctctcggggacaaaatcagggcactccaaggaactctctgcgcgttcaggcctgtctgtgaagctggcaggcggaggacaatgggagcaggggtaggtctccagaggcgagcccgcctccacctttcccacctgctccccacctctgcgccggccgcatttaccccgccccccttccagcgcccgc

SEQ ID NO: 5778 - DNA, 1666 bp, Homo sapiens
cgaaaccgcgcgagtggcaggagcaggccaggccggaggcccctccccggcccccaatccggcggcctgccctccccctcccggggcgtttgtatagcagacacctgcagcacgggcggccgcccgggttcccgacacaaggcgctggtacctgagcccttgactggtaatgcaccataaaccgctcctttcaggccctttcagagcaggagcacggaggtcaccgtgcctacaaacccctctgtgtccgccacgtctcctgggccctgggcgctcgggcctccagccgcagagcacgcctgcccgtgggaatcccaacacttgtgctccgcgaggccggcggggcgggggcgggggattgggaccaccctgccctcccccagcccggcctcccccgccctgcccgccgctggttcacagagcgcagcgagtggaacgaattgggtgcgccgtcctcagacgctggcggaaatcaaatgatgaggcgaggtgggacacccgctctccgccccgcggccgacgcccagcccacggcaaaggtatcacacggtgtcccgcctcgcggcgacgcgagcggcgggatgactcggcctgggccctggcgcagccaaaggcccggctcgctggggcgcgatcccagctcggcgcgcacagccctccgagttccaggttggattgggtgcggttgtacctgtggagtgggtggcccggtgactgccacccgggccagtgctgccagcagatgtgcacatcctgggcgggggctggcggccgagtgtcactagtaggggcggcggctaggcagccattcgccgccttccaagcccggcgctgcgcgcagggcttggagcactcggtgctgagacgcgaatgcgcataaagagaaaagtgtttccagtgtttccccaaaatggggaacagggaagaaggacaagtatcatgcaagactgccactgccacctgtcttttgcggaccatgctgccttctttcccgctggcctggctctgagcactgaaagccggggagagggcgccggccttagagccagccgcactcggggaccgcaggcggcgctggcccgggccacccaagcccggcagatgagcctttggcctgcgggggaccgggccggaggccagggggacggcagtgtcgccggagggagcgcgcagcccaaggccggtgctccggccccgcgcgccccctcccgggtccgcagggaacccgggttacctggggagccgggctttgtcggccacgctggctctccgcggccccagaactaattaaacgcctcttttggccaagggaagtcttgcgccggacgggggtgggggcgtgtgggggcggcatgtgggcaccggaataatcagccccattcttgcgcttctacagaacccgcggcgcagcgagaagtgaacagcggccgcctgaatggcggtttcaaaaggcgacacctgcaagcgcggccggttgtgaattgaattgagtcaaatgcggcgcccgctcgtacctgagccgcgagctattagtgtcaggcgcgcccggtcgtccgggcggggaagcgcgcggccaggccgtccgcgctgaatgcggcaagctgcggcgcggccgctccatgggaatgtcgccacttgtgctgctagcggtcgggagggggtgcgc

SEQ ID NO: 5779 - DNA, 5030 bp, Homo sapiens
cgcgtcacagtggcctctcccgcctagccacgcgcagtgaaatttccggcaatcgggccagctaagacacgggatttgcaccgcagcctctcagcttctggagccggagccgagcgctcccggcagcttctccaatttctctcctaaagtgcgaagggaaaagccccgtctgctccacgactgcaaggccggcggatctgggagccgcgcccggctccggaggactcggcgggcccggggctccccggcagcggctcctctgctaggggttaacagcagcccccgcggccgggcgggcgcggacgcttcctctccacccgcccgggaacgtggataccgcgcccgcaggatgttcgccggctgggaccggcagtcaggaaacatgagaaggcctcgctattcctgttcccgggcggcgcgcgccgggctgggtaaataaagccgagacgacggcggtggcggtggtgagcgcgctggagcccgcgtggagaacatgcggcggggatgggagtgcgcctagtctcgaggcgggagagccagccgccctgcagccggccgtcggccccgcagccacaggtacagcccccgcgtcgccgagtctcagccggctgcggcggaacgccaggctcgctctggcccctgcgccctgggcgccggtgctctcccgcccttcccccaacttccctccaaggtctggtggagaggcgctcgggtagcggccaaggctggcccaagggtctgcgcggagcttgggagcccacctggccgcgcctcctttgctttaaaattattcgccggcgttgggggagggggacacttctgcagggagtgacctccccggccacagtctggagtgaatcggggtaagtgatttgagaagaggcgcgggtggccgcgcgcgggagtcctgggagggtcagcaagtgtggttcacacgcccccggaccccttgcgacaggacagcgctcggacctttgccatcgcttgcctctgagcctgctgcctgcagacctacagcgcgccgggtgtctgtgtctgcgatctctgcgtgggcttggggctgccggggaagtgtccgaggtggctaacctcgtgatgacttcgctaggaaaaacacgtcgtcgcatctaggaggacgcgctggggtggctcggagaaggccgggccggggaagggtgtcttgtacaaataaagcagcatgaacacacatccctaagggcatgattttaaaagaaaacaccaacgcgagtcttgactgtagaacaggggctgcaagcacgaaaattctctttgacacttatcaccgaggctatgtgcacaccccaggcacgtacctgtctgcgcgggaggacgcagtcctaggggacacacgacatccagcagaggtctgacttcacttccctacgaacacagaccgtagccgtcgtttgatcgcggtggtcacgcgtggtcctaaatgtcacgcgtggcctctgctgcggtggccgaagggcggggcgggggcgttggcgagtgtgggcgcttggcgaggcaaagggtgtgtgtgtgtgtgtgtgtgtgtgtgtgtgtgtatgcgcgcgcgcgtgtgttagtggagtagcagcccatgccgcggctggacgggcaaagggggcgctggcagcgaagctgaggccgctcggaggaaacgggagctgtcccgaggcgcgaggcgaggagatggggcgggcgaagtccgccgcgcgccttggggctgtaactctgcggctccgcggccgcgcggacttgctcctgacgccggtgcgcggcaggcagaggctcagggcctccgcgaccccagaggtgagctgctggctctccccgacagtggcagcagtggcccgggaggtgcgccgaccaagctgcctcctgccttgggcttctgacacctttacagcctctgaaagggtccccggagaccccagagagaggcgggtgtcgaggggctacgagctcgcggctgacacccgcgctgcggaagagaatggcactgattgagggctctggggacctgggtcctggcgccttggaccttaggaccatgcacttcccggggcgcgttgggggatgataggaagattctgggagagaagggggagaagtggtgctttcgtcctgacgccacttaactttttcctgtccttgaacccaacctcaccccgggggaccttggcggacagaagatgcgggggtttcaaccaaaccatccacgatctagaaaacacgaaaatcccccaaatcccggtatggcctgggactcatgagctggggggtcttgtggatacggttggcacattaccccaaatcttcccttccatccaacccctcctgacgccccgagttggggttcctagaggctttagtcttctgctgtgattgaagaaccacgcgcggcctcacgccggtcgcgctccgcagtccggagtatgcctctcccagattcaaactgaaacccagaggctcgtttgggaattcgtttcctttgcctctgcgggtgaatgattcccggttgtagttctggggagtgaagggattggggggatcgatcgcccaggcaaggaagagggcaggtacctgtccggggaacctgcaggggcgggggcgtgtagccaactggggagagccgcagggtccctgccagttgcggcggcgccgctcctcccctcggctccgcagcccggcgacccggccaagttcaaggccctgaacctgcaggggtctgagcactctcagccagtaagtaacgagatgcaccttcctctcctagaagccgagccccgctgcggagctcccggcggcccagccccgaggctctgcggccgcgccgcgcgtccctaccaaccgacaccatgaacaccatcgtcttcaacaagctcagcggtgcggtgctgtttgaggacggaggcgcctcggagcgggagcggggtggccggccctacagcggtgtcctggacagtcctcacgcccgccccgaggtgggcattcccgacggcccgcccctcaaggacaacctcggcctgagacaccggaggaccgggtatgcgcactcccctgggggccctgcccgcctgcggcccggaggggtgggggtggtgagctgtgacggggtcccgtggcaacgcgggcgggtggacgggaaagggcccggagttccctgggagtgcaggtctgcccctccagggctcgcgcattctcatgttaaggggctcctatcttaaaacatgagggatcaattcgtcggggcagctccaaagagcttggtggagactaagggcgccaggagctgcccctcggccctccgctgcctggacctcggagttgggggttatttgcccctctccggactgtgggtgccggtgcgcggctgagggcgaggaaaaaggactgagctcggtgcagagaaacaggcgaagccgagcagtcggggagtccaggctcaggctccgcggacttctcttcggtcactcgagcccctcgccagagccccgcggctcgcctggcccaaggagtcgggaaggtcgcctcccgccagggagtcccgggcgtgagcgcggctcggctgggcccgcggcgaacccggagggggaggccccgggcctgcggggccgggtttgagtttagcggggtgaggggtatgctggggggggcggtagcttgcgggtgggccagctgctcagactgccggtgagtggagggcaggctctgcctggcccgatccggcggctccccgggcgccccgccggggaggggcggccgtcctagccgcctccacctgaacgattgcatcagctgcttgttctgcggcgtcgctgcttagtaaaacagagattcggtttcgtcaaaatgttactaccagtcgtttcgggtggaattgcatttcaaagtgtttaaagaggcagaaacccaggaggctccggcgcaggcgcgcaagcctcggggagcggctgggctcgctggcggccgcgcgcgacacctcccggacccgtgagggagcgcagcgccccaggccacgctccaggctcctggctgcctctgcctcctccccctttgaatgtgcttttcctgaggtctttttaccttacatgatgggacagagcttgccgtacttttaaccctcccttagtcgggaaacggcccgacggtgtttttgggttctgcagctttcctccacaaaccaccaactcctttagaaagtttcccccttttcctaaaagatcaaaggaaatagcttaaagagagccggggcggcaatgctcctttgctttattccctatgtccagtcggcgacctttcccctgaccacaagcgacggaaagcctctgggagcagacaagagatccccgagggaagtttcgagagccagccgcataccctgccaggcctgccaggccagggccactcgagggtgcggcgccagcgggtgagggaagggtagcagttagccccgctgcccagatacgcgactggaatagcagtattcttcaaatcacttgaccttcgtcttctaaacctctaaccttggggtattgggttcaaggtatccccctattcaagataaacctatcgaaatgatctccccatccagaaactgtgtggctcccacttcctgcctctcccaaacactctgggcgcgcgcaaagcaggggcgcaaggcaggaatgcgcagtttggatgcggggcccgggcttggccggggcgtggagcgtccgggcgggcaaacgcgtcgctcaccagggccgcctcctctccccatgtcccagcgcccggcagaatggcgggaaggtgaggcacaagcggcaggccctgcaagacatggcgcgacccctcaagcagtggctttacaagcaccgtgacaacccgtaccccaccaagaccgagaagatactcttggccctcggctcgcagatgacgctagtgcaggtaatcaggacccattaacaccctgatccgttttcccgcgaggggctgaagagcgggaacgcttagagttcgtgtggctctccacgtggcgc

SEQ ID NO: 5780 - DNA, 2868 bp, Homo sapiens
cgcgtttcgcatcccagaggggagggagaaagggagcccaggcgcggggggtggggctgggggagcacgagagagttttctcctaaacacgtatttcctcgttttctcgacgctgcagcggtcccattatagacgcatttattgcccctctcttaaaagtcgttttaaaaataacgcaggaaccaaagcgagcccctcggtccgaaatgtacgtgtaattccttatatagcctgggctgcggccggcggcagggccgttgccgcccattattatacaaacaggtaccggggcggcgcaggcgggggctgctctccctgcgctcccgccgcccccgggcggacaagtctcgcccctctcgccacaggaactgtccagacaataacaatcagcagacatttcgctgctgcacgagagggagagaaagcatagcatcgccccgagataaccagaaatacaatcaacttacaacgtctctccaaactggaaaaggcgactgtgcaaccaccaccacatgttcaggtctcgatccctcgggctgtctctctttttttttaactctcacgccaggcagaggggtgtgtgtttcccttggcacagcagcacaaatcaataaacactgcagctgcggtgcaagtagcagccccgcgcgtccgtcggtccgtccgccccctcccccaccctccttccacccgagacccagagcgccatccaagccccattatccggcttcagcgctccgtgcgtccggcccaggtaacaacttccccaaaaaccgaaagagaaaagcgcgaggcgcacgcacaccggcccatcccggcgcagagacctcgtctgccccgggagggggatctgtctgtggtgcttcccggtctctaagcccaggtaacaactccgcaaacacacccgccgcccagctcgcccccatccgcgcggctcccggcggcgttaagtgggtacctttcctgccttgttccccgcgccgccccgccgcgccccgccaaacgtggaccccactcgcggggctcgccgcggagtccccaggccggggctctgggccgggcagcgggaggcgccagggaggaggggcgcttagggacccgcgcccccgcgcctctaatccccgttacgcgagcgcgcccggcccgcgggtcccaactttaccgccgccggccgaaccctgtccgcccgcggcgcgcacagccggcgcccgcgcacacgcgcgcacaaaccccacgcaacccgcggccgccccgtcccgccgccgccgcagcccgcctgccgcgcgcccacagcccggcccgagtcgcggggcccgagcgacagcgacggcgccggccggggccgcggcgcgcggaagccactttgcacggtcagcgccgggcacaagtttgttccgcggctcccgggggcctgggcgctgagggagaatcgcgctgagggggccaggaggagggggagagggaggcgccgaagggcacaagagtggggaaaagtgcggaaagaagcaacagccgctccacccgggaccagaaaagtggccagtgcgtcccggccgcccgccctgcgccggggatgcggcggcgtcggcgccggctaacggtccagggaggcggcaggggcggcgggagccgctaggcggagagagaccaggtaagagacataacggttcagggagagcgagcggccgcggcgcggctccggcagcggcggcagcggaggggggcagagagcactactttctactttcccactccactttgccgtccctgccccggctgcccccagcccggctcgcccccctcacccccgggggcgccccggctgcccagctccccctgactccgccgctccccggtcccctccgccactcaccgttattgcgccgcgggttcgcctgctttctgcgcttacacctggggccatccgccatgatcctctcgcttgtgtctaaatgctcgagtcacctcctccccctccctcccccttcccccccacccctccgcctccacccctcccccctccccaccgcacctggtttacgacactcccggctttacgacatcaccttccttacacctagaggctctcgctctacggccggaaccttgttgctagggaccgggcggtttgcggcaaccgtgggcactgctgaatttgaattgaggggcgagggaaaagttttcctcaggtgtggtggggagagggaggcggatgccgggaaaccgtagggacgcggtcagaaaggcgacgggctgtcggagttggaaaggtaaagttggaggctcggcggcgtcctgcctccgcgctggccacacccgccgcggctgcccggggcagggagggatctggctgattctccctgtaccctgtgccctcggagctgcccctccgagcgcccagaggtccccgcctgcctgcttcctggaggcagggctaccatcagtcccacgcctcgcgtgtccgccccccgcaccccggggccaaggaaagggatcgcggtctggactccccggggagttcccttgatgaggggaagggcaggtttggggacggcgaggacacgcggcgaccggagagaggctacctgacccgcgcagcccggactcccttcccttcccttccagggacgcctggtttccccccaagcgaaccgggatgggaagtgacttcaatgagattgaacttcagctggattgaaagagaggctagaagttccgcttgccagcagcctccttagtagagcggaatgagtaatacccacacggtgcttgtctcacttccccatccgcacccggccctcacctgctgtcacctcggcctcccacacccggtccgcgctccccgccctcttcctcgcgtagaaccgt

SEQ ID NO: 5781 - DNA, 2678 bp, Homo sapiens
cgagaggcgatggcgtttgctttggccagatttaagggcaagcgaggctgcgcgcggctcccgcagggtcggatctccgagctccagggcgcccctccacccgggtgtagatttcccgcggaccccttcgccctcccgggtttcatcagctgcgcaggaatggagctggccagagctctgggagcggggagggaggcgccgccaccagagggcgccggagccccagcgctgcggccggtgagcggccaggctccccggcccagcccagcaaaggcctggggacgcccgacggctgccttcttcactggacctcactgccttcagttctttaagagcagggccaagtcagtggggttcccggctccaagcccagtgcccagggtgggtgggtgggtgggtgggtgggtggatggatggatggatggatggatggagtgccggcccacagccatctaacggccaaagtggttttggaaaaaaaatgcacagaagacacctactcccaccagcggagttccggagccctcgcagcctcctgttgaccgctcccgcctaatgcagccgctgaccgcccactccccgacggccaggactccccagggacagggacgtgtccccagggcaggcccctggatggacgcggcgactgaccccacttcgctggacgctgtgctgggaaggacacagagaggtggctggggcagcctgcggtcacaaagcgaggcccaaaggggcgctctcctcacccccacgtctcctgggtgccgacctgcaccctcccttcgccaccggactggggccatctgggatgtctcgggggtatccggagggctaagcaccgccgagggacggctccgtgggaagagttttctggacccagaaggcagacgccagtagtactgtcctaggagtcggaggtcggggtgggggagttctcagctctttgggtcgcacggagcttttcttgggtaaggcagtaagtacttaggtttaaaggacttacttacagctaccatttattgagtactgtctgcttgtcagacacgatgcagagaatttcgcggcgtggggcgggtctcattgaatctcccgtcccactccgcggggtgggcctgtgattagctcatttcaccattgagaggtcggaagtacaaaggctacattcgcttttactgagagccgccggcgccttctgctttgtttgtacaggcgaggaaactgaggctcggctggtggcgccgtgggcttggagtccgagccacgctgactgcaaagacgggtctcattcccgcagatcgagctctgccggcggctgcgccgcaagccgggcaggtggcgagcttgagcccccacgcacagaaagcaggaccccctcggctgccttgggccgccaccgccagcaggccctccgcccgggactaacttgtttgcttttcattggttctcattcagttcccgccatcgaaaggccccgtcccgcagctttccacgcgcgccccactttacgcctaaggtcctcagtctctccagtggggccctgtcacagggacaataagcggccctccagccggcgtcgctcaggctgcggacctcactgcagaccgggccagcggtgcggggcccagcggagcctgagaaggtcaaaggccggagcgcactgcgcctcgggagcacagagggagcggaggaggggcgaaggggatgggtggggggtgccgccgagggagtcgcgcgtcagagaccccggccacggccagcactcggctccgggcccgcccctcaccgcgcgccccgccccgccccgcctggctctcccctctaaagcgcccggcgcgcgcctcccaccgccgcactttcactctccgtcagccgcattgcccgctcggcgtccggcccccgacccgcgctcgtccgcccgcccgcccgcccgcccgcgccatgaacgccaaggtcgtggtcgtgctggtcctcgtgctgaccgcgctctgcctcagcgacggtaagtgcgctcggcggggaggccctggcgaggctctgggcttcggctcccgcccggcgcagagccgcggctcctctgcctgcgcccgcagtttgcgccgcccgacacagtgggggtggaggcagctcgcttagctgggcgctctggtgcggtgtcgcgttcaaagccctacttttgcgccgagggtttgtgacctgcagagagcgaccgcctgacctcaagctggctgcagagcgaggtcagccgggacaactgggcaggaacgccccaagagagcgttcgggactggcgcgggaaggcgcgagggtggggagccgcggaccccagacccctgcctgcccaccctccacccactgccttcccgctgcgggctcggtttccacaggcgaatgggctccgaggtcctgctgcgcacagtgctggaggtcgggcggtgcatggcgagagcgcgctttgcaaagttcgcctcatgccgcgacttgaggctgtgaggtccgatgcagccgcgcagcctccgctccctgcgaagccgatcctctccccacaccctcgcggggctcttggccaggcgcgggcgggctgcgcggcgcagctgtcgggcttgtgccacccgccaggccgcgcttctgcacagctccgcggtccgcagcgacgcggacctgggcgcgcgtccagccgc

SEQ ID NO: 5782 - DNA, 2756 bp, Homo sapiens
cgtcctcgcacgcatcaaaagggccaggcgggctgcgaggctcgccgtcctggccagacacaggacgctcacgcaggcgcaccgcatcgtacagaccttgcggtggctcatcaagcagcacatcgcgctcggaacgggagcgcgtcaggaggcccacgttgcggagcagcagcaagacgggagcatagagcaggttggccagtcccatgccaaggctgagctgctcaaagcccagcgagtgcacaatgtggcctgccactatgggcccgagcgcgtaggccaccgaataggagatgtcggcgatggcgtagacgctgccatagactgagacatggcgcacgtccaccaggaaggcgagcgtgggcagcagtgctgtgtcgactagggctatgccaaaacagaggccgcatagtgagaccactagcggcgcgaaggagcggcaggcgggcacgatgcacgagctggcgccgatcacagccagcccaagcgcgccgtacagccactgcaggtgtgggtagcgcgccgccaggcgcacggtgaggtagacgcccagcacatgaggcacgaaggccggcagccaggccatgcccatctcccactcggaagccgccatcgtatgcttcatccacgtggcaatggtgggttcgaggaaggcgaggggaatgttacaggtggtgagcgcgccggccaccacggcaatgtaggggtctagcatgaggcggtggatgggagtgcccactggcaggttggcccgagcccgtgcagccgccgagaagggtttggccactgccagcagcaacagcgcgtcaaagagcgacacggcagctagcaccaagaagggcacgcgcttgccggcgaactcatagaggatgcccccgaagggcggggccactaggcttccgaagctaatgaaggccagcgccacgcccagtgcacgactgcgctccggctcctccgggtacttatcggcgatcatggctatgccagacgtgtcggcgaaggctgagcccaggccctgcaggctgcgcgccgcgaacagcgtggcgtagtcctcggcgaaggcgaacaggactgtagaggcgaacatgacgcccaggccgatcagcagcggcacgtcgtagctcatgcggtcgatgaagggcccgctcaaggggttcactagcagctgcaggatagccttggaagcaaacagcaccccgatcttcacgtcttcgctctccgtagggtagcggggccgaagggctgagcccgctggccacgcagctgtcggggacgccgaggtgttggccgtgtaggcgctggcattggccggagtgggcagcggcagggtgggctcccacacctcgggagtccgggtggggccctcgccgcccccgcgcatgtgggcgatgtagtcgggcactatgggcacgatgaccatgtacagcatgttgtccagtaacagcgccacgcacacgataacaagcaccaggcgcctctgccgccggggctcctgcagcgccgcgcccacagcctccgacagcttggtggccgccgcccgggcctggcccgcaggttccgcggattccatgcccccaccccgatgctcttccgaggacgcctccgccagggccgagcgctggcgtcccgcagtgcagaggcgagggcacgggacttcggggaggctgtcctggccgagcagactcccctgtgcctcaggtggccgcggagctcatggcccagcgtcccgggaaaggaaaggactccgtccggcgaggcgttgcagctactcttagccgatcccgggacccgcggctgctgggctcaggggcggccgggaagtcgggcgcgccgaggggccggggccggagactgggcgcacttcgcccggggcgcgcccagagcagcccccgccgcgctaagaggccgcccgcgctggccgagggacatgctgttgccgcccgcccgcttgcccgcccgttagccccgccgctgcgctcccctcccctcgcgtcggctcttgcctcctccgccgcctcctctttttttttcccttccactcggggctgtgacgcggcgagtcccagcccccgagtggtgcccgggccacttacgtcgctcatgctaatgcgacgtcggcggggcgggggccgggggcggggcgtggccgggcaggggtccgctctccagatgctccagggctggaggcccaggaagggctctcggtgtggaagtcttgaaccagcccctgggatgggcgttccgcgccggtagctggccctctgccccccgccccctgcctgccccccgcccgcggttctaggactcgcggggtcagcgcccgctcttctcctcttggggaagggggcgcggcagccggttcctcgaggccccttgggagaggcgggagccagaggcttgcgatctccgcttcagcctggacctcggcgcacagcgagcaggaagcccccgaggtgagccgccgctgcgtccatctgttctcgcagctggattgtggagccgcgtccggaggagcgctggacacggacacccccaaccctttctccgactccgccccctggccccttgcacacacactcccgccaggaggggaggggaaggctcagcaactgcctggcctggctctgacccaccggcccctccgcagaatttctcggccgcgaatcgcggccgggagcttgtggggactgagggcagaagttgccgcgccccagtcggggtcgcgaatattagcctggccgctgccgccctcccgc

SEQ ID NO: 5783 - DNA, 990 bp, Homo sapiens; identical to SEQ ID NO: 5553

SEQ ID NO: 5784 - DNA, 829 bp, Homo sapiens
cgcagcgatcccgcgcaggtgagggtactggggagcccgtggccttctccgcccgccggctcctccccatcagccgtcagccagggctctcggcgccggggaagcctcccacagggtcccaggccacccaagcgcggtcaaacgccggcggcccggcctcgcttacctgacgcagccgcgcgtccgcctcgacccatcaggcgcgcagggcccgctcccgaaactcgcgcgggctctcgcagtcggccgcgcggcccttagccgcgaagagagcgtcgcgcacggtggcgccgccacagccgtgggccgccgcgcccaggtagcgctccagctgcccgcaaagctcctgcagcgccgcctcgccggggcccacgcgcgccggccagagcagcgcccaccgcccgagccccagacctcaggccccgccgccgcccacgtccagctccggcggcagccgtgggaagcagtgttccagaggcggccacagcgccgctggctgccggcgcgcgccgcggaaccccgcggccgagagccggccggcccagctgggcggggacacggcggcctcgggcttgtgctccagccccagccgggccccctcgcgccgctgcggctgctgcgcggtgcggtcgtgacaagtcacagcaaacttgccctccgcgccgttccaagccaccaggaagcgcaaccggtgcctctggggatcggcgaagaggccctcccggagcggcgcccagccctccaggctgtcgggctgctcgtcctccatggccgtcggcggcagcggccctagggcttggcgggcgcgggcctgacctcgtcgcaccgc

SEQ ID NO: 5785 - DNA, 4119 bp, Homo sapiens
cgggaaaggtggcagccgaagacctcgcggttttccctcgctcaggcaccccgccccgcccccagccccggtcctgccctccgcgccctgctggccgggcactcgggcgtccaggagctccccctcggggtggcgcgcggcgaccgccggcgggtttggcagcagcgccagtcgcggggcggcccgggcaactcgcccgcctgccggtccgcccacgtgcgcagagaggagcgaagcgcgagcagtcgcctcgcccgcgcttgctgccggtgggtgcctcacctaaggggccggcgggggccgtaacccgagccccatcgcagggatccgcatttgcataattcggctttcccccgttctttcggactcagggcccgagatgcgagtcggactcccttccgaggcgtcgtcttgcccatggtcagcgcgggggccgcgggacccgccagagcgcaggcggagtgggctggcgcacgtggtaagaacgcagctatcttttcttgcttttcttttctttctttctttcttgagaaataggactttgcacatttttgctggggtggggtatctactagggtgctaaccttgctgcgatttctttccatgtccttttcatccccaattggaaaaaagcgcacagcgcgagcgagaaactttcccaaatgtgctctgggtgacttaagtcagagagatggccggccgctggataccggctgttttggagggagggggagaagcagcgcttcagtggaagagcagagggagagaccgctcccggcagcctcagggccctgaccgcggtgcgctgggcccggcgagagctggcgcacggctgcagcggtcgaggcaggtgagcggctgaagacccgcctgcagcgccgcgcttcctccacggcgtggcgccgtggctcccgcccgccccggcccacactaagctagggccgctccgggcccggggtgaaaaagggacaggacaggcctgcgaggctgaccctgcgcgttatccctggcctccgcggctttggagcgggaaagggctctggggcagttcgcaacctgcacaaacgaccatgaatgagtcatgcaggcggcggtgcgctggacttgggcacccgggaccagcctcctgtggggccccggacaggcccggctatccattgcgggctggggcgcactgggaggtagaagctttgcgcccagcaagccagaacctgctgctatttggactttggaaaagtttttaaaaattgctttgggaacgaaacagaagggtttctaccggggtctcgcaaagtaaaacgagtgggttgggggatggggatggcgtcttgaaagtgattagagatgctttcggccgtcactgaggaccgcgctgggctcaccgaggtgttttttggggagggagagaaaatatttattctagtacgtgtattctggctcgggtgcgggcagggcgcggtcctggatcctgggctatgggggtcagggggattctgtggctgcagggaccggtagtgaaggttaggccagtgtcttcatagaacctcctgtccagcgagcccggagcccgctctgccgccgggacactgctggcaacgacggcgcgcggacgcagtcaacagggaggtgtgtagtgtaaggtgtgtgagcgggtgtgtgaagagggcagcgggggcgggagtgtgtagcggaagtggagcgagtgtgagtgtgtgtgtatgtgtgtctggaggggcagggtgagtgtccaagcttccatctggacgcccccacgcagccgaccgcccagacgcgccgggaagggcgcccgctccgcgcagcagctgaaggggggcggggagcgcgcgggcagaggaaggagggtgtctccggctgaggatttctctcgaagctccccacagtaattctgctcctcctagggtttaccctcccagtcccaaggtgcccaaaatacttaaacaaacaaacaacccaaacctgttccgttttcgctcctgtataaatagaacagactttccaaaaaagcaatacgcattcactcttatcaccagccacttctttccaccaagtaattcagaaaaaagcagtcagcttccgtgaatgcatgtagctttttttttcttcgctgcctccttttgcttgcggttttgagctgccaagaaagtgagtaggggtttgactgtagtgtctcggctccgctcggtttctttccgaagtttaattttccggaatggctcccaaacaagggctagggaggcggagccgccggcaccggatcttcgccttttttggaaagtcccagagaaccggaattcctccccgccccgggaggctgagccgcagcctggagcagctcgctctcctgctgtggctgtgactgggtccatggcgcgccctctcccccgcgatccctgcgccccggacccaggctgcagctagggccgcgcgcccgggaccccagcgatccccgccgcctgcgagctggaagtcgcgagcccggcggagtccgcgcggccgagcccgtgtatgcaaatcagccatgtgacggcaaaagccgcctggcccagccctgttcctcagtccatatatgggcagcgacgtcacgggtattgaagacctgcccataaatacttagagcaacactttccgtctaactgagcgaggagcaattgattaatagctcggcgaggggactcactgactgttataataacactacaccagcaactcctggcttcccagcagccggaacacagacaggagagagtcagtggcaaatagacatttttcttatttcttaaaaaacagcaacttgtttgctacttttatttctgttgatttttttttcttggtgtgtgtggtggttgtttttaagtgtggagggcaaaaggagataccatcccaggctcagtccaacccctctccaaaacggcttttctgacactccaggtagcgagggagttgggtctccaggttgtgcgaggagcaaatgatgaccgccaaggccgtagacaaaatcccagtaactctcagtggttttgtgcaccagctgtctgacaacatctacccggtggaggacctcgccgccacgtcggtgaccatctttcccaatgccgaactgggaggcccctttgaccagatgaacggagtggccggaggtaagccgcgtgtcttcgcaggcccggacctgcgcggcccggaggtggtggatggggtgcagtgggtgtgcgggaatcgcaggagaggattggggctccaggtggacggtgctgactgcactggctttgaagactggaagtgggtgcaggaggaacctgcgacagctgagaccagggcgcgcgggcagatgcgccaggtcgccagcaaaccggcgtgcgtgcgccccggcgcgcccagccccgggcgagcgcagggatgggggtggaagaggcgtccccccgggtttcgaggcttgcgtaggccctctggccggcagcacttcgacctcccctctcccggggcaggggcaaagtgacggtaaagttcggggctctcggggagagctgcgcgcctggagagccgagcggcggagaagcgccaggggaaagcgtcggtagctccctcctgggcagagccgaccccgggaaaatctcggagcgctcccttcttgcggcctggaggcgcgcccccacctgcccgccgcccgcgaagttgagggggttagtaaggcgggggctccggccggcggaggcagcgagtgggtggtggaggagggcgcgcaacggcgggaagcagcccccggactgccgagggaggcccgcgggggcaccggcgacgccggtttccttggcgatgctgtggaaagtcgtctctcgcggcccccgcgccttcctcgaggccgggccactggccttgggctgaggcggggacgcgcggctgtcgggaaaggcggagaagattgggagggcacggaaacctacggactccttcctctacatcccccattcgctccagcagccctcggctgaagcgcagcgggagagggagggagaaaaaggcacaaggcgccggggatggggagcagccgggaaatcacccacccccttctcgggctctcctctcggtttggcaccatcacgg

SEQ ID NO: 5786 - DNA, 1575 bp, Homo sapiens
cggcctgggcctctgggcgcgcttgccgctgcgcgggcgcggggcggctgtcacaccaccctggccgggtcccgaaagggaggagtggagcttgcccgcctccgcgagcctccgcgcgcccagccttcctccacctgcccggcgtgcccagggcgctcccagcgctggaagccgggggcgcttgcccgaggcgggagtcgctgggtcatgctcttgcccaccaggtcctccgaatccctggtagggcagcgtctgtccgtgtccccgacccctcccgcaggcaactcgcgcgaacctggggctcgcagagagcgagcgcccgcggacaccggctgaacagtctggaggctgcgcgagggggcgccgcggggagggataaaagccagcaacaaagagcacagacctcgtccagcagttgattgactcgtcccaaaatagccgtctccatttgctgctccccgcgctccgcttccaggcgcagcacccgggcctgcagctcggccgtccgaaagtgggcgagcaggctgagtgccagcgagcagagggccagcgtcagcagcccgcacgaccctggactcggcagccgtgcgccgcgctccgcccgcgccgccaccagagccaccgtcccgggcgcgcccaactccccagggccgcgggcaccggtggctgccgctttgtgggtgcgctccgctaccatcctctcgcgtcttgagaaccaataaataaataaatagaataaataaaggcgacagccgctgccaaaaggctctatccaaactgcggggcagggggaaagggcttgtatcgctggaaaacgtccctttccgctgctcccggcaaagaggacggaaaaattagcagtaggagaggaagtgccgaaaaagcacaaccagcggtaattggggtacacctaggtgagaaaaaagttatttcgaagaacgttccaagtccaggaaagttaggggaatctgaccggctctccttctctccgcccagtctttcccttcaagtgtctgcagagcagttggtgccgcgctgtcagtccttctgggcgcctcgtgtctcccgggccagtcagtttcagtccccgggcgaaggggcgcacacggagggccccatgggcagaggtgggtcgtggcggctggcgaggagcgcaggggccgattccggcgcctctgtaacttgacacactccctgcggcggcacggatcggatgagcaatccgtgctacttcccaaactaatctctccctcccccctccctcctcctcctcctcctcgtcactcctcctccacctcccgcggggccgacggcttggatttgtttatttatgcaaactcgcccagggtggggggcgtggtgagcaggtccggcggccccagcccgccggcccgggagcccctctgccgcgctccccgtcctctttgaagtgacacttggggttatttataggcaggaagggggtgtggagtggagctggcgctgcacttccctctctttctccggattcacaccgagggctcgtttggccttccacggaggcggtgaggcgggcaccaccttccatggacgcgt

SEQ ID NO: 5787 - DNA, 2401 bp, Homo sapiens; identical to SEQ ID NO: 5563

SEQ ID NO: 5788 - DNA, 1579 bp, Homo sapiens
cggcccggtgcacgccggtgccactctcgcggccaagcctggggctgacaccatgcagcacacggcgctacccacaatgcaccggccctcctctgtcacacacaggcacgcacactcacccccgcgcccggagggagcccagggcccggcccgtgggcgcccaggcgccgacccctccgaccccgcacttacctagaagttgcaccggtcgcgatcccgccctggcgccctcgggggcttggggcccggccggcggcggccgcggcgagcgactccgggtaggattcagccagcgccgaacaaaggctgcgcgcaggcagcgggcgccgcctgcatccccgctccgcgccccggcggcggcggcggcgcgggggcccgggcgggtccggcgcccgctcgctccgcgctgcccgctccgagggcgctccggctcccgcgctcccgctcgctgctgcccgccaccgccgccgccgtccggctaccgcaccgcacacatcaattattcatcgcccgtctccagcttcccgggcgaagccaatcataggcggaggctccgctaatggggccgccgccgccgccgccgaggaggcagccagccgcgcgcccgggcgcaagcgacagctctccagggacggggatgggccgggggcgcgcggggggcgggggcgcacggggcgcgccggagaaacttcccacggcccgcgctctgcgccgcgctcgcggaccctgcgggcgtgaccacccaccctgcgtgtgcccgcgtggggctgggggctccgggggaggccaggccagccgcggcggggggaggggagggaggaggaggaggagcgcgggaggaagatgaaaggcgagcagacctgccttggcgtctccagggagccccggctcgcgcgcgccctccccgccccgcgagcctcgccgtccgcaccccgccccccagcccgccgcccgcactcactcgcgcgcgcagaccgtcagcccagccacttcgctgcgagggagcgcgagcgagtatgaatcggaggcagctcacatttcaaacttgcacgcaggggtggtgctggtgcacgccgctgccgagcgaacgcacgacccgacgagcagcactccagcctccgggcgggggcggcgacgaggcccctttccttcccccgcccaggcaattaattggaagcaacacttgtgcgagtggggctcccggagcgctgtcgcccgaggaggccgccgggaaggcgctggcggtggatgacttcgggtgtctcccgccccccagcgaatcctcccaagtgggcatgctaatgagggtccacggcggggagggggtggaggagggagctgaactggagggggcctcggccggggggaggggaggggaggggaggggagggcggggctaggcatccagattaaatctcggtttaaaggattttcggaacgggctacggggtggagaaggtaggcggcccggcatcttacttccctgaccctgggtgccctggcacccccgggattccccgagcgaggggcccaggacagggtgaacacgcgcacgtacgctcccgctccccgacttcgg

SEQ ID NO: 5789 - DNA, 919 bp, Homo sapiens
cggctcacccaccccgcgcgcctccacatacgcctttcctcgacccctcacgagcacacgcccgtcccgcgtgcccgctcctctctgcctcccgccccgatcctacgctccccctcctccctggaccccgccccctggagcgcgcccgcttctctctgccacgctccccttctttcattccctctcctctctgcccgttgccccctcgtgcgcgctctccctcctgcacaccgcctcatctctgccgcaggcccgactcctgaacgccccctcctctctggccccctcccctggcgcgcgcccccttccgcacgaccccttctctctgccgggcgccccgcgcctgcacgccccctcctctctgccgcgccccctctactctgcggcgggctcctactcctgcacgccccctccactctgccgcgccccctctactctgccgcgccccctctactctgccgcctgctcctactcctgcacgccctctcctctctgctgcgcgttcccccttcgctgcccaccgcgtgccctctgctcacctatccgcgcgccccttccgctttgcggcgcctacactggctcctgaggcgcgagctctcgttgcctggcaacgggacgccgctcctgggtggcgagcaggcgcgtgtgtaggggtgagcgcaccggaaaggcccgaactgtttttgggatttgttcccctagcttcgctgggtccggcgggcagaggcggttctgaccgttgggccttgggcgtcgagcaggactcacctgaggcggagagaggccgcttcgcgcctggggctcccgaaagcggccagctgtcctcctgctccccctgagcggggagcgctgcgtctcctgcgggctgcgggagacccttccagactcccgggtgggaaaaccacactgagcgccccgg

SEQ ID NO: 5790 - DNA, 944 bp, Homo sapiens
cgctgggcgaggccagggctgcggcaggggagccgagccgggagaggggcgcaagacctggcgctgggcgggacgctcgggcagggtgcgggaggggctgagggccgcccccactgcctccccgccttggagctggggccaggcggccggagattggctggggcgcacggcgaggcccgggctggagccccgaggtgggaggcgccaggatcagtcggggcgcccgcagcgcaggctgccacccacctgggcgacctccgcggcggcggcggcggcggctgggtagagtcagggccgggggcgcacgccggaacacctgggccgccgggcaccgagcgtcggggggctgcgcggcgcgcacctggagagggcgcagccatgcgggcggcggcggcgggggggggcgtgcggacggccgcgctggcgctgctgctgggggcgctgcactgggcgccggcgcgctgcgaggagtacgactactatggctggcaggccgagccgctgcacggccgctcctactccaagccgccgcagtgccttgacatccctgccgacctgccgctctgccacacggtgggctacaagcgcatgcggctgcccaacctgctggagcacgagagcctggccgaagtgaagcagcaggcgagcagctggctgccgctgctggccaagcgctgccactcggatacgcaggtcttcctgtgctcgctctttgcgcccgtctgtctcgaccggcccatctacccgtgccgctcgctgtgcgaggccgtgcgcgccggctgcgcgccgctcatggaggcctacggcttcccctggcctgagatgctgcactgccacaagttccccctggacaacgacctctgcatcgccgtgcagttcgggcacctgcccgccaccgcgcctccaggtagcgccgccgccgccgtccccgcgcgctccgacgg

SEQ ID NO: 5791 - DNA, 1096 bp, Homo sapiens
cgagcatcaggaaagcgaagccacacaacgcggctcctcctagccccggcgcggcagcctggaggggatgtcttttttgcaaagcgagttctccaactttcccgggccttggcggagctccgggaccgcgcaggggtaagtggagtgccggggaaggggcgctggggctggggtgccggggcaggggtgccctgtccgcacgtacccacgacagtgagcagcatgttgtccagcagcagcgccaggaacacgatgaacaggatgagcttccgcgagcggcggctctcctgcagccagcggaccagcgccagctcgctcagggccatggctccggggctccgctgcgggcgcggtgcgcggtgaggacccaaggcggccgtggaccccccattctcccgtcccccaggccgcggaagggcgggtcagggagccgcgcgcaccggcatccggggacacccccgggcgccccagcctcggctcacctgcctcgagcgcgtccccacgagagcccgcgctccctggaaagagcgcccgcgagcgccgtcggggacccaatctggagacccaacctagaacccccaggacgctgccctgatccccgccgcccccaactgtgccacctcccaaactgcacgctcggccccgtgcaccttgcgccctgcgccctgcgccccggctgccccggggtccccgcagccccgcccgcgtagctctgggggcctccctgcctccctgcctcccccgggcccgctcccctccggcaccgcgccctgcgagcagggaaccggggccgtgttacctcggggtcgcttgcgatgcctgcccgggtcctccgtgcccgcgccaacgcccgcaccgcagtgggctccgtcagtccgggcggctccgggtcgcagtctccgccccagcgccccgccgccgccgctcagtttaccccgtccggctctgacgtcacggccggagggagcgggggcggggggctggggcgccccggcctccgcccgcccgcgccgtcgctgcgcaggaggggctgccgcctccctgtccccgcctcggccgcggccgcgcctcttccccggacccagcgcgtggccga

SEQ ID NO: 5792 - DNA, 4048 bp, Homo sapiens
cgcacgcctagatgggttcctcgcgcccgggccgcagtcacctgagtttccgtgaggctgaggctgtgtgccagctgcttcctttcggcgcccaccacgtagtgattcttctcaaaggcgtgttccagccttagaagctgggacggggagaaggcggttcggatccgcttgggctttcgggccagcgcgttgtgcaaaaggaaactctcggggctagtgtcgttccctgcggggagcacagcagaaatcccattagggggggctgctctgaccggagccgcgcacttctcccgagccgggctggcccggcaccgtgctcagggccttcgcatagccgcgccgctcgacctgcgggggccggtggtcctcccaagggctcacgaagggaacgcctgctcagctgcccggcccggaacgccgggtctccaccggtgcggcacccaaccagccgctgtcgcagaggagccagtccccaggctcctgacctcggccggctccgcagccgccctggcgccgcgggcctcgccacctcctcgccgggcgctggaggcaggggagggagccgcagagcctggccaggggattggcgcccacaacccgaagaaactactttctcttctttctaacctctcggggaactttgacccacggtggaaaggcggcgggctgctctccagagttttcatggagatttatttttaaattatttgttttattgcccctccggaaaagtatagaggcggggcgagtcgttgaagcccgatcgggacagaaatctggccggcgggtgtgcttggctacagccgctgctgcctctcgcgaactgggctccggggctcccggctcccgagaactagaagagaaacgcgagcgaagggatcgaaacccggggggttaccgacttgcagacaccgccaggacagtctgtaacgcaggaagatcccagcggctccgggtctggtgaggggaccataagcatgactgatagcgaatgaggaagggcagccctaaacttttcaagcaaagcctcagagttttgggttcactcattagcataggaaatcgattcaccgaaaacccaaacaaagaaaaacaagccgacagtccaggcaggatgcaggcaaatccagttcgggattaagggtaaaaggctttttgggttttttttcctttggtttgattttttaaaatatggggaggggggtgacatctacccgattctaggctccggcaggaacgcaatgggttaatgaatggacaagccgcggagtattgatcggctgccgccggaggtaggtcttttactgactccaatccgtaaactaattactcctttttctgaagttttaactctcctcctcccaccccgtacccagagaaaaacaaacaaataaaaaatatcgcaagaaatgaaaacacacgaacagatatttccctctaagacagtttcctgaccaggttctttttttttttttttaaagaaagaaagaaaaacaaaaaccagaccgaacctgccttcccgctgtggctgctcggcgccccaattaagcaggtcgcggcgagagcgccaagccctggagctttcctcccgcacgggttcccgcccctccccaggcctccgaaaagcaggaaagaaaaaacaaatcccatacttttctcccggggcgcgaggatcctctcgcctccagaagagggtggaagactaagaagccgcgggtctggactgaaggggcgcaaagtgggtggtgaacagggtcgaacgcagtcgaaagcaagcctggcggccgagtcctgtccgcgcccctcggagccaggacggttgggggcattgccgagggtaccaggagcctggggatcccgcgggctctgggctccgcggcgccgggcacgcacagcccagcctgctctgattcgagcgcactgggggacaacttctccgttcgcaccccttcccaaagggtcaagcggcccgcaggccatcactccaaaccagtcgtagcttcggagactggggatcgacaccacgcccggccccgcgccgcctagtttcccaacagggcgcgctggcccgcgagccggaggaacctccgcccaggccttgccaagcgcccacccggagcaggccgggggcagtgaaggatgcggcgggagcggcgcgctgcagttccgcgacgtggcacgtaccttggaagcgatgacccagatatcggtagcggtggatgagccaggggtagaaggtggacggatcccgctgctgcgaggcgaatagggggtgtggcgagtgcgaggagggtagggggtgggcggccagggcgtgcggcggcggcaccgggtgcactggcacggcggggttgggcgggtgcgagaccgcctcggcgaacaccaagtccgggttggagtagacgcccctaccggcggcggcggcggcggccgagtggaagccgttgaggaacggatttatggggctggagttagcgtagctgagtgccgcgggacggatggggtcctcggagcgcgaggcgggcaggggactgtccttggccaccagcgactcgatggtgaagcagcgcttgggcgccggctggaacatgctgcgccgaggagcgggcgccctgggctcccagctcctggcgaccgccgcacgctgcctccgccgcccgctgcccgcggcgaggacggacgagaattggggactcgtttgtttggggtgggggtgggggtggggggaaggaaaggaagaaagaaaggaaaggaaaggaaaaaggaaaggaggggggagggagagggagaggcaaagccgaggatcccgagaatcttgcaccaaacgcgcccaacctgaagagaggggggaaaatccttccagaagaatttgcaggcgtggattggggtaattttttttctttttttttctttttttttcttttttttttttttttttttttttggcgagatggcgtggggggatcggagttagaggcagggaggagaaggggggaaagttctcgggggaggcaaaaaaaaaaaaaagttttttctcctctgcaaaaggcgggcagggcgccctaagtccaaggacaatccatggaagtgttcgcttcttcacaagttgtgcaaacgatttgttagttcatgagcctaattagtgcggggatcacataaacagcttcctccgaagcctggtaaatggcttgatgattggtcgctattactcgccctgaggtggaaggggggagactctttaaagtgcgtcagagggaggtgagcgcctgggaacccggaggcctggatccgggccgagagtggaacggagtcggcgccgccgcctcggctgagccttctgccgcccaccgggcggccgggcttctccgcgccttcgcccctcgctcccagctcactcgctcctgcggcgcccgctgcggcttctcctcctccttcgcctcctcctcttcctccagtttcttcttctcctcctcctcctcttcttcctcctcctcctcttcttcctcctcctctttccccacctactccccctcagccaccgcctcctcctccaccagcaccactccctccggggcaccccggtccctgcagagtccctggccggcgccgcctccgctgcggccccctgaatcccgagcctgcctcgcccaagctggtaggacagaaggacagacagattcctctagcctagcgctccgccgctgctgccttacgcggccccgcgtcgggagaactgggatcgccccaagagcaccgcgagggtaagcgggcaggggctggttcccgggctaaaggcgccgttcggttataccaatccccacacttagcaaaactcccagcggtttcctaggccaggagggatcctggagtgaggggtacggggtcctcccaccccatcaaccacgcttagcctcgaggtcccagggtcggtgcgttcgcgattcttgacccggctcgttcgtttgcgagttgagaccgggagctgccgaccccgccggagcagtgggcttccaactctctccctctctcgccccacggtctctagcgt

SEQ ID NO: 5793 - DNA, 3292 bp, Homo sapiens
cgcgcccaagccccagttcctgaaggccgctggacttctcggcgccctcggcccggcccagtctcctccggggtccggacaaggaggccgggcgctccctcccccacccctctggggcctcagaccggccgtagcagcggcacggaagagaccaccgggtgcgagtagtagacggggtgcgggaaggtgagcagcggctggctgactggcaccggggcccccgcggctgcagccgccgcgccctcggccgccgagttctcgtggtagaggatgggcacccgcacgatgcgctgcgccgcggcatggctcaggttggccgcctccagctccgccgccagctgccgcttccacttgttgcggcggttctggaaccagatcttgacctgcgtctcggtgaggtgcagggacgcggccaggccggctcgctccgagctgctcagatagcgcttcatgtcgaaggtggactcgagctggaagacctggctgcgcgagaagactgtgcgcgtcttcttcttgcggcacgccggcttcttctctggactttcagcgcccttcttccagtcttctgcgcccggagtggccgccgccgcccctacgctcgccccggccgcgcctggcgccgcttcgccttcctttttgctttcctcggagtcgctctcctccagaatgatctcgtccgggctcttggagtccagctccttgtgatcggggtcggccttgagcagtggctccggagagtcgcggtctgtgccggaggcgggggaggagtctctcagcaaggccttctccgaggctggggagacagacagacggacgcacacacatgcacaccgacacagccttgagcgaggcccggcgcctggggacggcaggctcaacccgcgccggcctccaggtcccaggccatgaggcctcaccattcccgcgggctgcctccttctcggctgggccagagaagggacgccgagtcctgggatccccctcctcccgaggacaggcaagcagatggtggtagcgcggccacctccttccattccctcagcttcctcgccaggggccggcagaacggttccctttcggcttaggcgcattggaatcaccccctccttccaggccgtgtcccaagccccggccgtccgaagcctccctattcacgcccgaggccacttttcccgggaagcaccgtgcccggggctccaattccacttcttttctcaccaagtgggattggattaacgggcagcgcaacccagcgcgagggcaggctaggggccgaaaaaaactgaccgagcagagggtttgcgggtgctggggtcccagaactgcggagggaagcagcgcggggcggggacggggcgggcgcgcagggggacaacgaaagttcaaagagaggtcggtaccttcaggtcgcgggaggtggccgccggcgggggtcagggtgtaggggtaccaccaggctggggagcgctccaggtagtgcgcgggcagggcaaacctctgcgccgggatctcaaagcgagggaaagccaggtcgcccacctgcgagagcgcgaagcccgcggcgccctccagggcccccttggccgccgcggcagcggcagcggcggcggcggcggcagccgaggctggcgcgaagagcgtccgtgggggcggctgaggcttagggggcggccggtggtggtctccgttgagcaggttcttgatggagaacggggactccttgggagcgggtggggggggcggcggcggttggggctgtgcgctggcggtgccggcagcgtccggcccgggttccggcatggtcccctctcctccgggtccccgggagggagggagcgggacaggcgggcggcggggcgagcaggcgagaggccggaaatcagaccataaacggaactcaactacggggcgcaaagtcgggggccgccccgggcgcaaatccaacggcgggagggcggagtgaggacccagacgggcgggctcgcatgagggaggggtgcggaggggcggggagcggccctgccgcggcaccgagggatcgaggcggctcggctgcggctgcggctcccgcggaggaggcagcaagagcagtccccggctcgaggctgcgtcaatccggcgccggatgctaatgatgaaatcaaaatgtcatccaagttaaatgcggggagtatacggcgattgggcgcgtacaatggcaaatgggattaggcaggcgaaggctcagccgagccccggccccgcagccgcctccgccaccgccccctcctcgccttccctcggattttggcgctttggcttcgggctataagagcccgcccgttattggctttatatagtccaattaggcagcaaatgaggacaagcctattagcacaaaaggatattggctcccgctaaagaggcactcggagcgctcctgcgagcgcaggaggcgagcgagggacgcggagcaggcggcgcccttggccgaagcgcactaacggccgcgagcccggagaccgcgcctgcctctcccccctgcggcgcagggacccgcttcccgccgccaggcctgcgggaggggggaggggcggaccaggccctcccgggtcacctcggggttatctgcgctcgcagctgccgctcccccgccccctggggctggacaggggcccgccgcccccacgcagctggagagccacgcagcgccggcccaagaggcaggacgtgacctcggccctcggagaactcatcattttcctaccctttggggtccggcgacctcggtatttttcctaaagcctgctaggaagggcgaggccaagaagagagggatttgggttccccacccaccatccagccgatagtaagggaatccaggtgtaagtcctcgcactgcgtcttcggactcagaaatccgcgtggccttggcctttagccctggaaaaccgaagagtgagccttcccccgggaccaggagtgggtgtgcctgtgtgcgtatgcgcgctgacccggccaaaacccgcgcgtcactcggtggggctgctggggcaacagcttctcggcaccgacggctgctctcggaagggcacccctctgctctggccgccggtgcccaaggctcgcggatcaactccgagtctgtgaccccgacgacagcactttctcccaggaagtctctccggccagctggcgtttggagctgtctaactaacgctttaatgggggcaaggtgaaccgaaggcgcagcggcgtagcttcctccgccgcggcaagcagcggcatccgctgcgcgtctcgacggcagcga

SEQ ID NO: 5794 - DNA, 3753 bp, Homo sapiens
cgcggctattctctcggtgcagcgccctcccagcccctgcgcggccgcaggtgtcagggcgaggaagtccgtgggcgcccccgccgcgcgtcaaggttccattcagagcaagcggccgcgtgctagccggtgatccagccacacgctgaaccaatgcaaactattaacaacaaaagagtgtagggaagcgcctttgcctccctcaccttctttgcctggtcccgggcctcggatctctcctgagccgcagaactgcctcaccgcgcccagttccctctccgcgcgagacacataactctgccaccggccgggtagctgggcgcagcgacaagctggtcgcgccaagctcgcggcgagcaaagtggaggctttactaggtacaagcagcgccatcgcctgctttatacccctggagaggaagtgcgcggcacagggcatgtcatagcgggagctgctgtggccaagctcaaggcgagcccagtgccgggaatatgccgctgggcacccagctcgcttgttcccagaaggcaatcgcttaaatggcgaggcctgcctcccagtctttgtctttctccgcgcggactcttgagctggattccagccggggtgcgccccagcccgcgcgacgattctgggcgttaggagggagagtgggcgggcagctccagccacgtgcagtctgggcggcgccaaggtcccgacctttaacccctgaccccggtcccaccctccacgtggagcgagccaaacttccacagacagacgcatgcaagtctttccaccgaaaaacctgaaaaccttccgtgcgttatcatgccgggtaaccaagcccaccaaagttagcaaagatgtttaaaatgttttatttttttttctttttaaaaatatttacagatctgaactctccccttttcgtccctaccatcctcgggatgagggaaacgaaaagaagcaatttagtaattgtccaaagcctctgagggcctggcttggccgagcgtgtatgcatgtacatatatacaggtgtatatatgggggaggagtgtacctggttttgtaggtgttttcctgatttttttccctaccaaccacagcctgtctggccaaaactccctttcccaccaccacccgagaacatctcactccgaatggttttcaaagcgtactggttcggtctaggtaggaagcaggctctctgacttagggaatgccaataaatacccgaaacaatcaaaacaaaaagtagggcagagaccataaataagagctaatgaatacacatggtgtatttcttcatatttctggaaacacgccgccttgctccggagccctgcttacagtacagtacgcgcccggctctgcgggcagctgggggcggcgcggggcggcgggccggtcagtagtcgagcttgttgtataggttgtagagaggtaaggccgagaggttgcttcccgggtagtagagcggcgcgggaaaggcgagcgagcgcggcaccggcacgcgcagcagcgaactgtcccggaacaccagcggcatgctcaccagagtctgcgccgacgcgtgcgccatgttggccgcctccagctcagccgagagctgccgcttccacttgttgcggcggttctggaaccaagtctttacctgggtctccgtgagctgcaggctggaggcgaggcaggcgcgctccgagctgctcaggtagcgcttcatgtcgaaggtggactcgagctggtacacctggctgcgcgaaaagacggtgcgcgtcttcttcttggccgcgccggcctgccgctcagcgccgccgtcccgcggccgctcggaccccggcgagggcgagcccgcgggcaggagcctctctttctcttctttaaagtccgagtgcgaaggagagaggaaaggcgtgcgctccaagccgcccgggcccgagcctccgctgcccttgggggtacctgaggagcgagaacagacagaaaggccatggagttggttggggagcctcggagaccgccagctctccctgggaccaagcggttggcaagcgcctgcagccttggtcccaccttaccaatcccctcctcttatccctctcactggccccccaaacccagcaccccgtcctttaaaagcgacaagagagggacccagctacttggagtatggggtctctgtgctcccacctttatgaatgggccaggggcaacagggagaggaggtctggagggggaaacattagcatggttttaaaaggcgaatttgcttggtggtaattgagctggaagagttcctcgagctttatagggtggcatcatttcacaggccgtttgtttggaaatcacgctaaggactaacgcaggactccccttcgtcaaatgttgtaaagaggaaccgtctctgaaatgcaccattgtcaatcatcttggagtgctaatcattccaaggaggagagagagagaaaggcagagatacggagcgagtgaggaagaagactcagaaagagattacggtggagacagactgcccagacccgacttgcagatctccacctcgtgtccggaaagaaagtaccagatgtgcagtgattgaggacagccgggtgtaaggccggccgcgtgtccctctcgctgtggtccactctctcaacaactcaaccttccccaggaagcccaagccggcacgggtctgtgttcgcctgctcccaggggcccaccgggcggaggaggcaccacagtgcgcgcccctctccccgcggtcccgaacccccggctgccgcagctctggccagagggggcccggcgcgggagtcttggcggggcgctcagcctccctcccctcgcgctcgctcgctgccacactggcgacgtgcgatccttacccaggcaaggaaaagggatggggggatggtgcttggggccctgctccttagggccgtgctggtctgggcagaagcaggcgggcgccttccagccgtcgtccggctcctcctcctccgaggacacggacaggctgcgcttcctggctggccagccgacgggctcccgcggtgcctccgaggggcccccgcccaggatggactggatggtgaagctggagacgccaccggccgccggacaccccttgcccgcatcttctttgctgcccatcctgggttcataagaaatcgaaggaaaccaagaactccctttagagacgatctgggtgatctgggtggaaggtggtgcagcaggcaggcagtggggaggggcggggaggaaatctagggggagggggcgccgaggctggtgaggcgtcccttccgcgccagggacatgcaggcaccggatggctgcgcaggggttcctgcccgcctggctctgggtgcgcccgcccagccccggtgcaaatgccccttcctcgcccgccaactcgccgggtctccggcggcgcggaggcggcgcggcctcatttgcatagaggttacccgaacgcggccaatcgcagcgccgccgagcggccccggaaaatttcaaaacgctccggccaggcacacagcaccggtgcgcccccagagcgcgccgagggcctggcgggcatcagcggcgtctaaccaggggcagccagggctgaaagcagctgcagattctagcccgggttcctggcggctgcggcaactccgactccttggaccccttggacccttctctccagaggcaggggcggtgcgggactcggagctggagtggctcgacgcctccgcaggcgacgggtctccgcgc

SEQ ID NO: 5795 - DNA, 829 bp, Homo sapiens; identical to SEQ ID NO: 5784

SEQ ID NO: 5796 - DNA, 1328 bp, Homo sapiens
cgggcgagagatgcccctttgggcgcttagggccgggcggggtcgcgcgccgggctgtgggccgcggtggagacctgacccgcactccgagggttcccagagagccggggagcgagtagcagagtcatcgtttccagcttcagcctgaaaagctggaccgtgccgccgcatgtgcgcttggcagccgggcgccccgggccctgcggccacatcatcctggggcggggacgtgtgcgctccgggcgcccggacgccactgagccacgtctgagccgcccaccctcgggggtgagcgagccgcggctcggggcgggaccctggcggggggacccgagcggtctctaggacccgcgggacgccgccaactggcgggggtgcgggggagacaataatttgttccgcggtaataagaacggtgactgctggccgtggatccatttcacaggcctgccttctctcactaacgctcttcctagtccccgggccaactcggacagtttgctcatttattgcaacggtcaaggctggcttgtgccagaacggcgcgcgcgcgcgcacgcacgcacacacacggggggaaacttttttaaaaatgaaaggctagaagagctcagcggcggcgcgggcgctgcgcgagggctccggagctgactcgccgaggcaggaaatccctccggtcgcgacgcccggccccggctcggcgcccgcgtgggatggtgcagcgctcgccgccgggcccgagagctgctgcactgaaggccggcgacgatggcagcgcgcccgctgcccgtgtcccccgcccgcgccctcctgctcgccctggccggtgctctgctcgcgccctgcgaggcccgaggtaagtcgccgaactagggcggctcgctgcccgccccgccgagggcaccgcacgctgcgcctgggcgcgccgaggtccagggctgccccgaggggcgacgcgccccggcgcatctccggagccccggggcttgcgcttccagcgcggcgagaccgaccccccccccccaggtgccaattccttggggaagggcgacacttggcccgcagccccacaggagccagtacctgccccggagggcacagcctcgggaccgctcccccgtcctcaccctcttgggtgacatttgcagatgtctctgtatcttgacatttacacgtgtcactcgggacgatgcgtgtcgggtcctcttgctggccctatcccgcagtgaatatccccaccccaggctccgggccagcccttcaccaggtttcctttccagccccgcctcccccgctaacacacttaggggggcgcgcagcggccccgc

SEQ ID NO: 5797 - DNA, 2957 bp, Homo sapiens
cgagccgcccccggctctgcgcttcctcccagggcaccaaggccttcaacgccaacacgtggggctgtcaccaggggaaaccggaggcctgagctcagcacctctggacccgcacccggctagcctccagcctcccttcaaacttcggtcccttcccggctgtagaggaggtgactgaggcggaagccggcggccgcggtctggtggccaggggcgaagccaggggaggggttaagggtctggggagcgtgggtggcgactgtcggtggccgcctcccgaaagaaaagtcgcccgccaggcccccggggaaggtgccaaggccgccagccagagcgctcatagcagaagcgaaaccggagaagcaggtggcggcctcgggtgcggatggagagggcgaggcctgcaggtccaggcaagccgcgctcgggggctccagcgctggcgcctcggcccctcccacgctcctggctcccgagcgcacggccgcgctggcttcagctctcctcttcctcttccttcggaagttcccgttgtcaaacatcttctcgcagttggggtccagggtccagtaattgcctttacctgcagaagaagaaacagcccagttcagaaggttcgagctttgacgggccgtggtgtgagccagcgaggaggtcagcttcagaaagatcccctgctggcccttacagagggtctgagtcctcgcccccattccacccttgacgggcactctgtacccgatgggcctccacagcaggactgggaagaaagtgacaatccagaaaggaggaggaagggagccctgggaaaggccgagccccgttaaggtgaaggaaggcctgcgagatgctaatggtgggactccgccagccgctctgccaaggacagcgcagaccacgccaggcccccaggtaggctccagagctttccaaacgggcatcctatttgttttgcccatccttggggtaggcgctgtcttccccattttaccaggtagggcactgaggcccagggaagttgagtcactcccaaggtcacccagcttgctggctctcccgcttcttcctccgaaggagcgcacagagattgagagccccgggaccgccgcactgtaaacgcgggcctgtggtgggctcagccgctgtctgagaacctgtccatgcccaagcacttcttccccttctccctcctccccgggtatccccaaccgcgcagggagaaattaggttgtctaaggtgctcccacccccggagtgcccgcggcccggcgggaagatggggagtcctggacggagcgagccggcgcgccgctgttacctgggtcgtcctcgtcgcggggcaccttcttgaagcagtcgttgagcgacaggttgtggcggatggagttctgccagcccgccttgctgcgcttgtagaaagggaagttaccagccacgtactggtagatctggctgagcgtcagcttccgcagcggcgcgctctggatggccatggcgatgagcgccgagtaggagtagggcggccgcaccagcctcagcagctcctgctggccggagaggctcagccaggcgaggtcggcgcccgccaggccgcccggggcgccgaggagcgggccgggagccccgtagctcggggccgcgtagggcggcgcaggcccgggacccgaagcgtaggacttggggctgagcgctggcgcgttcacccacaggagggggcccccgcccaccgcgcccagatcccctggctcatagcccggggggtgcgcggtggcctgggcctggccgggcggggccgaggaggggcccaggtcgtcgcagtaggtggccatgtccagccgcgcccgggcctgggccagcggtgccgcaccgaaactcactggcgacccatccagcttggccgccagcagcgcccgggtgcgaccagcccggcccagccctccgccctttaaacaccgtcggggccagagcccatggagagtgacggtggcgagcccctcccctggcagccctggaggagcgaaatccttgtcctcgccctggtgtcagttttccgccccgcccaggcctgacacgtcctggaccggacgcccctctgattcccccttcctcctttgtgcgatccgtcccgagtccacagtcgctcgcggtcttggttgcagggaccctaagtccgtagcctcgtctggcttcacgggccccgcagccccgactgccctggaccgtaccacgactcctcaaggcccccagggctgtggcttgggagccccgtccaatgcgcggcccctttgctcggctcgggacatctcgccccaaagaaactcgcctcgccggggcccctgggttacccgggactcggggctagggatagagggcgactacactgcgcaagagatcgcaatgaagtccgtagatctccaggctggagccgcagagcgaggtggcgaggtggagaacgcggggctgggcctggacagcggccctggggtcgtctggagtcctcgctccctcaacccggaaggcagcggactgacatctgcgccgaagtcgcgcgtaccccacggagggtcgggaccctggaaatttcgaacgccccagcagttcagggcagtcatcgcttttcccaagccggggagtccggggccccgccaggtttctccgcgctgtgacctcgggcgcgcagagcggagagcgccaagctctctgctgggtgtcggaggacgcgccgaaaacagggacgtctctgcagtgcgtccgacaccagctctccagtcctgctgccgcccggggttgctgcagcccgggttatcccggccccccaagctgcccggctttcggcctcccctgctccccgcgctgtggggtggcggaggatggacccaggctgacgctgggctgggtacctggaaagagggcccgcctcccggactccgagtcgggcacctgtgcgaaagaggcga

SEQ ID NO: 5798 - DNA, 1860 bp, Homo sapiens; identical to SEQ ID NO: 5570

SEQ ID NO: 5799 - DNA, 1422 bp, Homo sapiens
cgcggggagcagaggtgcccagacacgcggcctgtccccggcccccactccacagagcctcccaccccggcactgagcccggaagcccggtcaccagctcgccattccacaacttttccagcctgggagtccccatacgggtggccgcccccccgcagcggcctagcccccagctgcaggacccccgggacccccgtactcaccatgagcgctgcaaagttgcggaagcgtgagcgccgctggaggaggcgtccagggggaggcgatcaggtggcgccctgctccccgccagcctccatggcctctggaaggtcaaagtcccagacggcggccaggaggtcgcgctcccgggcccctggcctcagggtgaccgcggcggggcgggcgcagtccgggagctgctcccatctgtgaagacagcggcggtcagcggggcgggcggagggtccccgcggagggcagctcgcagccccgaccccgccagggagcagccgcggcccctgtcgctccctcccctccgcgggcggcctgggggctgcgcctggggctggcggaggcggtgccggtggggaccggtggggggctcggaccgaacgcgccagcggcagatgcgtctccttctccatatttaaaaatcaatctgcgccccactcccggctccggagccaaactcaaccatctcgggctgcacaaagccagaggcgcgccggggggtttgcaccgggaaccggcaccgagtgacccgcccgccccagcccggccgcggcgcctgctctgcctggatgtggctcgagctccgggccgggcgcgcggggcgggggccctggattatccgtggcgcctcccgccccagcggagccgaaagttactcggagctgctttcctcgcggccagtgtcacctcggggcgcgagcttttctgccgagccgcggccccgcgcgtccctcccgccgcccagacccgcgcgtccttcccacctgctgtggccgaagcggctgccggggcggccgggccgcgctcccggagacagacgcgctgcgctccccccgccggggacccgctctccattcgcgagggcagcggccgagctgggaccgagttatcaacagattgcggggctgcggcgccggccggtgagtcacagccccgcgcacgagcggcccagcccggccagcagcgccgccgcctctgcgcgcacctcccgcggcgacagcggggacccggggccggaggcaggcgcgtaaccatggggaccggggcgggcgatggcggcgggcgggctcctgccgcagggtggggatggctcttccagccgggcggccgccgtcacactgcagagcgtatttaaagagacacctcgctccgcgctcgctccccagcaccagaccctcgcccgaaaacgccgccgggcggactgcacga

SEQ ID NO: 5800 - DNA, 1479 bp, Homo sapiens
cgacgagtctacgaaccccatcgtggccggcggtagtcgctggtcgagcctagcgcccaggcccaggccacctccatgccgtgcgacccgccgggaacgggttcaggcccgtctgcccaaggccagaagcaccctgtccccggcccaacgccggatcgcgtcccgcccttctcaccccataccaaggaaaggaactagacgcttgggagaaaggatgagcagcacccggtgggattcggccccaacccggggccgtccccaactcccaacttcccagagtttccttcggcctcgtcccccttcccacggctccgaggccgccgcggcctcccctcgctctgagtgcagatagcccgggaagtggagagcgtagctcggagctagggagccgcccccaggagccttggcgatgggagcgcaggtggcgggcgtggtccctccaaccctgccctagccgacccggagtcggcctccgtgcagtagccaccgcccgggtccccgcctggttacagcatcaggccacagtgcgctggttcttgatcactctcctggctcggtggccgccccccgccctctcccagtccgcgtcgctgttctgcctcaggccccggtgcggccccaagtcccagcccagggcccttaggtccctccaggcggcggtggcggcactcacctgggtcgcggagccggggtctggcacggtcccgcaggtggtaaatgaaatcctggcagctgtcgtgctccagggccccacgggcacagagctcggccagcagctgcagcgcctggtgacagagcgcgtccctggccccgggcatcgcccccccgcatcctcggaccgcgccgggcaggcgggcgcaggagacagccctccgcctgccagctcagagccgccgcctccgggccgtccgcgctcaccgccagggacctgccgagaaacggtgcgagcctgagcccgagccccagacccagccggcccggcctcccaccggttgcatgcagctcttcgccagccggtcggtcaggctttctctctctcccgcccggtccctccgtccctccccagacaccgaggagaggcggtgccgcacagcccagagcgcctctctgcttgcgctccgcccgctactcgcggccgccggggggcggggccaggtcaggagtgcgcgccgcagggtaggatagcggcggccccagaccggggacctggggtactccccggctcctggccgagcgcgagacttggcttgggacctcgcgcccagagcggccgcgccctggcttggggagtgtgagtgagtgcgcgctccgggcgctttcgctactccacccctcatccctgatgcaaaccaagcacccgctcccaccgccgagtgtgtccaaagcacgttcttggatgcctagtgcgaaggttacaatctgggcacacccgccagatgcgcagaaccgagtccctgcttcgaacttggaaagagccgc

SEQ ID NO: 5801 - DNA, 446 bp, Homo sapiens
cgtgcgcctcgcgcaccttgtccctcgcgcgacgccgtccgcgccgcccgcggttcggtcgggagcggcagcccgtgctccggttccggttccggttccggctggcgtctgcacctgcgaccaccgtgagcagtcatggcgtactccacagtgcagagagtcgctctggcttctgggcttgtcctggctctgtcgctgctgctgcccaaggccttcctgtcccgcgggaagcggcaggagccgccgccgacacctgaaggtaagagcaggccagctccctctgagcttcccggcgccgaagagtacggagaacgctgcttgagggaggggtgactctgagagtctgcagccttcaccgaaatatccaccaaactgactggagagggcgggcgagacggcgttgaagggccaatgcccacggttccgttgttatcagcgggtggcgg

SEQ ID NO: 5802 - DNA, 2991 bp, Homo sapiens
cgcctgccgcctacaggcgtcgctgagggacagctggcccagtttgcggattttcctccggatcccacacccatgtccagggaaagccggagccacggcggtataaattagcgcctttattttgatcacctgagcgagcgcccgcggctcgcccgcctgcggtataaacgtacaaattccctgtagcaccacacaccatgcctcagagataaatacagccccaggggctcctgctctggcaaagcaactcttatttacaggaatagattacaaaagtattacaaaaagtggtcctgaaccgggaaacgggttgggggtgggttacggttacacctgctacatttgggaccggagtgcactgggtctcacgcccccccaaataaccggtgcatcccggggcagggcttaggtctgcgagggtctcacccccatgggggagggcgcgagaaagctgaacctagcccctcaaggttcagctctggcccaccgaggaacacggagcggccatcgcaatgggtctccgagaagggtgctgcgtggaaaaaaccgcgctgtgtccttgccctgtggggcgggggcggaaacttcagttctcccgcctctcctacctcaagagaggtcgcttttaaagcgctgttgggaggggggcatttaagttcaatcttttgggcgcgagggaccctaggggcaccatccctcgggcgggtgggcggccaccatcccctcagagcacctggtatatcgggttggggttcgcacccgcagggcactgcggggcggcgtccggtgactgggtggggtcgccgctgctctctccctcgctgggggcggcagcctcttgcctgcgcggaggcgactcagaaggcacgtccgccagcaggagggcgggcgccgcagggctctcggtggagatgcgctccacgatgctggacaggcagtctaggctcgacaccgccgcactcttcccgggcctgggttctgcgcggggagggctcggttagtaagcaggggtggggccgcgacaagcctcccacccccgggcccagtactttgagacagattggaaactgaggactttagttagagtccgggacaatccaaaagacagggagctacttgcttagtatttcatctcctgcaccacttcccaggacataggcgtgtgtgagtgggggtgggagcgtcctagatagaggccaggacagctccatgaaggaggaggagcgagcagggagaggcccggaatacccaccgctgggcgcctcgttgtagtaggcgccttcgtagcagttccgccgccgggcgccgctcggggggccgctgtagtccatctgcaaacagcaagggcgactgagtcaggcccgcgggacggctcgaggcccgaacaccaattcctgtagccgccccctccctaactctagcctaaggctctagttccgggcccagacctgtcctggttgggggggtaattacgggtgggtaggagatgaggtctgcaacatgcagggccaaaccaagggcggacagtcaccaaggggcgcaaatttacattttggaagtagggataagtagagaaaaagatcttcacgttcgcgctgcagtgttctaatagcgcccccaatggggcagctcgaacgcttgcccgcacacttccaaaacaggctaccccagtgacagctgcccaggacaagggggtcctctctctcgggaaggatcctggcccaaacctcccgcaaggccagctccccgccctcggaaacgcgtccctgatatcccgagcgccgccctaacttcctcacttcctggggtcccggccttaccatgccgtcggagcagttggagcgcgggctggacgcgtcggagtcgccgctgtagtgctcgccgccgcggcccgggggcagcgggcccggcgcatagaaggcggctgcggcgccagggggcgcggcgtcctggtcgcgcagcagagcctgcaggccctcgatatagcggatggcgttgcgcaggatctccaccttgggcaaccgctggtttggattgctcgacgtgcagcgcttgagtgtctcaaaggcctcatttactttgctcaggcggcgccgctcgcgcatggtggcggccttgcggcggtcggcgttggtggtcttgcgcttgcacgccttgcaggcccacagtaggcagcggcccgcctggtggtgcccgctgggcgcgcgcacatgctcgtcctcacgtgcgcccggggccgggtgcaccgccgcggggaagtgcgagtgctcttcgggtttcaggagcgcgcccacgtgcatcaggcgcgggtccaggtcttcgaagaagcgcaggtccggggagtcgaaacacgggtcgtcatagaagtcgtccgttgtggcaaaggagcagagagagccgtcgggggccgtcaggtctacgtcgcggagcggtggcgacagtagctccatatcctggcggtggcgcggcacggtcctggcttcgcccaacccaagcggcagagagtggccggaactttctgccgctcgggagccccggctgtagatagcaaagtgctggcagtctgaatgcccacccactgtcccccacccctccctctcctgtccggcctgatttgtggttaaggaaagcggcggcagcgccccagggcttcctcacccctagcttctcgccaggcgccctgggctatttatccgtagtagcctaaacgccccggagcccaggcgggcagctgggggagggggagtccgaggccaataggaacactgcggggcggggcttgggggggtccccggggtggccgcaggggcccgcagactggccagccagcccgcccctccacactggcgtgcgcgctaggtcccctaccgggcagggagggagggagcgaccggcagccctaggcggctgcacttggctctccggcacgccctttccaaacctctccaacacccgactgctgtatccgcgggaaacgctggctgcgcgcgc

SEQ ID NO: 5803 - DNA, 928 bp, Homo sapiens
cgagcctcgcagccctcctccttcgcctcgcccgttagctccctgccccccctccccacaccccccaccccaaagccaggcgtcgggcgcttttccctgtcgccgcccggcatccggccaatctttccaaaatgcgctctcactctgttggctgctccggcagggagcatggaggactgggggtccgaagcctgcaaagggtgaccttagcgttgcagccttcccgaaacggagacttgccatcttttcagagggcggggaagctcacaccactctctgctttatagtgtccgtttcgcctcgcttgctggcccttcgcttacccgagacattccaggcacggctcgcactggagagggccgcgctgctgctgcgaccgcacggcgcccggggcaggaacatgctcgctctcccctgcgcggggggaacgaaacccccagagtgcgttccgacacgctctttctactatccaaggcaggtttcggcagctttggccacctaggcccggggagccccagccggatctgctgcggcctcccccgcagcgtaggcaaggaccttaaaccccaaaccagggactccgattctctcttttcccctcccgtcttcttttctcttgaaagagaaatagacagaaagctcagccttgagacaaagaacgcgagtgatttctccgaaataaacttgaagataacgacataacagtgaatggcaggacgcacaaaaccccatgggctcaggtcaaatggcattagtcacaggtcttagccgcagccgccgcgccgcgcagctccttgggctatcgcggagtttgaaaagacgcgttcaaggagatcacttaaagtaagatcctttcgtccgatttcttgcttccttaggatttatttttcctttcacgggcggccagccctcgccccctcgcccccgc

SEQ ID NO: 5804 - DNA, 1267 bp, Homo sapiens
cgcgggatcccagggttctcccgcagctctctgccctcgccgcaccgcgccctcccgggccccggccgcgcccgccagccggaagcgctccctctgcgggtgcgactcccgcagctaccccttcccagcctggcgggggtcggcgagagtggtttccacagcaccttacaagttcgggaactcggggcacgcgggcccgccctgctgcgggtttcgactccctgggacggaaagccggttactagcagcaagagggtgcgcctactcggccgcgcccctcactcctgcgcccctgaggccgggtcccctgagaaggggcactcaacggggacatcttcaagcccgtgagtccctattttcaccctgtcactccgagcagggcaaagagatcccaggaaccggtccacgctaccgccgttccccagaccagcgcaaagctcggctccaggtctccccacgccgccgtggtctgtgggcacccccatttcccggatccctctaaccgccacagtcatgcttacctgtcctggcagtgcacacacagaaccacacaactaaaatcaaatccatcggcatcgctctcgagggtccccgcctagcagggggcaccgaagctaggtggaagcaaatgagcctggatcctgaggcgcgcctggcttggagccgccaaacttgctagcgggcggcgggggaggtggctcggcagcgccgggtgctgcgctcgcatatgcgcccgggaaggcagccccggccgccccgcccccagcccgccccccaccgctggcgcggcggcggcggcgtggggctcggggcccggccccccgctgcggctgcgttcgtctgggagcccgggcaggagcgcggggtttggctactgtggcttgttgcgctccccactgggggccgattccgttcgcctccttcgcccgcagaactgcgaggatctggactgcaggcgccgcagccgctatcacccggagcaccgaagtcggagtcccaggacctgcggccgaaacgagagagcgggaggcgcacggcgcccccacggcttcacgcgctccagcccctccgagccgcagtcgccaatgttgccctctttacttccgcaccgcggtgggggctgccgaagttgccacagttcatccccgccgagtcgaaaagccgccgagccctcgcgggtgggtatttttcctcgggggaacccagaccgaggcggcgccaccgagcgcgcacggaccccctcggaaaacaattactcgggattcgc

SEQ ID NO: 5805 - DNA, 1225 bp, Homo sapiens
cgccggtcgccccctggtgcttccggggctggtaagcgcgtagctgaggaaagggcacaaaggtggcgagctttgcgggagtagttgtgcagaacctgccggaccccagggcttggccggtaggctcgccttcggcggctgggctctccccttggagctcagactccccagccgcaggctgtctctcgggcgggccccagccagggcgcgcagccctgagcgtttgtcgctgcggcccggctggcaggccccgaggggcgcggggtcgcgggccggccggcagggctttgtgccgctcgttcccgggtgtgcgcgaggcgcggagcatccaaattgacaccatatgttttcctattagttgcttcgcggtcgagttctaggcgcataatcatcgccagtgggcgagagcgccagcagtccctagggaagggacacaatgattgaggcttaacctctgaaggggaatttggagctgcgctttctctctgccatttcgatgctgggagtggcgctctggccctggcgtctcctgggcaagcaccagccggcggtatctgcggaggtggctggcacgttgttattttttgaaatgagtgaggagggaggtctagatttaggcggccttacgcgcccgccttggcattagcagactgggaattgccgtggctatgcccgaagtttggaaagtctctctcggtctctttctgggacagcctttctttttccgggaagcttcctgtgcctagaggtggggctctgtagctggaggggtagatggaacttgcgaagcaaaggaaggcaataaaaggaagttaggagaaaccggaaacgtgggccaggccttgctctgttggagaagcggtgtccccgcaaagtccctgcttgcgctggtcccggccggagcccagatcccccaaacgcctgtcacttctcatcgagttgaggctccggcccccacccgcgccttggtgagggccccccctcagccccaagccttcggctaccctgaaaacgcggctcccctcgaaggggaaacaagtgcagttcaatctcgtctgagtgatctacaaataaggacggaaagggtcgttttatcacggtcccgtttgtcgtgacgatgcaatttcccggagcggagcactgtcacaaagtgacaaggctgccacaagcgccccgactgatcttttcaattagccttccatgcatgatccggagcgacttccgc

SEQ ID NO: 5806 - DNA, 1627 bp, Homo sapiens
cggctgccggcgcgagcggcggctccctcccggctgcagaacgcctctcgttgccggagaaggggctcagcaaaattgactcttccttatttgtttccatccataattgatggggagatgagaacgtaacacatctcagcaccgagctcttgtcgcctggcggagaccctgtccaagacgcttccgtaaagcatttccagtcggggaacaaagcacggaaagttgctgggtagagcggccgggaggagacaccgggagccgggtgggcggtggggtggccggtgggctgctccgggcccgggagtccgcccgcagcgcgctctgccagtaaggggagagggacggtgggaagcggccgccctccgggcctgggccggggatggggatggccaagtcacccgagctcccgcccctcgccggcaggcactacccgggggccgtgcaatccgggcgctcactgacaggtatcctacgcccgcgaggggctgctccggcctcaactgcggcgctgcgccccttctccaggacgcaggctaatgctcgcccgcccgctcctagccgggcgcagagctgccagaccccgggcgtcccagcgtccgctctggggccaacgggcgggagggggcggctaagcccgcaggcggctccttcggccttggctcagctctccccggctggctcctggagacgctgtgcccggcagagaagcaacccctgctaaccccagctatgtgcgggggacgccgagctggctctgcctggcaagaaacttttacttgatgccccctccgctttttttccaagggggtgcacagtggaggagggcctccaagtccacttgcccctccccctaagccgccagctttgccagttttgacgcgtccgccaaacctctctagccctttgcgcgtcccttgcacggcaggcagagagagcagcttggaaaataaatcaactgtccagtggcaacacacacacacacacacacacacacacacacacacacacacacacagcgattcgggatctcaggttccgacccccaccgcgcgcacacacacacacacacacacacacacagcgattcgggatctcaggttccgacccccaccgggcgccacaagagcattagcaaattgttgaaaacggtcttacctcattggggggaggctggtaagaaaaaagaaaaagaaaaaaaaaagcttgccacgcgcaaggaagaaagaaaataaagaaaaatattgtaaaaatagatatccctctgtctccttaggtcttggcttccttgatagaatcctgaaactcgccaccaccccttgcagcagcagcagcagcagcgggacagagcaggagcaaaacaaaccgatgcacggcaaatggtgtaattcgatccatctccaagtcaatccatcaggcgagccggagcctggctccctccacgcactcggcagctcccggcgcgggtcccacccccgggcacggacggcaggaggcgcggccggccgggcgcgctcgccctcgcgggtgaaccgtggccagcgccgcctggaggcccccaccctggcgccgcggccctgctgacccctcggtggcctccgcgtccctcctctccggcgctctgctgcgc

SEQ ID NO: 5807 - DNA, 1857 bp, Homo sapiens
cggcggccgtacttggccttacagtgcaaaatgtgcttggcgaggaagtcgaggcggcgctgtagcagctgagcgtgggggtctgcaagggcggccagctcggggaagcgaggctcgtggcgccggtagaggcgcagcagccgggccgcggcgtcctgtccgcggtgcagctccaggacgcgccgcgcggtccgctcgcggaacacgcacactgactgcaacagcggctcgttatacttgtcccacatgcctgctacccggtagccgtgcaccaagcccgcctcattgtccagaaagaccagcgccccgcccggaccgcggtgcaggttgctggtggcacgctgcatgacgcgcgggtcccactgcaggctgaagaggttgcttacgagccggtcgaagttggccgtcaggtagtcgaaaaggattaagtcggtccattgtactaggtccaccagctccgcctggctgaggttggccagctcacccccggcatcccggagggggcgcagacggccgtcctccgagcgccagggcgcgggcaccaccacgtccgtgaggttgggcagccagcgtgtcaggctcaccacgctgccctcggtccagtgcgcagcgcgcagctcctcctgcacctgcgcccactgcgcgccccgagcctccacccgagccagtgccagcggcggcacgtggcgctggaggcccagcaggcgcgccagatagtaagacagggcctcgccctgaatctgctccgggttgatgccgtagcgcacgcaggcgcgggtgccgtcggcaaaacgggccagtcggttggagctgcgcccgcaacccccgcgctccagggccaccatccgggcgccgcgagccgcctccagccacgccgccgcctgggcctccgaaaagcccgggggcacctgctcctccaggccgcggctccagaagacgcccccgtgcaccgcggcgctctcctccggccggggctgcctggctgacacgtgccacctgggctcgctccgggactgccggggcgggccgtccgcgccggccgccagggtgagcagcgcccggaaagttttcagggagccgccgcgggcgtcccacgccaggggcgggggcagagggaagcgaggcgcgggcgcggggccgccgctccgggccgggcgccgtgggagtcggtcttcgggcggccgggaggcgggcagctcggtccgcggcggcaggagccctccccacagcgccagcagcgagcccagcgccagcagccagagccccgcggtggcggcggcgccccgcatcctcctgcccatgctcccgcggctgtgccggtgcgccgccgccgcttcaagccgagcccaggcacccgggtcccggcggcgaggcgggcccggcagtttgtgggctccggggcttcgggcgcttcggccccatcgcggccgcggggcgctgcggggctctgtccggcgctccgcccggcgctgggaactcgagtccccgccgcttcccagctgcttttgtatttcgctgtgagaccctccggtgggcgcgattcacaggcgcccggaccacgtgggagccagggggatccccctccccctcctccgcctccgctccccgccccccgctcccccgcccccttcctctcctcttccacttaaagcggcgatggctccttccgagagggagaggcggccccacactcggtccgggacttgggggcctggaggaagccggactggctgcgcccgcgccggggcgtaggagggggtggcgcagagccggagtctggggcctggcgggagggacgcgccctgggccctcgcgggggtgtcttggtcgccgggtccctttgcctaggcagcgcgg

SEQ ID NO: 5808 - DNA, 2423 bp, Homo sapiens
cggagcgcagagaacggctggagacatagcggccgcggttttccccgcagcgcaggagcgccaggcactgcgctgggtcaactgcggtcagggagtcacctgcccgcgacagcgagcgcgcacccacactctcgaccaacccaggctggcctccagcccactctcgggtcccaacgcccaaacatctcgcattgctggctccgacatctccccacccgccgccaggaatcagcgcagagggagatgcgtcttctgtggcgggtgcggggcgaggaccctgaccccagctctgggaagtgaactgtacggaggagagagctctccatcgtcagctctgcctccgcccctcctgcggcttcacttcagcccggatgccggcgatggggaatagaccagggacgcaggagcacactggaccgggggtggatccacttggggaggcaggcaaccgacccgcgcaccggtggcgcaacctcgttccggtgaccgaagcttgtggaggtagctccactcccggctccctggtccgacatccccctgccacctcctcccccacctccccgagtcttgggagcctggaccccgaaggtgcaaaaagtcaagagcctggaaaactgcactgtgcaaatatattgactttatttgtctcctttcaggagcctcacagacatatccaggtaaaaagatcgttaaataaatgccttcagccatcgcaatgcaaaaataaatatcaatcctccagacgcagtagcagccgcgctgcgcccaaagtcccaacggccacgcctaacaattataaaagtgttcagcgagagtgttggcgtgagtgtgaatgggtgtgcgctggggggcacggtggagcggtgtgcaaaatcggagttgcaaaccatcggacaagggcatggagtggctacccgccgccgactcagcgcgggcgcgcctccccgcacacactcacagcagagttcgcactgggaagagttaaaaaataaacatttacaaggacgaggaaagcggccccgctcccggcgctcccgggccagggcgagcgcggcgaggggcgcaccgaccggttcgcagcggggcgggagtccgagcgcgcgaggagcggcggtcccgggtccttgcgggtcccccgggagcagggcgcgggcactctcggggttcacacgccggtccccgcgcggaccgcggacgcgcgcgtcccccccgcgggcggcgccccttacagggccgagtcggagtcgctggagtccaggctgttcctcagtttgcagctgctgagctgctcccgctgcagcgacaggctctgcgtgctgcggcgcaggcactccaggctctgcaggaacgacttcttggccttctcctcctccatgggggacaccccctcctcctccacctcctggatctcgtcgaaggtcaccggctgcgtcttgaagcgagactggcgcggccgccgcagccggccccggcccttgggcagcttggcgggccgcacgggctgcgggaactcgtcggccaggcacacgaagtgcggcatcaccgcctggtaactggagcagatgcccatcagctcgccgggcttggcggccatggcgcctccggcgtctgcggggccgggcggcggggcgccggggctctccgagggcggccgctgcgccggggccccccgggaggcagcagccgggggctcgccgggcgggggatccaaatctgctgcggggtggcggcggccctcgcgggcccgggccggcgctcctcgggagggcgggcgggcgggcggacccgtcggggggcacggggctcggggggcgctgttccgccgcgctccgaggcgctcgccgccgctgctgtcgccgtctgccccgcggcggccaggctcgcggcttatatagcccgcggctgcccacacggctctgagctcggatgacagcgaatgccatttaaagcgtgcgcgccccgcgcccttccgcctgacgtcgccccgccgctctgggaaagtaacggccccttccccggcgccgcccgccccccgccaaccggctccggaaggcaggccccgcccgcgggggttccgggagaagccgcggccccggagcacgcggctggcccgagctgcgcccggacagggaccctcaatcgccgcgactgggcgggcactgtcccttctgggatccccaagtctgcaccaaccgggttggccgcggggccgcaggtccccctcccccgccccctggtcccagatgcacacacttgaggcgctggttattccaccgccggttctgcgcggggcgcgaggcagctctcagctctctttgcagcctggcgagcctgagcgcccggctccccagagctgagctcggaagaaggggtgggctccccttctggatccttgccacccccctccgcaggcgcgcgcgcgc

SEQ ID NO: 5809 - DNA, 1146 bp, Homo sapiens
cggcatctgggcctctgcgcgcctcgccccgcggccgggcccatggcactgtgagcctgcaagggagccccgctcagcgcggggagcgcccggccccctcccgccccatgcgcccgcggctctgaagcctgagcgggggccgggggccgggcggggccggggccgccgtaggcatggcgtccgggagccggtggcggccgacaccgccgccgctgctgttgctgctgctgctggcgctggcggcgcgcgcggacggcctggagttcggcggcggccccgggcagtgggctcgctacgcgcgctgggcgggcgcggcgagcagcggcgagctcagcttcagcctgcgcaccaacgccacgcgcgcgctgctgctctacctggacgacggcggcgactgcgacttcctggagctgctgctggtggacggccgcctgcggctgcgcttcacgctttcgtgcgccgagccggccacgctgcagctggacacgccggtggccgacgaccgctggcacatggtgctgctgacccgcgacgcgcgccgcacggcgctggcggtggacggcgaggcccgcgccgccgaggtgcgctccaagcggcgcgagatgcaggtggccagcgacctgttcgtgggcggcatcccgcccgacgtgcgcctctcggcgcttacgctgagcaccgtcaagtacgagccgcccttccgcggcctcttggccaacctgaagctgggcgagcggccccccgcgctgctgggcagccagggcctgcgcggcgccaccgccgacccgctgtgcgcgcccgcgcgcaacccctgcgccaacggcggcctctgcaccgtgctggcccccggcgaggtgggctgcgactgcagccacacgggcttcggcggcaagttctgcagcgaaggtgagccccggggagcggccgcccggtgcctgggcgcgggggtgagggcctggggcgcttcgtgggggtcggagtgtgtgtgggctcctgaggcacgggggctgggcacgagggcttgtgagtgggtgcgagcgctccagggctgcggggacgcgtgtccgggcgagggcgcgtggggttggcggtgggcggggcgagtgggcggggccggcttgggcgtggtcagcgtgagtcctgcggcga

SEQ ID NO: 5810 - DNA, 577 bp, Homo sapiens
cgctctccctaccctgcgcgccccacgtgcctcctgtaaacaagagaacgcgcaggcgccgcaaaccagcgcccattggtcggcgtgccgtcgccccgctggagggaggactcaggccccgctggccgcgggctcggtacccggtgggtcggtggagcgtctgttgggtccgggccgccggcttcgccctcgccatggcgccctggctgcagctcctgtcgctgctggggctgctcccgggcgcagtggccgcccccgcccagccccgagccgccagctttcaggcctgggggccgccgtccccggagctgctggcgcccacccgcttcgcgctggagatgttcaaccgcggccgggctgcggggacgcgggccgtgctgggccttgtgcgcggccgcgtccgccgggtgaggacgcgccgggggcgggggcgccaggcccgggtccaagggataggagctttgacctaacattgggatggggcctgcccgctggacgaaccgatctctggtgatggggaatgggcagcgccgcacgggcggggccttgggcgccgtcaagggccgactgtgcccgc

SEQ ID NO: 5811 - DNA, 1721 bp, Homo sapiens
cgtgagcctccgaaaggcgaagggcaggcagcagccgctggcttctgcgcccactaggagcttcggatgcccgagttagggctgcgccaaggcggccggagcagagagggagacggggacggggacaggcagggacaaagtgcaagaggcaaaactggctgaaaagcagaagtgtaggagccgccaaggggcgggacgaacaggtccgtgggccgggcggagccaagggtgggggccggggtccctccaggtggcactcgcggcgctagtccccagcctcctcccttcccccggccctgattggcaggcggcctgcgaccagccgcgaacgccacagcgccccgggcgcccaggagaacgcgaacggccccccgcgggagcgggcgagtaggagggggcgccgggctatatatatagcggctcggcctcgggcgggcctggcgctcagggaggcgcgcactgctcctcagagtcccagctccagccgcgcgctttccgcccggctcgccgctccatgcagccggggtagagcccggcgcccgggggccccgtcgcttgcctcccgcacctcctcggttgcgcactcctgcccgaggtcggccgtgcgctcccgcgggacgccacaggcgcagctctgccccccagcttcccgggcgcactgaccgcctgaccgacgcacggccctcgggccgggatgtcggggcccgggacggccgcggtagcgctgctcccggcggtcctgctggccttgctggcgccctgggcgggccgagggggcgccgccgcacccactgcacccaacggcacgctggaggccgagctggagcgccgctgggagagcctggtggcgctctcgttggcgcgcctgccggtggcagcgcagcccaaggaggcggccgtccagagcggcgccggcgactacctgctgggcatcaagcggctgcggcggctctactgcaacgtgggcatcggcttccacctccaggcgctccccgacggccgcatcggcggcgcgcacgcggacacccgcgacagtgagtggcgcggccaggcgcgaaggggcgggggcggggggcaacggccgccgggccaacccgctcagtcacactctgagaccctcggcgggcacctgctcgggggccccgggaaccggggcggactcgggctccggtcccttctgacgcggggctggggacgcagacactcttggctccggcagcccagcgcaacccctgaggtcgggcgccgcctcccgccttcagaaactcgggctccgagcgccgaattccagcgccttcgcccgtgggcacagggcgcgcggtgcagccacagggggcccgagacacgcgccccggcctggcccaggctggggaaccgctggggtcgggctcgcgtctgaaggtccgggactgggtgcggccgccgggggtcccctacacaggcaagctaatctgagctagcgcaggcttgggctccggaggccctagagggcagcttgggctctggaggcccttgggggcggctgcgccgggaaccctggccctttatccccaaccccaccccagaaatagggtccccggaggcgaacaagccgaggggcggagtgggccagggatcacctgccccgcaatgacctgcgccccgcccccaggcctgctggagctctcgcccgtggagcggggcgtggtgagcatcttcggcgtggccagccggttcttcgt

SEQ ID NO: 5812 - DNA, 1721 bp, Homo sapiens; identical to SEQ ID NO: 5811

SEQ ID NO: 5813 - DNA, 615 bp, Homo sapiens
cggagttccgggcacgcaccgccgagcgccttaccctgagccttcccggtacccgcagccccgacagctcagccttccccacctgaaagttccacctgaggtctccctcaactctgccctcctgcattcttggcgtcgcggggagtcaggggttaaaccccgtggcccgcgtggccccttccccctccgcagccccctcgcctccactcggcgccgcgcctggagcgtccgtcccggagacccgcacaagagaggaggggaaaaagtgggcctgtttctcgggtggccaatccaccgagcccgcggtgccccagaggaggcgccagcgctaggccagcgccaggccgggctgcctgcttcccgcggcaaagtacaaatgcgcccgagcgcggcgcctgaagcccttggcgagcacagccggcccgcgctcagcctccctccgcggccgccgcgccgccgccgctgctgggaccgccgccccgccgggccccaggcccccgcggcccgaccccgagcccaccgagcagggggcgccggccgcctctagcccgcgcgcccgcaacacccgctggtcccgcgcgcctcgcccggcgctgcgcgctcggcagacgccgg

SEQ ID NO: 5814 - DNA, 1542 bp, Homo sapiens
cgggacggtcgccgcgcgctccctccctccgccccttgcttacaagacctaatgagctcccccgggaggcagcgcagcgagccaggcccggaactagtaggctgcgccgcgcgcgccgcgccggggcgggagctgggtctgggcggcgggcaggagctggcgggggcgcacgggcagcgctgcggacagcccgggagccgcggcgatggcggtgcaggcggcgctcctcagcacgcaccctttcgtgcccttcggcttcgggggctccccggacgggctagggggcgccttcggagccctggacaagggctgctgtttcgaggacgatgagaccggggctccggcgggtgcgctgctgtcgggagccgaaggaggggacgtgcgcgaggccacccgcgatctactcagcttcattgactcggcgtccagcaacatcaagctggcgctggacaagccgggcaagtcgaagcggaaggtgaaccaccgcaagtacctgcagaagcagatcaagcgctgcagcggcctcatgggcgccgcgccccccggcccgccctccccgagcgccgccgacacgccagccaaacggccgctggccgcccctagcgccccgacagtcgcggccccggcccacggcaaggctgccccccggcgggaggcgtcgcaggccgccgcggccgccagcttgcaaagccgaagtctggccgcgctcttcgactcgctgcgccacgtccccgggggtgccgagccggcggggggtgaggtggctgcgccggcggccgggctaggaggtgcgggcactgggggcgcgggaggggacgtggcaggccccgcgggggccacggcgatcccaggggccaggaaggtcccgctgcgggcacgcaatctgcctccgtccttcttcacggagccgtcccgggcaggcggcggcgggtgtggcccgtcggggccggacgtgagcttgggcgacctggagaagggcgcggaggccgtggagttctttgagctgctggggcccgactacggcgccggcacggaggcggcagtcttgcttgccgccgagcctctcgacgtgttccccgccggagcctccgtactgcggggacccccggagctggagcccggcctctttgagccgccgccggcagtggtgggaaacctactgtaccccgagccctggagcgtcccgggctgctccccgaccaaaaagagccccctgactgccccccgcggcggcttgaccttgaacgagcccttgagccccctgtaccccgccgctgcggattctcccggcggggaggacgggcggggccatttggcctctttcgcccccttctttccagactgcgccctgcccccgccgccgccgccccatcaggtgtcctacgattacagcgcgggctacagccgcaccgcctattccagcctttggagatccgacggggtttgggaaggggcgccgggggaggagggggcgcaccgggactgacttcgaggcacgcttcccttcattagagacggctgtggagagcgccgcgcctccgt

SEQ ID NO: 5815 - DNA, 1542 bp, Homo sapiens; identical to SEQ ID NO: 5814

SEQ ID NO: 5816 - DNA, 1768 bp, Homo sapiens
cgcgtctggagtgggctctcgacacccagggcaagtgggggcggcagagccctctcctcggtcggcacagcagcctctgccgcggtcccggcctgcgacgcgcccagtcttagcctcccggcctccggcgtctgctgagtgtccggcgggagaggcgcagggagcgcgctaccgggaggcgcgggcagcggggactggttttctctcgggccagggcctccggggcaaccgtctccagcgcgcattcttggtgcaggtggaacagctttctgctccggtagggcttcacctatcgcgggagaggttaatctcggatctaaacctcgcagccgcagagcgggctaaaaccgctactccacctcttcccatttctcccctccccacctcaagacaaaaagtcccaggccgggcaggacctgatcacctctgcctcctcccactgcgctaatcctgcgagcgagaggccccgcaccgaggcggaggctggcaaaggggagtggaaagggaggatggatggggccggggggtggggtggtgatgagggcgacgaaggagggggtgtcattttctttttctttctttttttaaaaaaagtatttctctcgcgagaaaccgctgcgcggacgatacttgaagaggtggggaaaggagggggctgcgggagccgcggcagagactgtgggtgccacaagcggacaggagccacagctgggacagctgcgagcggagccgagcagtggctgtagcggccacgactgggagcagccgccgccgcctcctcgggagtcggagccgccgcttctccagtgggtgcagccggggtcccgacgggggtcgggcggccaccggggctggagctgcggccacggaggcttttgcgtttgcgccgcgccgagggcagggacagggactggggtgaggggctgtcccggaacgtccacagctggcgctggccctcccctgcctgacagcttcctggcccggggctcttggtgccgggctccgcgtcagatgttcggggggcggtggcatcgcccggagtcggcggggacggcgcggctggcttccagcctggcggagagggcaggctgaggagtggggcgttcagagcgcgcatcgcgcgcaattcgtgccgctaaaaaaaataaacccagagagctcgcccggggcttaggaccgctggggatatgggtactttgcgccgcgctcttctggcggggcccgggaggccgagggatcggccggggctgctgccgccgggggcctgggctttccagccagctgtggaccaaacggtcttcccttacccaaattaactgcgccacgcgcaggcggcgcacgggttgggcttgggaatggggaccgcgaggcttcagcatcccgatgccctgaaagtctccccgcctcggggatttgtctctgtgttgcagctggcaggggccgcctgaagtgggagcagcgcctggagaaggcgggaggagcccggcccgggggacgggcggcgggatagcgggaccccggcggcgcggtgcgcttcagggcgcagcggcggccgcagaccgagccccgggcgcggcaagaggcggcgggagccggtggcggctcggcatcatgcgtcgagggcgtctgctggagatcgccctgggatttaccgtgcttttagcgtcctacacgagccatggggcggacgccaatttggaggctgggaacgtgaaggaaaccagagccagtcgggccaagagaagaggcggtggaggacacgacgcgc

SEQ ID NO: 5817 - DNA, 2656 bp, Homo sapiens
cgcacaggaaccccagccgctcaagccccgggtgggcgcgtcgcacctccccaggcactgcccagacagctcgccccctccccctgggcgccctccctagtctggctggggccggggcgggttgggggaggttctcgcgggtttgtctgacacttgtaaatggaagtgggatccaacttggaaaacaaacgcgccagagtctgggggcggagaggagcgggaggaggggagaggggggaaaaagacttcaatcattaccgcggtcccagcgtccctccctcccgccgcggctgctgcaggttcgcccaaacccgaagctgagtcccattgggcgcgcggcggcggcgggatggagctggagctcccggccgaggcgctaggagtccaccagattccgcgtgccagagccaccggccgcccacgctccgggccgcaggcgccactccctcccgggagcccctcctagtccttcacggagacctcgcagggtctccgcagcctccccgcccccgacgtccattccggggacccctctccaccgcctggtttgagcccattattccagcgagctgcagcctcaggatgtcaccgccagcacacccacaccccgggagcacccctgttcctctcatcccgagcaacccaagcggctctcttagctcgcagccaaactccggccacccctgcatccttgccccaagcacgcccccgccaccccccgcccacaagaggagaacggtggaaagtgaataaaagttgctttccgcaaagcccaatcatgttcaatgttaaaccatctcggaaagcacatgtgacaaaagtcaacgagagaggagaggagggaattcagatcacagcacagctaaaaatatccgggctcgccatcatgcaagccggggggccagatgcactttagctcagcgactcccactggcggaatcctcgcgctcaccgcgcgccgcgccaagatggtccaggccacctctactgcctccccgccagcgcccctcagccccctacacttgccctgcacacacactggcctgtagaggggattcgtcccgaaccgcccgggagtggggcctgagctcggagctggtgcccctggcgttctcgcccccaatccggagacagctcctccgcactcctggggatggtcagacccgcgctgctttcttttcaaagacaagcagccttcccacacgcccgccaaaaatcatgcactctcgcaaagcattccggttccctctccttgtcaagatagcagggacagtctctgtccccaaccactccgtaaaggatgtcgtccccagtcgaagagccgccgccgccgttcactacatctcaccctgaccacaagccccgcaagcccgagtcaggcgtggggaacggacccgcagactggtaaccctttccctttcctagcgaaagtggaggctgggctccctctctgcgccgcgcctcgcctagcgatgacccaacttgcacctcggggtcccctaagtgcatcatccatcggcatctgaacatcccccactgcgcccgagaggcaccggctgccaagcaggctcgccacctgaaccttctcatccacctgcaggggcggctgggagccggggatgggtgcactgatccgcaacccccctcgcaacccctccccagatcctcagccccaaacttggccaactctccgtgtaaacctcccggctcccgccgcggggccaagccaccctcttctcctgtttgcagcggtagcaacggcggctcggggctgcgcggaggttggaactttacaaggtgaaaagtttcccccacgcgcttcgtcggctctcgcctccccagcccacctcgcagcccatttgcacccagcagctgaggctgtgctccggcaggcgcgctccagtcggtgcaccaggcagccaaatcatcacgctacaaatccccacgcacccttgcctccgctggcgatccacggctctacgaggcgcctcccccgtggtcttcttcacccggtgctcggcgctcttgctccgggcgagccggtcccccggctgctgccgccgcagcgcccaccgcgcgctagccgggactgaggccgcgagcagaagcgctctgcgctcgggacgccgccgccgccgccgccgggggttcgcaagcggaggaggggagccgagatgaagagaacagcagcgggaggagagggacgggaggcgcgagatcccaatccgcaggccagttcacagcgcagcctgcggggaggagcgccggctctcctgtctgctccgagctgcagccgccgccgctactgctcgccgcctggctgctccgggctccccatcacagccgacgccgacgcacggccaagcccctctccagtctccccctcgcgcttgtctctcgcagtctcctcctcccaaaccgcgagcgaaaagggcgagggggagaggagcctcggcggcggggatgactagcgatctaggagcgtggcgcaggggagagggggcgcgcgggagggggcggcggaggaggcgcggcgaactggagggcattcccggcgccgggcctggaagcggctaattttagagctcgagtcttccctcagccctctggggctctaggatgacaccaacgtactttcctgccgcggggagagcgt

SEQ ID NO: 5818 - DNA, 623 bp, Homo sapiens
cgacaccacgcgagtgtgtacgcgctggggactgagcccccgaagcgaagccctgtcggaggagtttcaggcgggagtgggaacggctgggcgtggggtcagcaacggcgccacccggtagggtggggggagccaggcttgtcagagccagagcgcgtcaccgtcgccgcgagagacgccgcgctgcccaataggcagaggcgctccctagcagcctggtgggagcagagatataaaagtgctccaacaaacccggagctggcgtgccgaccgcgggctggtggcgggcggcgcggtgctccgcgcgtccgggctccctggctcctcgggacggccttgtatgctgtgcgccccgcaccccggctgcgcgctccgatcccagcgggaggggacgcccggcccgcaggctcccaggggaggggtggctcctgcaaaatggtccctcacctcttgctgctctgtctcctccccttggtgcgagccaccgagccccacgagggccgggccgacgagcagagcgcggaggcggccctggccgtgcccaatgcctcgcacttcttctcttggaacaactacaccttctccgactggcagaactttgtgggcaggaggcgctacggcgc

SEQ ID NO: 5819 - DNA, 1967 bp, Homo sapiens
cgatgatggaaaggaccgccaggcgatcccccaaaaggcccaccaaatatccgggctccattgtcacgctcccacccgggggcgaggatgtctcaaaaacaccccccttcccccgccccatgtggacaggtcgcgtcgcggcacccacgggcaccgcggaaaggggcataaccggggtggcccccgcccaggtggcagcggagacccagggccaggcggactaggcttggtccccacccctcctctccgggccctgccacggccccgccccgccgtcagtagagcccccggcccgcggtcggccggtcagcgcacgcgcgtaggtgtgcctgccaggatgccctccccggcgacgcgctcaggcccggattccgcggcgcgagagtgagcgctggcgggggcggtgggatgctccaagtcggcgtgaaagaggcgagagtgggcgagcacgggcggccggaccaggagcactcccggtgaccacctagtctccattttatttcctcggaaactgccgggcaggcgggggaccggccgcagggcggggtttctcttggcggtgagtgagcgagaccgttaggctgaagcaccgggagactgtcctggcagctcctggccgccacccgcgccgcaataaaagcctctcgcggcttcccgcccagccagcttcgcactgattggtcgccgtgggagggacccgagttggctggaggcggcggccgagcgctgctcttgtgccgcccgcggagggggcgcactgggtgctccctggcccgccccgtgcgctccccaaccgggggtcggccgtccagggcaggtacaacggtacctggagctgcgaccgcgacacacagcccctccgcccggctttcctcgatcgcttcccagcacacgccccccgcccagaatgtccgcccaacccacccagctctctgcggcccctgcttttcttccttccctcccgtccatcagagccaaagcgcaaatccttgggtggaggtggggggatgacagctggaggggagggtgggcacgcacagaagaattttccagggaggccgggatggaaatagccaaaatgaaatgcacctccctgcacactgccgaggttctctgggcggcggcgcaacccccgccacccgcggcagcatcactactgtcttcctcccagctccctattgttcacactttgccaggatcgggaacctcgcccaaagaaaggagacagggcgaggtgtttcgggcggctacctgccattcttctcccgccccgtgcaacactgggcacgcggcgcgtgtaaagacacacgcgcgcacacgcgcgcgcacacaccaggcagccccaatcacgccctcctcgccctccgcccctccgcacttcctcctgtcaaaacgcggcgctcgaccctcccatccttcagtgctcgcggccgagggtaggctttgcaactaaccagcaatttggcaaatgaaaaactaacgtcatgtcgactggggtgcaacaacggtcacaccaacaacaacggccgtgcgattctgcccattttgccccattttgcaaaccgttattcttctggggcgggggaagcaaagcagcgatcctgactttattagacccaggaatataacgatctggggcggctgccctagccttattgttcactcttcccggagccggggctgacaagccacttccccctcggaatccgagcccgtgcggcggcaccacccgagccgcgacctcccccgccccgccgcccgcctttggggaaggagcgctgcccatcaccagcgcggccgctgagtccccaggagccggccggctctgctcccaccgccgcgggcgcacaaagtgggaagggcggacgcgccggaggggcgccgggcgctggcggctcggggaggcagccccgtgcagcgcagccctggagggagcggggttcggctgggcagcaagggcgacgcgc

SEQ ID NO: 5820 - DNA, 2558 bp, Homo sapiens
cgccccggggtggggacggaggccgtcaaggttgggatgagcattcagccgagccgagccaccgcgtgctttcccgcagacatcggggtttctgagaactaggagggaacagccaaaagaatggaagcttggcgccctgaaacaagccttttgggtcctgagggaaatctgggcgcccacgggcagccgtctcccccacccgccgctcggcgcccgcgatccggctggcgctggctgcagcgtccagccaggcggcgcggggaagagccggcgataacccgcccgagctccggggatcgaccgcgctctcacacccccccagttcccagcgacccccaccgagacttggagacgacttcagcaaacttggggaagcaacttttcccgaggagctagactcctgaaagaaggagagctgagctagggacgagggaaagcgaaagagacggggaggaacggcgacagtccgggcgggctggactccgcggcgagagcggcaggggaggcggacccgccccgcggcgaaggggaagcacaaaagccccgcagcgagttgtgggaggaaaggcgagaaggggtctgcccgccctccctctccgacccagggccgtgaccccctgggagcgaccggctgggtcccaggcctctggccagcggcgccagcggccagcgcgcccggcccaagcacggtgcgagcgtctcggggaggcggcgagcgagtcggtgcggagcgctccgtgcgtccgggtggttccgcgggccggcgggaccgtgcgcatttcaagcgcgtgcgggagtgtgcgaggcgctgtgcgagctagcggcgggcgcgccagggtgggaaaggcatcccgaacgcatcaggtgcagagaccggcacccaccgagagcggccgggagcgcacggcgagctccggtgtcaccgccggtcccgccgagagccgaggagggcccgcagcgctgcagaccctctggagcttccctccctcccctgcaaaaggggggtggggatcaagtccaatcaagaaaaagcccaccacgttttctcaaagagaaacaaaacgtaagcagtcccagtcctgctcccctccgcccccagatctactcgtcagctcctccgattctagcttcccagccggccggcgaataaacacacaaataaataaaccacaaccttatcttgcgcccgcgcaccggtccgcatacataagagcacccacgggctctgttgctccgccagcccctggcggtacaaagcctccggatccccgacccctctgctcacgccctcagcccccgcacaccgctacgccccccacctctcaccccgaccgtgccctgaagaggaagggctggggaggcagctgcgcccaggctgacagccggggctcccccttctagccgacccccaaccggtggcggcgacggctgcagcggcaggaagggaacacgccaaataaaaaaggcacaagcccagcggccgagtggccgaagcgagcgcgcgccccccagacctctccagccccgggaagccccggcgcgcggcgctcgctgggcggtgcgcctcttcccggcccctcactcaccgcagccgagccgggcactgtggggtgggtgtgcgtgcctgtcggggggtgtgtgcctgtgtcggggaggggtgttgctggggaactgttgctctccgtatcacggcggcagcgacagcatcgcccggcagttcgcagtacccgctctcatcgccctcaactcctctctgctgcgaggttagcaaatcaccaccggctgctgcgcctccgccgcgtcccacgtcaacgccgagccccctcccctgcaaggccccggcgcctctccatctttagtgctggcggccgagcccggctccctgcccacagctgccccccttccctcccccctcccgcgccgtccccgggctcagcccgcccaccaccccgcactggccgagcccgcgcgcgctccccgccccacccctcctttcccctcccctcccttcccctcccttccccgcgctccgcgctccgggcttcgcctgacatctagctgctgctggggcgccggcggccgcctctcaccggccgagcggagaggaaggaaggagccagaggacaggagtgcatggggactcagaatccttaataggggaactgagggtgaagggcgcgcagcagcccccacctactcccaagattttaatttgcactggatacgggttttgtccccccctccccgcaccccggtgctcaagcacgcagttttgtctcctcttccaatgtttgccccaattcagtgcgtgtcatctcgcctttaacttttttctcatggctcggggctgcagtccccctgacatctgttttaaaaggccgctttcctagcccaaacccggccctctcatcctcctggttactgcgcgcctcccggcttgagcatccggatttcaataagtctcccgaggcagagttcgcgggcgctagtgaaccaggtgccagaaggtccgcggggatctattgtcgaagcgagacacccgtttttagctgtcgcga

SEQ ID NO: 5821 - DNA, 2558 bp, Homo sapiens; identical to SEQ ID NO: 5820

SEQ ID NO: 5822 - DNA, 1508 bp, Homo sapiens
cgcctctcagacagcggagccgggtcggggcggtctggcccgggccgccgctcctgttcctgggcttgtggggctggggtccgtctgggctccgggctcgcgcggcgctcaccacccggggtgccgcgggggggcggggagagcggccgcctagcccagccccgcggatgacaggagccggggagccgaggagggaggagccgccgccgcagccgagcgctgggctgaggagcagagagagcggggcgccgagtgcgggcggctgggagcgcgctgagcgggggagaggcgctgccgcacggccggccacaggaccacctccccggagaatagggcctctttatggcatgtggctggtaactttcctcctgctcctggactctttacacaaaggtgagacctgcgcgggcggctgggcggcggaggcggcggggccagggtggcgcggctggcggcgaggcggggtgcccggcgggctccaggtgcgtgggggaaccgaccggggtgcaaggccccgggtggggcgcagcggggaggggcaggcaccctgacaggggccgagtgagagtcagcccccgaccgctccgccagccacccgcgtctgccgttttggggcgcgcccgtaggggtggtggcaaaggagcccctcatctccctgctccctgcacggcggcagttctgccctggacccctcccccagccccttgccctcttcctgcggcttggtggcactgggaccccggagtgccctccgagtcgaggggtcctcaggccgtgactcttgacctaggagtccttgcttattcaggcctcggactcggcggctgattcctccgctatgtccgtgcgtccctctcccgccgcggaccccagccctggcgcgaatgttggcgcaccgcatggcgcttatccgcgcattggctggaggcagggtggggatagtgagagtcccgagagctggaggtccctcggatagcaagtttgttctccaaacccagaggtcaccctcccccggccctaccccacccctctgccccggctttagccccggcttggtgcgccaccgtggccacctcgggcagcgcgccccaagatgcgagattctccgcttccgcgcctggccagttggacctggggacaagtcttcaggctggggggcgtgtccctcttcccggagagagggggttgctaggggtgggtccaggtgtccggcatgtccagacctgcggctggggcgctgcgtacctgatccgcgaggcagccgggatcgggaggttggaagagggcagacatttccgactgaagccacctgggcactgagtcgggaccaggcaggcgcaggtagtctgggttccaggctatcgcagaggacgtgcccccgggcgcgcagatggcgggagatgaggcggccgaactccgcgcccttgcgtggtggagcacacacgctccaacaagctcagcgtcacctgttcagccctctaacttttctccttctcgccccggggcgg

SEQ ID NO: 5823 - DNA, 1119 bp, Homo sapiens
cggtggcgacatggcaggcagtcccgcgtggcggcggccgggacagctgggcgcgctggcaggagagcaggcacagcgctccccacaggcaggatgacgcgggctccgcagcccgtcctcccacgctgccccgcatcactgcctcggccctgacgtgcgtgcgacagactcaccgcaaacagtccccagcgggagcacgaggccgggacaggaggtgggcggctacacaggacaccccaccccccccacccccccgcagccggcggagccgatcgccggaaaagggaggcggtgggcgaaaggaaagcggggagctgggagaggagctgtaaacaaagagctgcccttgtgcgaagtcctgagccgggtccagtcagcccgcttcctgtggcccacgcactgcccgccggcccacgcgggagcctcgaggggcgaggcggaggctgggcgcagtccttgcagccagcagccacctccgcgcgctccgccgcggtccagctaattacctgctgcggcggcggccgtgccctttagggtgcattagtattcccgccgcgggcgctgccctcgcggcgtcggcaccgatgcccggccacctccaggcccgaacgactgcggctgcgggaaggcgggtcgaggggggctacggcaccccagggagaggccgggagccgcccggacctcggaggggatggggtcctctctgggaggcacccgtctccttcctgggtcctaagacccttcccagccctgcgctccgaccccactcctcccgaaacgtcggggaatcgggaaaggagggccacgggcaaagcgggggcgggcgccccctgattagcatgcggcgccggttgcccgggcccggattcccgagccccctccccgcgagcgcacactaataagtttacaaatggaatccggtggcgccgcttgcaataaaaggcagaagctgcgctccggcgcttcaatgagagcattttcccccgtaacaaggggctggattcagctgcctggtgccgtctgagcggggcgagttgccagagtaaccaaggcctagcgcgcacgtggggagagggagctggctggggctccagcgctagccgccgcctgcgcgcccgg

SEQ ID NO: 5824 - DNA, 1119 bp, Homo sapiens; identical to SEQ ID NO: 5823

SEQ ID NO: 5825 - DNA, 653 bp, Homo sapiens
cggaagtaaggcgggccagccaccgcctcgagccaaagtttctgcagccctggcaatcccccgcgcgtttctgctcaggagccccacacctcagagaaacttcccggcgtccccagcctcgctgtctcccctaggctttgggacacagctttaagggactgagcggcccggacgggatctgaaacctttggaggaccagccacgtccgcacagcccgcccatgcgcgctggcaccaggacccgcaggctgccagcggcgagtccccgccgcggttcctcagggcacccccggagaagggggcggccctgaggaatctcctgcactccggatgccctattttccccgcccttagcgccccagggccctgctcgggtcctggccgcgcgtggtgttcttttcagccgcggagctttgtttcccagtgtcgctgaaaggaaagagaaagaaaacgccttcggtcctggaggtcctgccccttcctgaagcgatgccatttcctccctccatctctcttttcttagattcctcctggggccccggcagaggcggggcggctgcgccccgagtccctctccggcggcagcgcgggagcggggctggaaaagagggcgccgggagccgccccgcccctcatcgctcctggcttctccgc

SEQ ID NO: 5826 - DNA, 1768 bp, Homo sapiens; identical to SEQ ID NO: 5816

SEQ ID NO: 5827 - DNA, 1101 bp, Homo sapiens
cgctgcgaggatcaagggagatggaatgcagcgtaaagccccacgtaaacgtgtcgtgcaacatgaagcccctcaccctgagttggggagcgggtggcacgcgtggaagctgaatgccaccatccctgggaccaggcgcagcgccctccagaagcgcctctggtgacgggctcctgttctcccccaggacgtttcccccagaatgccccggggccctggacggctctggagaggacgggagggaagggaaggagacgggcggaacggggacgtacctgctttcactgcactccttccgctccctcaccctcagccacttgcggaggaggaagcgttttcggcgcggggacgcgctgggtgtggagcagttggaccacggggtgtcctcgtcgctggagggcgtgatctcgatggacggcagctgcaggaactccttgccgggggccaagacggcgggcaggtcccgggccagcccggcctccaggctctgctcctgtacgttcttcatgcggcgcatcttgaagcgccggcggcgaagcgtgggggtcgacgaactggaccagaccgggctgccctcgggcgcaccctgcggctcgggcacctgcagggcgggcagcggccggttctccatcatgttggccgccggcatgggggccgtcgcctctgcgctccccctgagccctccgccagcggcctggttcgcgtctccctctggctgttccccaccctcggccccgcggcacactccccaatcctggggccgaaggaacaagttcctttcccggagcgcagcgaggaagggacgcgaggggacgcggcgtagcgcgccgccgcccggagtctaacttttcggagcgcgcgtcctccgggccgtcagccgccggcgaggccacccgggaggggcgggagccgcctgccagccactcggcagccctcctggggctcccctcgcgcgcccgcttgtttttcttccgctgcgcttcctcgcttgctggcgtctttgccttagcgggactcggcagccaggggccccagggggcggtgcagcaaactctcagcggtttgcgttcagcagaccaggttggggagccggcttggcgc

SEQ ID NO: 5828 - DNA, 1101 bp, Homo sapiens; identical to SEQ ID NO: 5827

SEQ ID NO: 5829 - DNA, 2341 bp, Homo sapiens
cggcccctgcaacggaggcggctccgaaggacgcaggaccctttcggaggcgacagctccaggagccctggtcctggagccggcgcacgcctaggcgcgaagggcgggggctcggggcgctagggatctgtgcggacgggggctggggaaggttccccgccggagaggcggcgaggccggcccaggagtcccgcggagccggcggctctccagcgcctagagccgggcgactgagtgccgagaggaagggaaagcgctgacatgtaaacaggggcttccatctggaggagcccgctcagatagatcccccgacacactcacttgcacccctaccctcgtgcaacgaggccacttacccaccccagggcccaccaggcagggacccgagcccgggcgactgcagcccccgcccccgccgtgttccgcctctgcggagaggaagcccagtgcctagcgctggggccacgggagccccgggtgtcggtgggagtggtggaccccgaggtctctcgcccttgactccgttccgtaccctggggtcccccggtttcccgccgtcccctcctgcagccccggcgggcagcgaggtgggaggggggccggggctccactttgggggctgggatttcgggggagggtcgccctcaatgcgggcgcctggccggctggcccgcgagtaggactcgccacccgagcgccggaggagccggcgcgaagccggggcgcggagggaagggagagaggccacgtcttccgggacgcgggccccgcacctacccgcccgccgcttcgcctccccggccggtccccgccgcccgcgtccgttgccccgccgcttaccttaatagtcccgtccatttggccaagtctgcagccgagccccccaatattccacacattgacccggttacagcctgacctcgcagccccttcggattagcccggcgcggcctccctggcgccctgggccctccctgcgtgccccctgcgagcgccctgccctcactcccctgtgcacgtttgttgttgtagcggagcgaaagagacagttaaccggatgaaacttttttttcagctaattttgggaagtgacttcactttgcgaatcggggaggaagtcctatctctctctctctctctctctctctctctctctctctctctctctctctctcgcctcgagctctcctctctcttctctcccctctgctctccctcgtcttccctccccccccacaccccctcttcctcccctgctggtcctgcttttcgcatcacacactatataaatatacgcggagatgcccagacacattcatgcgctgcgcacacaggatacttgctcctgggagataagagctagccgggaacaatgacggggtccacgcccagcgtccgcgccctgattcccgaagtctgaacctccccccatcaccttcccccaaaatccaaagccaaagacctttggcttctttgcttttcctgaggcggttggccgaaggtggccctcctgactcattcactttccgtttcttcccacagatacgttcattaatgctttttccagccggagacaaactttttgggggtggggtagggggggtatggagggagagttggctagggctgcgggtaacccagcgcctactgccggggaagactcggacgaaaaccgaggcaaaccaaccattaaaaagtgcatccaataagaatttttccactcaggccctccgctgccgagacgcggcagactcccagagcggctcacccactcatcgaagcggattctgggcggtttcgggctgacccgcgctgtcagggcgcggactccattccgggcgcattgttaggagaaggggcccctcggggcggcgcgcctcgaccctgggctcccggtgcccgcagagggcggagatccgcggcgccctaggccacctatccgcatcttctcgagccaaacccccagcgcttacccggacccgacggcccaagcactgactcccaggcaagagtcgcccttcctggtccccagggaactgacactaccgcgggacgttccctctaggacagtcagcaggtcccaggagcgcagcacgcaacagcgcagagcagacccagacttttcccggggtgagacccggaggcccgcgctctggaccgtcctccctacccagcctggaggccggcgttccccggcccaacccggagacctccccgcctccctcctgggccgccgcgcgccccagttggagcagcctcgaggggctgggccctttcggccggactcccttctcccggacatccaaaacaggttaccttgtccacgctctccggaccacgc

SEQ ID NO: 5830 - DNA, 3857 bp, Homo sapiens
cgagcagaaaccatcgtgtttctgggggctcttcgggcgccgtggggcgacgcggtgcagcgtctagggccgccgcaggccgggggcagggctcccagcggttcccccgcggccagcggccacgcaggaaaaacccgcttcctcgcccctgcatctgctgacaagccgcccgaggtgtctgcgctgagcgtggccacaccgatgcagctttctaggaaatggcccgggagggggagggggcgagtgagggattaggtccggctccccctcgctccccctgcgcaaacaccaccaccccttcctttccccggaggcatgaggcctccacgctcggtccttcgcccgcatcctcgccgacccctccggtttcgcgcctcactcgccaggctttctccctgggagccgactgcggtgaagtcgccgccagcacggtcggccctgacacgtgctctaacgcatgcttgagtcaaggctgtctttacaggagatacgatctggtggcgtttcttcacctccttcctcccgtcaccccccacccccaccgcgccctttggtgtatttcactccaggaggaaggggagagaccagcgccctgatgtgctggccaagctggcacgtgcagcgggcatggcgtggctcgagctctctgggcacaccgaggccgactgagtgcctccctcaccgagagagggggcccgggcaggggcgcggagagccagcaaggcggggtggggcgcgggctgggtgagccgtacactaggttccctgcaaggcggaggaggggagcgaataaactagaggtgcaagcgattaactcaggccccggagccagcctctttaaacgagggtggggcggaaggggtggtgggggggaaaggaggggatatcgctttaaaagggtgaggaagagtttggggcgccgtctcccctccctctatttgcatagccaatagctctggggctcctgctactgcgcgctgattgttaccgggcagattactttttttttttttttttttttttttttttagtaggacgcgttccccactacatcaaaaggaagccaagggagggcggagggagagcgggcgctggggcgggcgaaagctggggagaggcccggccgcctccgaccttatcaatagcagcgggaatgagtatcccatctcctatatgtaaagaaaggggagggaaggggcgggcgaggaaaatgtctaattgctgtggaagccattagctttcaggaagaaaaaaagctcgctgaaaaacccaagttgcaaactcaaaatgaaacagtccagcgccgcggatgacacccgggccgaataccgtgtacacccgcacacagtcggccccgaacaatcacctattggttttagtcacgttgggcttcccgacttaagcttttgagtcaccccggataaggacattcacttacattttaagacccccataagggaattactccaatttcacctaagccacctttgagcggatcaaagaaagttgcagcggggagaggcgagagaaggagggagggcgggaggtatttttaaagtataaatctaacccgacaggcaagggacagaggccgccggggctcccagcctctggacatcacttgatatagctctgcgagcaaggtctcttccaccccgactccgcacacccccccttctccggggaaaggcatccagagctctgggtctcccgaagtgggggcagcgggggcgaggaagaagcgggtggtcgtcccggggcccagcccaccccgaggagaatgcctgggtggcgagtcctcacgtctcgggagtgagccgagggccctctcgccccttccctctccccctccccctactccgtcttgctttacagagaaattccagcggggaggggggcagcgaatgggaggggcagagagggtcgcggccggatgcccccccttcccggcgccctctgcattcatggagacccgcaagttcgggcgcttcccgcgtggcaggctcgcctcttgaagttcccctgtccacttccccttccgattactgactgttcccgagcgtgaagctcgccatcgaatccaatccccggtggttttgcagactctcacacgtggggtggggcgtgagagggtgcggaggttggcaggaatgtctctaggaggcttggactggaaactgagttttcccttttggtcgccactccagccatgtgttaaaaccctaatgtcttgttaaaatgcactccacctagcacgcgggaaaacgcatgttgccttctaggcaaaagtgcacactttctttcagtgtagacttcggtttcaagaaaaagcgcaagagcctgtgctctggctttgaagtccaaactgatcaccgtggcgcgggggtggggggcggcgggagggggtagattgttggttcttccttatctccttttcacccttcacggaaaaaaaaatacatatatatatatcccatgtaggactggtgataaactttagcgaacgccagttttattggacttttattctttttccggccggctccccaccctctacgctagcgttttggagtttcggttggaaagtgtacaaagcctggaggtggagggtgcagcagggtgttgggtgtttataggcacttttctgcaggagcctgcagcactaagcacacatactcccaagcttacctggaggatgcctcccagccaggtgattccgcggtcggctcaaggcccgggagcagcgcgagttcgagtcccgccttctccgcgcaggggcgcctaggccaggtggggagcgggtagtgactgagttcaggctcagaaatgggagccactgccttcccctcggctcccccaaagagtggagctgtgtttgtgtttctccgtggagggatggacggtcaatcaaaaccgaaaacccgactggcaaaatgcgaggggacacataaatccgaggggacacataggaggcacatcaagaggaaggagggagtgcaggcaaagtagaaaaatgcggacaaggagaagaggaaaacgtcgggaagcggagagcacgggggagcagggtgggtggggacgggcagtgcgattgcaggtgttcactcgcttccgggaccctctggtcgcagccgcgcccgccggggcgctgggccgctgcgttctggaggggggcagagtccgccaggcctgtgcatccgcactcccttcggcgaatttcggcttggacggggctggattactgaggcggcagatgcgacaggcgtgagttaagaaggcgagcgcctgccgtctgtcacccacctagcatctcactcccctcccttcggaaaaaaaaaaaattaaaagacccgaacttccccctcttcctgtctgattcagcttaggacacgcctcacgcggccgaaaatagctctggaaatacatttgctttacaaaagtgaattttccaataagctttggggcggggggcgtccggcggtcggcgtcggggggtcctgcctcccgggaggagaaggaaccggccgcctccgcccttctccccctccaggcgcccccgggagggggccgctgggcggcggaatcgcgcctccgctcggggagccaccacgcggctttttcgcggaattttgacgtcatccacacgtgggggaaggggctgggagagcaagaggaagcggcgggggagggggccgcggctgggagagcgcggcggcggcgcggcgggtctggcaccctcgcggtgggcgcagcgccgggcagggtccgggccctgggcagcgcggcagaggaggccgtgccgcggaccccggagccagcgccgcgacccgcctccctccccgccccccgcccctcgc

SEQ ID NO: 5831 - DNA, 1439 bp, Homo sapiens
cgcgggttcctccgccaagcgggacgccgcgccgggcgggtgagagaaagcccgggcaggagagcacagagccggcgactggacgcgagcgcggggcgggtggagagcgtctctccgggcgccgctgctgttgtcccgggtgctgaaaagccgggaacttcccgggaagcagcggcacttttctccctggaaggtgggtgtgggggttccagactgcgcacctgctaaaccctcctgggtcccccgggaggggtccgccagatgtgccccttcccagccccattcgggggagaaggatgggggcgggggcgtgggggtgagcacagccggacaccgcaagtgggaacctggggtgtccttccccgcagctcccgggcagccgcgcgccgcgaaccccggtccacctgcaagcaaggcgggccgggggcagagggcgccgggctgtgcgggggaaccggcccgcgtcccgggattggggggcggtggaagagagagcgagcgggcatgcgcagtggggcggaggaggtggcgatggccgggggaggcggggggactgctgtttatttgcagctgggccaactccgcggcgcaggcggcggcggagcgcggggagctcgcggcgggtccagctgccgcagcaccatgcccgagcccccctccgggcagacgccgcgcgccgccggggccccggtaggggaggatgccagacgcccgggagaggccagggcagcagcggcggcggcggcgcgatggtggtgaccacctctgcccgaggcggcggcggggaccgcacaccctcccggcggcggggctgcgggctagcgccggccggggccgcggcgctgctggccggggcaagctgcctgtgctacggccgctccctgcagggcgagttcgtgcacgacgacgtgtgggcgatcgtgaacaaccccgacgtgcggcccggcgccccgctccgctggggcatcttcaccaacgacttctggggcaagggcatggccgagaacaccagccacaagtcctaccggccgctctgcgtcctcaccttcaagtgagtccctcacctcgcgctagccgccgctgcctcctctaccctccgcccgtccctcggaccgggagaagttgcgggactgacttgggggcatttcatttttgccgccctttccctccacgcctccctcctctccaggatgtgcatggcactttgctccgggatccactgcccggctaatctgggctctcggggcggttcgggaggcgccggctggggagttgggatcgagtttctcaactgtctgccctctcagcgggcttctctctcgaggcagggctgggagcgggctggtgaaaccgcctccgcaccccttcgcctgccggatcgtgaccaagtgggactagcgcggacccagagggttccggaggggtggcggtggtggcga

SEQ ID NO: 5832 - DNA, 1288 bp, Homo sapiens
cggagagggctcctcgggccaactctgggcaacgatgagcatccccggcctcggcaggggcgccgggccgcccgccctccctccctccctccctcgcgagtcccttcttcagaggacgcggggagccgggtctgcgcgctccgccgcctgtcacctagcgcccgcgccgggctgcgattggacgcgtcgccgccaggcacccgccagaaacaccagtgcgctggggagaggaggggggcgtgcttgcgagtcgagggcttgctttggcttttttacggctcccccctcccctcagcactccatgccgggtctctagttccagcgcgcctcggctcgctcgcgcggcgggagagttggcgcaaacctcgcggcagccgcagcctcctcgcgcgcctctccttcccctacgccctccgctcccgccatggggccaacgtggggctcctaagagttgccggctctcagcggcgcaatctccagccaaagtcaccgcgggcggactatggcttagggcgccagaggggttagaggtacgggaagaggaaaagacggctaactgggaaaaaaagagaaaacgaaagaaaagccaaacgatgagtttccacaaggaggacggagtgaacagtctgtgccagaaggctctgcacatcgtcaccgagctgtgcttcgccggccaggtggagtgggagaagtgctcgggcatcttccctcgggacaggggcagccagggcggaagcagcacaggtaaccgggagggctccgctcgcgtcctcgcgctccgctgggaccccgcgcgctaggctgcaagctccggggttctgcgcctcccgcgccgctcccgcggcatatttggggcgccacgctttcctacctcgctccttccttcgctcagctcctgacgacttcgagggtggggcgtttgggttttgtttcctcctgtccacctgccgggcttctcccattctctggtccgcttcccgcctcccggcgccgtctcccgctcccagcctcgccgcgcctctccgcgttctcccacgcctcccatctccctcccggagtggagaagtgagtgcgggcggtgacggcgccgggacggctcgcggcttggctgcttgtgggggcggctcacctgtgggactagggctgctctcgctcgttccaccggccgctggtcccggccttgttgatgggggccaggcgggacggacaagccatgcttggacgcagaactcccttgcagaggtggctgccttggcctccgaggtaacccgcggctgcaacctgtcgg

SEQ ID NO: 5833 - DNA, 1006 bp, Homo sapiens
cgagtccgggtctccacgctttatttggcagggggcgcgcgggttccggagctgtccagcacctcctggccaagttctctgcgctctccgcgcccgggaagctctccgcgccggggaagctctccagcgccccgcccccggcagggaacctctccaccaggacacccggggcttcccaggctcgccatccgtccccaccagtctctacctactttgcccagctccacctcggcagtgcagcgtgttttggtggccttcctccgcacgccctggagggggagtgccctgcaccccggggctgctccggagcccagtgcacgagtgcacatgggcttccctcctttgcttaaagggcaggcgagcgctactcgctccagccttgcctcctgcagctgggtggtcttttttctctcctgtctttcaagacacgcgcccgaaatcgaggggtgagagcaaagaccgcccatcaacttagcaccttggatttagagctttcaatcccgaaaggaggttggcattgcccgggtcatcgagagagggagggagaagagctgaggctgcaacggctcctgggctccctagaccgggtttggcatccaggagaccgtgcgggagaccgacgctgagcgccggcctcgccctcggcggcccctccctcctccttaccccgcctcccccggcccgcccctccctccccggaggagcagtctctccgcgcgtctcccggagctttctccattgtctctgcctttacaacaggttcgggcggcggggaagacgggggggtgcggggccgccccagcccgggctttcttggggccgccccccttctaccgggtgtgcgagtctttggctgcttttattcggctcgggagctaattccccgacggagccgcgccggggcgagtccgacccctccctccgggccccctccgggccgcgctgccgcctcggccctgcgtgtgggaatgatgtgcgcattggagggtctaagttcttcacgcgc

SEQ ID NO: 5834 - DNA, 1185 bp, Homo sapiens
cggagagccagggttcgcccaacaggagtacgcggagacaccccagacgacagcgcgtcccccccacccccaccccgccctccgggcgctccaggccagcgtccaccagaccccacgcctgggggactgcttgggctctagcgagagtgccacggctctgcacggcagcggggaggtggcgagcgcgcccgattcacgtcgcctccacgcccacctcctcccactacgagtcccctccccttgccacagcactacccttattgttggccgcgtctgtcactttgtggggctggtgacatgaatggatgggctggacacaccttccgtccgtccagaaaaaaacaaaaaacaaaaaaaaaacccgtccagatctgcatagagagggggaaagactcccccctgcgctcccagagcctacgctgtcggccagagaaactcacagcttccccctcccacactcactcctcccatcccttaaaaaaacgcccaacgcaaataaataatatcgttccaagtccgccgccgtcccgggtggcctttcctccctgcctggctccgcgcgctccagccctgcgggaggcggcggcgagaagctgcggctctgggtgcggtgcggggcgcccgggcgacaggcgggcgcaaggcgggcgcgcagcagaccggttggcgccgcactatgctccccagcgcggtcgcagcccacgccggtgcgtactgggacgttgtggcttcctccgcgctcctcaacctccccgctgcgcccggctttggcaacctgggcaagagtttcctgatcgagaatttgctgcgggtcgggggcgccccaacgcccaggctgcagccgcccgcgccccacgacccggcgaccgccctggccaccgcgggcgcgcagctccggcccctgcctgctagcccagttcccctaaagctgtgccccgcagccgaacaagttagccccgccggggcgccctacggaacgcggtgggcttttcaagtgctcagtccctctgcggacagtgcgaggctgccgggccgggctccgggggaccgagactgtaccttccagccttcagcgccaggtgagccagctctcccctccctccccagccgcgcccgcgcccccaggccgggtggtccagggatctgggagcgccggcggtgcgcactgcgcccagggagagccgg

SEQ ID NO: 5835 - DNA, 409 bp, Homo sapiens
cggctctggtttcacgcgggcagcgtcagctggtcggtgtcacggagttcccgcgtcctccgcccgctcagcccccgcggacccatccactggggttgctccgcagcgcgactctctctcatcccgggggagggctaagggcggcggtggggggcggggtgggggggaagcggcgggagggggcggtgcgccgccgccttaccccgggctcgcgaatccgcagcgtcctccgcagcatcttcccaggcccggccctctcctccccccgcgccgatggtacgcgccggctcgcctggcccggctgcagtggatgttgctagaacccacgcggaggaaggaagagacgcaggcaggctgcggttacccaagcggccacccgggcctcagggaccccttccccgagagacgg

SEQ ID NO: 5836 - DNA, 1813 bp, Homo sapiens
cggggtcgctgcgtcttcctgaccactgacggccaggacggccccagccccgctttacctgcaagccccactccaggctcgagcccccgagggcagggatagcttcccgggtcccgaggcttgaccagagcctgaaagctcctgccgggggttgctccgactcagcgaggcgccaggctgcccggcgcggctgggggcgctcagcgccgggaccccagccctgccccggccgcccgctggcccagtgcgcacgctccggcagctcagctccccctcccacggcggcaggagagctcccggcatctgcccggggcgggggcgggggcggggcggggcgggcgccgcgccctcctgcctgactggcaggaagacagaccaatcggaggggctccccggggggaggggcggtgccgtgcctgagccgggcgcgggcgaccgagggagctgcagccacccgcgtgcggcacgcgccggccgcctgcccggatcgcggccaccagtgccgcggcctctcgactcccgccccgccgagccgcgcgcgcgactgccatcctcctcaattgctttttacgattttttttgtgcatgcattcattttctgttccgttttgtcctttttaaggcggtggcggcggcgacagcggcgtaagctcgcagcggggagggggcggccggaggatgcggcgcggggctgcgctcgctacgtccgctgctgctgcccggctcgggcctgagcgccgagcaggtgggtacaggtgcgccggggggcgggaggcgagcgctggccagagggaacccgtggacccggcgaccgaggggcggacctggcggcaagggacgcggcgaccggtgccgccccgccccatcgtccatctccccctcctccggccatcgcgccccctctgggtcccccttccactctcgcatcccacctcagtggtcccccacccttccatacccatcccccactcctcttcagacccccttgcaaaatctcccagccgctgcgtcgcttcccccaacaccccctcccggtcccgcccccagcccccagctctccttcacgccacccctatttccactcttctccggattccgccctcaagccaaggagcgggagggggacccacccggtgcctgccggagtggcgcggggggtgtggccggcccgtcccctccgtgtcttccgcagggtaggtcacagtcccccagatctccgcccaggtggcaaagaagatggagctgggggccgcgccccggcggcgcggggcccgaaggcgaggccgcccagcccgcaccccaccccacgcacggcacacgccgccgcggcccctgccacgcacaccctcgcgctgctccgcccacgtgggcgccggggaggaggctcgagagatgggaagaaaggctggcacccaccctcctgccgggccggcgcgccctgggcgcactggcctccggagatggcgcgcaaggattgactctcgtggtgccagacaccttgccgggcgccctgcgtcggggccagcggcctcgctggcctgcgtcagtgcgctgcggcctcgcctcccagcccctcggtccttcgctccatcccccctgctgtgggctcctgagcatccggcctgggcagcccagatagaggccgcttacgaggctggcgcttcttttcgccttagaagcatcccgctcccacacaccccagctcgccggtctcctgaaggctgggccagcctcggctctccgccagcctctgcccggctctctgagctccagcgatactgtatctaaccgccagccctcctccgccgcccgc

SEQ ID NO: 5837 - DNA, 1294 bp, Homo sapiens
cggctggagaagctctcgctagcgctgcctgtggccagacccgcctcttgtcccctttcgggcgcacacacacgtccacccagacactccgcgcgctccctcgcgcttttgcttgcccgcccgccgccgcctgctttttccctcctgctttcgccggtcgccttctccttctttttttttttttttttttttttttttttttttttttttttttggtaccatagagttgctctgaaaacagaagatagagggagtctcggagctcgccatctccagcgatctctacattgggaaaaaacatggagtcagctccggcagcccccgaccccgccgccagcgagccaggcagcagcggcgcggacgcggccgccggctccagggagaccccgctgaaccaggaatccgcccgcaagagcgagccgcctgccccggtgcgcagacagagctattccagcaccagcagaggtaggaggctggagaggggctggggagggggcggcgggagcccgggcgcggagcggggggcggccgggagcgggcgcccggggcgcggggtccggcggccgcgcgcgagcctgcggcggcgccccgagcccggaggacccccctcccctcccccctccgccccccagaaatgttgcaaacttttgcagcccgttctcggcttgcgggagcagagtggggcgggggaggcggcgggaaggttgacagccggcgggctcacccccctggctttgatttttctgcaaacactggaggaaagctgcgttgcctcaattaaatacgctcccccaaaatacggagatgcggggagtgggggcccgggaaagaaacttttaaagcggcagtgtccttttaagaaggggcaaaaaaatctgtttatggccaccctccttccgctttaccttttctcctcttgacagtttcggccctggctgcccgagtcgggggtgtgttttcggtccctctcagatctgggcggggggcgggaggagtgagcgacctgggaagtcccgggggtggagagggggcgctccggggtctgggggcgacgtggacaccttctttggagcacggcggtgcgtttgggatttgaaggaagggccgaaggaagcggggtgcgggcgggcgagctgttcgccaagttgtctggcgggcgcggcgaggggagatgcgcaagtttgcagaccgggggttcggagcccggcgcccaggctggcggggggcgtgtgcgcgccaacgcgcagagggcggcggtcctgtggggcgctccacgcgcatccggagggagcgt

SEQ ID NO: 5838 - DNA, 939 bp, Homo sapiens
cgccgcaaggttatgggccgaagtggtgcaggggcggcgcccggggaagcgactggcagagctgtgcgcactgggggtgctgcaggcgctggggagagtgtggagaggctgcgtggagctgcgcgctcggggtgggggctgcactcccaatgaagcgcgtgaagggcaagcggtgatgggttctgcgccagtggggctgggagcccgtccggggctgtacatggggctgcgcgcaaggtgaggactgcgcatgtgggcttggggcctgcgcgcaccggaggctgcaggcgctggggagggtgtggggggctgtgcgtggggctgccctcaccggaagctgcacgctctgggaagcgcagaggcgggggtgctgctcgcgctggggagcacgtgaggggacactcagggactgcccgcgcgaatggcttccaacgcatgcgccccaccccacatttcacagtcgccatgacgaccgggaggtccgcaacggctgcggggacaagtccgttgaggctgccaggcgagtcaggtctctctggacctcgcctgactcggctgggctgtgcctgaaattgacccagctccaccatactccttgattatgagaaaacaaggagtaagctcaaagcggctgcaatcttccggccgcagccagtctaaggggcggcgcggggcctccctcgcccgggagccggaggtagaggaggagatggaaaagtcggccctaggcggcgggaaactgccaaggggctcctggaggtcctccccggggaggatccaaagtctgaaagagcgaaaaggcttggagctagaggtggtggccaagacctttcttctcggccccttccagttcgtccgtaattccctggcgcagctccgggaaaaggtgcaggaactgcaggcgcggcggttctccagcagaaccactctcggcatcgg

SEQ ID NO: 5839 - DNA, 939 bp, Homo sapiens; identical to SEQ ID NO: 5838

SEQ ID NO: 5840 - DNA, 899 bp, Homo sapiens
cggcctctgagggcccgggcagccacccgcacttccccgccacgcggagaaagccgagcacacaggccgcagggtgggggtccgcggggagagggtggaagcagcgggttctccgcgcctggggtggccgctgccccacccaggcccccgtctgccctctacccttccagaccaatcgctccctgcaggtgccaacgcggtgccccgcaccaggtggcacgcggactttccccagagctccccggcctagacggagtcaggctaaggcagaagcgcgggcagccccggcgctactttacagcgccccatctgcagccctggggtcctcacccggctccagggtgcacagcagccggggcgcggtccgggaaatgcagctgcgcttcttgagcacattgctcaggatggtgcccacgccgccgccctgccgcttcaggcatctccccccgcgcctcagagacccggtcagcttgtcctgccgcatccgagagcgccccgggctctggcacggctaccgtccgtctcggtccccgctaccccactcgctgagcggctgagctcgcggagctgggtgagtgtctgcggctgaccggcccgtgggagcagggagcgcacagccggctggtgctggagggtcacggggacttacggggcaccgcgggagccgccgagcgcagggaagccagcaggcatctgcagtgcggagcctgcaaggctgaggcaggagatcgctcgaggcggggagggcgggagcgagcgagcgagcgagcgcgtgggagacggaggcggcgtgcccgcccccaatcccggcaccgccgtgcgcaggcggggccgccccagctcccccgtgcccagaagcgccagagacagggagccagtgggcgcgtaactgcgttcgg

SEQ ID NO: 5841 - DNA, 899 bp, Homo sapiens; identical to SEQ ID NO: 5840

SEQ ID NO: 5842 - DNA, 547 bp, Homo sapiens
cggcgccttggcgaactcggccactccagttcctcacgtggtgagcactcagggcagcgggtcgattttccgaggtcccatacctgggtttgaggggcgcggctcgcagcggcgggtgcaggggcgactgccagccctcaccccgcctcggggtgcgttcggaggccgacacctggaggacgcctccagtccccgcgggacgccacgcctgcgcgccagggatccgggataagaagtgcgcgccgggctccggctgcgcgccgcggggccaccagtttgcgcgcagggctcaggcgaccgtgcggccatggacacgccacggggcatcggcaccttcgtggtgtgggactacgtggtgttcgcgggcatgctggtcatctcggccgccatcggcatctactacgccttcgctgggggcggccagcagacctccaaggacttcctgatgggcggccgcagaatgaccgcagtgcccgtggcgctgtccctcaccgctagcttcatgtcagccgtcactgtcctgggcaccccctccgaggtctaccgt

SEQ ID NO: 5843 - DNA, 2505 bp, Homo sapiens
cgccccgccccgcaccgggggcggaacctcgcgctcccggacctgggacagcaccagcagcgtgaaatacgcgcacccgagtgcaggagcaaacaggcaacctcttgttctggctacctccagcccggccgcctcctcagcggcttgggacagcagcgcgtggctgggaagacgcgggagggggacgcgaggcaaacttgcgccaagagttggccaggttaggtgagagggagtggcacccgcgcagacacttaccgctggcgttcttcccgcagatcaggtgctggtagggctgcaggagaccccagatctccgagtcgttgttgaccgtgtgctccagggtctccacggtgaacttgggcgcctcgtggagcgcatggtggtggtgatggtggtggttggcggcggctgccggcgggactgcggcggccgcggcggccggcggggcgcaacagctgctgcccccgctggcgctgctggctgcgctgcaggcgccgccgctcgccgctcctcccccgggcgcctcccgctctttatccgccgcgggggccgcaccagggcccgagctcgggcctgggccggagcccgagcctgacccagggccactgcagctccggggcaccccggaggccacgacccgcgagtagatgtcccggaagaggctctccatgcaggctgtcaggtagatggcggcgtgctcgtggatgcgcagcgccacgcggctgtccaccatccagcgatacacgcggcccacggagaaggtgaggccgcagcgggccgacttgccgcggcccaggcggtcgccgccggcgctgctcatgttgtagagggacagtgcggccagcgcagccgccgtacagtgcgcggccaggccccaggacagcacgatctccatggcgctctggatctcgtacttggtgcacttggcgaagcgcaggctcaggcgctgcgcctctttggctatgcgcaccagcgcccggctcaccagcgtcgacagcttggccagcgcgtccttgggcaggccgccggggaccgccgggcctgcccggggatcccgcgaacgcagcagcagcgcctccagctcctggagagtccaggggacctcgtctaggtccggcagcagccgcgagcagtgctggccggcgcagtccagcccctcggagtcttccaccagggcagtgttgacagtgtcaaagctgttgtgccggctgtgcatggagtcagctagaggcggccagcagctcccgccatacggggacgccgggtgcgagtcggaacagcacaaagacaagttggaggagcgcaccgagtccgccgcgccaccataacccgagtccagcgtcagatcctccagcgttctcaccacgggcttcttacctctcctggccatcgctgcgccacttcatgctgcagccgcctgggagccaaagggaaggagcggcgaggagcagcgagtgccgcggggcgcggggagagccgagtccgcgccgccttggctcacttttccactagccgctgctaccaactgttagtactttcggctgcctcccggaactgccgccgctggaatatacagagcagaccctggagtcatcttccagagtccgggccggagctgggcgcaatggggagcgagccaggccgggaaggaagctcccgccggggcttgcccctttcttccaaaataaaaagtgtctagaccgctcttccctgagccccgctgggcgcagtagccaccgggcgccggccacggtgttcgtgggactgagaccaccccagatgccgccgccgccgcagctccgcgggcagctggctcccggctcccggctcccagttcccggccctggttcgctcggcgccagcctgccctgcaccggagcgcagcagcggccgtggcggctgcaaaccttgccgaaccccagcaaaccccgggcagccagtgggacgggcgtatgcaaagcaggggcggcggagagccagtggaatcggagaatgctaattacctcgctttttttttttttttttaaatccctcctccccatgcggccccgcccctcacacacgcccccggcggacaccgaggctgcaggaagtggggagcagtggccagggacttggggaacccttgcaagcgtagagacgtggatgctgccccctgctgctgtccctgcccgcattctcccggagggtggtgggttgggccggtgacctccccacctaggtgtgctctccaccgcggttcacaaggtgtctgcctgacggtcgctctctcccctgcggttcgcatttcacttttttccccccgtaacacctgaaacatggttttcctccctctctattcccacttcgggtacgcaaaccaattagtgcggccctctttcagccggggtttgctccagcatggagggaaataagcctgtcgagcggaggcccgtggcggtggacaccactgggaggccggatctccggccattcgccacctgccactagggcgcgttaactcga

SEQ ID NO: 5844 - DNA, 1587 bp, Homo sapiens
cgaggagtggggcgttcggaaggacggggactgggaagcggccaggacggggagaaggcgcgggtgctggaaccacttatcagaagaaacttaacgagatttgccggcggattaaaaaaaaaaaaaaaagtgggtccctttttatctccagactgatgatctcgcgtcttccgcgaatgtcacggtcaaggcaggatgctctaaccgccctgttatccgcaccattttcccgcccctgatccccgccgcacccgccgagactttgcgagactccaaggctggggggccttgccaggcgcgtccggggcactccgggaaagaacagaggccggagccgcgcctccacggtgcgttctctgagattccacctcccagccccggctcctacggggtccgcagagaacacctccaaatctaggggaggcacacagactcccacaaagggaggatggggagaaagtgatggggtttcgaagagtcgccctagggaaggagagagaaagagcagggaagagaggaaagaaacagaagaaaagcagagacgggagagaggagacgaggggagcagcggggagaaacgcaggaggcagaacaagcaaggaaatctctcatttaaaagttcccttgggcccgagggctgggagtcacctgctctgcgccgctcccggctctccaccgccctggaggcaggagcgcaaacttgcgagcgcccgggcccacctccaccgcccgtctgcatctagacttgggaaggggatggaaggggcgggggggtaaaggcaagaagcaagacgaaccccaagaccccggcccgaggagaagaggtctgccggcgcttgcggccagtccggcggcggcggctctggcggcggcggcggcggcccccgggtggcggcgcgtccgggctgcgcagccaggcgggcggcgaaggctgaggtgccggcgagcggcggggcgcggagccgcctcctcgccaaccccggctccctcctcctctctcctcctcctcctcctctcctcctcctcctccctgcccgccagctccctccctccctcgccggagccccagccgggtgcggactggcaagcggcgcgctccgcggcctccccgggcgccgcgaagttgggaggcgcgcaaagtgcggctcaggggggaccgccgggggttcccgccagcagccccctgcccgaggccgtagcccctgccttccccgctcctcgcccggccgcctggccgctcggccgctccgccgaccgagggctcactagcgcttctccatggtcgcggcagctaatcgatgactgaaccgaacaaagagcagcggcgagatcaattcctaatacctatcgatgggcagcgggcggccgagccccggcgagccccggcagccgccgcccgccgccccagggcgtccgcctgcccgcccggggacctccccaatgcgcccagggcgcgcccgggggctcctcacggccgcgcggccggcgctgcccgcactaacctggagtcgccgtagatcaaatcgcttccaatattgaaacatcgatcccacattggcggccatcttgggggctatcgagacgcgc

SEQ ID NO: 5845 - DNA, 5693 bp, Homo sapiens
cgcgcggagagggcttaagagcgcccctccaaaggcccagccccgcctggagagagtgggcgggcaccgggtccctgggggaggggctgtcgcaggtttgggagggaatccagcggggctggccgtagcctgggcaggccgtagcttgggccggcgggaacccgccactggactgaagaggcgtctggccgtcgctgacgccgctgtccccttcccgatccgtccgcccgcagtgtcatcctgtacggaccgcagtttgtccccggacctccaggacgcactgcaggacgaccccaaagagacggacaactcgacctcgtcggacaaggagacggccaacaacgagaacgaggagcagaactcgggcaccaagcggcgcggcccccgcaccaccatcaaggccaagcagctggagacgctcaaggctgccttcgccgccacgcccaagcccacgcgccacatccgcgagcagctggcgcaggagaccggcctcaacatgcgcgtcatccaggtgcggcccggggcgggcacagctccttagccccgctggcctgggagccgggagcctcggaggagtctcccgccaagcttccttggctacgagcgcgcctggttctggtctgggagcagaccgtgcgcccgagtggggcacttgcccgaggtcggggactgtgaaccgaaagattccatctagccctgctgtcctcctggtattgcgatttgggggcgggtcactttacctctctgaattccgccccccgccttgcttatggaaggttgtaagcctctctggggtccgggatccctctttacctccacctttcgagcagagaaacaggcgatgccccctccctccctgcgccgaagcgcgggcagacaaacggccagaggctggctccggagccgaggggccgaggcgagagccgtgccgggagggaggcctttatagagccgtcaggccgcgggcgagccggggaccaggaagcccaagtctttatgagtcgccccacgggtccgcgaaatccttcacccttggctggttcgccgaagcctctctccacccctcccggcctaatccggcccggccccgcctcgggggagtcctggtgcggaagaggcgcaaggacccagcaggggcagcccagtcagggaagggagaagagggggggagaggacactcctgatcctgggttcacagccccctcctctgtcccaggtgtggtttcagaaccgacggtccaaagaacgccggatgaaacagctgagcgccctaggcgcccggaggcacgccttcttccggagtccgcggcgcatgcgtccgctgggcggccgcttggacgagtctgagatgttggggtccaccccgtacacctactacggaggtaaggggcgccccgggattcgctgttccgcacctgtcctattccgggagctgagggcgaagggtcccggccagcacgctttccgccgctccagaacatcgcccactcgctggacacacgatcacagacacatgtacactcacccacatgtcctggacacaaaatcagatacatggtctcacccatacagtgatgcacacagaagcacacacgagatacagtgacacattcacccacgcagggcacaaggtgcactcacacttgcgttcagagactccagggacacacgtctagacacgatcgcacgatcacgtataggtaaattccaccctctcacacacaggtacactcacggagacacaactccacagacgcgcacactcccaccagtcacactgaggccagtactggcaaatccacatgcatgcggcccccacggacagacgcacagccttcctgccgccctgtgcctggtgtacttggcatgaggtggattccgagcgctggagggtagtgtgaggggaggggatgggggtctggattcattccaagccgcctgctcactagcatcgaaggcagcaactcctgttccatgtggcggggtgtgtgcgcacagcatctggcagtgttagcccaaatgccggcagttgctctgggcaggactgtagtccaccctccagccccgagacccctggggttcctacagactgggggcacaagtgttgggccaaccccagatttccaccgtctttggggctgcagagagcgaggagccccagtttacaaagggcttcagatggtggtaccaggcttgggcctggggtgagctgtccccttgccacctcagcttttcctcctctcacttccctcacactggattggtgagccatcccaactccccctatccgattttttcagctccttaccctgagccgcattgcttgagctcaccaagctcactgtcctgttcttcccagggctgagggctcaagaaagcacctctcctcttctattctgaagcttctgaatttggagagaccccaggactgtctatgtctgagaggcatctgcacttctgagttgtaacgcaggttaggaagaggcaatttctcttagaaagtgggttcagtggcagtgttagcaaggcaggagctaggcacccaggtagacgcagaagggaagggaagataaccccatcactaacctcagcacatccggaagcctgaggggggattagaccttgagaccggaccggggcccctagaaattgtgggcaaaatgccaggctgtgcttttcagggcagagaccccaggcagtggcagggctcaggctggagcgccccagccgcccaaccctggacagccccccaaccctggacagacccccaaccccggacagacccccaaccctggagagcccggatggtgggcgtgtcttccggagtctccactcaccgactctctccacctaaatttgcctctttccctacaaaatctgggcccggagcagcgaggtagtgggggcggtaccggcccggaatttttccccgcctggataattaaccaaggtttccccgaggaccacttcgcccccgccccgacctatcccaccgcctcctctccctgcgcgctggatgaggtggggagctggatactgggggcccctcgttccccgtaatggtggggaagactccccagcccccagcgaggcagccccgcctaatccgcgctgggagatcccggcggtggcgaccggcagcgggcgagaaaggggccgggcggcggggccggcggctccccgtgggagcgcggacaaagccccagctgcggcttttgtgcccttttcagacggcgtttgttccaattacctccggcccggccgccatatgggcggaggcggcgcgcacggcgcgggggcagcggccttcgctggttttccggctcgccgcgggccgcggccgtctcccatccctgtccctttggggctccaaatttgccgctccccatcttccccttcactttcggggagaattaaattaatggttttaaaaagtaattggcaaccgttttagctgttgcttaaactgcctccaagccacgcctccagacaccccccatttggacagatttcagggtttggagagggaagagggtggcagggggcatcaggaattcgccccttgactgagatcccaggactcagcagggggagtggatttgcagaagagactcaggcttctggactcgctggttttcccgccgtacaaagcgggtgcctggtacaaggtggtcctttcgtgacgtcccccacgtcagtccttcagggccccacctggtgggggaaggcaggatatcccgaaggttctggaaaaggggctatgtggggcggtcagagagttgatacagatttgttgaggcagaatgggtttgcaatccggagtccctacacctcctgaatttatgggcaaaattctcatccttgcattttccttgagagagagcccatagctatcaccagcttctcaaaagatctcaatgtcctcagatgcttcagaacctgggggtgctggcaaaaccaacccggggcaaggctggaggaccgagcttctaccccaaggagcccgcggagctctggccatgacccagagaatcttcgtgtcctcctccccctctcccaagtcgctggagctcagttttctctttctcaggctaggctaggccggtacaaatggtctcaccgggatcgacgcggcggccgtacttggcgaggcgaaggacttggactgggttggtagggcgcagggaccgagtttagggcgccaaggccgccccgcccggcccaacccaccagtcgctcctgccgcggcccggatccagtttcccccggccaggtcgcttcccggtctcaaccatttcgcgctctgctctgtccgctggtttgtccctgcccggttcctctccccgggcctgtcagcctccgcttctctggaggttcctgggactcatctctgatccaccgtcttgcgttctctgggcgcatcgacttctctccatcttcgggctcactcctgactccctcgctgccgcccccgggggtttccacgcgtgtctctaaccgcggccgtctttcctctctctgcgtctcctcgactcctccgcgaccctccgatgtctcgggctttcgggtctcagccgcggactccgcgtctctgggtctcttttccgcctttctctctgcccctctgccgatctctccgtctgtctctcgctgtcccgcatctctgtgtctctcaccgaccctaagacacttaggaatcattgtctgtctctgcgtctctggccgcctctgtctctctccatctctaggtgtcagggaacctgtgactgaagtctccgagtttttgccgcgtgtgtcccccacggtctcggagtctctcccgtctctgtgtgtggtctctggcagtctgagtctcttgccctttcgagatctctcattgtctctctccccaaccctccccgtgagcctgcgacgtccaccgtctcaaggggcgccggcctccgcaggtctctctaaccttgggtcggtgtcgcgcgctcccctctctcgcccgcccgggtcccctccccgggtcccgggtcccccgcctacttcgccttctctcaccgcgccctgtctccttcccgctccccctccgcagactaccaaggcgactactacgcgccgggaagcaactacgacttcttcgcgcacggcccgccttcgcaggcgcagtccccggccgactccagcttcctggcggcctctggccccggctcgacgccgctgggagcgctggaaccgccgctcgccggcccgcacgccgcggacaaccccaggttcaccgacatgatctcgcacccggacacaccgagccccgagccaggcctgccgggcacgctgcaccccatgcccggcgaggtattcagcggcgggcccagcccgcccttcccaatgagcggcaccagcggctacagcggacccctgtcgcatcccaaccccgagctcaacgaagccgccgtgtggtaaggccgccgggccgccccccgcgctcggcccccgggggccccgccccgaagcagcctcctgaaaccaaaacgcccgacgcagacgcggtgggagacgtgggtgtccctcgggggttctctctcgggtccgcactcaactggcagctgctcctcggctgggcgccgagggggggccgacccccatctccaccccgcgggctctccaggagcctcagcccaccgccagtactctcccagcaaccgcga

SEQ ID NO: 5846 - DNA, 589 bp, Homo sapiens
cgccgcggaggctccagcggtaggtgcgccctagtaggcagcagtagccgctattctgggtaagcagtaaaccccgcataaaccccggagccaccatgcctgctcccccgcctcaccgccggcttccctgctaggagcagcagaggatgtggtgaatgcaccggcttcaccgaacgaggtaaccgtcccggcagatggcccgggaggctcaggagggagctcgtcggccgagtcggctggggcggcgggaatggcggattccagcccggctttgcattctgcagagcacagcttgcagagattttgcgcggctcggagctccccggcaaatggagtctgggaggccgccgcggctggcggagcggcattgaggtttgcagaagcacggcctggttctgtcaaaccgcatcttgttcgcctccgccagcccagagctccccgggaccctggcgagggcgcggggtaggattctccccgcggccggcagtgaatgggagcgcgtgtaggggcgccagccctgctttcttttgttgtgagtaggcagcggggctccagtcgccgcctccctgaagccccgagaacgaggcga

SEQ ID NO: 5847 - DNA, 1294 bp, Homo sapiens; identical to SEQ ID NO: 5837

SEQ ID NO: 5848 - DNA, 1373 bp, Homo sapiens
cgaccctcgctgagctcacggctcagtccctacatatttatgccgcgtttccagccgctgggtgaggagctacttagcgccgcggctcctccgaggggcggccgggcagcgagcagcggccgagcggacggggtgagccaggggcgcgcgcggggcgcccagcactgcgccggggaagcccgcagcctccgtcccgaacttgggttcgctgaggctgagggaggggacgcaaggggagggaagaagagaagggaggagtgggggctaggggagagggggtggggagggatcttggaggcacaaagcggaggggaaggggagggacgcgcgcggctcctaccaggaggcgagtgggtgcaaccggcgccctccagccgcgcggggcggcggactcggaggattcagaacccggagcgcggcggccgcgggcgcccgggaggaagaggaggagtacgaggcgggcgggcgggtgcgcagcgcgaagaggcagcctcggcgctgcccggctcggcgtcaggtgagttcctgatccaggcgtcccgcgccccttctccgtccccagggctccccgctcccgcccgagcccctggtgtgcgcggaaggctcgggctttgctgcgcgtcccaacttggttcgggcggcctcattttcctcctagcgggcggcctcaggccgggggctccggtccgggggtctacgcgcccaggctccaactttgcaagaccctagtcgttcctcagccgcgcgcttggctccgagctgtgcgctggcggtaatggcggagcccttggcacagctcgctaccctcccgcgggcagcccgggctgggggatgccagtccctggggaccgttgtacctgcccaagctcaactttacgccttcctcggtgcccgactctgcggccgaatcgcaactgcgagccgcaggtaatggcggagtctttggcactgccagctgtccgcggctgggggcccgaggctgggagggctccgctcccggaacatcgctccggcctggcctccaactttgcgaggagcctccttgcgctctcctcccgcggtcatggcggggccgcccgcacctctcacttcttccgtctgggcgagattggggtgtaagagcgccgtctccaaaacctgggaaagttgtgcttctcccgcaaaggaggctctagggaggccgaggggcgcgttccgccacggttcggggctgggcagtggaaggagcgctcgatgaggttgcttccaggtggccagggttcggagcagggtccccgggggatccaacttccagggccactcaggggccttgcgtccgaggtcccggaaggggctctctcgggactgcgccccagaggacgccagacgctcgc

SEQ ID NO: 5849 - DNA, 1524 bp, Homo sapiens
cggggaaaggcgtggaggggggctgagcgggctcggggttcgcccggaatctggggggctgaggggccgggcgctgggcggtggagggaggaggcagggggatgcggggagtggtgggggagtctccttaggaagtgagtgtgcgcgcgcgcttgtggggagatgaggcagctgctggtgcgttttggggtctccgatccgagctttgtggcgggccgtctgcctctcccccttccaagccccgattctcctccccccacctcctcttcttgcactggcgggcgggcggcgggggcggctggggtctcagcccttccatttcagctttccagcttccccggtagctcgggggcggctccagctttagaaatgccgccggcccccggttccggcttcccggctctgccgccgcggccgctggggctgctgttaccgccgagccgggcgccgcagcggctcctcctggggcctacatttgccccgccagcccgtgtccggagcccccttcgcgggttacataaccaggctcccggccgagtgggcgaagcccagcacatttcgggggcggggggcaggggagggtccccagatgtcccttcagtgcttccgaagacaccggaggggagtaccccgcgtagagcgcagctggaccctcggggtgcgggcccctctccttgtcctgcttttcagcatctttggcaattgcgcaaagttgcttgggttgcaatggtggggtgcagggggcgctcggctgctgcacctgttagtgctgggcccaggttgagaggcgacctccagcccccacaataatgtcccgggctctctggtttgggtcctcgcagcgcccgattgaccgccagcgatacgacgagaacgaggacttgtcggacgtggaggagatcgtcagcgtccgcggcttcagcctggaggagaagcttcgcagccagctgtaccagggggacttcgtgcacgccatggagggcaaaggtgaggcgcccccaccccgggccgccctctgcgctgcgggccgagcgcacgtggggagggagctgccggtggctgggttcgtatttcgcgcccgcgtcccccattccaggggatccggtgacgaaacgaggccgagcactgggggggtggggtggggtggtgagggaggagggcaggcagtaaggggggccgggcatgggcctaggcccggcccgcgcccaccaccagccccagggtgggcagagccagggggccggcggacagagggacctggagatggacaggcggaccgagggagggcgggagcgccgcgtcctccccctccccgagccggtcgcgctccctgcgctgcctgaggtgccgccgcctggctggaactgggttcagggcgcccctggggcatcggggtaaggccccccaggcccgaagccttcccaatcccgttcccgcttggggcctgccagtgaggaactggtgatgggggcgcgtcgggtgtttgggacgatgcccccttaggcctggggtccgcagagccgc

SEQ ID NO: 5850 - DNA, 1009 bp, Homo sapiens
cgaagtggcgggccgtggctattctctttacctgctgtacttcttggagtcccggggcgcaaacagccgctgcatttcccttcattcccgacgggatgacaccacagtcttctccccagacagcgcgggcctctgctccgtccttcctcagcgaccgcagcgacgactctgctccagggcgggggagcagcttcccaagccgcgggcgcccacttccccgcccggactccgggcggtgctggccggggcgcgcggggaggcggggaccagggaccccccaggaactagcctgggctgctgcaccgctgccagggccgtcctgcgcctagccgagcccagggcgccgccggctggacgcccgtcaactcccactgcgcccggcccccgagcgcgcccggctggatccggcgcgcccctccgccccaggcgccgccaagtcccagcactatgcgcccctccagatgtccgaaagcgcctctccagggcagcctatgtccctctgtgtccttcccgcgacgggccgggcccaccactccacacctcccgggtccttccatgtccatcaccgtgtgcctctccagcatcccccctcccctccaagttccaacatagcactccttcacatattccccgcgtcgcttcagaggttcctccagccactgccccgcccctccacttttccagtttctccagttctatcgaggcgcgcccctccagcacgtccccacccctccactccctccccgcgtccctgcactccctccccgcacccctgcactcccactccgagcccctctgtgaccaaacaccgcgcctttccaagcgctcctccttcgcgccgccccaagattcccctccataccctgcactccttccgcacccacccacgcacccctgcgcgcctccacccggcggcctctccaccctcagactcgcccccgcgatccagcgcgcggggcactgggcagggacatttctcgctcccacgcgagtccttcgctgcagacgc

SEQ ID NO: 5851 - DNA, 961 bp, Homo sapiens
cgtcgccgctgtgagcgcgcgaggacccggggctccaagtggtgagaatcactcgagggacccttcggatgcctttttccccctctgcttttgagctctgcagcacagcggtgccggccgccggcagggaaggctgcatcttctctgcgccgccaaaccgtgcccaccatcgcggtgactgccgcctaggtcgcatccctgagccgcatccgcgcgtaggggcgcacgggcacgcgcacagggaggccgcacacacacacacacatctgtacagggacgagccgggggtctctgacgcccgccgctcacctcgccccggcctggagccttttggccccgcaggtgcagcgacgcccagcccccgtgcggccagcgcgccgcgtcggcggatcctgcagcccagagagcccagggagcccagggaggggagcggggcgcgggcggggcagtgtcgcataaccgcaggcgcgccccgcgccgcccccgccccgggcccaccctccctcgccgcgcccctcccagctcacccacggacgagcggatcctcgacctccgcggcagggacatcttaagagctttgtccaggcctgcgccgttcagcatctcgcccgtgtcgggggctcggcggccccgggcgagagacggaggctacgcgcagggctgggcgcaggggccgccgcccgaggaccatgggtgggccagcgcctcgccgggctgctagctggcggggaccgccggcgcctgtgccgggccgcgcccgaggctgcgccgtccgtgccgcagcggccaatgcggcagcatccgcgaacgccaccgcggcgggccccgctggcccgggctgcggcgtgggggcgggggaccggccctgagcggagccccgcgggaggaggagcggacgggaggctgggagggatccgcaatattacgcaggaccggggcttttaggtgtcggggaaggcga

SEQ ID NO: 5852 - DNA, 961 bp, Homo sapiens; identical to SEQ ID NO: 5851

SEQ ID NO: 5853 - DNA, 980 bp, Homo sapiens
cgctcccctgccccgcccggtgcaagcccggggccgccggctggggtggggcgcgcagcgcggcaggcaggcagggctaccatgcagttctcagcctcctggctccttcgcccctcgccccgcgcccctgggccgccctcgcctgcccgcaccctagagcagccctgacccgtgggggcgcgcggcctcgcggggatcccgcgggcgggcgggcggccgggcgcgcgcggggcgggggcggcgcgcgcgcggggagcgtgtgggccgggcgggcgcggcggggaaagctgggcgcgcgagccgaggctgctgctcacctgcagccgcgccgctcacctgccgcggagtgcgcgccccgcgccctcccggcccgctccggagcccggccgccccccccttgccacagcgggcaactgcgccgacatgcgacacgagtagcccacgcgcttcggaagcaccggaggagccccctcggcctgggcgagccaaggtgaccccctcgatgacccccccgcccccgcgggccgcctgtccccgcaccctgtctgtccccctcgcgtccgactcccgtccccgccgccagggaatcggcagcagtgcatgggcatctgtctgtctgtctgtctcggtacttccattgcacacacctccctctcgtggccctcccgactgccccgtgcgcacggggggagtctggagcccctctttgttccggtcgggggtgcgtttgaggatgtgcacgcgcgcgggggatgcgtttggagggtgggagttcgatggaaataggcgatttaaatattccatcgaggatggcggcccctggctcgagacctgccgctgccgcgtggttttctcggcagcagcccagatgtcaaacagttgttcgttttcagcatgcaagatgtgattttccaatgtgcattcccagcgctgttgcaaacagaccgccgcgagtccgtgtgtgcctgcctcgctcacgc

SEQ ID NO: 5854 - DNA, 408 bp, Homo sapiens
cgcggcgcctcttccgaaacacctgagcataagcagccgcaagggcgagcgcaggacgcggggcgtggacgccgggctgggaagagccccgaccaaacccgcgggtggctctgactctccccttcgggaggagctctgcgcagaggccgtggctcgcgcgggcaagtcacctgtggcagcctggcagggcagttctctccggcaaatagcgacatgctctcggtttctgtcggccttggcctggcagagccgctttccgctttctggcctctggtgcgcccgaggcgggagaggagccccggccgcgtggaccctagcttgcgcggcaatcatcgcgccttgactctaggcccggctgctcagggaaggacagcccagggcgcgcccagcgagcttcagggggtacgg

SEQ ID NO: 5855 - DNA, 2190 bp, Homo sapiens
cgggtgcatcaatgcggccgaaaaagacacggacacgctcccctgggacctgagctggttcgcagtcttcccaaaggtgccaagcaagcgtcagttcccctcaggcgctccaggttcagtgccttgtgccgagggtctccggtgccttcctagacttctcgggacagtctgaaggggtcaggagcggcgggacagcgcgggaagagcaggcaaggggagacagccggactgcgcctcagtcctccgtgccaagaacaccgtcgcggaggcgcggccagcttcccttggatcggactttccgcccctagggccaggcggcggagcttcagccttgtcccttccccagtttcgggcggcccccagagctgagtaagccgggtggagggagtctgcaaggatttcctgagcgcgatgggcaggaggaggggcaagggcaagagggcgcggagcaaagaccctgaacctgccggggccgcgctcccgggcccgcgtcgccagcacctccccacgcgcgctcggccccgggccacccgccctcgtcggcccccgcccctctccgtagccgcagggaagcgagcctgggaggaagaagagggtaggtggggaggcggatgaggggtgggggaccccttgacgtcaccagaaggaggtgccggggtaggaagtgggctggggaaaggttataaatcgcccccgccctcggctgctcttcatcgaggtccgcgggaggctcggagcgcgccaggcggacactcctctcggctcctccccggcagcggcggcggctcggagcgggctccggggctcgggtgcagcggccagcgggcgcctggcggcgaggattacccggggaagtggttgtctcctggctggagccgcgagacgggcgctcagggcgcggggccggcggcggcgaacgagaggacggactctggcggccgggtcgttggccgcggggagcgcgggcaccgggcgagcaggccgcgtcgcgctcaccatggtcagctactgggacaccggggtcctgctgtgcgcgctgctcagctgtctgcttctcacaggtgaggcgcggctgggggccggggcctgaggcgggctgcgatggggcggccggagggcagagcctccgaggccagggcggggtgcacgcggggagacgaggctgtagcccggagaagctggctacggcgagaacctgggacactagttgcagcgggcacgcttggggccgctgcgccctttctccgagggagcgcctcgaggagtggctggcctggacccgcgagcatcagcgctcagaccgggtccgcgctggggctgtccgtttgcgacaggatcgctgatcccttatccagctgtcgggttggggtctcactgccgaggccctgggcactaggagcagcacgcaccgggacctgcctggcacccagagcccattcccagaggacctggggcaggtacgcagggtcccccggagccgggagcagaggctcctgaaagcctgccaggctgcccggggctgggctgaggccgggactttggtgatattgggcactggccgcgacctcgcgtcacgagagtgtaggaggggagccgatttggaggggactcgtgcctgcgggggagcaggaggatctcaggagagggccagcgccggcatcccatgacccgcttgagtccccaagccggactgtcccggggaacgctcggcgagcgcccgctcctccccgccgctctcggaccgcggggccccagtgcgctgcgctcagccacccgggtggggcctctgccgggagcaggcgtggtgcgcggtccagtccgtgtcgcggacatcagtgaccctgacccacaagggcagcccagggcccaaataccgttaacttactgacttacaagcctagcctttaaaatccgagcgaagagagggcgggcgattttgaccaaacgatgtggtttgaggaatcgatgaggtccgcccgccacctaagtcagccttcgctgggcgtttgggagacgggcggtggaacagtcaggggccgggggttttaccagcagttagaccgccgccattgaggggtcaaagccccgaggaacttgagggttcggactcgcagtctctgctcagtggggctgagtggcggagatttgtgcctcgttcccctgggcgcagagagccagatttcggagcgc

SEQ ID NO: 5856 - DNA, 2190 bp, Homo sapiens; identical to SEQ ID NO: 5855

SEQ ID NO: 5857 - DNA, 679 bp, Homo sapiens
cgccggcccaggctccgtgcggcaattcttcggttctgttgtttacttcgccccaccgccccccacctcctagtttttgttcagcccggggaagccgcgccgcagcgcctcagatgttatttatcttttcctgcgaggggcttgtgacagtccagggtgttgtgtatcctgtgcgattgtttatcgcccggcccatgcggtggcctgagcagcctcgcgccggcacttcacgtaccgaaccccgggactacgtgagccggcggagggcggggaggtggcgctcgggcgccggcgtgaacccgcgtcccccggagcccagcgccgtgtcctcaggccccggccctgacctcagggcgctcaggtggaatggccccgcagctgcgcgctgctcccgcgcccccgccttgccccgcggaaatcgcccccgacagtcaacccgaccgggcgcgcggcgcccccggccggtccccgcccgaccccgcgcagggcacagatcggggcgcacgcgttactcgtatccggtcacccgcgggtcaggccggccgagcggctgggctcagggggtactcctacgtgcgcagccgccacccggcctggccgcccagacgcccccgggggttcgcgccggccagcccagcccgagcctggcgccgcgctgcggccgctgctctccactcgg

SEQ ID NO: 5858 - DNA, 2013 bp, Homo sapiens
cgccacgcagtccagggcgctcagcctacaccgccgcacacccattgtcggcccagaggcttggccgctgagcgccccctggatggcgtggtctgaccgtccttctccttgactcacctccagccccgagggccgggctccacggcggcggagagggcgtcgcccgcacggccccggctgtgccaccgccccggactgttcccgcgcagcgaggtcccttccccggggcccccgggtggggccggtcgagccgggtgcgctatccctttaagcccgggcgagatgagagctgtcagcggcagccgaggctagcgcgggacgtcgccaccctagcgccaggccggagctagcagccgcggagccgcggagagcggagggggcggcggggccgggcgtggcgggtcccctcgccgcccactgcgcgctcgaaccctgggccccgcgagcggcgggcggcacccgctgtaatgcggagaatgtgagaggcagcgcagggcggtggggaggaaggggcgcgggagagggcggcggcgagacagacggagagcagcggggagaacgaggaccgggctgggcaggtgggacaaggcagggaggcgccggagaggccggactggaagggggggagaagggcggcggcgccgcggagggggccggcgcttcccgcgggagtgcgagaagcccgagtcggcacctgggcccaggttcgggctgggagcgcggccgcggcccggccaggcagggtgcgggagccgggccgcccgcggggtccctacggggagcagcggggcacctaaggccggcgggtcccggaggggcccagggccgcgctccgcaggctccggccgtcccggcagggggtctttgtgagcgctccaggagggcgagtcgggagtgcggagccgggtgtgcgcgcctgggtgtgcgcgtgtgtgcgcgagtgtgggcgccgggcagtgggggcgcgcggtagagattctgccggcatcgcatcgtggcgagcaggaggcaggagcgggacgcgcaggggagccgggaccctcccgcgcacacgcacatgcacacgctgcgcgctctcacgcgcatacacacgccctccctgccgcgctcgccgccgcggccaccatcgcggagccgagccctgcggagcgggaaccgaggccggagcggggaccggaggcagccgagccgggggatgccggcccggagcggagccgcgcgcggacggcgcgcccgggacggtgagtgtggccgggccgggacgctgcagcggggccagggccgcaggggcgcaggccggggagccggtgtgtctgcccgccggcggcgcggcgcgcgcggcctctgattgggcgggagcctcgggggcagcggcgggggtggggtgctgggtgcgcgtccgtggggggcgtgcacgcttggggctgggagggggcgtgctcggcagcccaggccgcggccccgcctcacccttacctgcagctgcagccccgacgacttgcagcaagtttgtggagcccctggggcgcggcgggccgggaggggtggggacggaggcgctttgagggtgcaactccggccttcctttccagagaagagaacgcgaggggagtggggcgggggcgcgggccgggccgtctggcgggcggaggggtgcgcctccagctcctcagtcgcgcagccgcccgctctctgggacacccacctaggcccgcggcgccgcgctggagccgctccgggcgccagactactatgaccccgctagggtcaggcaggaccgcgcggggacagctcccaggcccagggcctgggatgtctttgcaggcaggaggaagacaccaaggttcagttgggggagtgcggcgacgtgcccgggcgtgtatgtgtgtgtccccgcgccttctgctcctcaggacggtggctggaagaagggaacttgccgcaaggcgcgccccacccgacctggaccctcaggagctcccaagaggccgggggcgtctccaggtctgccgg

SEQ ID NO: 5859 - DNA, 1501 bp, Homo sapiens
cgtggccctccgcctggcccctcgcactcaccaggaggaggttgtgcgccaccaggtacccgagccgcgggctgccccggatgccgggggccaggcgcccggtggcgtagccgtgccaggccaccacgtaggggttgtcgatggtgatccagtacttgacctgaccgccgaagtggcggaagcagagctccgcgtaatccctgaagtggtcggccagggcgcggttggcccagccgccgtaggcgtcctgcaggcgctggggcaggtcccagtggtacagggtgaccacgggctgcacgcccagctcccgcagccgctccagcaggcgccggtagtagcgcagcccctcgcggttggggacgcccgcgctgccattggggagcactcgcgcccacgagatggagaagcggtagtgagtgaccccgagctcgcgcagcgcctccgtgtcgcggaagacgttgttgtagctgtcgctggctacgtccccggtggcgggctgcagcggcgacggggcgcccaacggcagactggcgttccgggagtctcccgggggtgccagggggtggtgggtgaacgtatcccagatggacgcacccttgccgtgctgctgccagccgccctcggtctggtaggcggcgctgcccacggcccagaggaagccgtcggggaaggtgccctggaagaggcccgcggcctcgggggcaggaggccgcgagaaacgggcccaggtctgcgcgccgtcgcccggctccgcacgcaggcggcggccgcccaggcccagcagcaccagcagcagcgacagcgacggcggcggcggccgcgggcggcgcggcggggcgctggcgggcatgctgcgcgggagccaggctccggggccccgcgccgcgcccctttatgcccgcgccccgccgcgcccgcccgcccaccgccggcgcgcccacccccgctccccggcgggctccgctggcaataattacctgcgagccgggactgcctccgccctggcactgggggcgggggcaggggcgccgagggcgaggggtgcccgggaggggcgcggcagcgggcaaggtgcggcaggcgtcgcccgcggacgtcggagaaaggcacctgtttctcccagctcccgggagccgtgcaggacgtttcgtggacgctcaggttcattctctttgcctgccgcgcgtcctctgagagcagccctggagcggcttcgtcggggagaaaaggcgccgaccaactttccccgacttgggggcgggatcctgccgggccctagcggagcgcgccgctggggaagcacctgctctcacttttctcccactcggaggcccaaagaagctccggctggacattgctggagccaattagggactggccgaaatcctagagggactgccaggtgggacagccgagggggaacttcgccgtgcgctgaaagggattcccccttaggtgagatgctcgcggggagacgcgcccacccgcgcccctctttcga

SEQ ID NO: 5860 - DNA, 668 bp, Homo sapiens
cgaggttgctgcggtgggaagagggcgctgggagggaggaggacctggggcgcagccgtggtgggtgcgccctgccaagaagggcgggggcgacggggcgcgcacgcggaggaggaggaggaggagggagacgggagggcgtgtgagcgagtgagacaagaaaagggagcgcgcccgccgccgccgccgccgccgccctcctctggagagagaggctggagtgaggctgtgcgaagcgccgcatttcaatgaggacgggccgaggcacatccctgcactagtggccgcaaccgaggcgccgcgctccagcagctgctgccgcccagcccggccccgccgccgccccccagccctgcagccccgcagccccggccgcgcccagcccggcgaggacagcaccaggaggcggcccccagcgcggccacaaagacccccggcggcgtctctccgcggaccggtgcgtggtttgccttccctggggacgggagctgcggggagggcggccgggggactccgcagagcccgctccgcccgcagccgcggggcgccgagggcagggcgggcgctcagcttggccccgccgccccgcccgcagttcctcgaaaggcggccgccctgccctggccagcctggcccgacccgggggcgttgcgtgcgggcggccccgg

SEQ ID NO: 5861 - DNA, 1006 bp, Homo sapiens
cgccacagccgcagagcccccatcccgagcccgcgcctctctggtcgcgccgtgtcattctgcccacccattgggcgacctgggcacgagcaccgcgacctcccgctccgcgcagccctccagcaccgtggccccagcacacctgcagagcagccaggcgcaggaaccgaaacccgccgggtggtgggcgggaagggaaaggtagatgcccaagtgaaggcgctcatcttttttcctacgtgaacagaagttgattcttaacttcaagtgagaaatgacagggagaaaaagtatgcaatcactaccagaaaaggtgagaggccagtgttgtttcccagcgaagggacggggtgagattcaaacccatcgtccggccaggggagtccgcccccagagcaccgagaagctggggtgcgtgggcggagagagagcagggtgcgcccgacagccctgcgccaggttgtccccaaactcaacacttcctctctcccttctggagtcactttcccttccggaatatgcaagctctgggtggcccagccctgccgccagactcagtttccaagtgcgggggaaggagatgggcgctctcagccgcgatcccctgggaaggtggccactcacctgcgctctgaaatagaagaacagggcgacgctgcagacaacctggcccagccccagccccaggagggccacgaacatggagcgggaggcggcagggggctggtgcggcgcaggcggcggcggggcgtgcagggggccctcgtgcggggctccggggccgccgcccatctcctccgagccacgcaggtacttggtgtagtctctgctggcgcggcgcatggcgctcggccctctcgcttcggagctctcctccctctcccgctccctccccttcttgtctgcggccaactccggaggctgcggcggagcctcgacgtggggcgccgacttggagcccggctttgggtcctggggcgcgcgggcgagcgggcagggcgcccgg

SEQ ID NO: 5862 - DNA, 867 bp, Homo sapiens
cggaagcaaagttcgcagtgaggtgggctggaagcgggttttgcagcagccgcgagtccgggctcaggtttccaggcgcggctggagcagaagtgcagggaccgccacgatccaccgccgcggccggtcccgctccgctagaggagacttcgcacgcgcagccgactggcccgggctgaccgaggggacccagacgctgccactttctctttccaaggcagtttccgtggctctgcatgtaggaagtgctccgattaattttctttccggtctccgcagagattccaaattctgcggtccccacctttcgctgtactccctctccgcccttctttccaatgtccctgccagcaaaagcctctatttgcagcaccgggcatgttgtccgtttaacgcgctccggggatctgctggctcgtgctcccaacccaggggtggctatacgtctcgcgcctctgttcctgggtagactcccccatctgtgcattttggccccttcacttagcaaagagatgtgcgaagtgtgcgcctggagacgagccgcctcggtgacccccatccgcccgcagcggtggccctggttccccggatccgcgcccgcgccctgcgggtctcccgcgccgcccttgcccgccggaccacccgggctcagagggtcgctcgctttcagcgcctgcgagcgccgcttccgcccgggcctggggagcgccagcgcgtccctcccacgccggaccctgcagagcatgctcagtgcacctcatggaacccggctctcctggggccaggatcagatttccgggttttcgctgctgccgagggggcgcggaggaggggaggctgggagacagtcagcgccttgttccgcgc

SEQ ID NO: 5863 - DNA, 1072 bp, Homo sapiens
cgcggagaagactgcctggccccgccggccccgccaacgtgacggtcagccccgccgagcgctcgcacccgctcacactcatgatcactcgcacactcgctccaatacgtgttaaggcgcgatcgcggggtccctggcagccttcgctgcaccctcccccccacaggggtactcacagttgccatctgcatagggggcaactttctccgacccagctgtggccgccgccccctccagcctcctctggctcctcgcaccctccggcctgggttcgcgccggccggccctcccctcccccctcggctctcctcctcgccgtcttcaccacattcccccctggtcagtggcgcacgccgggggacgagccagagggagcgggtcgcgggggtgtgcatgcatctcccgccttcttcttgcagcgcacactgtacatggtagtgagggggcgagcaaaggtggcaccggcccctcggctgctccagcgaaggcggcggctgcagctcctgcgctgtcctccgccccccagcgcagcggcgaccaccgcgctgggatcccgccgacgctgtctccgcgccgagcccgccgccgccgcggcccctaattagtatttgagaggctcttgcatccctttggcagtttcatcctcacggtgtttgcagggtttttttctgtatcccttccccagatgcggcgcacaatcgtcattagttggaactctctatcaccgacatcctttggggtttctgggggaaggggggggcgggcagcaaccgcgtcgttctatgcctgtggcttgtcctggcagcccggtggctctaaaaaaaactccgagaaagttgcgtcttcctcccgggcgccgaggaggtggcaacgcggtaagcaacaccgggtctctgagacagctgctccggagcgggtgcagggcccagtccagtgcacttgtttattgtcgcgcctctggtgcgagccaagctgcagcagacatgatgggcccggggcgaagcgggcgctcggtggccgatagatggcagccgagggcgaaggcgtccctgggctagggcggcgcaaccgg

SEQ ID NO: 5864 - DNA, 1633 bp, Homo sapiens
cgacacgtttcattcacagagccccagagaagctcggattcggttggagctaagagccggaaaacaagcacccagactgccgcgcaagttgtcggagaccaagtgctacacacactggcgccgagagaaagggtgggcgctctcaagctcttggtggagcaatgccagtggccgggcatgcgggggacacggggcccccgaacccggacccgaatccccagctgagccacccgctaaagttggctgttcgctggcagacgaggccggctccagaccgggtggcagggtgtccccgggccctgagtggccaacagcaactggggaagcactgaggaaccctaacgggaaagcccgccccacatctgaaacaggcagcccgtgaagtccccaaaccagccttgaaacgccggcgtccagaggccaggtccccggcgagggtccctcccagccttgcccgcccccggcccgagcgccgggcgctctgtcgcccgaaggacggataggggagagaggggctgggggagccctccgcgtctctccaccgcccctgccggcgcaagggcgggagtggagaaggcgccactcagactgtggcgctgggcaaactgcggtcgcagttcttccaagtttgcccgaaccagaacgcggagtgagcgcccggctcggctctccgtctgcgccttgcagccgccccggagtgacccgggctccctggccagccgggcctgagccatcaactaaggggtagaagggcgcgagagcagcgggaggcgggagccagggtgctcccgcgtgtgcacacaatgaggcggcggagacgcacaccttcccccgccgaagaagccgcaggagcatccgccgcccaacacggagacgcggagtcccatagcggtggcagaaagtgagcaccaactcagcaacagggggaaggaaggggacgccgggcggccagtgggacgtgcggcagccgagggctgcagcctgcccctgcagcgcgcccgcgcttacctgcgatctcctggtaggggatgtccgccaggctgaatcccttggcaccgtacgcctggcggacctctccgcagctccgagccttcacatccgccccggcggggagggagagcagcagccccaagaggggaagaatcacagccccgatccaagaaggcatggtgcaacatacaaatccagctcggtaaaccccacggccggtgcgctcttcaccttgcccctcaagccgaaagcccgccagaggcagcggcgcgctcctcgccgctgcccagcgtcacccccttctgccagccgaggggacgagcagcgcagccctctggactgcgctcagcaaacttttataagccagatggacgatggcaagccaacaagggctggctgggaaggctgctgccttgctcctctagcccccagatggaaacggtgcaatcaaaacgaggaagagaaggaaaagaagtgtttaaaaaaccaccatgggggttcagagctgcaatccgagttccgagccgcagaatcctggagcgctgcgggctcggctcgccggagtgtgcggcaaaggtgggagcgcgcgccggctcccccgggagggagatggacaagcgagagcgagtgtgtatgcgcgcgt

SEQ ID NO: 5865 - DNA, 1143 bp, Homo sapiens
cggtaccgtgcacagtctgacctcacgctcgcacgctgggctcccggcctcctggcagtgcacttaagtgtaccccgcgtgtgcccggcggactcccgtgcacaccgccgccgtgctgttgagtacgaaagacccccgagaggagctcgcagatgagagcctagctgttgctgtgagactgactgcgggtggcagccggcaagaaggaactgccagtaccgaccctggcgctccccaccaactgcggcgcagcctcctctgcggtgcccgcccttcggcatcactgcagtccctgtagcaaagctaactttaaaaatttaaataaaataataattttttaaaggcccgaaaactccggctcccacccctcccccagcctgcccggcggcggcggcgctcagtgagtgacacggcgagcgtgagccgcggccccagccgggccgagcgcgctgcctgagctgagccgccgtaggtgaggggcccgcgtccccgcccgccctgggcgccgcgcctggcactgatcctgccggtcgcccactgtcgccgccgccgccgcccgcgggcaccatgacagctctgagcgctggggttacaggttggtcaccgccgccggtgcccgggaggctgcggcgcggccggctccgtgccctgcgcccgaggcccgcgatgcgcgctcgttagttccttggccggtccgggccaggacggctcaggggcgctggggctgcgagaggggctgctagaggggctgcgggcgggggccccgcgcgggggaggggtggggaggggcgcctccacccgagagcggggcggtggggtccttgccggcctggccggggcgcgggagccgcgatgcgccctccctattcctgcgcgtgggtgtcgggggcgcctgccgcgggatgcccctgggctggcttgggaagcccagggccggcgacacctcgggcctgccccgcctgggcatctagcaggtgttggggggcaggtggctgaggacgaggccactgggcatcactacagcgctgcacctgccccctcggcaccagggccgctgcctgggtaaacctctgggccaacgcgcgggtggggaggtgggggtgggcagcctggctccagcaggtctccgcgggggctccgcgg

SEQ ID NO: 5866 - DNA, 1143 bp, Homo sapiens; identical to SEQ ID NO: 5865

SEQ ID NO: 5867 - DNA, 1371 bp, Homo sapiens
cgtctctcctacggcgcccgcctagcccggtggtcccaaccccctgcgggagctgcacacgccccggaaacctgggacagaaactgagtccctctccttcctggtggtggtgacagcacctgctcagatctggtcggacgccgccggccggagcacccagcccggcggagaaggagctcgcccggcgctggggactgggacctggagccccttcccctaccgcacgtacgccccgccccgcgcacgcccgcccgcccgcccgcgcctggcgcagcttcactccggatggttcctgtcctcccgcgggtccgagggcgctggaaacccagcggcggcgaagcggagaggagccccgcgcgtctccgcccgcacggctccaggtctggggtctgcgctggagccgcgcggggagaggccgtctctgcgaccgccgcgcccgctcccgaccgtccgggtccgcggccagcccggccaccagccatgggctctggcccgctctcgctgcccctggcgctgtcgccgccgcggctgctgctgctgctgctgctgtctctgctgccaggtacgcgcacaggcgttagggctccggagggacgggcgcccgagaaggggcgcggggtccggaggggctgccggcgagaacaccgcgcgggcgagcggagagggctggcgccgtcgccggggactcggaacccgcgcagactggctccagcccggcggcgacttgggtggggtggctttttccctttcggctcacctcccacccctagccaccaccaaacctgggagtcactgagcgggcgctggtacgcgccgggtgatggggaggtcgagaccgggtccttcgtcttgggcgcaggagttggggattcgcgtccccgcgctgcccgtcgccctgccccgcgcactggctcccaaactggcgcgcccaagcctcccgctccaccgtctgcatcccgcccacctcctcatttgacggagatggctgaagacttggccaaggccacctcgggaagaggggagtcgcttcgggactggggctggagctggagcgccagcctctcctccggttgtagcctcctagcgctcctggctgcgtcgctgagggaccctccaccgggagagcgcctcctgtcttcctcccgctctccagaggagcctgctgggggaagccggccctggcccgccgctgggaggctcttgggtgcctgggagggctggtgggtagcgagagtcggggaccgggcaaggctgcagggaattcctggagggcccaggccggcggtctgtcgtgcggctgtgagctcagagcgctttccgccctcggtgccgaggcctgcactactcagaacgccatacgctctcaaccga

SEQ ID NO: 5868 - DNA, 1545 bp, Homo sapiens
cgcgctgtgagagttaggctactcaaatgttacgctccccgcaccgccggcgaggggacaaatgactactctgatggattcggtagcccaaggaaattatcgctttcggagggatggcggcagagcaggtcgggcatgctgcatttgcctgagttggaccgcgtgtgagcgagcttacgctccccgcgggccaggcccagctcccgtgctttctgacaggtgaagttgagcatccttatcaaaccctcgggaagaacaacgatcccattccacatcaacgtgactggaaatctcaatttaagaattggatgcaccggtcggtccacctggggcttgtccagctttccatcttacttcgcgcctctgatgtgtcaggctttttgcacagatagctcacatatttaaccctcaaaacaccgtttcctgaagcgatgctcaaccaggaaaacttgccccaaactgcatgatcatcttccgtggcttctcttcccgaatccctgctctgtccaccaggtgcggccccgccccgcatccgcacacaccttttccgccgctgccctgagcgcagcgacaagggcccccacacctccgcggcccgcaatgctccggggccaagccgaggcagggaggcgctcccgcagctcctgactttacaacccgcgcgcgtgtgcaccgagccgcgggcacaccgcgaacacacacacacacacacacactcgtgcgctcccgccctccgcccggcccgggctctccgaacttacctccgaggcgccccgggcgcagggcccgcccttctctgcgggtctccagcggctgttcggcagtggtccgcacggcctccgatgccgcgcctccggtaggctccagagtcagctggtcactgtcacccggcagcccggattccgcgcccagggttgcaccccgcggatggagcgactttcgcctccgccgcccgagtccaggtctgcgctcacacgcgcggcgctcacacgcgcggcgcccacctggctgcagtcccggccagggccagcgcgccgcggctgaagggggcgctcggactcctctggggcggcgcgcagccgggacagtctcgcatgacgcccgcgctccagcggccccgggacgcggcctcaccctcaacccctggcggtctcagcctcggtctttgtgtctcggtcggcgtcgccacgtcatgggcttgcaggctgggagcagcgcgggccgggaacgcggctggggagagctgggctgggcttctccaccgccgcccgcccggggcgctcaagctggcggggcgcacgggcagcaactgagcgcaccctgggggaccgagggggcggtcccggggaggggcgcggcgtcgcgccaagggggtgccctgccagaggctgcggcggaggaaagtgggagtcagagcgccgccggagccccgggaaggcggtgtccgttcggtcccaggtcgcggctgcagcgccgaggggaaagcgagcggaagctgcgcgctggagggagcccaccacccggagccacccgcggggttcgcgt

SEQ ID NO: 5869 - DNA, 1545 bp, Homo sapiens; identical to SEQ ID NO: 5868

SEQ ID NO: 5870 - DNA, 1027 bp, Homo sapiens
cggtgcgtgtataggggcgctccgggaggggtggtgaccggcagccggccttccacccttcgcgttcaccctctcgtctttgttctttccccagctggtggcgggcagtgtggtgatggcctttgaggaggtctgcccggagcgcatcgacctgattcacaaaaactaccggaaactctgtaacctgctgatcgacgtggaggagtggggccaggtggtcatcatcagcatgctcacccgctacgcccgcacgcagttcctgagccccacccagaacgtaagtgggcccagcccaggcagagcgggccgaagtgtgtcccggggaggcgcccacagacccgtcggtctccccgtccaggaatccctactagaggagaacgcggaaaaagccttctacggctcagaggaggacgaggccaagggcgcggggtctgaggagacggccgccgcggccgccccctcccgaaagccctatgtcatggaccccgaccaccggctgctgctgcgcaacaccaaacccctgctgcagagccgcagcgccgcggtggtgatggcggtggcgcagctctacttccacctggcgcccaaggcggaagtgggcgtcatcgccaaggcgctggtgcgcctgctgcgcagccacaggtgcgctccgcccccagccccgccccctccctcgcctcctgccccgccccacgggctgcccggctccgccccctcacgcccaccagccgcttccacctctgcccacccgctccacactgaccgtagtcctgccctccgcactggtcctctccccgcaacgacttgccccaccttttcccctcatccgctgacccttgccccaaccgaggggcccggggtgctctgacccgtcctctccgcagtgaggtgcagtacgttgtgctccagaacgtggccaccatgtccatcaagcgccgggtgagcctgcgacggcgggctgtcctcgctgtccgagggccgcttctgcgggcactggaggcgttgtcggggctgggaccggggccgg

SEQ ID NO: 5871 - DNA, 693 bp, Homo sapiens
cggattcgttctatttgaggatcccgggtctacacaggcgaccgcctcggccccagactggaagcgacactccagggaccaaagcttccagcccgcgctcggccccagcccctgtttccgcctcagagccgcagcgagcagggtcctgcggcaccgcccagagactggcctaggaggttccagcccccagcgccagcacacactcaccggctgcagcagccccaccagccctgctccttctcccgggtcccggccacaccaagagcttcggaaacgccgagaactctgcgggtccagaacgcccgcgcggacgcttctcttacggcgccggaagccggcgccgagtctgtcaccgggcatccctctgttgccttgacgacggcgggcgctgtaagagtggagaagctgcaggtgctgaggcgcggtgaaagaaaccctgggagccaagagcacgaggagctggtgtctgtgtcacatttgtacttgcgggtaagaaaccgctggtgtagcggcgggccagggcttgggagccgacctagggcctaggtgcacggagcgggctcctcgggaaccctgagagtggccgtcccccggagatgaagggacgagggcgcagcgacttccgcacttatcccgccccacgaatactcgctccgcacccgccggctacccggggataaaacgtttgttcgt

SEQ ID NO: 5872 - DNA, 1496 bp, Homo sapiens
cgcccccgaatccggagaaagcagcccgcccgccccctcacccggcagccagctcagctcacccgagagctgagcccgagaagccggcctctgacggtgctggcgtggcgcttgccaaaatatgccccttgcatctcaatttcccccggccatttctcttgcacgcacagctcgcccggggccacctcggctctccagcgcagccctttcgacccctgtttcttccttccccgatccatgcctgctcaaggccgaatgcaaaacccacctccaagaaagcgcagcgggcacggggggcacctagcgtgccatgtcccgcagtcccctcccagccaagaccagagccccagactctagattacggaaatgagtgtcattcagaccaaggactgcgcgtctgcggtcccggtccccggctctgggtgcttctctggggtgtctgtgcgctccggcaccccccgtcgccgtccgtgagcctgcgccccccacccacccaggcttgggagcgccccccacccaaggcttgggagcactccccaatcacctccgccacgttcatttcacttcctaccgcggtccggattgcagcaaaaccgggtagcgcgagggccaaaaagtggaaaggagagcgcctttccgtgtcgtgcagccagctcgccaactctccctccccagccccgaccctcgcaatctcaaatgcaactttttcccttcggtctcggtttcccccgggctgcggctagcgggcgccgcgctgcgaggcgtggagcgggcgggctgccgcgaggctgcgggtggcggtgccggctacagccgcgagccggcgagtgggtgggtgggtgggtggggaggagggagaggacaggcggggagagagacgggtgtggggaggggagggagggggagattccgctctcctgccgctcccagcccgggcggggggcggggggaggaggccgcgacgagggaggggaggagggagggaggaagggagggagggagccgaggaagacgctccgataacccgtgcgtttcgtaaggctcggagcacttgtacatttctgcagccgcgcggcgagccattcgcggcggctgctgcagctcctactgcatcttccttctcttcctttcctcgggctccgggtgtgtgtatgtgtgagagtgagtgtgtgtgttttgcaggtgcgtggtgtgtccgttttaattctgcccagtaggtgggacttggtgactttagcaccattttttccttttccttttttttttttgcctccccaccgtctgttgcaaccctgcaaagtctcggagtcggagagcgcgcctcgcttccagagcccccggacccggcgagtcagcgatcgccgagccggccaccatgcccggcagaccgcgccactaggcgctcctcgcggctcccacccggcggcggcggcggcggcggcggcgtccgcgatggtttcagacgctgaaggattttgcatctgatcgctcggcgt

SEQ ID NO: 5873 - DNA, 5820 bp, Homo sapiens; identical to SEQ ID NO: 5626

SEQ ID NO: 5874 - DNA, 699 bp, Homo sapiens
cgccgcggcctccaaaggccgctgctgtgggtgcgcatacccgggttggagaaatcccggcggttctgcaccgcgcggcctcgcctgggccctggagggcgcatccgtcccgcctgggctgtcccgcggctcatggccaagcgctccttgcccagcccggaaccgggcgcccgagccagcgaacaggccggctcgccccagctggccgagcccgacccgccgcgcgctcgggccaggcgagcgcggcgcggcggattagccctgagcccgcagcctcgagggcgcggggcgggcgcgtttggggtatgagggcggggcgggcggcggccgcgcctctaatcccggcgctgcgtgtgggagcggccggatcagggaattagcgctgtaacttcggattagtaacgctcgctaaatgagtgcctaattccgacccttcatgcttttcagcgtcgcggctgagtcctaggaggcctcctggccaggctccctccgcgctctggtcccatttcccgggaggtccggccgcggccggcagagaactctccggcctgtggagatccggcctcaggccgcgccgcagcctcctctcggcagcgcatttcattggcccgggcagaggcccatgcagtcccacagcgttcggagttgggagttcgtggaccagagaaaaggaagccccggatgcctcgcccaccacgg

SEQ ID NO: 5875 - DNA, 1845 bp, Homo sapiens
cgcacgcggcgcgggactcgagaagagcgcctggcagagcacaaatcccacagaagaagagaccttctgccctctttgagacctcaccttccccttgcccagggccaggaagctctcctcgggcctcctcagaaccccggctgcctccccacctgtcgtctaccgccctttggaggttccggagaggggcccggcccggcgagccgaaggctgcggggcggggcgcgagtctcagcccctgggacacacagccggtgcgtcccgcgcctcaagtgcgcactccaggaagtccggagccgggaggatccgggctcgcggtcccaccctacctctggcgaggtcgggagaaaaaaagcgccagatcgcccgcctgagggcccagaagcccaccgggcggcggtacagactttcccgaaatgtctccgtctccgcgctgcgagcgcacaggaacccagggtcgccggggttgccgtggcttggctgaacgtccaaagccaggcgagggcggggggtctcagtccagctatgcgagcccttctctagtggtgccagctcctacgccgggctcccgggccggcgggaggcgcgtgtgcctgtctgtgtgtgcaggggacattccgcttcccagtagcccatgcagaaccccgccctccgctccggccccaggaacccctcccccagctcagagatccctgcgcgccccctgcccactttgccaaggcgagaaagcggccgtgctggagacaaagaaactcctgcctccctccactctcggcccctccgcccgcccgagacactccccggcgccctccctcgaccccggcgacactgcgcttggacacgccaggcaggggggcagggtgggcgagtccgcttcccgacgcgggccagctgggggcttcccgtgaaccccgcccggggacaccccacagcagccgcgcccccaccctcctctccccaaaccgtcccgggcccctgtcgccgccaccttctgccaaaccgtccccatctctccagcggagctacagcggggcgcggcgcacacaaagggggtcggagggtggagagtacagaaggagggagagatcccgccagggctcgtggcacgggcctgggagcagctatttacccgatttcttcttcgatctctgagatgtctgcgaagatgaggaagaccacgagcagcgtgagcgcggccagcatccagctccggaactgcagctgcatggtgggttcgcgcccgccgggacccacgcgggccggcgcgaggagcaggggccggagggcgcagcggcggacgccggagcctccgcgcgccgcgcgcagctgggcagacaccctgcgctccggacgagtccgggccggcggcggcagcggcagcggcagcggcagcgacaggcaggggttgctcaggcgcggcgagcccgctcgctccctcccggctcccgcctgcccctccctccctcctctcccttcccccgccccgcgcccggctccgcgcgcagtttgacagctttgctccgcgcctctgctcgcctcctcccaccaactccagcgtccaggcgctagcctttgcttctcccgcctggctttattcagctcccgagggcgcggggatgcagccggacgccactcctggcctagagagactgggctctggccaccgcgagcgaccgggtacggagctgagcccagggaagtgcgcgcaccgcccggcgcacccctcaggctggcaaacgccctccctcgcccgctctttgtccagctccctcgcctcctcgcaaagttttctcgacacaaagaccaacacctggggacagcccccagcgcgcggcgagaaggcgg

SEQ ID NO: 5876 - DNA, 1844 bp, Homo sapiens
cgatcagagacccggcgcacggagcggagctcctggtccttacctgtaccaatccagcccgcggccgtagttcctgtcaaagaagtggggttccgtgcccaaggcccgcacgtccgggtgtactcggataaactccagcacggcccgggtgccccccttcttcacgcccacaatgagggcttggggcaaccgcttggtacccagcttgggtgagccggagtggttggaaccggagaggcgaggggcgggcacggcggcggcgggcgcgctgggagcgctgggctcgctgggcgtcggcccggagggatcacaggggcgggacttctggagaagtttctggccgcccgcgctggggccgcggaggcagcgaggcgcgccgaggaggcggctccgacccaggtcgtcgcagcagcacaggaagctgtaacacaggtaagtgcaggagagcgagagcgtgaaggcgaagagcagcctgcgcgccctccgcggctgaggtggccccgcgcggcccaggaccctataggccatggctccatgggcccgcgccgggggtcatggtttccgagggggcaccggcggctgagctgctgtggccctgcggtcgcctagagggctcgcgtggcgctgccacggccacgcgggtcgggcgttgggggcgccgtcttctccgggggctgctgaccagggtgcgcacagtgccagggggtcccgggggcagcggctcctcggggaacaggcggttgcatttccagcatctcccggtcctaggcgatggggctccgggcagccgggcggctcgggcgctcccaggctcttacgtgcgccgggttcggagcgcgcccagcgcccgaagccccattcctgatcctcggagcgccgctcacgaaacgctcggcggcggcgcggctgtgcgggctggcgggtggaccggacggtggcgctggcgccggccgcgatctggctcttcgggaaatgccgagcggagcgcgctgccggctctatttaaggagtggcctgacgtcagccgcgcgggtcccccgagcccgcgccgcgcccagggacctggcccgccccctgcgcccccactctcttacccctcccagaaacacagcacgcgggccctccccatgcaggccactccctacggagccccaggccagctttggggcggtgaaacgaaggtgtcaaggcatagtactcctccgggaggctggacacccccaccacgctggcctctcgacatccagggacacgaatccaggtcgagatcgcgccgacatgcagaccagacagacccagacgcagacgcaggcaccctgccctgatgcgcggtcccaccaccctgacccgcacacgcacgcacaggcacagaagcacacgcgccctagcccggacacacccccacacccacgcgggggtggggaggagaagtcccctaacctgggcccagatacaccgacaaggacactccccccgctctcgacatctcgccaaatggacacacacagcccggaatcggacaccgagcgcacgcacgccctggactgggacacgcgctgtagacgggatgggtggaggagccgagcgtgagtgagattccgtgactattcacccagcttcttagcccccagcgcgctgactcacaccccggcggctcgctctgtctcgcacctatgaggcacgcgcgcaccccaacccattgtcaccccacctctccccgggcctgccggagagcgagccccggagcggcagactccgcgtcaggagggttcctctcttagcagccgccgcctagcggtagactgctccccggggagctgtccagggtaccagagggtcgccga

SEQ ID NO: 5877 - DNA, 1480 bp, Homo sapiens
cgctcccggcgggttttgttgccccacgtccgccgtggggatcttttctcaggagcgccttgcctgggattctccttgcgtctcagaccctcaccctggctcggatttctttcgggggcgtccctccactcccaggcccccgcccgcgcccggcgtggcggccccctctccccgtgcgggcgggctccggaacagtgtcgccggccgcctgcaggtgtctccccacggaggggcgcgcgtccctgcgccgtggccgctgccaggcgccagcggctcctagccgaggtgcactcgcgctccgggctccgggcgcgccgtagccgctcctccaccgccgcccgccccgccagcccgccccgcacgccccccgcgccgcgcccccaccccggggttggggggggcatgggcccgcgccgcgtccgccgccgccgatctcaggcacccgagccccggggcgcggcgggcagcggccgctgacgcggggcgccagctgccaacttcgcgcgcggagctccccggcggtgcagtcccgtcccggcggcgcgggcggcatgaagactagccgccgcggccgagcgctcctggccgtggccctgaacctgctggcgctgctgttcgccaccaccgctttcctcaccacgcactggtgccagggcacgcagcgggtccccaagccgggctgcggccagggcgggcgcgccaactgccccaactcgggcgccaacgccacggccaacggcaccgccgcccccgccgccgccgccgccgccgccaccgcctcggggaacggcccccctggcggcgcgctctacagctgggagaccggcgacgaccgcttcctcttcaggaatttccacaccggcatctggtactcgtgcgaggaggagctcagcgggcttggtgagtgcgcgcgggcggcggccagctcggctccggctcccccggggcggcgcggccatcgaggcccgagccccggacccgttcgccctcctcccgccgcctgggcccagctcccagcgctccgcctggctaggggcgacgttccggggcagggggcgcgcgccgttccggggccggggaccagcatggggggacgtgcgggacgccccgccgtggagaggtgcaaggcagagctcctacccgctgcggacgccccgcggctttggggacgctcccgcgccccgggaaggcgcccacccccgctgccggtcggaggggcgcgcgctgctttccgctcctgaactcatctccacgctcgccccctcctcctcttcctttcgcggggcactagatgcccccacccaccccggaacgcccctgggggtgggggtgatgcagggactcctgctaccagccgcccctcctgccgcagatccacagacccgggagccttccacccccatcgccaacccacgccgaacctcccagacgggagtggggagtgggggagtcccgcgggctcccggaaagccgcacccgc

SEQ ID NO: 5878 - DNA, 5065 bp, Homo sapiens
cgccaagcgcctcccccgggtgcggttcctctccgccagtgaggtcgcgaccccggcgcagctgccgcctcacttcgggctatccccattcgctattgcggatcagcccctaagtaccaggccctctggcggaacctgcaagtccaaacttcgctacccggattccccagtagtcccccccccaccccacctccacccagagttaggagggtgctaccgcacgtagagcgcgcaggtctctggggtgagcagggcgcgtggagggactccaggagtggcacctcactcccgctcgccgcctactttcgacccgcacaaaaataaagaataacccccactctgcttctgtttttattgatgtatttctttgcatcgcggcacgcggagcctcgccagcgccctgacactgcagcgcccgcaccagcgaaccacggaacttgggaccgagacaatggcccgtaattgatgtattgccatcaacaataaagaccaattctcctctccccgccattccgaccatccccctcctcccatccccccctcctccacctcccatctcctttcccggggccaccgagggaaagaaaacaaacaagaaattagcgggggacgccaagcgcagatcgaaacgcccgcctctacgccgtcgaggacgcaaaaaaacgaaaaaagttattaaagtttggatcccccaatttattcgtctctgctcgcccatttttaattaagcatcgcgtagctgcttttcgcatgttcatttcgtttggttgtttgttgtggtgtttttttggggggggggaatttttttttttcctacacttaatcttaaatcacacgtagaccaagtaacaaacacgtgtgaagttattcccgggagcttcctgctgcgcacgcggcgcgcaccaggagaaaagctttgcgggaccgccagctccgctaggttcctggctgcatgcggtgcccgggaggcccggactttcaagaagccaagattgttagagaaggatgcgggcggctccaaacacgggcacattccgggaaaggagtgtgcaagtgcacacaaacgcgttcgtgtacctgggacagtgtggattggtgggtgtgcgaggacccctgtttgtgagatggaggcgggtgcgggatttacacgtgctcccgtacacgttccccggggtctgggagatgcgagccgctcacaccccaggagtgcgcagatccatctttgccgagggatctctttaaatattcagtgagaaataatggcatttgaagcaccacctatggaaacattattatcttcattcttcaacatcagccccactgatagcttcgtttgtctttttatcaaaatctactgtacccatcaggacctggcgagaacgggagagcgaggcggagagggtgtgaatgtgtgtgttagggagtgagcgagggcagaagataagtaagagaaaaggtggaaaacggacgagcagggagagagaagggagaagttataccaataaaaaaaaataaagtcagcagatgaaaaacagaaacattcatcggcacacacacacatttacaccttaaaagaaaagatttaagaagctaagagaaagggaagggtcctctaccggagcgcagtacaggtccggagtacacgaagtcggctcgggagaccggtgcccacttcgcgcgaaccgaccgtggcaccggccagactcaagggcgctcgcgaattggggcgtccttatgagccctctcctttcctgatcgtgagatagggcagggattgtgtatctgcacccccctcctcccccattactcagccgaagtttagtttagtttagtccttcgggcgcaagacttcgagaaccttggagcgaggagaccccgaggcgcgaggggaaagagctaggctgagccgcgtaccgagtctcaggttcgcgggcgcctgagcccggcagagggatcgggctcctggctctgggctctggggcgagggtagggaggttgcatctcagcttgagggagatggtgatagagcgaaaagttcgggcgccgcgctcggcaagtgcccaaaaagtggaggcgagcttcggcgccgccaggcagcctcggacagaacacctccccaccgccctccccccaccccgctttccggctctgcgccgccacctcgtcccggaaggctggggcgcggccccctccccagggcggggtgcccaggggtcccagggactggcccagtccagtgccgggtccgcccgggctgtgtctccctaggccggtgctcgctgctgcgctcagtgtgagccgcagcccctcccctccccccggccggagctgaactcggagcccaggccggtccccgctctccgcccgcccggggctctgcggcgccaccgctgccgccgcctccccgcggagtgacgcgccctgcagccaaccggggcagccgggggggaggtccgggaggggtcctgggcggagccgggccgcccccttatcccacgggctcggggctgcttctcccgaaaacttcagccctaattgtcctgggaatgtccgaggtagagaaagggagcgagggagcaagcaagaagctggaggatcagtgcccctggcggggaggggatggggtggcgggagaactgcccctccccccagccacaaacccatcaggttcccaaacctttcctggatcctcttctccgcgcccccgcgagcccgggatccaggggatggagaactcggggcggaggagcgccgagccaggcgggagggaggccgagccgtgggcgggaggcggaccggcgtggggctggctcttccccactcgcttatttttttttttaatgggggtgggggtgggctgctttctggtagctcttaaagaaacgaagaaacactcacgaaacgggacgccctcccccctgatcccgccgcgggactccctccccccgcgggccggcgcgcctcgcccccgagttgggaagttcgcagcgcgccggcagcccgggtccccagccctcgccgcccggccccaccccccacccggggcggctcaattccggggagggcatgctaatttgggtcggcccagcccgggattgtgggggggggcgaaggagggagggaagagggaggggagagggagagagcggggggcgcctgccggggcgccgggcccgcagtggagaggaggccggcccccggcggccgggccgcggagtcccgggcggtcgcaaagagggttaacccagtgtcgggcggcgcggcgcgcagagccagccccgcggccggcttattgggccagcgcgcggagagacaggggtctgcagcaaatcacgaactaattgattaaggcgagcgggtttgaatagcgctggcccggtgccaatcgcctttcaaagagcccctctatgattaatcgcaatgcattattgataatcataattatagcaggacacatgcgcgctgcgcccggggccggggagccggggagggggcgggcgggccggcgggcggggggagccgccgccgccgccgccgctcgatttccgtaattttgagaagatttttttttagtaattttttattctgccccagctgatgtttgagccagcatgtcgcggaggaagcaagcgaagcctcaacatttccaatccgaccccgaagtggcctcgctcccccggcgagatggtgagtgctccggcccgcgccgtggacacacacacacgcactcacactcacgcacactcggacccactcacacgcggctggcccccgcgccccctacctcaccgccgccgcggccccgattgcttcttccactcggcgtaattttttttttctttttaattttcaatgtgcctttgctgggctttcccccgctgccccggggaaagcgagcacatctcccggcaggatctttccggagttgttgggtcctcccgggggaaggagggcgggcatgccggcctggcttctccgtccctgcttttccggggatcccagccgcggccaagacccgggagccccatgaggcgtgggtgcgggtggaggtcgccccggcctgaccgcacggggcccctagcgctcccggcgccggccccagggcacccggcccggcctccgccgcccggccttgctgccagcggtaaggaagtttacttcgggcgctgggctgaactccgagcgtgggggagttcgctgcgcccccctgcccccacgcacactccccctcggcctgcgaggcagaaccgggtgtctttggaggttcagagctgcaagaagatggggactggtgtcggggcgccagcgcctgacccgctggggttgcggccggggtggagagtgctgctggccgccagttgttccggagacggtgcaaacggacggggaaagtgtcggggtctggctcgcaaaatttatctccgcatctcttcccacaacacttgcaccctctgccccccaaaatctttctggtcggtatgcgccctctgcggatcgtggtgctccctacttccaggggggtcagggaagaagtcatagaatagttttccaggtttgcgggtggccagccagagtggaatcccccctgaaacaggggcacttgttttctccgatggaggcgacaactgtgggtcccgaaggggctgaacaagtccagaacaaagtttgtgtgtgggggctatggcagagagtggaagagatccgggcagggagttggggtacaaagggaggacacctggaatccctccttgctcctaaaggtgtttcacggtaccggcctcaaagctcccaggcctagcgcccgaggcggtgtagcggcgcccggactcgggtccccgggtcgtcccggcacgatgctggcctctcggctgtgggaggacgcacaaggagcaatctcggcggggtctcagcggctccggatgccactcgggatgcccacgccctaggcggcattttggggtgtgaaggagggagctgggccccgacagagctccgaagcgtgaccctgatcggcacctcagcccactaagctgcggccgcccgggcccccaggtccccggctcgt

SEQ ID NO: 5879 - DNA, 2372 bp, Homo sapiens
cgagggacgcaggatgaaagaagccaagagtgtcgccagggcttgcgccagcgccgtcagactcccgggatgggggagctccagggcacggcgtcagcggattcacggagaaggagaaaagccccactgccgtgcagaagcctaggcccgggtgagacgcctgcgaaggctgccagcagcggaagagaaggggcgtcctccgtgctgcgcagcactcgcccgcggtaggtgggcgcggagctcagagctgggagccaaacgcaaacgctggcgagaagccccagccccctccggcagcccactcgctgcggggaggggtttctcacgcccccagctcctgggagactgcaccggaggtcggaagtaagccgggcgaggatgaatcatcccgcctaactcctccttcccggtcccctagcctccgcacgccggcccccttcagagatcttgcagccgcgagcgaagactgccctatcctcagactctaccgaaccccctgtggcctgcggagacgaggagacggacgggtctggtggccaatgagagcttcgatctcttgccccccgcccaatgggccgctgctcatgggccggggcgggactaggagggcaggtaggggcggtccgggctggcgcgcggcgcggcggctacgcggctgcggctcacagagctagcgcctctctgggtgtccgtgccagtgctgcgcgggaaggcaccaccaccacagccgccgccgctggccagggtgctggacaagacgggcccgtcggccacctcgccagctcaggcacccgctgcagccgtcgctgtctcctcccagaccggtccccatggaggagatggaagaggagttgaaatgccccgtgtgcggctccttctatcgggagcccatcatcctgccctgctctcacaatttgtgtcaggcgtgcgcccgcaacatcctggtgcagaccccagagtctgaatccccccagagccatcgggccgcgggctccggggtctccgactatgactatctggacctggacaagatgagcctatacagcgaggcggacagcggctatggctcctacggggggttcgccagcgcccccactaccccgtgccagaagtcccccaacggcgtccgcgtgtttcccccggctatgccgccaccggccacccacttgtcaccggccctggccccggtgccccgcaactcctgtatcacctgcccccagtgtcaccgcagcctcatcctggatgaccgggggctccgcggcttccccaagaatcgcgtactggaaggggtaattgaccgctaccagcagagcaaagccgcggccctcaagtgccagctctgcgagaaggcgcccaaggaagccaccgtcatgtgcgaacagtgcgatgtcttctactgcgatccgtgccgcctgcgctgccacccgccccgggggcccctagccaagcaccgcctggtgcccccggcccagggtcgtgtgagccggaggctgagcccacgcaaggtctccacctgcacagaccacgagctggagaaccacagcatgtactgcgtgcaatgcaagatgcccgtgtgctaccagtgcttggaggagggcaaacactccagccacgaagtcaaggctctgggggccatgtggaaactacataaggtgagtcctaagaaaacccactcctaactccctgcgtctccgatcatccggttttgcagcagacggtccccgtctcttgcgcacagcgcatcccagtgggggcgcaatgcaggtgccttcgatgtttacctccctggtctggtgcattgcaggaggcatgggggaatcttaaccggcgcacgggggagttgaatgcccccacagagttgttgcggggatgccttagagcgggtctctcggggcgcgctgcctgcgagcgggactcagggcgccccctttccgcggcgggtctgcagccagtggccgcggccagtgtgtgggaaagcactgcatagctgggtagagccgcgccagtgcccagggccgctaggcacgctcgagggcagggcgggctgcgaaccctcggggagggactgggatgggggcggtggggtcgcgcggacggcgggagtctgtcgctgctggataggcggacctggtgaggcacggcggagggtcggggagacgccgcaggcggaatactgatgagcccggctctgggccagacctggctctcgagctggagagaacgcggggtcctggtgccacgtgctcaaaagacagagcggagagggcagccagcggtcgccatggcaacgcgacgtgcaggcttgggcctgaacccttccggagttgggacctgagactagagtgtcaggaccggagtttgcgcagtcgcgg

SEQ ID NO: 5880 - DNA, 2372 bp, Homo sapiens; identical to SEQ ID NO: 5879

SEQ ID NO: 5881 - DNA, 2372 bp, Homo sapiens; identical to SEQ ID NO: 5879

SEQ ID NO: 5882 - DNA, 2142 bp, Homo sapiens
cgcagctggtttcgaggttgtgcggtttccagtcctgcggagcagctcaggttaccgcctccgtggccgcgggggagggcatctccgacggccgcagcaatgggcaagagatcagggtcttcccatccccgcgactcgcccctttctgcctggtaaccaagcgggatgcctcatcctactccccaaacggagcggatcacacacagtagtatttcatggtctttcctgctgcggttttcccgggggaaggtacttccagagggtggccaagtcttccctagcggccggccttcgggagggggacagaacttaggagtcagccctctgccttcgtacaaaggctcgcttctcctcagggcgtctctgggtggagcgaagcggccgaggggaccacgacaatgtccctttgcttttcggaccgatggccaggcctccagagccaggagcgcccgggaccccagggcagggagcaaagctcataccgcaaccccgccacccgcccgcgccctgccagcctgttggggccacagcgcgcaggccagcagccgcactcgccgctgcggggttccctttgcgctgagctcatctcctgcaacgccgctgccccaaaccttgcgggccatttggtcccgggggtggggctccttgggggccgcggggcagcccggatgagaggatgacccgggagctccctgggggcggagtggaaggggcagctccaggcagccctggccaggagcttttaccccgccagccccgctgctccagcggccgctgccttagaaaagttaacgagaaccagatgtggtggccactgccgaactttctcagagccggtgattggtccccagccgagggcctcagccaattagcttgctgggtgggcctggagtcccgccccgcccaggcgcccgcggagatccaggttcgaggctggcgcggcgcggagagtgggctggaggccggggcgggacgcgttgtgcagcgggtaagcgcacggccgagcgagcatggagggggaccgggtggccgggcggccggtgctgtcgtcgttaccagtgctactgctgctgccgttgctaatgttgcgggccgcggcgctgcacccagacgagctcttcccacacggggagtcgtggggggaccagctcctgcaggaaggcgacgacgaaagctcagccgtggtgaagctggcgaatcccctgcacttctacgaagcccgattcagcaacctctacgtaagttcagccccctcctggcacttttcccgcagcttcttccctggggtcggtctcacggaaaccctgcctccagaggggaggaaacagaccccactcctggagccccccagcacccttgcggtggtacccggccagagagcgatgccgctgcctgccccgctgctgtaggggagcaagaatgacctggaggggagagcaagaattgttcgcagccacgtacgcgtcccaggcagaaaaggtggcgttgctagggcggccagcgggctttgcagttaggaccgcgagaaggctgtgcccgtctgcggagctggggtgttccctcttcagacctggaggcttcctctccgaggacatggggctccggggttgtgaggggagtgagaagataggtgaacgagttttagggcccctggacctactgcagcgcggagctgggacagtcgcaaaagttgcgcttgtttccctgaatccagactccctggccagtggggaaggagagagaggctttttgcctaagtcagttcccttccctccctgcgcgaaagggtagcgtccttgggcttgagcgactgtcacctttttgtccctctcctctcccaggtgggcaccaacggcatcatctccactcaggacttccccagggaaacgcagtatgtggactatgatttccccaccgacttcccggccatcgccccttttctggcggacatcgacacgagccacggcagaggccgagtcctgtaccgagaggacacctcccccgcagtgctgggcctggccgcccgctatgtgcgcgctggcttcccgcgctctgcgcgctttacccccacccacgccttcctggccacctgggagcaggtaggcgcttacgaggaggtcaagcgcggggcgctgccctcgg

SEQ ID NO: 5883 - DNA, 544 bp, Homo sapiens
cggtctccagccggccttgtgctgcccgctgcgaatacagcccgtgggccaccgggcagccgagccatgcaagccaccctgatccccaaaaggcagacgcacaaacccgacccagaactcgaggcgaaccttgaactcacagcgccaaaaacgcgcagtgccttcgtttgcccggctcgctgaaggctggctctgggcctgggggcagtgcccgcgaagggctgcgatggcaggccccgctgccacacggcatcgagggtccctccgcctcggcgccaggcgcacgcccttctgccacatccctcgcggggcgcgccgccagggccacctgccctttcaagccccgccaggcagccaagggtgaggagcggagagggacccggccgctgctgccgcgagccagcacaaaggcagcgtctgaaatcgaacttcccaccctgggcaccgcggcctccccccacccctggcctccgcggccggagcgcactcactgtcagtcgccatggtcggacgagggggctgcccgacggccgcccaggttcgg

SEQ ID NO: 5884 - DNA, 2002 bp, Homo sapiens
cgcccccgccccgtgccaagcgggcccaaggcccgaggctcccccgctcacaaccccggtgcccggaacacgtcttcgaggggccgtgctgtcggggttattactcgcgactggacctcgcgccgtgttgctctcctcgggccccgagcccgcccagcggtctgcacggcccaggcctgagctgcgggcttctcctgtggggcgcgctgggagtgagctctatccccaaagcccatttcaacgtcccaggtatgactacgacggcagaggccggccgcccaccctcgcccccttccccggccagagcgcctttgccgggagccgacgaccgcggcctgaccccgggccccaccgcctactcccggctcccgcccttcctccacggtcaggggtcacacacagcggacgccccgttctcagccgcccctctgatctctgaatttgggagccagcgtgtccgctggggcatgcactgccacgggcactgggacccctttgctgctgcggggaggagccccgacggcaggtgggaagacctagcctgcccgcgtccccgctccccagctcctgcgacccgggccgaggctctcagcccctgggcttccccgctccgggtttgagggaggggccgggccttcgggcctgcagacccgccaccgcgcgtgcgcatgcgtcggccgcgagcccccgggtgcaggcctgggcggctccggcccgcgcacttgtccaggcgctgcggctcagcgcgccccaacctccagctcgggcggagagcgggggcgggactgaagcaccgtgttcctcaaagtatcctctcgccgtcggcagccctggcctcgcaaatgctccagcgcgctcaggcgcacgcagagactggcgcggcagcctccgggccaacggcacgcgagcaaagctggttggcgacctgggacacgcagtagaagttgaggctgcaccgactcccgccgcttcgggggaggcatgggcccgggcaggcctaggaggaagctgcacagcccgaggcccgggcgggagtggcgggccgcgggcaagggaacgtatatttggaaggggtcaggacctcggctggagtctggctttttatggcgaggaagccgactgggaagggccctctggcgaggctttcctgttgtgccacttttccccggcagcgccgggcgcggggaacgcggggctgcaccggggcgggggagggggctttacccggcggctccgaggactcgactctggggtcgggcccggcgggtaggcctgcccaggagccagctggcaaatgcagcggactgtcacgttattccactgtcaccacttactgtaaatcactgtcctaagcctccgggagaatccgtcgaacctgagaggggggagggggatgggggtgggcgcgcaggaagccccacaggcaccagggactggtgacccaggacatcagcccctcgagttctctctgggaatttctagcacccagactgtccctgactgtagggaccacggtggggcgtcttccttctaagctctccccgggacaccgggcgcgcccccctcgcccctgggttagcgcacactcctccacgcgatgaccagcacagccactgtgaggcccggccttggccgcgtttgtcctttgcgagtgataataataaaaatcattggaattgcaaggaagcccctggccccggctccccagccgctgctgtcctgggtgtcccggctgcggaaagaccccgcagccgggcccgacccacgagtggaacaccgggctgcggacccagccgggcctacaggactggcgcggggctccggggacaggcctcgcagggccctcctgcgcaccgtctgggacgccgattttgccaacttggaggacaatttttgttttcactctaccagcagatttttaaaaatccagtcgccgctgaaacgtgcttcccacccgtccggtttgtttgtagcctttgacgagccccggcacagcctccgg

SEQ ID NO: 5885 - DNA, 983 bp, Homo sapiens
cggtgccgcgcgcccgcctgctgcctggagctcccaactcggcggaatccaggtcaggacgcgccgccgttttgacgtgctgccggccgggaggcgcgggcgccaggctccaacgactagggtgggtggccgcggggcaggggttggatctgaattcgtccctcgggggctctggatgcgggatgcgggatgcgggatgcgggctcgacttcctcgctgctggtcgaggagcgttctgagagtctcccctccgcgcgcgaggataaatatgcgcggcttgtcagtcagtgcggcgctgtctcccagctgatagggtgacgttccgtttggaggcttggagattggctttttgatttggcttcttccggcagcttaatgggcaaagctctccgctcgcccagaaaccagcctctccgcgcgtcccctctgcgcgcggcgaggccgagacgtctcccgcggtgacagcgtgcaaggcggagacccggcgcgctcccagcccagggaaagcccaggcgacgcgaccgcaagcccgagcccaggtccctcggagccgccagggcgcgccgggctgcttgccttcctgccccttcctgcaggaatcccccgccgcccgcggccgggactccgggcctctcccgggcgtagattccagtcaccgctctgggtcggggtttccctctttctgaaatccgtgcggaaggacccctcccggggcccctcgccctggccccagacaccctccctcccagaccccgcgctccagatgcgctgccccgcagctccctgacagctgcgagcccacgaaccccggcgggagggcggcggcggcggactgacatgccccggacgcggctgcggccggcgggcagcccgcgggggcgatgagccgctgcgaccggtgaggcgccgggcggcgggggcatcgcgtaccttcctcacccccctcccttgcccactccgctcgggaggccgagaggaaacgg

SEQ ID NO: 5886 - DNA, 947 bp, Homo sapiens
cgctcggtgctcatccccgggatcttgaacttcgcctccctcttactttctgccagacccgcgagggccaggaagggctctgggaggaagcgggagcgcagcggcggggcatggaagaagagggttgggggcgcgcgttacctgcaaaggttctcgaggtctccttccagccctggtggtaatcccgctcagcgccgcgccctcccccagatccaaacttttgctgggtcctccgggtggcggcggcggcgacggcggcggctgctggagccaagccctgtcgcccgcagcgtcggggcgcgggggtgcggaggccggagcctcagagcggcgcgcgcctccccgcagcgggccggggccggggcgcccagctcgcctcgcttgctctcgcctacgtcccctacggagctgcggcatcgtcttcccccgtcctccgccaccaccgcctccagggttcgggcatgccactttctcttggcttcggccgccgcgacccccgccttctctcctcctccgcctccccctctccgcttcgccaagccaacgaaccccaaaagaagtacagcgagcggggaaggcggcagaaagctgccccgcggcgccggagctcctcggatttggaggatcccgggactcggcgggagagctaggcgggctctcctccgacgcgtgtgtgcggacagctcggagccgggcgtgcggcgctgcgcgggggcgggcgcagggctcgctccaagtgctgcgcccgcccggcgtgggtctggaggctgctcagaccacactactgcctcaatccgacgcggccgggctaatgtaggcgccgcggcccccacccctacccctcctgacacccccggatatgtttacagtaatgaattcgcgggatcgcctccgcagctcccgcgctcctcctctccctccgtccctcgcgctctggcgcgctccgc

SEQ ID NO: 5887 - DNA, 1362 bp, Homo sapiens
cggcctccgggccctgcgaagggagctttgttcgcgaggcggagggcctggcttaccgagaagcgcatccggaggcggttgaggggcgcgcggggcacgcagcagagccgcagcccggcccggacccggagcgccggagccgcaggaaggcgaggagaaggaaaaaaaggaggctgccgccggctcctgcctcattctcccgggcagcgttgacccgctggccgccgccggatagggctggccgccgggcgcgggaccccgtgcgcgctgctcatgtccccgtctgccgctggctaggtgtgcgcgcagcctgctggtctctgggcggcacccgggggctcctcatgccccgcgccggggctcggcgggaggacctcggagaggcagcgcggagggaaagagagagagacagcatgagaacgcgcagagctgcaccccgcgggggccgggcgccagcagcaccgcgctgccccacccacggcgcgtctgctccccgcgctgcgcgcccagcggggcgccgagccccagaaactttagcacatggccggtccggcggccacggtggccgtagctgccctgctcttcgagcgccccccactgcttcctgccccaagccccagagcgcagcttaccagcggcgaccgcgaccgcagcggcggggcgcccacccggccgcaagcacagcagtgcgcacctgcgggaaaggaggaaggggctggcggcgtcggggtccctacaggggaggggcacctcggcggcagcaatcggcgcaggttaaggcattctgggccggggctgcgcgcgagccaggtggtggcaggccgggattggggagggtctctgcgccccccgccccgcggcgccgctgctgatgacgcgcgcgggcttccccggccccgcgtctgcggagccagccccgttacctagcgactcgctccggggagcccccgctgacgcgcgctgcgagccgggctgcggcagccgaggggcggggagggaggggagggggagctccagtgcggggagggccggcggctgcgggccaagctcctccctccgcttccctctccgcgttggggagggggcccgggaaagacgtggcctccgcctggccctggaggatgggaggccttcgcggggcgggggggacggagggaggcactgagtgcccctgtccccgcagtggggatgcagcagcaggtggcggctatgtggcctgtggaggctcggcacccagaggcgcgcggtgagcccgccccggcgggagcgtggcgaatgtggctttgggcgcgcgggtgtgtgggacacgctcccacccacgtggcgtacatggggacctggggacgcgggtgaaagaggcgc

SEQ ID NO: 5888 - DNA, 1092 bp, Homo sapiens
cgaccgcggcgcgtcgacgcttggcgggtcacggtcacaaagcgggtctcagagccttcctcaggcggcggcaaagggggcgcccgaggtcaccggcaagagacagattactggcgcctcgggaaaacagagtggggaagggcgagactgtgtgcccatccacgttcgcgcgggtctgagctggcccggccttggagggctccgggaccccagaagggggacagcagtgggggatgggcagaagggggcgactcgggctgcccaggctcctcgcagccttcctgccaacgagaggggcccgggcgggaacagctcgagccgcgggggtgcggggcgcgcagcccgccccaccccgggagagccgcgatcgccgcccccgacgcgtgcaccaagtgggggtgtccggctcgggacaaaggaccgggacgcggatcgcgggcgggcgccactgcccagccccagcgtggagggcgagaccgtggccccgaacctccccaaacttggcggcccggggcgcgtgggggggacgccccgttacctgcgcggccataaaggagagatccatggtgtcgctgcagccagcgctcgagtcctcgctgctgccgctgccgctgcgggtcagccgcctgcacagttggcggggatcgggctgagcagcgagcgtccggagaccgcacggcgcactcggctgtctctgggcttctggctccagatctctactaggcggagggccccgagcgcgggggcgggcggggcggggtggggcggggctcggcggacggggcgcccctccacgtgaccactccccgccccacccccggggcggggtccgtcagaaaccccaagcgctcgcaatcgcctcccttcgtgggcgggatggggaaactgaggcccgaggccgccccgctggttggtgcaagaaccagcctgcaacccaagtcctgagctgttggcgccccgccccgtgcagttgaacccaacccacccggggctgtgggcagcgctctcttggggctgacacgttatcccgagcctgaggaccaagatcggagtgacctggctttccacgccaacgctcctcccagagtccgg

SEQ ID NO: 5889 - DNA, 1092 bp, Homo sapiens; identical to SEQ ID NO: 5888

SEQ ID NO: 5890 - DNA, 1092 bp, Homo sapiens; identical to SEQ ID NO: 5888

SEQ ID NO: 5891 - DNA, 580 bp, Homo sapiens
cgtgtccaggggagcccgatagagcacgcgggaaaagccgggtgtctacgcttccgcgacttaggctgcagagataagagaaggtcaggctctgggaggacgcgaggccgtccaggaatggcagggaggcccgctggggcctgactttggtcctaatggaccaaagcttcgacggagcaaggccgggtgtccgtggtggcacctctcatcagtggacgctggcgaatgactatggaaacaacattcaacagcagtgttttctatgccaggtacacaaccgccttggcgtgggttgataaccatgcctatctcaccgcgtggcactgagccgaccgcacacccagggccccggtctccagggctcgcttactcgcttactgcgtgaagcatccatccccgcaggagccggagcaggaacagggctgggccctggggcgcgcgcatgcgcaggccgtgctccaggaagggcggggcactgagccgagggccggcgcggggcggagggcagggggtggtcgcactctccagggcacctgtgcggtgactgagaaccgacccggcaatccgcgggcccgggcgg

SEQ ID NO: 5892 - DNA, 888 bp, Homo sapiens
cgacccgctccctggtcgtctcctccgcggccaggcgcatcctgcagcgcccagaccgccgcgtccccacccgcgtccccaaccgcgagcgctcgcctgggccgggccgggcgcccgagattcgggagagattaggggcccgcaaagcagaagagcagattcagaaagaaaaaaaaaaaagcgagaagtgcgagaaaaatatactgaattcagctaaacacacggcagatgaaaaaaataccttgctcagaagccaaaaacgagctcccgagccgtgagacactgttgcgcccccgccaggcgtgcaggccggatgttaggggggcaacctcgaggcccgatggtggcttcgaccccagggcggacctgcgcctaccctcagcccctgcaactgcgggtcaggagaaagggacctgccatggcgaagaaaaccgaatcttctccaattaggcttctccttaaagagagaaaaagtaggtagttgggcaacttaatccaatctgggactcgggacgtgtgcttgggcgcttcccgggcagctggccggagcgtgtgggttcggagctcccagcgctggccccgcgctgcccctcgatgccaccagcaaacccgcagggcgccttggcgcaggctcgcgtttgcagagccggcctgggaagcggaactccctccggtcccgatgaccaggcctctttagggtcctggctcaggctgcctttgtgggacagagcctcatgaagggacacagaaacagagacagcctctgggcggcgcccccgggatgtggcgtttctgtgccccggggagggggcaccacccctgcctatgcggagcgatccggacgctgcaggggtgacgccgggcagcgcccgctctgacctcccacgg

SEQ ID NO: 5893 - DNA, 1483 bp, Homo sapiens
cgcggctctgggcgctggcagggggaggcttcggcaacgcctgggggcttcaggccagcctcctccgggctggaaggcaccgcacaggggcttccgccaacttcggtcctcgcgcggtcgggacacggccacacctgcccgcgggggtctgcctcccaggccgccgcaggccccccggagcctaagaggaccccacaagcagccaaagccagcgccgcctgccccttgcagaacactgccccccacaagccctgcagaccctcccggctctccagacgcccccacggctctcgcgaagccattcccgcgctctgaatgcccccgaatctctgcagagcccccgcggttctctggaagcccccgcgcccgtggagcccccctcccgccctcgggggcaccgcgggcccccagcccagcccctccgacgctggccgctgccacctcccacgaggcgccggccccgactcacctcattgtcgctgccggggacgggcgcgccgggccaggggcgacccggcggcggcggcggcggcggcggggcgcgggacgcgggcgctagcgggggagccggccccgggcgcggcggctccgcgtctgactgggctgcggggggcagcgggggctcatcttctccgggtgggcgtcggggccgctagctgcggggaagggccgcggcggcggcgactgacagctgggccccggcccctgccatcttggcgggcgcgtgcccgggccggcgtgtgcgcgggcgcgtgcctgggggccgccgccgggggatgggggggcggggggcgagccggctggggtccgggcggcgggaacgcgtgcgcgtccgcctgagactcggggcggcggcccctggcgagtgcgcgggcggctccgagtcctcgagggagaggcgcgcgggcgcgcgggctagtctcagcacagcagccaagagctagggtacgcgcgttgctgttcgccccaccgccctccgaggggactgcgcgcgcgtgcgcccctccgcccgcggccgctgaggtgaatgagcgcgcgcggcggtcaaagcccgacacaaaaggcgcggggccccaccgtccgcgcctccgggagcgctgagcttgaggctgcgaggggcggggcggacgagagtggcggggctgaggggcggggctttgagggaagcgcgaggggcgtggccggggtgggggcggggcgccgggcgggcacgtggcgcggtgcgctccctcccggcgcggacgctcctccagtccccgcctgaccccagagctcacagaggccaccgggggagccagggtccgtgctcgatggccccatgattcccatcacctggccctgctgagcaccctgcccgctcggactcggggcatccctgatccgagggccgtcgaggtcaccggcgactgattccctctctttgtacataaggagccgtggcggggccggagagttgcagctttggggcgatatcagtattcga

SEQ ID NO: 5894 - DNA, 3714 bp, Homo sapiens
cggcgtggccctgctcggaggggtcggcctaaggaagtgtcacttacccggagggtggtcccgggcccgctgaccagcttccacgcctgtcgcttgagctccaccagcttcgtgtggcagtggcggcaccagccgcctccgccggccgagtggccctgctctgggccggccccggcgccttcgggagcagggcggctgccgcatgggtcctggtcgggcccggcgggtagcctctttcggggggacacctccagcagcggcggcggctcgcgggccgggccgccctcggccacctgcagggtgtgggggcggaagcggacagtgagcctgggacgtccgtcggatccagacccctgcgcgccctgccccagcgtgacgctcttgccaaagttaggagccctgggcacgaccctggcgctcacccactccctccatccccggaggtcccgcctgcgggtccgctaccctcagcaggaggcccggcccccagggatccagcgcacaccgcgagtatcttcgccgtcccgggcccccgccgcccgcctccctctccaggccgggccgcgcgtaccgcgggctgcgcagcgcacagagggacgccgcggccgaccatggccggggcgcgggaagagcccggcaggcgctcccggccacgctggctctccgggggcgccgcggctacgtgatccggccccgaggcgcccccatggcccggcccagccgctcggaagttcgcagagcctgcgagtgtcgcgaggagcgcggtggctccggtgggcgcgctcgggaggcgagggcggggccggggaagggcggggctcgggctcccggggcgggcggcgaggggcgggagcccagagagtgccccgcccttgcccagtgctgggcggcgcgtggggggggtagggtccccgcttccccacgcggccccgcgcactccaaggaccccaacctgttaggtgagtccctgccccggggaggggcgctgggggcggcggcgaggatctagttgcgcgcgcgcatgcgcctcccgcccctctcccgggacaccagggctgcgcgtctcccaggaggcgccgacgcccctccctctacaggcgggaaaactgaggctgcggaggggacgctcttgcccaaggcccacggcgaggtgggccgaggaaggggcgggaccccggccccgagactcccaggcgcctttccagcaagcccagcgtactctgcgtgtcgcgggccactttaggtctaactgtcgcgcgtgggttagtgtcgccgcggtgtgcgcctcgagccgggcagcgaccgcgccggcgtatctgtgcctcggcgcgtctgcgaacggcacgtgtctttacagccgcgcgtgtgcccgcaagtgggtgtgcgcgccgtgccgcccgggaagcgggaggtcctgcgggcgtgcgccggacctgttgtcagcaggcctggcagatgggaactcagctccggaattaattgcttgtttgtctccggctgggaggccgcccccccgcccttccctggcgaccagttgctctgtgcctagccgggccccaaatgtcgccggcatccgcggccgcaggcagctccgggccaggctccgggtcagccccaaagcccgggtcaagccaggcgggcgcggcgggcgggctccccgtgacgcgagtgccccctgccggccgctgcgcacacggctccgagactggggagacagcgccgcgcgtcccaggcctgaggcgcactcggaaactccgaaggtcgtgacccggcggagaccaggacacgcggctgccggcacatacggtgaggccttcgcagagactcagtacgtcaaagtgaccctttccgttttgcccacccccttttacttggataagcctccccgcccacgcacgcactccccagaaagtggggtgggtgatcccctcccggctttccgggtcgttgatgaccttaggggttcgaaaacgcaagggggtatggaataaagtggcaggggctctccactctttctgagatccgtaagcctgcagtcgctttccacccagcctggggggccggaagcgcttcccctacccgtctcttcgcagcctggagaatgaaaacgggcgtcagcccacatctggatctgggtactgaggacaacacccaaaccccaccccgcactgccggcagacagcaccgcctcccgccgctccactgctccgggacacacactctctatatcccgtccccccacccacacacgcaacacagaagcacgcagcggtcgggagcaccggtcctgcgcccctggccagccacacccgcaacttcagcgcttctaccgccgcggcgcttcgggaagcacaagctcacatcccatatccgcagaacacggggtgcacaaggctggagtcacctcgggggctcacgatcagtcaggggccccgaccccctacttcgcccatcctagcaaggcgcaaggtgagcccgagaatccctgcgctgcgctctccgccctagccacagcctccgggtgggtccggttgggacacagccttgaaggcagagggagacttggacaacgctaatgggggaaagtgcggcagcgagtcccagcccgggctgcgggacgcggctccggacctgccgtctccttcccggcgcagcacccccggccgcgcgagccgcgcggcaaagtaacgggacggcgcctacgccgcccgcccccctcccgacagccctcaccttgcctcgtcgccgcaggaggtggctggtgaagcccaggatgatctccgagtccaggcagagcgcccccatctccagcaggctgggagccttgcggggcgcgccgcggggcggctcgggcggctggggcagcgccatggaagagggaagcgcggggagcggcccctagtgcctcccgccaccgccgccccgcccgcgcgttcactggccgcgcgcccgccgccgccgcgccccgcaccgcgcagggccgcccgtcaagcccccggtcctccgcgccccgcgcccccgagccctgcgctcgctccgcgccgcgcgcccccgcgctccggccccgcccgcctgcgccgacagcgccccttccgccccggcggcgagccagacaccagccacgcggactggaggtgtggggcgacggccccgcgcgccactgggcggaggttggaagccagaatcgggtcgcggtccgcgcccacctgcctcgctagcccccagacgtcggtgtctactgccgggtatccggcagggagagggcagcgcggctgctgtaaaacccttccgactggggcataatcgcagccccttccccctccaatctgtcctgaggacacggcgcgttggggtcctggcccatggaaacgctcagagcccagtgacctgtgcactccaccccgcccacgctccagagcccccgttcaaccttggcctatggacctccaaggcccaccccaaccggaccacggagcgtgcgcagcgggacccgcagtctgcgcctccactccaggatcccgattgtgccgccacccgtggccttccctgccccgaccccgactccctgagggctggaagattcgggctggctgccgggcacgacgactttactttcagggtccgaagctaggggcgggggtgggcgctctgcctgggtgcaaactcaagcccgggtcccgcgctcctcctgtgggctgccccagcctcgcgcgc

SEQ ID NO: 5895 - DNA, 1266 bp, Homo sapiens
cggctcgggcgccaggtagaactccagctcgatgctgccgccgtcgggggagagggaatccgttgggagggacagtcgggggctggggaaggaagagcgggtgctgggagggttcaacactggcggagccccaggtggcgacgcgggcggcgagagctgctccgaggcgggggcctcgggcaggtcgctctccacgcagtacacggagcagaagacttgtctcttggcgagggacgggcgccgctgacccagcacgtccaggaccagtccgtcggcggcccccacgcgggtcctgggctccagctcttcgccggggggcgcctcctgctgttcatcccctccctcttttcgatccccagcttcctcctcttcctcctccagctccaactgcagtggcaaggtctggggattgagaggcccggtgagtgccagtcccgcaggctgcgccggtgctcggctcttactccagcccgggggccccaggctcctcgcgggctctggggcgctggtgtccgcgcagccccagtcgcttccgcagccaccgccgctcggctccgcggaggcggcgcgcagcgggggcgcccgggcgctgtccccctgaggcctcgggggctcagggtggcccgcagtgccactggccagggtctgcgactcctggggcccgccgccgccgctcaccgtgctctgctcctcgcccatcgccgcccgcggcccgcgccgccgctgcccatccagccgccgggacccccacccggcgcccgcgggcagcgggggcagtggctcggctcgactcgcggctccgcttctgcttccgggtccttcctcctgggctgggacgccccaagtcccctccggggagcccgtgctccgaggctgcggcgcgtggggagcctggcccggcccgccgctcctcctcgtactctggcgcggcggggcaccgcctcgggggcgccgagggccgctcgctctgggctcgggcgcgcccgccccacatgcagctcggggcggcgccgcagccccagcgagccccaggcgggacagaggggtctgggaggagacggccgtcagtcccgcgccatcaccggtcccggctgccggacgcgcggcccgagggcggtggtcaaagggtcgaggggcctgtggcgccgccgcggcgcgcaccaggaggtgcagccggagcgctggccagccgcagggcccctgggggagaggccggagcgggcgacctccctctccccgcgcttcacctacagccctcctcgccgc

SEQ ID NO: 5896 - DNA, 1316 bp, Homo sapiens; identical to SEQ ID NO: 5773

SEQ ID NO: 5897 - DNA, 10783 bp, Homo sapiens
cgagccgggacaaaggcttccaacgggagcgggacatttgtctacatttcgctcattgtccgcagcttagcaatcggtttgtatttgtgtttgcccgggtccgaccacccaggacgcgccgacgaggggcttgctctaacctgggccattgtcacccacgtcacatactgggggcgaggcagctagggctgcagaaagccgccgagcggctcggggagaggtgccctcacccagcgctggcaacccgggggcagctggggcgcggcggcgtccgctgcagctgcgcgcgaggaggacccggtgcccgcgcgctcagcttggcccgcgcggaggagcccaggttgtgggaagactagacctggaccccgcaggggtggccttctgtgcccctccccgcccccagacaaagctccttcctgacactcctctggggcgaacgagcatcaggtagccaatctacacccctgcaccccccccccaaaaaagttttaactagaagaaggggtggcaaatgcggcgtggtcttttccaaccccagcgccgaggaggaagtgcaagtcccgggaaagttcagttcccagagccgagagtggctggaaacttcacactaacctgacttaacctggaaacgtggagcgcgtactccgaacgcacccaaggcgtccaaaaagagaccacactaaagaactcgcgtgggagaagaaaactggggagaaaacgaggcatcgtcgggccacccagcgacccccctcccccgcagctttctgggtcttcacccaggctggagacacaacccccacccccacccccgcaatcccgccccgccgccttcccgctgctccacctctagccagaggctggagagggagggggccggagagggagggataatagagggcaggaaagagcagggccgtctgccctttcctccacccggggaaagaggcccgcagagcccagaggcagcagggccagggtccgaccccagacgaagttggagctcctcactcttaccccgccctccccgggaccgcccgcaaagcagaaagtgaactgcgcgtcctccttggccgcagagaggtggaggcggggggttgggggtgggaggtggggggaggcggagtgaaggaaataaatgagtctttagcaaataaagggcggctggaagggggcgggtcgcttggtggtggctctggccggcccggagcggagctctctcctgggttttgggctctctcgcggttaactggaatcaattacttgccttgtcatttctagcactcatccttaagcctcaaccaaaatattgacctaggaggcttacagaagttgggctcttgccatttgaaccggatcttgtttaggcaaccaccaacgatggaaaggagagatttccgcagctcggccttcgccccctcccccttttccaaaggcgccacaaatcgccaattttccggcttgccgggggtgggcgcgcgggggcggggaggtaggaaccggtgaatgttaaagaggattttttccctcctcctggtttctgttttgttttctcccctcctcctccccacccccaccttttttaagatgcaatttgttaaaacggccctttcaagtgtgtggactcgcgagcgacgcggtggccctttgtatgtaaatactgggtttaaaaaaaaaaaggctcgccccgtctttgcaattaattgacacgttacacctctcatcttgctctagagggccgttggctgggagcgcggagctccccaaaacccacaatttcacatctgcaaatactgtcttcatccacttgactcccaagacccgcccacacgtggccaacctttgcgtttttaatgtctcttcccccttttttccacccttctcccgctccctctctcgctccccctccctccctctttctttccctccctccctctctttctccccctctccccgcctccccaggttcgtgagtggagcccagccttatatggactgatcgctcgggcaatggcccattttttcctcgccaccagccgccaccgcgcgccgagcggccgccggagcccgagctgacgccgccttggcacccctcctggagttagaaactaaggccggggcccgcggcgctcggcgcgcaggccgcccggcttcctgcgtccatttccgcgtgctttcaaagaagacagagagaggcactgggttgggcttcatttttttcctccccatccccagtttctttctctttttaaaaataataattatcccaataattaaagccaattcccccctcccctcccccagtccctccccccaactcccccctcccccgcccgccggggcaggggagcgccacgaattgaccaagtgaagctacaactttgcgacataaattttggggtctcgaaccatgtcgctgaccaacacaaagacggggttttcggtcaaggacatcttagacctgccggacaccaacgatgaggagggctctgtggccgaaggtccggaggaagagaacgaggggcccgagccagccaagagggccgggccgctggggcagggcgccctggacgcggtgcagagcctgcccctgaagaaccccttctacgacagcagcgacaacccgtacacgcgctggctggccagcaccgagggccttcagtactcccgtaagtagcaaaacttggctgccgaggccgtggtcccctccattcctgcagccgcagcccgggttggacgctgggagtgaaaggggaaggggccatgtaagcccggaccccctcactcggatccgtagaaagatttttaacacctgtataggatgtcctctgccctcctcttcaagcctccttagttccgggaaagaacttggtctccaaaatttttttcaatgcgagaagttaaggagaaagagggagaagggctatacctcccaggggctggtatatgatgtcaacccggaccgatggctccagccgcagcccccggactccggccgctgggagggactggcctggcgccctggaggtagccagcgagcctcgtccgggtacgggtggagggtggggaggcttcgggtggcccgggtataaatagctcaccctgccccctgcgcgatcatagaggacgctttgtgcagtgcagggggtgtctagaaggcccgaaagcagaaacgaaagcccccaaaaacctgccttaaatggccgagccgatcaatgctgggattgtggggtatttcttttaaaaatctgcccacgtctcgccggagaggaaaccgcttaagggcgccggagcccttaacccgcgatgatcttcagtgccacttccccccccaaattctcacccacactatgtgagccccttgaaaggcgagcccctagcccccactcctacggatttccctctttaccctgggaggtcccgacgtcttcgtcaggcgtagaggaaggcaggggtcatggcaaaggcagcggggctgggctgccaggcgcggaggtccagggtcgcacggaggatccagggtgctccgagtctggtgcaggctgcgcgcggcctccagacgcctgacgcgcttctctctccccctccccccagtgcacggtctggctgccggggcgccccctcaggactcaagctccaagtccccggagccctcggccgacgagtcaccggacaatgacaaggagaccccgggcggcgggggggacgccggcaagaagcgaaagcggcgagtgcttttctccaaggcgcagacctacgagctggagcggcgctttcggcagcagcggtacctgtcggcgcccgagcgcgaacacctggccagcctcatccgcctcacgcccacgcaggtcaagatctggttccagaaccaccgctacaagatgaagcgcgcccgggccgagaaaggtatggaggtgacgcccctgccctcgccgcgccgggtggccgtgcccgtcttggtcagggacggcaaaccatgtcacgcgctcaaagcccaggacctggcagccgccaccttccaggcgggcattcccttttctgcctacagcgcgcagtcgctgcagcacatgcagtacaacgcccagtacagctcggccagcaccccccagtacccgacagcacaccccctggtccaggcccagcagtggacttggtgagcgccgccccaacgagactcgcggccccaggcccaggccccaccccggcggcggtggcggcgaggaggcctcggtccttatggtggttattattattattataattattattatggagtcgagttgactctcggctccactagggaggcgccgggaggttgcctgcgtctccttggagtggcagattccacccacccagctctgcccatgcctctccttctgaaccttgggagagggctgaactctacgccgtgtttacagaatgtttgcgcagcttcgcttctttgcctctccccggggggaccaaaccgtcccagcgttaatgtcgtcacttgaaaacgagaaaaagaccgaccccccacccctgctttcgtgcattttgtaaaatatgtttgtgtgagtagcgatattgtcagccgtcttctaaagcaagtggagaacactttaaaaatacagagaatttcttcctttttttaaaaaaaaataagaaaatgctaaatatttatggccatgtaaacgttctgacaactggtggcagatttcgcttttcgttgtaaatatcggtggtgattgttgccaaaatgaccttcaggaccggcctgtttcccgtctgggtccaactcctttctttgtggcttgtttgggtttgttttttgttttgtttttgtttttgcgttttcccctgctttcttcctttctctttttattttattgtgcaaacatttctcaaatatggaaaagaaaaccctgtaggcagggagccctctgccctgtcctccgggccttcagccccgaacttggagctcagctattcggcgcggttccccaacagcgccgggcgcagaaagctttcgattttttaaataagaattttaataaaaatcctgtgtttaaaaaagaaaaaaagaaaaaatccctgccctcccgtttgtcctactgcgccgggccggaggcctgggcctgggagccgggcccggccgcccgcggggctcccacaggcggttcctctcgggcggggaggccgggggtaccggggccctggggcgggcggggctcccggtgcaggcccctccgaccacaggctgcaccccgcgcctaggattggggcggggaggagaacgctcggcctccggcctgcgagcggtcggccggaagcccagggccgcccaccctcccccgcatctcccctggtctcgcgcgctgtctgaaccccgggcggcagcgtccggctacgggaggaaaagtgacttcgggagccgcaaaggcgaggagagcaaacccccctcgctggcccaaatctatgagtggctccttcagcctgagaagctgttgaagccactacactcgatgactttcactttgttacatttgacttacctcacgctaagaaagtgggtgggtgggggtctgaggttaagactggctgccttctccccactccccactccttttcaaaatctgcgggctggtgctgacctaggagaccgctaaggctgggggtgggaacggtcagggcgcgcgaggctttggcttagggggcttgggggaagtacgcggggttctgggctcgggggagggaggggatactgcagccctccctaggatctttggccccaggaagccagggagcgagaatctttggcaatcccagcaaaccatgcctctcccttcccttacgctcccatcctttccgggcttccaggcctctctccggggactggatcccgggcctccttccctccagcgttcggcggtccgaaccagggtgtgcggtccccccaggtcagcccttgagcgtggaactgggtggattgctaggaagtagaggtttgggggtggggtgagctccccggatgggaagtgggcacacagccccgggcacgcccgggaagggcgcatccatctttccggcggggaacggattccgtcccacccttgttgctggaggaagatctccttggcagatgctggcgcacacttggccacgcgggggagcgtcttaggaagcctggccaactggaggatgagcctttctcctctatctcgcgggtttctaaaaatacttgggactctagctcagagcccagcgggtgctgcagacgctgagggactgaacgtcggcgcatttggaaattgtatctctgttctctccgaagctgcaccatcaaggctggggggttgggtggcagtgaggaggccgggcaaaaggagcggtcccagctgactttctcgctccctgtagttgatgatcaggtttaattcaatatctaaagcaaacatgattatccgtgcgaccaaatctgtgcgtcgatagcactctgcgcagcagcccagggacgcgatgacactttattcccgcgttccacaccgcccctggataattgagggctcggaagtctttctaataccccagtaaaggtcctttcccatctccgggctcatcctcggggaaagggcagtttttctaaatgctaaaaggtctccctttgttctccacactagcttggcaatgtttgggggcttatgtcttactgtttttaaaggccaacgaatttctcccaaatagtttgttgtgcaataattgaacgcccaacctgccctggtactaaccactcaacatccacttgcaacttcccctaatcccaaaatcctcttgggaggaaaggtgagggtttcaagtctcttggagcggagctgtcagaaggcctgaggccattttgacttttccaggccccagggcttccagggtgagaatgatcacaagagaccctcaggtttccagagaggaagggggaagcgtggaaggtcctcaccctggcaggcttccaccacttgctcattgaggacaaatttggagctgtggccaggaccgcgggcctgcaatctgggtgtgcgctcctgtggccggccgggagcccgggaggtggacccggcgcccgcctctctctgtcctcgggtccccatggagtcaataaaagcgcctgcggagccctgtgtggccctaaccccagcgccctgggagcgcacccggcgcggggtccgcttcagcagtctatcttcgcccaatctacagcgggcggtacaaaaccgcacaatgggaaagctgggagccggagatgttagaggcgtgcatattaaaaagggacagagaaaggatcgcggggacagagagaggggaagaaggagaaggggcccgccccccaccccccgccccaccccgcaccattcagcgcgcttatcgccggcagtgaatcccggagtcaggcagaagtctccttggggttttgttgggcctgtcactgggtccctttgtcatccacgggctccatgctggattccatatggccagctgggccgagggagcgcgaggagggacccgcacaaaacctaaattgtgtccggctttcaaaccctgtattgttgtctgtgaaaggaagacgcattaaaaattcgtgctatatctattggggaggaggctggaggaggggagaaaaagccacccctgtctttgatggcttcggagggcgcttgccccgcctaggccccgtgacactgaaagttggatctctctcattctgtctctctctctcaaaatctctctttttctctcttctcataatctcgctctcataatctctttctctactttcataatctctttttctcataatctctctcccttcctcacttctctccttcctctcttctgtctccttgactctaacgctgggatgggagtccgcgaacctgcgtcttcagggtttggctcacttgtgcgcactttgctcactgctgtgtgtgtatcaggaaactaacttctgcctgggagctctgcaccatcggaccgtcctggggctcaggaggcaactcagggtacccagggcctgggtgatgctcggtcccctacgggcttagcggctcctgggtagatgaaaatccaccccctgatttcgcaaccgaccggccccgaagcgcccgcgcgcggagccgcccttccactcaccgcgagaaaggttctgagaggccaagggtgccgctcagtcccgggcccagctagacttgggctgcagccggttccaaggcgacttgcgcccggccggaccacttggttaccaaccccgaagagctaaagacgcgcgcgttcctttgaattatgcgcggggatccatcccactggcctcttggtgcgatgggaaaccacttcagaaacttcttccaacagcgtctctccccatgttggaggagggagatacttcctctttaattttcaatgtctcctgtatcgcgtgcttacaaaattcagtaccagggagacacagcagggcttccaaggaatttgcccattttttgcctcctctaagcggtccaaattggcgcgaggcagtcggaaataatttgggtcatgccttctcccctgcaattgccaggtcaaaactcccataagcagtccccaaataaaccatatgtactaaacaaaaatagtttatgctgagctctgtggaaataaaaactggaacccagatatgttccccacaaagtcactcggcccttaatgagcagaactgagctggtggaaattccgactaatgggaaacttggatgcgccccctttcctatttagtacaacggtcatatttagtagaatcagataatttggtaagagtggaagtcccccttcccaacattccccacctcagatggggaaataacttatttccttacctattgactgttgggcttagttgagacctggtgtgtatttctcgagccttttcaagagcctggtcattgaaaagctaatccaatatttaccgagcataaggacagttctcagacgtatttattaaggcccatcgctaagtgattacttggactgaagacaaaggccaggggagggggcgtctaggcataccagatccttctcatttgggctctccccacccagaaccaggaaaccgggagcgcgcttgtgcgctgctgaagttcccctcccggtgttaagtggcgggcggattagatactgtgctgggcggtatttcaggaaatatgtacttgtggctccctgagaggccaagcgcagtgacactctaaaccgtgtcgatatatcatcttttatccaggatctgcaaataaacccctgatccccccggcgcattatagccgccgctatctcgccaaggaagcgatctgagttttattgctttcaccaacgccccgagacacacacacacacacacacacacacacacacacacactcctctctcgcactctgatttttaaaggctctattttttccctcccgaggcatcgttattaataaagaggcgaataggcctcagcgccgccatccgagcaagcggggaaatgtgggccagcagcccaggcccgcgcgcggatcccgcgtacgctccacgcgccccctcgggccggagaaccgagcgtgtgccgcgtgctgccgccgccaggaggcgcccgagcccagcgttcccgagcgtctctgcgcgcgggtccgggcagagcccgggagccgccggaggcagctgcgcatcagcggactcgcggcccgggtcggagcccggtgagtggtgccaagaggtggcggcgagtcggaaccttggggagagccgcgagtcagacggcggcgggtgcctgggaggtgcgagtcgacctgtgttcggctgtggttttcccgccatgcctcttctcctccacgtgcgtaccaccgcccgtcccagccccggtttccatcgtgtttgggcacagaccacagccgactggtccaggagcgctctggccactgggagggccccaccaggcgccagggcgcgctgtctccgcgatctcagggcccctggcggcgtcggccgcgcgggtggacgcggagagggcggtgctgcgagggcccggagagtgggtgcccgcgtggggaggcggcccgggagcgcgggagcgatgcggaggagggacccggtttggttgcaggtttccggggcgggggttccgggaaggagagaccctcgccttccgcccgccctggatccgggtcccgccggacccccggctcctgccgttcgtcgcctggaagcggggcaggcgcacagtccagacgccagggagagacgcctcgccgacccagaccgtggggtcagggcccgggaggcaagaacgccccacacacagcagggcaccccaggcaaccctcactccgtgctgaggcctcggctagggtgcaaaggtgtccgggaatggaagggacacgagggtgtggacgcctcgcactctactcacgcctggtgccttctgagaggctgggcgtggggcagagggtaggggacaagggggtgacattccttaaggtcctccccccaacaaaagtagggcctgcagttccagcttgattcgttgattgttgggtggaaccgcctcacatcaaaggcatcgtggctccaaacactgtcccctttacttttctaagcccccgcttcaaaaccagctgtcggtgggccggtgagggcgtctgcagtacccaggctttccgcggggcggcgcggttggataagaaaaggcttcccggctggggcgcgcagcgcagctcagacacctgcgggactcgagatgtctccgcga

SEQ ID NO: 5898 - DNA, 810 bp, Homo sapiens
cgagtgccgacccgcctgggcgggaccctttgagcgcatcccctccgagcgcgccagtgtctctgggagaggcctgtctgggtgagggactggacgccggcctctccgcaagtcggccggctgagggtgggggccgaggcggggtcgggaacagccctcggaccagggcccagacaacctcgcccggcgcctgcctccccgcgcgcacctgccgggcccgggggctgctagaagaggccgcagcccgcgccctccgggctcccacgccccgcagcggcgccccctcccccggcggcacggattggctgcggcgccgctccaagcccgcctcgcgctgccggcggggggcgccgcggaccagagcgcgctgcgccgccaccgccgccgccaccgccgccgccgccgccgccgccagcagcacagcgcgcctcgggctccgcgcgccgccagctcctggcccgcccgccggccccgccgcgcccgccagccccgcagcggagcctcggcccggccccgggccgccgccaccacgccgcgcgccgtactccgcgtcaagaatggggcggccaagctgcccaagccgcccgccgccgccgccgccgccgcggccgaggcgcccggcgccggcgcgggcatggagcgctcgcagagccgcctcagtctgtccgcctccttcgaggcgctcgccatctacttcccgtgcatgaactccttcgacgacgaggacgcaggtaagcgcgcggcccgccccccagacccccggggtgtcccgggatccaggtccggtagccccctccccgacccgtgcgc

SEQ ID NO: 5899 - DNA, 1142 bp, Homo sapiens
cgcgtggagcgcggccccggggcagcggagagtggggttttaatatctagcacatgtagaccctggggcggtgctgctaggggcgcggacccgggaccaccggagcacttgcaccgcggggaaagctgacagggcgcgcgaccctaggaggctgccgcgccgcctggtgcgtgaagctccagggcagcggagcgcggggaccttgaaggctgtcgcgtgcaggcgaaggggccgcagggtggtcgctcctgggagagcagacggggaagaaggcaacgggagggagggcgtagcgcgagcagtcccggacgcgggctcaggaactggccgcgaggagcgcaatccagcaggcgcgccagggcccccggatccaaggtgcggggtcccgattgggcgcctggacgccccgtgacggtggcgccgctgccactgtcccgaagcgaggcgaggccaggcgctgcgctttcggctgcccgccccttctccccgccccgcgctcagtcccctccctccgtcccgcctcctgcctcgctccctccctcggcggctgctgcgccgcgctcccggcgcactcggagcccggcggggaccgggaggcagagacggggcggccgtggctccgagggcgggagctgagccgggccccgggaccgaagtttggcggcggctccgggaggcagagcgggctccccgggcgacttccaggcccctctcgcgtcctcgccccggacccgtgggcagccggggggaacggaagccgcggccgggccaactccgaggcggggacgccgcgacgggaacttgaggtgggaactttgcgcgctgcagcctcgccgggcgccaccaaagcgcgaaccggaccccgagcctgcaaactcgggctcgggggcggctgcacgtggccgtggccctgaactccctgcgggggcctcgaaacccgcctgcggggaggccagggcgacagaggactcgggagtcaccgctggtgcgtggcggcgtggagcgcgcttgttacggccaaggtgcgggtccggcttcggttcatcccaaggggtcaccgggatgcgaagtccgggacgttcgccgccgcggtgaccccggcgggggcgcatcccggctgtgggccgaggtttctcccccga

SEQ ID NO: 5900 - DNA, 2885 bp, Homo sapiens
cggaggctccgggaaagcccaccaagcctcacgcgtttcgctgatagatgcccaggaagcggctggcagggaagaggcggtcctgcagctcacagagctcccctcccacccccggggagccccaggccgcgctgccctccaccttcccgccctccccggcctgcaacgctcgtggcgtttttcaacaggttctagaaactccctctcactctgcccctcaagcctggccacagggcgccccgagcagggagtgtgcgggctccgggtacacgctgcgccgcggctgcaccagagcgcccacgaccctgaccccgacccgaagcggcccctcagcgggacagggtgttggcgctggcgctgctgctattgcggcgcgcccccccgctctggcccctgcgtgtcgccagggactcttgcgctagggtcagactcaaagacggaccgaggcgggtgcccacctgggacgcgtgcgtttggtggcggaatccccggggcggccggaggcggcggccggggagtcgagaagcaagtactagcgctccaggaccgcgcgcgccgccccgcgccgccccgcgccgcccctcggtccagagcccccacccccggcctgtgagcctgcggcgctggtggagcccggctccaggaagaggagctcacccggtcccccctgattggacagcagcgaggtcccaccgggcgcctccgcggcttaaaaccgaagcgggggcgagggggaggtagagcccgccccctgcgcgtcgcggctgggagggagaggaggtgggagagaaggaagaggcggaggaggcagcgggcgccgaggctctgggacccgcaggcaagccagaccgacgcgcagagccgggagcctcatcgcagcggcagcggcagcggcgggctcgggccggcctcgggggctgctcacccacatgagcatccgcccacccggcgagcccccgagcccaggcggcgcggccatggccgagctcaagtcgctgtcgggggacgcgtacctggcactaagccacggctacgcggcggcggctgcgggtctcgcctacggggcggcgcgagaacccgaagcggcccgcggctacggcactccgggcccgggcggcgacctccccgcggcgcctgcacctcgcgccccagctcaggcggcggagagcagcggcgaacagagcggggacgaggacgacgccttcgagcagcggcggcggcggcgcgggccagggagcgcggcggacgggcggcggcggccgcgagagcagcggtctctgcggctcagcatcaacgcgcgcgagcggcggcgcatgcacgacctaaacgacgcgctggacgggctgcgagccgtcatcccctacgcgcacagcccgtcggtgcgcaagctctccaagatcgccacgctgctgctcgccaagaactatatcctcatgcaggcgcaggccctggacgagatgcggcgcctggtggccttcctcaaccagggccagggcctggccgcgcccgtaaacgccgcgcccttgacgcccttcggccaggccactgtgtgccccttctccgcaggcgccgccctggggccctgccctgacaagtgcgccgccttctccgggacgccctccgcgctttgcaaacactgtcacgagaagccgtgaccgcgcgggcccccggccctcccgcacgcgtcctccgatcgcccctgtgactgtctctctgcccggacaggaaaggcctggagggaccctgcagaccaggaggagggggcccgacttcgcttccagcctgtgcgcggtggacagtttagcgcagcgggaagcgccaaggccgtcggggcgcgggattgagctcgagagccggacgctggactctgcgcccgggaactcgcggcacccactgggtattgtcgggacccagcaagtctaggaacgggggtgggtagagcatccttcgggcactgccgttcgtccccaaaagaagaccaccgcggggtcccagggccacggcgaggacgggcactggtcagattccggacaggcggtcctggccccgggcgcacgaaaggtggagacgaagaaaagccggacttactggctcctgatcctcttgcagtgggcctcgcgctcccgctccagccggcccttcgtgctaaactgcagggcagtgctctgttcctgaggacgcgcgtggccggcacctcccacctcggtgactccgagactccgcagccctgcggagagcccacgatggccgtctgcagaggagctggaccgcgggcgcaggaagaccccggggaaggccttttccaagtaggagtttgttctatttatttgggaattggacgccgtcgccggctgcctcgaagtctgaggaatttgtcccctaaatgtcccctggcctcccccccccgccgccatccgctgcctgggacgtccgcggggtggagttggatggagaccgctttgcgggccctctgcctcggggggctgcgtggaggagggtcctcacagcccgcgccctacttaaccctgacggtcaggggagggccccgtctagccctggtgtccagcaaaccccctccccaccgatcccctctcccttccgagggaggaggccgggctacgggtgagtaagctgctgcgggccccgtgccccgccgggtgtgaacggagatgcgctgcgcagtgcccgtcctgcgcagctcccagctctgccaccatccgggatccagggagccgggcagggtgcccccggggacccatctgtccgcgccggtttgcgccccgcggccccgccgcagtatccggctttattaacccaatttcctcggctgtcggtaatgccaaggggagagggccgccgccctgcaacgcgcctgtctacagcgt

SEQ ID NO: 5901 - DNA, 1460 bp, Homo sapiens
cgcgcccagctggaatgcagagatcgccgcccggctacggcgcacaggacgacccgcccgcccgccgcgactgtgcatgggccccgggacacggggccgccgctgacacgcgcggcctcgccgccggccccgccgccctcgccgcgcccgccgcgcccgcctcgccgcccagcccgcagcgcagtcccccgcgcagccccgagccggggcgctatggcctcagcccggccggccgcggggaacgccaggcggcagacgagtcgcgcatccggcggcccatgaacgccttcatggtgtgggcaaaggacgagcgcaagcggctggctcagcagaacccggacctgcacaacgcggtgctcagcaagatgctgggtgagcggcgggagggcggcagagaagggggagagggcggggggggctcgggccggggtggggcggggggggcaggggtcccgggccgcggggtgcgggggctgcgccaaaccctcgcggggcgtcccgggcgcacggagggctcggcgcccacccgcccgacggcgttccactcactggcgcccacggcccgcaggcaaagcgtggaaggagctgaacgcggcggagaagcggcccttcgtggaggaagccgaacggctgcgcgtgcagcacttgcgcgaccaccccaactacaagtaccggccgcgccgcaagaagcaggcgcgcaaggcccggcggctggagcccggcctcctgctcccgggattagcgcccccgcagccaccgcccgagcctttccccgcggcgtctggctcggctcgcgccttccgcgagctgcccccgctgggcgccgagttcgacggcctggggctgcccacgcccgagcgctcgcctctggacggcctggagcccggcgaggctgccttcttcccaccgcccgcggcgcccgaggactgcgcgctgcggcccttccgcgcgccctacgcgcccaccgagttgtcgcgggaccccggcggttgctacggggctcccctggcggaggcgctcaggaccgcgccccccgcggcgccgctcgctggcctgtactacggcaccctgggcacgcccggcccgtaccccggcccgctgtcgccgccgcccgaggccccgccgctggagagcgccgagccgctggggcccgccgccgatctgtgggccgacgtggacctcaccgagttcgaccagtacctcaactgcagccggactcggcccgacgcccccgggctcccgtaccacgtggcactggccaaactgggcccgcgcgccatgtcctgcccagaggagagcagcctgatctccgcgctgtcggacgccagcagcgcggtctattacagcgcgtgcatctccggctaggccgccggcgccgcccgggtccctgcagcgcttcctcccgcagcccccgcgaccgatccgaccgcgtcgctgccgctctgctctctcatacgcgt

SEQ ID NO: 5902 - DNA, 1560 bp, Homo sapiens
cgttctccaaccgaaccctccctcctgggaaccgcagcccagcgcggtaactgagttaccgcaaccgggcggtggggaggaagggtggtccaggaaaccggcgagggagaaaagcggtggaagggagagtcttctccctggagcggccccagcagtacaaagtgctggtcacagcgccccttccgcccctagattgacgagcagtggcgtggagccagcgcggaggctgccccctccccctcccgagcccgcagcgcggagcgcggtttagcaccaacggagccgggggcggcgtctttgggatggaaaagggccaaaggggaggagtggggtgggggtgggggtttcactggtccactataaaaggaccgctcggctgcccggttcttgcactcgctggaaagcggctccgagccaggggctattgcaaagccagggtgcgctaccggacggagaggggagagccctgagcagagtgagcaacatcgcagccaaggcggaggccgaagaggggcgccaggcaccaatctccgcgttgcctcagccccggaggcgccccagagcgcttcttgtcccagcagagccactctgcctgcgcctgcctctcagtgtctccaactttgcgctggaagaaaaacttcccgcgcgccggcagaactgcagcgcctccttttagtgactccgggagcttcggctgtagccggctctgcgcgcccttccaacgaataatagaaattgttaattttaacaatccagagcaggccaacgaggctttgctctcccgacccgaactaaaggtccctcgctccgtgcgctgctacgagcggtgtctcctggggctccaatgcagcgagctgtgcccgaggggttcggaaggcgcaagctgggcagcgacatggggaacgcggagcgggctccggggtctcggagctttgggccagtacccacgctgctgctgctcgccgcggcgctactggccgtgtcggacgcactcgggcgcccctccgaggaggacgaggagctagtggtgccggagctggagcgcgccccgggacacgggaccacgcgcctccgcctgcacgcctttgaccagcagctggatctggagctgcggcccgacagcagctttttggcgcccggcttcacgctccagaacgtggggcgcaaatccgggtccgagacgccgcttccggaaaccgacctggcgcactgcttctactccggcaccgtgaatggcgatcccagctcggctgccgccctcagcctctgcgagggcgtgcgcggcgccttctacctgctgggggaggcgtatttcatccagccgctgcccgccgccagcgagcgcctcgccaccgccgccccaggggagaagccgccggcaccactacagttccacctcctgcggcggaatcggcagggcgacgtcggcggcacgtgcggggtcgtggacgacgagccccggccgactgggaaagcggagaccgaagacgaggacgaagggactgagggcgaggacgaaggggctcagtggtcgccgcaggacccggcactgcaaggcgt

SEQ ID NO: 5903 - DNA, 5118 bp, Homo sapiens
cgcccctcctcgcgacagagctcccgagcccagcgcaggccagtcctcgcttccccgcggcccctggctcccctgtcgccagaacgcgccggcgccagtcggctcacttggcgtcggaggtgaggcgcggcaggctgccggcgcccatagccgacacgtggtggtgcggcggcggcacctggcacatgctgcaggggcagggcatgccgccccagtgctggaagcccccgctcgccccactgccgccgcccccgccccccagcggggcggccgcggcagcagacggagacttgagtaggccgtgcggtggacggatggagccgaccgacggcagcccggatccgggcagagaggcgctggacacagccgcggctgcagcggcggcagcagccgctgcggcggcgggcggcaggatggggtggtgcaccgcggggtgatgtgcggcgtgcgctgctgctgccgggtgcgcggtggcggcgggcaggggcgcggagtgcgccaggccgccgcaggccgacgggtggaagccagcgtggtggcccccgtagatctcgctcaccagtcgcttcatctcctccagcgagttggtgagcatgaggatgtagttgcgcgccagcagcagcgtggcgatcttggaaagcttgcgcaccgaagggccgtgtgcgtacggcatgacctcgcggaggccatccatggcgatgttgaggtcgtgcatgcgcttgcgctcgcggctgttgatcttgagacgcagctgctgcagctccggctctgtcatttgcttcttgtccttcttggtggacgacgcagccgccgacgacgtagacgacgaggtgctggacgaggatgacttgaagccactgcctcctagcttgtccccaggatgcgcgcccgcagagcccatagcgccgcgcagctcggcgctcagctccggcgggcagtcactcggggtggacgaggacacggtgcccccagtgaaggcgctgccgctgctgcccttactccgggccggcagaaaaaggtcatcgggctctggcgacgacgggcggctggacaccaggctggcgtccgagtccatggccccaggggaagatagtcgtcgcagctttcgcagggtcctccttccctcggacccgaaaacttccaggagaggaggagaaaagagagagaatgagagagagagagagggagagagagagagagtgagtcagtgagagacagaaaagctgctcccgcctgcaccgcagtaccacagcgcggggtcccggcacaggtggcccgtggctcctcgtccccctcgctactatctctggccctccttttagctgcacgcgggtacctataattaagctctctctatctcccctctgctctcatgcaacaggttatttcagggagcgttggtgaccctcggggtgcgggtggcattctagaggcttcgggctttcagttaggtgtgggaaaactgagcccccgggctggaataaacgagtgggaagtgagggcctttctttggggagaatggagatctagatagagaactaatgatttggttcctcaaacggatccaccttatctccatcgacaccacgcagcaaacacacgcacacgcacatgcacccagagccggcgcggggcccagagtccatgtgctgcatctggagaccacggggagctcaccagctgactggggcttgggcagaaagagctgttgtcgctccgacttctcgcttttggtgagggagatgcagcggtgagtgtggggaggacagaagagcaaagtcgctctggagaaatggcccgcagagtagggatccagaccccctgtatcggagcattctgggtcacagccgagttgaggagagtctgtccctgggatctaggctgcggctgctgtggggcggggacacttactctggatgcgatttgaggagctcgctccgaaaagcctcaggggagaacctggcaccgggcgctggtgtcgcgtcgatctataataagcatccgcacctttaggggctcggccggtttttatagcccggtggcagcggcgacggcggcagcggtggcgggggcgggggcggggaacaatgtgcgtgtcctggaggggctgcctcgccaatgagctgggcccgccggggggctgggaagctgatgtcatccgggctaattccgctcaatgaaactcgccaggccgggcacacgcctcctccctgcgcacaaccaatgggcgcccgtggccgggagattcttggggagggactggaggagggacccgaggaggcgagggggaggagaagggcggctcaagggggatggagggagggctgagcgcgcttgggaccaagggagaaagggaacgtggtcaaatttctgtaaaaaatacggccaccacagagtcaggttgggggatgggatggtttggagactctgcagagtctaacaaactaacctgatgccccacgcagccgcaccttttgggatgcgcgcggaaaaccctggcgacccaggatccggggctggggtctcctccctagctcttcctctgtctggtttcccgccgcctgttcccatctcactggtttcatcaacacgtgggcatttggcgccccaaatgtaaacgatgcccaggcacaaagtccccactatcttggtgctctactcgcgcgtctaggagatggccgtggctgcagctccgacggcagccggtagcgcccccagctgggggcagggacttgaggggtagagggcgggcaaggagggaggggacggactccagaagagtgttttgaaagaattcacaactctcctttaggttgaggatggtgtgggtacagggacgagttatttccgcacggtaaccgcgctagcacaagggcagggtcgtgcctgtagttaaacacccctccatttattagcaggggagccggatgatagtaagtattttcagtgtcgtctttgtgatcaccacacgccttggggcaggggcaacgctggcatctgtagtccaagcagggctccgctgtaaaaggttagcaaagagccttccgtcccagtcgcctgctttctggaactgcaaagagaagtttcaggcctgggcaaggcttctccacgctgtgggccagacagcgagatggaaccactcgcgaccgcgttgggacatgttttaccgattgcaggctggctctgaaacctgaaaactcttgacgatgaggaattaagcccgaactggagaagcacctcacggaggtagctgaggtacggatgcattcacccattttacagatgggaaaagccagagaccgtgtgcagcaagcctacagaaaaaattgctaagcctttacagagcagccctgcttggactacagatgctggcgttggcggttccttatagtacaggcagccacctgtctcccccagtccctaatctcttccccgagctgaatttctcacacccatacatttcgaattcagacatttgtttctgcagatctcggatgctagcacttgacactgtgagcgcacgcgcgggcacacacgcacacagtctcctagggagtgtgaggaacgtcgggttacttccgttgttggggaacttttactgtgcaagtacggttttaaaaacaagcaaacaaattagcatagtaaataattggtcttcaagtagcaaagttacaaaataaacaaatacaaagagaaacccacgttattgcccctagttctgagatatgtctccctctgcggtctccgctagaagcccagcccgctctcgccttcgccccagtctcgtgccttctggagcattatttttcaatccgcgtgtttcccagctggctctgcagccatccgttaaatatgtatttaaaacatgaagaactgaagcgtggtgttatgtcgtccaacggttacaaggatgacccataaccgttcaattagtagaatctgtcactcggacgacgcagggagcgggggggtggggatcagaaagggctcgggcatttgtagatgcctccttcgggcctaccccgccaacagcagcgaggccatgtgtggtgcgcgctgtggggccaccagtcggggcgcggagttgtgcgcctgccagtgtagctaataaacaccagcaggcgcaacgtgcgcgctccttggttgcagccgctgaggttagtccagccgccggcacgtgtcccggaacccggtttctttttttgttgctgcccactggtgtctgtcctgcgaccgacttgcggcggtgagagcaagcggtctcaggttctttgcgcgctcggtccagtggctggagttgggagtcaggggtgaaagtcgaggggcccgtcttggcatggcgcgagtctagagcctggaaggcaaagtcggaagctctgtgctgctgctggccccttcttcacctggcaggcttccctcaacatcctcccgtcgccggagtagcttgggaggtcggggaggtctgtgtcgcccctgggctcccttggccctggtgccaatcggatgctgagtacctctcggtgtgtctcctatgcctccccaccccgtcccaggaataactagaaattagatcccggtgcccaagcttgccctggtgcgtcctggaggcgtccccaggacttgtccgggtcctgcgcccggcgcccggggtgggcgacctgggcgggtcccaggcactgcggttcccaccagcgcgcgcagctggggccccttcctggggaatggagtgctcatttgcagaggctaatgggccccggctccgggagttcctggttggcccccgcgtcctggtgctgttggcctcctccgtgtttttccctcttctttgtgtttctctcccacaaaagaccgggtgcgtgtcggggccggcctttgttggaccgccgggcggcccgggaggagcccgtgccaaaccggcgggctctcgcggggctccagggcgcagacctcccactgcttcccgggtccctcccgggccttctttctgattctctcccttcccttctccgagttcctgctcacattcaggctgcgtctcggcctggctgccaaacagaacgacgttcttgcgcagagctgaccaggggtggcggcgggaggcaaggctcccggcaccgg

SEQ ID NO: 5904 - DNA, 1423 bp, Homo sapiens
cgctgcgggacaggttcctagagatcgctccgggacggtcgtgacggcccccgagggacatgagagaagaggagcggcgctcaggtaagctggattttgcggtcggaattcgcgtagaaacgaaaacttctggaaggggcttagccccgagccccggaggcggacaagctgagcctcctggctgcaccctttggaggctgctggttgcagacgccgtcgtctcccaagggcggctgtcaccgcgtgcgtcggtcagaccaggccgcggtgccctcggcatccccgcgtcccggcggctgtatccggctcctccccacgaccgaggtcccgggcaccgcgcctctccctccggacgctctgcgcgacgtcgtcccagttctcatcagcatcgagggcagtccgcggtcattttataaacgtcttagtgtcgcaaccgttttcacttttactattttcaatgtttgcaacggttttcaatgaggctggaaaaatatcacttctcgctaaaagcgaccccgagttaggaggagcgcgcacccccgcggctccccctcccacactttccctcccctgaccccctctcctcccctctggtccttcccttgctcctcgcccctccagtagtcgcgtgctgggttcctttcctgctggggccggactctctcctccggccgtcccagcctctgctcctccgcctccctcctcctcttcctcctcctccgcctcctcctcttcctcctcctcttcctcccggagccgccagccgcgtcctaaacccgagcagggcgcgtagtgtccaaacctgcccgcgcggcccgcgctcttggccccgagggcgcgcgcacggacacgcgagcacacccacacccacgcgcacacggacacgcgcgcactcgaagactcccgcgcgctcgcacccacgcgcacctggccacgcgcgtgcattcccgcccacgcgtccctgccccgcccccggcgcgcactccgggttcgcaagtcgcgcgtcggggcggccgccctgctccgcgattggcgggagccggagcctccctgaacccggcgcccacaccatgggctgagcccgtcggcgccgagggagttagtgcgacccggctcggcgcgcacggccaaggcacgcgcgctggcacacgcgggcgcggacacgcgcggacacacacgtgcgggacacgccctcccccgacggcggcgctaacctctcggtaagtccagcgccccacgcgacctgcccggctcccacgctggctacagcggctgcggggacggggaggaaggcagcggggtggccctaggggctcactctgcagggctcttccgacggcgccgggacaggtggggcgtccagcgccgggagggacggctcgccagtgcggggtcccagggaggcgcgtgcagtcgggtgcgg

SEQ ID NO: 5905 - DNA, 1384 bp, Homo sapiens
cgagcgccttctgaagtgacggggccgggacgcgcagggaggcggcccaagaagcgcgccctaggccagcccagaatgcgctcggccgcgactaggacaacggcgggtggggctgggggcggctgccgggcggggagcggtcccgcgccctcagctacccctcaagagccgttgtttccctaacttcagctgccagaggctctgtgattggctgcggcacgatgacccgcgcacggattggctgcttcgggccggggggccgggcccgggggacagaatccgcccccgaaccttcaaagagggtaccccccggcaggagctggcagacccaggaggtgcgacagacccgcggggcaaacggactggggccaagagccgggagcgcgggcgcaaaggcaccagggcccgcccagggcgccgcgcagcacggccttgggggttctgcgggccttcgggtgcgcgtctcgcctctagccatggggtccgcagcgttggagatcctgggcctggtgctgtgcctggtgggctgggggggtctgatcctggcgtgcgggctgcccatgtggcaggtgaccgccttcctggaccacaacatcgtgacggcgcagaccacctggaaggggctgtggatgtcgtgcgtggtgcagagcaccgggcacatgcagtgcaaagtgtacgactcggtgctggctctgagcaccgaggtgcaggcggcgcgggcgctcaccgtgagcgccgtgctgctggcgttcgttgcgctcttcgtgaccctggcgggcgcgcagtgcaccacctgcgtggccccgggcccggccaaggcgcgtgtggccctcacgggaggcgtgctctacctgttttgcgggctgctggcgctcgtgccactctgctggttcgccaacattgtcgtccgcgagttttacgacccgtctgtgcccgtgtcgcagaagtacgagctgggcgcagcgctgtacatcggctgggcggccaccgcgctgctcatggtaggcggctgcctcttgtgctgcggcgcctgggtctgcaccggccgtcccgacctcagcttccccgtgaagtactcagcgccgcggcggcccacggccaccggcgactacgacaagaagaactacgtctgagggcgctgggcacggccgggcccctcctgccagccacgcctgcgaggcgttggataagcctggggagccccgcatggaccgcggcttccgccgggtagcgcggcgcgcaggctcctcggaacgtccggctctgcgccccgacgcggctcctggatccgctcctgcctgcgcccgcagctgaccttctcctgccactagcccggccctgcccttaacagacggaatgaagtttccttttctgtgcgcggcgc

SEQ ID NO: 5906 - DNA, 1361 bp, Homo sapiens
cgccgaggatgtggcctccgccccccgcagccgccgcaggagcttctgcctctaaagcggcaggcaggggtctcagcgggcccacttcaacctgggaaggccggtgcgtttccccacagaccccgcagggcgtttcttctggggaccactgaagccctggcatccccaaccccagcccctccgcgccacgggaaacgaagacgacactcttttgaacaatcccggatgtgtcaccacagaggggcattctacactggcccctaccccaacccccacctagcacattgcttgcccacccctcaaaccccgtgcggattgcggtacctagccccgggggaccctccagccctgccttcccgatccgcgtaggtgcgtccgtccacctaagggtagggaggcatgtccctccgggtccctccggccgcatggcttgcctgcccccctggtctcccttctccgcatcaggaggggcgtgagatagctaggtcgacccccaccccggcagtctgcggcgatcggccgccccgagcgcagcgccagacacttgggttggggggtgtcagcctgacgcgcaggaagggcgcagcggcgggagggggcttcatttcagatctgggaggcttgcctggcgccggccctcgcccgctctccgtcggtggaggtcgcggctggcggagaccgccaagccagaggaggggatccgaggtcccggctgggcgaaggttctggagggggagaagacggccgaggcgtggaggggcagccgcggcggggcgacccttacctgctcactgcggggcctgtccgtggggccggggcagactccgcaaaggacgcgcagcctgcaagtccgcggcccgcgcggcgcggggatggggagcgtgtgcgccgaggagcgcgcgccgagccgggtctccgcgcctgtgtggccggctggcggccggggtccgtgtgtccctgcgcggcggcgtgtgcgtgtgcgcacgcggggaccacgctcgcccggagccgccgccgccgccgtcactccctgcccggggccgagcgcagcgccccctttgcccgccccgcgcggcgcggcagtccagcttggctccgtcctgcgggagaggcgccgcctccgccgcgaagccaggctgggcgctggagggaggcgaccgaccaccgcctccccctgctcacttcacaggctggggagggggtgctgcaggccaatgagcgcccgggggcggggttagatcgagggcggtgcggtggggggcgcggtggggggcgccgggctgctcaacccgaccccacccgcagcacagactggagcaggagctgcggcgggaaatcccagcggcgggggtcgggggcgc

SEQ ID NO: 5907 - DNA, 1175 bp, Homo sapiens
cggagagccgggaccccgaagtccccactgtccctgccgaggcgccggcgccgtcccctgtgcccttgaccacgccagcctccgccgaggaggcgatacccctccccgcgtcctccgacagcgagcggtcggcgtccagcgtggaggggcccggaggggctctgtacgcgcgcgtggcccgacgcgaggcccggccggcccgggcccggggcgagattgggggcctgtcgctgtcgccatcgcccgagcgcaggaaaccgccgccacctgaccccgccaccaagcctaaggtgtcctggatccacggcaagcacagcgccgctgcagctggccgtgcgccctcaccaccgccgccaggctccgaggccgcgcccagccccagcaagaggaaacggacgcccagcgacaaatcggcgcatacggtcgaacacggcagcccccggacccgcgacccaacgccgcgccccccggggctgcccgaggaggcgacagccctcgctgcgccctcgccgcccagggcccgagcgcgcgccgcgccccggcctcttggagcccacggacgccggcggtcccccgcgaagcgcgccgaggctgcctccatgttggccgctgacgtgcgcggcaagactcgcagcctgggccgcgccgaggtggccctgggcgcgcagggccccagggaaaagccggcgcccccacagaaagccaagcgctccgtgccgccagcctcgcccgcccgcgcgcccccagcgaccgaaaccccggggcctgagaaggcggcgaccgacttgcccgcgcctgagaccccccggaagaagacccccatccagaagccgccgcgcaagaagagccgggaggcggcgggcgagctgggcagggcgggcgcacccaccctgtagcaggctgtggctcgtccgcgcgcagctccctcagcttcgcagcgccgcccgccaccccacacctcccacgctaccgggcacgggcggcctcctattggccgggcaccgcgcggctagcggaggttgcgtctcattggctcaggtcctgcagccgctcctggattggagcagtgtgctctggcgggaagggcccatcccgttggtcgaggcctgacaggcgcttagcgggcgactccctccccattggccgagttatggagcgctccgaccagacagcgt

SEQ ID NO: 5908 - DNA, 1087 bp, Homo sapiens
cgcttgcagctcggccgcgtggaggtgaccgggcggaactccgagggggcgcggggagagctgggcgggcccaccgctccagcggctgctgtcaggggccgcgaggctttccctgaagatgcagcgtagcatattttgcacatgagttcagaggaagaggaagtgtagccggcggacgcgcggcggcggcggcgggggcgcgtcggggctggagccggagcgcgccgggcgctgggcgcagcgagcgagagcgcggcggccgcgggctccggcgagggacagacgcaccgatcgccggagggacagacacacgaccacgcggcgccaccgcccacgcctccacccaccggcgcccaagtcctccccgcgccgcctcctctgtatggcacaaactttcctcccgggacggaacacgctgcctcagggagcccgcgaccgcgccttctcctccgccggtcccatacggtaggcggcggggggggcgcgacagggcttggggtgtcgaccggcacaggcccctccgtttggccccatggaccgggtctctggcgggtagtgggaaccgcgcgtggcgcctccctgcaggttgctctttgccggggctccggagctgccagagcagcaccccctggcccgcgtcggatggggacctgggctgatccttgggacgcctggatcttgggccaacttttttttgcggggaacgggtgtaggggagtcattcctggagcgatgtagggagaggcacttcggagcagcctgttgggggtcgtaggctctgcaggctcagaagcgcctaggaaggacgcagaggtgggggagcttggaggctacaggtgggtccaggacacactgccgctggggtcctcggaaaagaacaggagggagctggtcgcggagtccaggtttccggggtgcgcgcggcctgggtggggcagggtggaggcggtgcctgactgcccctctgcgtgtgccctgggaggtgggtttgctctggggacagaggtgctggacgtgtaggagcagacatgccgcgcgctccgaggaagcgccggaaccaccagaagcacagggacgcgggtgccga

SEQ ID NO: 5909 - DNA, 693 bp, Homo sapiens
cggcctaggtacccgggcagagggatgatcccgcgctctgcgaaaagcaacaggcggctgcaccttaccttgcgccagtcccgggccggggtggctgctccatcctcgtggctcagggaggaggcgttgggtgcgtatgcttaggggtgtgcccgctgccagggctgcagcggccgccacctccaaccagctgcaagccgagctgcccacctgggaccgggccggcccggcgggcttggctcccggcgaaggcggcggcgttggtgcgcggcggctggggcgcgggacgcaggcagtgcgtggcgcggctggcgtcttcgggcgccgccaccgagcgagggtgcggccccgggcggccgtgcggggcacgacttggctcgcgttgctgcggcggccgctgcagaccctgctccaggcgccgtagccttgcaggaagagcagacaaagacaggagagaggcaaagcgccgcttgcccagagatgcagtcggctcagtcaatagagggaaatcgcctccaaacccaggctgggaatgagggaggaggggcgaggcggctggggactagaaaaagcagcagggaattaacgtgacagtcagagcccagccagtgcctcgccggcgctgctctctcgcctcgcggttgcggggtccggaatggagagaggaggcgggggctgagcgttggctgccgg

SEQ ID NO: 5910 - DNA, 5065 bp, Homo sapiens; identical to SEQ ID NO: 5878

SEQ ID NO: 5911 - DNA, 307 bp, Homo sapiens
cgttttgggggcgacatcgccggggaacttgatgatgggcgacggcgcggcggcggcgtggctcagcaggcagcccaggagacagagcgccctcaggggacccgtgagcgcgccccgggccattagcgcctccatcgtagcgctccctggccccgcgcgtcgcccgggggtcgctggctcggtgcgtgtggccgcctcgccgcctggttggagcctgctccgcggcgcagggctgcgctccgagggtccgctggctcggtggcctggggtttgcccggctcagcggctcatggtccggcccccgcgc

SEQ ID NO: 5912 - DNA, 1563 bp, Homo sapiens
cggtgctcccgcagcccggacgccagcgccagggactcgccacaacctcaagtcctctcccggggctgggctccgcacacaaacaggtagcacaaaactaggacttagttggggtccgcaccccttcctgctcagacccgagccgccccagtccccggccgccgcgcccggagtccgctccaactcggaaagtggcggccggctgcggggcaggcgggcggtacctgtgagcagctccagccggtgtcccagcaccttcatctcggcgcccggcgcggcccggctctgggtggcggcgtcggggcagcgcgctcggccgagccggggagaggagcgcgggagacccggagcggagcggcaggagagcgcggagcgaagcggcaggagcagctcacagccaggagcgctctcccgcccccaacgccgcgctcccccctccaaaacggtttaaaaaaatccaccaattgcatggccgcgcacccccaaaaaggcacccgccgccacctggtcccggtgaactccaggaggcggaggaagggcgcggggtgggtgcggtgacaccgtgggaggtggtcccccgtgcccgccgcccgaacaaagagaccccgccgcctccgggcgtcgcggtggggggtcgcggacggcggctgggggtccccagcgcggccgggaaggcgaggaaggagagcgggagccgcggggaggagggggcgccgcccccgcggaggcgaaatggggcgggagcgagtcggtgcgggactcgcggggctagggtcgtgcgtggggctggggtcgtgctcggggctgggctgggctgggcggggacgcgcgcagcagccgcggcggcgagagaagctggccctgggctcaggggcgagggcgccgccgactcaccgcggagatgcggacgagacagacgcgcaggcggggagcggggcttcggcgccgccgacgcgcgggtgcaggtgcgggcagccaggagcccctccgcgtgcccgcggctgcaggggcggaggccgggctgggggcggtgcgccgcgggggcgtgcccgcgtgggtttggcgggtgtgggcgctcggcccgcggggcggtgccgggcctggggctagtcccggacggaccgcggtccctcgcgcgtggcttccgccttctgcgcggctggggtgcccggtgggcgggcgggagggcgagcggggaccgcgacgcggagcctgggggacaccccggtcgatccgcgcccccgccgacttctcacccgctccgccgcgcggactgtgctgggtgcgctgcgaggccctgcccgcccctccaggccccctgtggccgcgcggcgtcgggttcccgggggaggggacggcgctgccgtagtctttgtttagactcccaaggggaaccttagacctgcagagacatccccatcccagcgcccctgcgcctgctgcttcgcgctacccgccgtcgccgcctgggaaccgagggagaaaagcccttagggtcgggaagaaccaggggctcaggggcctctggggcgtcgtccccctccccccgttttcggagcccga

SEQ ID NO: 5913 - DNA, 512 bp, Homo sapiens
cgacccgaggctgtctacccggcctggcatgtcccggcgctcctggggcccctgtactccgctggttcctcgctgtggtgtcccgcagcccgaccatttctgtgcttctaggagcccaccctgggcggcagggaggcgttgcgtggggctcacgagttccacgctgtcatctccaccagctcctacctcccaggcgcctgccctcccgcactgtcaggttctgcctccgcagcatttggcagatctgagcccggtccctgtcacccctccgcgggagcctcatagtgaccctggaggagaagcagcaggagcccacaggccaccgcgctcggccgcgcgtgaagtctgtgcagccgcatggtcggctcgctggtctcggttctctgccgacggacacgctgctgttcacccagaggctgccccgggtcggtccagccgtggatccagtgccttgcccagcctcggagtttggactgggcagggagtcggcggggtgcgctgacttgggccgg

SEQ ID NO: 5914 - DNA, 1070 bp, Homo sapiens
cggcgcccggggctcgactggtgggaggggtccggcagaggccccgcctcgagatcccagcacgccccgccccgctccacggtgtagcacagactccgcggagaacgcgagcatggtcggaaatcatcgcctttatttcttggcgggtctcgagggaaggtcgggaacgggcgggtcctgctggcctagagggcgtcaggggcagccaccggcggctcgggatcctcctcgtcgcgagcgcgggggagctcaggtccggcctgccgggggctgggtgaggctgcggaccaggttcctacgctcctcgcgtccgcccgcgtctgccctaggcctccaccgcggcttcctctgtccccggggccgccctgctccccacagaccccactctcgggggccgctcccaggacccccgcccgctctctcctgactcggtccctgcccgccccgcctcccttcctcgggctccctacctctccctcgccggccccgacctcgggggcgctccggacctgctccccgaatatctccagctccgccttcagcctgcggagaaggggccgaggagacaggaggaagagagcgagagtccaggggacgaggaggaagccaccgagacgcggagacccgacgacgccgagggaggcacaggccggggaagcggcagtcgggggcggagcgggggacctgggcgggttcccctccgccctgcccctgccctcctcgcccactcctcccttcccctctcacccgtcattcaccgccatggcgccctcgacctcaggcggcgagtgcagccgccgctccacctcccgcagcttggcgcgcaccagcctccctgtcggtgggcgggcgtcaggggcagggccgaggcccgggcacatccccctccccccgcccacctggcgcgggaggctcactctccgagagcagctgctccttgcttctctccagggcacggatctcccgggccagtcgctgctccagcatctgcgaggacaaagaggaggcctccccgtttggccgtcctcttggctacacggcccgcccctccccttttgtgcttctcgcga

SEQ ID NO: 5915 - DNA, 766 bp, Homo sapiens
cgggaatcccacgcccttgcaccagcccgggggctcggacgagcccgggagccgctggtcgccaatcaccgcgcggtggagaggcgggcgctcggctccggcgcgctgggggagccagctggcgctgtcttccccatcgcctcagacgctcacaccgacacagacagacgcacagacgggcgggcagacaccgacagtctcccaaccgtttgcgctccagtcccggcccagggagccccccgtaccctctggggtgccgcaaactgcagctcggcaggcccgcgccgggagaagggagggcgcgcaggcggccggaggaggggaggtcccagcgcgcccccgctgcgatgtgaacggcggcggctctcacctggagccgcacctggggcgccgagctccggggccgcggaaagaatgcgcgccgcccgtgcgctccgcctgccgcgtctggccacccgcagccgccgcgtccgcacctgaccatggagtgcgccctcctgctcgcgtgtgccttcccggctgcgggttcgggcccgccgaggggcctggcgggactggggcgcgtggccaaggcaggtgccgccgagcggagctccgagagcgggtggcagggggcgcccgacgccagccccgccgcgcccctcacgcgcgatgtcaccttttctcttgcaggcgctccagctgtgctgcctctgctgtgcgtcggtcgccgcggccttagccagtgacagcagcagcggcgccagcggattaaatgatggttcgt

SEQ ID NO: 5916 - DNA, 363 bp, Homo sapiens; identical to SEQ ID NO: 5689

SEQ ID NO: 5917 - DNA, 2919 bp, Homo sapiens
cgagcgcgcaatatgagtctcaaaggccaaactccggccagtcaggagccggaaggctgagcccggctgacctgactttgagcttccccggagttatctcgcataggcgctcgctctgtccaagggcacgcgacgccagcgggcagccggtctccgtgaagaatggcctctaaacaacttattttacctcgttgtaaagagagggataaaatgggctttccctctccacggatgcccagccttctgggcaggcgcatggccgggcggcgcccagcccgcagccccgatccggacaccccactgcatccctcccttcccggtcccttccccgcacgggcgcccgagagacggacaaagagttggggccaagtttgagcgccgggcacggccaggctcagggaaggaaggtccccggcagacacctgggtaccagagttggtgcgaggaggaaaagctgggaggcgaattcacaatcctgggggtggagggcaggcaggggaggggaatcaggccaatcccagccgagtgagcccccagcgagctggggctccggatgggaggcctgtctcgcgctccaaagaaaagcaaaccgccctcccaggtccgcccggattgccgaagcccctctggaaaaactccttcccctcttacaccaaactttgcgccgggcctcgttccctcccgggtaggcagcggcgcaggaagggttaagccagcccgtcccagctgacagtcagctgattgggccctgattgacagctccgaaaagtttccttgtttctatactattatgctaatcgcggccgctctcgccgcctcccattggcccggagtgccagtcaatttctcatttggacctgacgtcacgagtgctataaaactcagcaattgctttaaactcttcttgctggatcagaggctttaaaatcttttttcatcttctagctgtagctcgggctgcttgtcggcttggcctccccctcccccctttgctctctgcctcgtctttccccaggacttcgctattttgcttttttaaaaaaaggcaagaaagaactaaactcccccctccctctcctccagtcgggctgcacctctgccttgcactttgcacagaggtagagagcgcgcgagggagagagaggaaagaaaaaaaataataaagagagccaagcagaagaggaggcgagaagcatgaagtgttaactcccccgtgccaaggcccgcgccgcccggacagacgcccgccgcgcctccagccccgagcggacgccgcgcgcgccctgcctgcagcccgggccggcgaggcgagcccttccttatgcaaagcgcgcagcggagcggcgagcgggggacgccgcgcaccgggccgggctcctccagcttcgccgccgcagccaccaccgccgccaccgcagctcgcggaggatcttcccgagcctgaagccgccggctcggcgcgcaaggaggcgagcgagcaaggaggggccggggcgagcgagggagcacattggcgtgagcaggggggagggagggcgggcgcggggggcgcgggcagggcgggggggtgtgtgtgtgagcgcgctcggaggtttcgggccagccaccgccgcgcaagctagaagcgccccagcccggcaagctggctcacccgctggccacccagcacagcccgctggcccctctcctgcagcccatctggcggagcggcggcggcggcggcggcggcggcaggagaatggcatcagaactggcaatgagcaactccgacctgcccaccagtcccctggccatggaatatgttaatgacttcgatctgatgaagtttgaagtgaaaaaggaaccggtggagaccgaccgcatcatcagccagtgcggccgtctcatcgccgggggctcgctgtcctccacccccatgagcacgccgtgcagctcggtgcccccttcccccagcttctcggcgcccagcccgggctcgggcagcgagcagaaggcgcacctggaagactactactggatgaccggctacccgcagcagctgaaccccgaggcgctgggcttcagccccgaggacgcggtcgaggcgctcatcagcaacagccaccagctccagggcggcttcgatggctacgcgcgcggggcgcagcagctggccgcggcggccggggccggtgccggcgcctccttgggcggcagcggcgaggagatgggccccgccgccgccgtggtgtccgccgtgatcgccgcggccgccgcgcagagcggcgcgggcccgcactaccaccaccaccaccaccacgccgccggccaccaccaccacccgacggccggcgcgcccggcgccgcgggcagcgcggccgcctcggccggtggcgctgggggcgcgggcggcggtggcccggccagcgctgggggcggcggcggcggcggcggcggcggaggcggcgggggcgcggcgggggcggggggcgccctgcacccgcaccacgccgccggcggcctgcacttcgacgaccgcttctccgacgagcagctggtgaccatgtctgtgcgcgagctgaaccggcagctgcgcggggtcagcaaggaggaggtgatccggctgaagcagaagaggcggaccctgaaaaaccgcggctatgcccagtcctgccgcttcaagagggtgcagcagagacacgtcctggagtcggagaagaaccagctgctgcagcaagtcgaccacctcaagcaggagatctccaggctggtgcgcgagagggacgcgtacaaggagaaatacgagaagttggtgagcagcggcttccgagaaaacggctcgagcagcgacaacccgtcctctcccgagtttttcatgtgagtctgacacgcgattccagctagccaccctgataagtgctccgcgggggtccggctcgg

SEQ ID NO: 5918 - DNA, 2267 bp, Homo sapiens
cgggcgggggagggggcctgccggcagagaaagtgcggagagggcagagcagcggctcggggcgtttctgcaggtggacatgaaacgcacgatatgcaaatgaatgcaaagtgtatgcaaatgacctggccccgggacccgcgggaagcgagggcttcgcatcggacccgcccgggaggctgagcggggggagcgcgacccctgccggccacgcacggaggtggccccgggccgggccaggcgccgcgctgggggcgagcgcggggcagggggcgggggcggcggccgaaggagcgacctcccccccaactccccacctccccaccccccccacaccccccaactcccgttcagcctcccgcgcggccgccagaagccgcggttctaaagctgcgaggcccgcggccgccgactgctgcgaggtgggtgtgcgcggcctgcggagggggagagggtgggcgcaggcgggggccgccccccagagccgcgccccctccacggcgcccgcacccctcaacctcttcgctcgcccccgcctgcgcctccccgcgccgccccccgcaggaggcggcgcgcccgtcgccccctccccgcgcccctctcccctctccctgctcccggcgctccgcacagccccggcccccacggccagttcttagggcgccgccccggtggcggaggcgttgggggcggctctcggcggcggggagcccctctccaggccggcgccccggggcggagctgagcgccatgggcgccgggcgggaggcaggtggcgcagcggcggcggcggggggcaggaggcggaggcggagcgcgcggggcgggggccgcggggccccgtgagactctcgggcgagcgcgcggcgttggagccacaggcgcggcggctggacccggcgcgggccgcggaggccggagaccgccccgggcggggtgcgcgctttgttcccgcgcggggtggccggagccgagtccccggcatggcccaggcggccgccccgcgcgccccagccccgccgcgcgcctgagcccggtgcggcgccagaagacagcgcgcagccgcccctgagtcgtggaggcggggaccaagctggaaggagcagcgactcccggaccgagtcgcgagtgtgcgccgtccgccgcccgccggatcccccggaccccccgaccgtaagtgccgtgtccgccccgcgcgccgccgccgctctaccccgactccgcccgcggctgccgttcccggatctgcgccgcagccgcgccgagcgcacgggccgttttcaaagttggtgcccacggcagggtggagccaacccgcccagcgcccacccatccgggctgagcgcagccccccgtgagcagagcctgacctgcgggggctgcggcgaaacttcgaggggaacgacgcgcccgggcgctgggagtctcgcgggctcccctggggccgcccggttttcctaacaaaggccccgcggcccgcgtgacggagacccgggagtggggaggccgagggcggccctgggagaggcagaggtggcggcggccggtctggggaggggggtccagagctccctcctgctcctctccctcctgcccgggtccccggcgctgccccgcaggctaaaggtggtccgcgctgggggtcctggaccctgcctggcatgcggtccctggggtcctgacggccgcgggcctcggcacagccgggtggcagcgatggcgcgcacagcctttgggaagcgtccatctgtgttgggcaggccccgagccaggctgtgggaacagcggggagggaggtgtgagcctctgtggagggacagatggctggaaacgcagccctagacggctgacttcacttacgtggagcagaaggcggccaggctggtggcggcgactcagagccgctgggctccgaacacactgcggggctggcgctcccccgcccctgcgtccgcccgtgtgtgctggggccgcggccgggctgtgcccacccctcattcaccctgtgggctgaggccggctgacttcaggcccattccagggcccaggaagaaaaacctttcccttgaaaagagagcacgtcgcgtgctcctgtgggtgggggcttgtcggtagctgtcaggcttgtggccccagccagggtgcggcttctgtgcgtccggcccgggtgtgcgtttcctctcctggacgaggaacaggaggttcccagggcagccacctcggcggacgggtcggccggggataaggggcgggggccggtttttcgg

SEQ ID NO: 5919 - DNA, 265 bp, Homo sapiens
cgcagcctgcgaccgatggagcaggaggcgcgggtgctgagagctgcgggcggctttggccgggcccggcgcctgctggcctccgcctcgtgggtaccctgcatagtgctggggctggtgctgagctccgaggagctgcttaccgcgcagcccgcgccccactgccgaccggaccccacgctgttgcccccagcgctgcgcgccctgcgcggacccgcgctgctggacgccgccatcccgcgcctggggcccacgcgagccgcga

SEQ ID NO: 5920 - DNA, 374 bp, Homo sapiens
cgaacagcgttctgaaacgcagaaacgtgcccattcgaattgttaacgcgagcgcagagcccactgacaaagcaaaataagacaaaccgggagtcagaaaactcagcgacccacaggatccaccgtgatgtttcccacaaatgttaccgcgaaaacagtcggacttgaaaataaacgcgacctacctggttctcggaaggggagaaggatccgggcgaaaggcgtcagttctccctcgctcgccccgtagacgcagcgcaggccccgagctcccgagcggcggtttcagaacccgcgggtcacccgggagctcctcccgcagtaccagccgaaagctcccagcgccgaggagggcgggcggctgccctccccga

SEQ ID NO: 5921 - DNA, 1133 bp, Homo sapiens
cgaacagcgttcttaaactcagaaacgtgcccattcgaattgttaacgcgagcgcagagcccactgacaaagcaaaataagacaaaccgggagtcagaaaactcagcgacccacaggatccaccgtgatgtttctcacaaatgttaccgcgaaaacagtcggacttgaaaataaacgcgacctacctggttctcggaaggggagaaggatccgagcgaaaggcgtcagttctccctcgctcgccccgtagacgccgcgcaggccccgagctcccgagcggcggtttcagaacccgcgggtcacccgggagctcctcccgcagtaccagccgaaagctcccagtgccgaggagggcgggcagctgccctccccgacctcgccccgcccgcgcggacgcccccggccccacgcggggaccaccccgggactcccgccggaccccgcgcgcccgcggccaacctgcgtgcacctgcgccccgcgccacgcccccggcgccccacgtttagccctcactgggtcccgcttcttagtggctctaagccccgccccctcgctggtcaccgcaagctccgcccctcgaggccccgcccctgcaaggcccgccccttcacgactcaggccccgcccaccacggccagcccgggtctaggccccgccccgacacgactcaggccccgcccccggccagcttcgctcctcgcgcgccccgcccagcaatcctcgctgaacccggcgcggtttccccagcgctgctccacgccgcagtccagcgcctggagtccgcgcgccccgagcccctgcccgctcatgcgcagctgggtcacccaggtgcacccacttccttgctgtcccgccgccctccctgcccccaccccgcctaggccctgggtgtcccttctccatcctccctggcgcctctgcctcaggccacctggccgtcctcctgggctccccgctcgggggcggcccctggtccgacggtgccgcagacgcgcgcgcacaggccagtcccgcggagaggctgctctcaggggctaggcggggggctgagtcagaggctggggcctgccaggagcggggcggcctggggcgcagcagcattggagctgaaggcgagggcggcccgcgccgg

SEQ ID NO: 5922 - DNA, 2358 bp, Homo sapiens
cgggacccgctttccaagcggcgcctcctccattttccgcgaaccccccggcggggtctgtgtggaccaagggagatcagagaccccccgccgccaccccacccaggcggagacggcccacccgaacccgcacgggtccttccttctccctggaatttgcagctggccctttccgaatgcttgctcccctcctctccccacgaaagaacagtgtcctgggactcggggtgcggggcagccgggttcgctggagctgttcagtgcggggaagagccgtcgagactgggagaaggggcgctggccagggaggagacggggcagggagcggactcgcgatccgtactctgggcggcggtcctcgcgtcccagccgcgtctcccgatgacctccagccgcgaagggcgagcgggcgggggctgggctgcgggttcgggctccaggaggcctgcggggccggggaggggcgtggagtggtccgaggaccggcttggggactgggggcaggtgcctggacggacgcgggccgagcatcttccccgggggcgggcgcagtgaaaacaccttgggaggcggcgccgcgcggctgagcgctgctgccttgggaataggacggcgctcggcactgcgagctgagagcactttcataaattttgtatgggaggcgctccgtgagcgggggcggggagcggagcgagagggagggagctagagagcaagggagggagggaggaggagaggagggggaagccggggggaggaagggaggcgccccgctccgccgatcgctcggtcctgcaaacgcgcgccgggcgctttccccggagctcggcggtgcgtgcgagcgcccttttgctgcagccgcggcggcggtggtccgagggggcggagaggagggggctgcggccggccggccagggggcggcgtcccccctcaaaaccgcctgcgaagtgctccgggtggcagaagcaggccgccggctccgcggagcaagccgctcgccccggggctgagcaagcgcgcggggctgccgggcagcaccacggttgcttgcgggcgccggtgccctcggcgcggggctggagctcaccatgcccctgcggggccgggccaccgggcacgagcggatccccggcttgcccccgcctcgacgcgctcggattagctgcagctggcgcccagggatttgaatctggaccccgggagggagtgcgcctaggccgacctcggagcggcggccccgtggccaacatgcttcgcaaaggtgagttggagccgcaggggcaagttgaagttgaatgcgctccggaaagagccgcgagcccgggcgccgcccggcgccggggctcccggtctgggaagtagcccccggcgggctggtgggttttgccgggcgcacccgccgaggggctgctgctggggctcagctcccgtcagcggccagttgtgagacacggggttttctccatggatcgagtggccaggcctagagatccggcccggaggggtcagtcggagaccagagtgagcggccggtggtggaaggggagccggcctcctgggacctttgctttgctgggataaagttttgcacttgcagcctccattccctgcgcgggcacacgcccttgcttctgccgctttgtggaggccgagtccgcacggcgcccccgtgcagccagcggtcagtgaccgcgcggcccgggcgctccccgcgcgccctagctccccagacggggcccggacgcggacgtcttctctgcagttctgctctgatcgctagggatgggctctgggcacccagcggctgagggtggggagcggccagcgcctgatgtccagttcctcaaactttcattatgctgggagcggagggacgcgaaagccgtgccgccagtgtgcgcgaccggtgcacagctcaacttgaggacagctggcttcgcgaccaccgtagctagacgccccagcagcccggcccggtacggagcgcggcaaagttggtgcgggcaccggggaagtcccgccgcgcccccacgtggttgccacgcggggcgccgtcccccgggccctgggagggcaggtgatcacgccgggagcccacgggccccgccaccagctgttccagcctctgcgtctgcctctcccctcccaggcccgagcaggctgtggcgccccgccgggatcccccccgcgcctggcccggccaggaggctgagaagccgcggcgcctgcggctggctgccccggccctgcgggagcggctgaggcgggagctcaggtagccgaggggcctgatccctgcgctccacgctccagccttaatccgcccctgtttccatggcaacagaccgaggtgtcgt

SEQ ID NO: 5923 - DNA, 1050 bp, Homo sapiens
cgggcgggcagctgcggctgctgaggctcggtggggcccctccaagacgcgtgtccgcatctgcccgccgggcgtctgcggggtgcagcgtccactggagcgcgacagcccctgggacagaggaggacagtggcctcgcttccctgtgcgatcgcccaggagctccgggccggagagtgcgagcggggaaaaggggtcctgcacctagagtggggcggacgtggcgaggaagccaggggggaccgggaagcgaggcccgcggtgcggagggcgcggggcgtggggggacacctctcggagagacaccggaggggcggaagtaaggagatggaaaggagagggagatcggggagatagacctgagagacccagaggcctgcagagagtttcatccgggacccttcagagcccaggaaagagcagatgcggacgcgggagggcgccttacgccaaagcgggcagcaccagtgaccaaaacacgccccgcttggcagccccgggacgcacctctgcctcggcagcgcaggagaggcttggacagcgcgagatgctagggcccaggctgcccctagagggctggcccgaagcgttggagtccaaagacgcctcccaccgccgccgggtggcagaattgggggcaggcgcgtcccacagaccccgaggggtggccccgccccagggccgcggggaggcgcccccgtgcggggcggagttgtcaccgccccctccccaatccccggggactgtggccccttcttaagcccgcggcgcctctagctgcccctcactcgtctcgcccgccagtctccctcccgcgcgatggcctcggcgctgagctatgtctccaagttcaagtccttcgtgatcttgttcgtcaccccgctcctgctgctgccactcgtcattctgatgcccgccaaggtcagttgcatctccaggcagcccttcggacacccggcgtcctgtgcccactaacgggcaccgatcccgggagccctgagctggagcgcacggatttcgcggggagcacagctctcccggggcgcgcgc

SEQ ID NO: 5924 - DNA, 1731 bp, Homo sapiens
cggccggccttagctgtcactcaggcaaccccggagccgccgcagacaccggatccactggaagggggcgaagccgcggggaggaatgggggacactggggaaggggcgtcgcccctgccgcccccgccctctccagtgccattgggcggctgctgcggagcccgcgccaccttttctccatcccaccccgcccgtctggccccgcctggccgctggtccgcgccccgctgcgctcgtccgggggctggtccggcccgggcctttgacgtcaccagcaagtttgctgccctcggcgtcccacgtgtggcggcggccagcggcggcccaggaggcagccggtgagcgcctgcgagcagagtggcgggggccgctgacaggtcccgcgcagcccagcccagcccagccacgcggctcacaggtggggtccaagagcagtttggagcaacccggcgctacggagaggggtggacggctctgcacgggcctcctgtctcccgctcgggcagagggactcggggggacctcgctccttggctgagagaacctgaactcgggcggagagaacgcgcccaggcgggcaaggggaccagagaaagccggggctggaagtcactgtcgctcgccactgtctggagcgcacggagcgcagaggcccggcagccgcgcgtgccctcacggggaccgagccagtgatgcaggatcgctgagcggagatccgcgccgagaagtctctcggggccggggctgagacgcacgccttcgacaccgctgccaagaccccgattccggcgactcttgcggggaaccgaggggccaaggctgccccaagctcaggacttgggcgagtctaagacgatggtttcttaagcacggacccgcgttccccttcccgctccctcgactggaggcagggatcctgcgcggggcccccgggattccgtttccccgcggagccccggccgctgcctcccgggacagttcgcacggccacaggggcgcacggcgatgtggcctccgtccagcgcgctggcccgccggggggatgctctggcacctgtcggggtccaggcctagcatggccggcgcgttgcccgacgtcgcctccggctaggatggcccctccgggcccggccagtgccctctccacctcggccgagccgctgtcccgcagcatcttccggaagttcttgctgatgctctgctccctgctcacgtccctttacgtcttctactgcctggccgagcgctgccagaccctgtccggccccgtcgtggggctgtccggcggcggcgaggaggcgggggcccctggtggcggcgtcctggccggaggcccgagggagctggcggtgtggccggcggcggcacagagaaagcgcctcctgcaactgccgcagtggcggaggcgccggccgcccgcgccccgcgacgacggcgaggaggcggcctgggaagaagagtcccctggcctgtcagggggtccgggcggctccggggccggaagcaccgtggccgaggccccgccggggaccctggcgctgctcctggacgaaggcagcaagcagctgccgcaggccatcatcatcggagtgaagaagggcggcacgcgggcgctgctggagttcctgcgcgtgcaccccgacgtgcgcgccgtgggcgccgagccccacttcttcgaccgcagctacgacaagggcctcgcctggtaccggtgagcggggcgggcccgg

SEQ ID NO: 5925 - DNA, 3535 bp, Homo sapiens
cggccgcgccaggagctgctggtgcagtccaggaacgcagtgtttggggccagttgcggcatttacagtgggctcctccggcagcccgatccgccgggtcaccgccccgggccctgtgccccctggacccgggagtcctgcttgtcagttcagggagatggctcgggaggacgaagaacctcccgcctcccgcggcccagccaagcccttgcggccgcccgggtccagccgccatgcgtggccgctcgcagcgcagcccccgggcgcaagtcggcagccgaacctcccgggctgcgctgtccgctgcaggcgcgcggcgagggtttccacgcgacttcgttcttcattcagcgttttttagtcaatcaaaaagaacgtggcaggtggagggcagccgcctaagagactgcgtgagccttcctgtggggatttccatagcttgccccaggtgcttcaaaaccgcctgacattaagggttcagtccttttcctgccagttcctcccaacccggcccaagtgtgtctgatctcagaaaatcctaggctgcctcggggctctggcgggttccacctggaagggcgctagttatagcctgccgcctggccctggaatcaccatcccaggaggagggggagtggtggtggtagaagtcataacaatacaatcggtgacaatagctaacgattagagaggccctcacgtgcctgcgaggcaccttaccgtaccagcgcattcactcttcccatccctgcccagaacctgcattattcccactgcacagatgagagcaccaaggttcacgcgactagccaggacgtgaatccaggcgtcggactccagagaccccattcttatccaccagtgtcccgagaatgggtcacagcccgggaacggtgggaaagatgactgtcacggttggctaaacctcgagacttgggcaactcctgacaataataaaaaaccattaaggacaaaggggaaggggtaggacgaggctgggaagggagccgttttaatccgcggggtcagccctcttttattctccaacccacccaggtcccgacagtggggtgggcacagggagaggggttcagttatcttctcctcttttgttttcccaagtcttgagcgtctgtgaagctaattgggcctggaggggtgtctgaatgtcgtgctggctggggttacgggtggagaccccaacgaaaatgtgggggtcgttacctgggcccctagtcgaagacagttatcggaggccgaaatctagacctcctgcccactcgcgccttacccgaagctcgggcaacccaacagctcaccccaaagaccagcagctgcggaaagcagtgggcagaggtagtgattgtgaccccggggccactgtccctttggaacctgacccgcaacccgactcgagaacagaatttccggaagccgcgacctcgaagcaaccctcatttctcaatcaatgggccccgaatattctttgctccggacgtgtaaaagccccgcggagacacgcgtccttgctttccctatcccagcaccgagggcagggaggcggaaacgggcggcggtgcccggaggcccggacgccttcaaagcctcgcgccgctccagccggttgcagtgcgcgcctttgcccgacagggaccagcacagctccacgctccgcgcgccgcccgcccgccaggcggaggcgccgggccacccgcccggctcaccctcccgagcccaggcggctcgcgagcgaggcgggtctgacacccttggggttccggtaaccaggcggactgtaacaaaaagttaacagactctgcggcctcgccgggacgccgcggcccccaccccctctccccatctgggaagcagaagctgctctagaagttccttgagggcggagaccgaccaaaggggctcagaacattcccagcgtctcgggctccgggaggaaaaaatttaaaacgagtcataaaatacgattcgagtcggatacccccatggttagagggtggctcgctttgctgagggcggtctcagtcgctgcccttcttctttgcggcgaggtcgcctgatgaattcaagggcaccagtgctccgcgagaactttctgtgggttgtgacgagaaccaagcggagcgcaaccctcaccgcacccggacaggatgcgctgcgcaatctgccgtagtttccctgccctaccccgggtggtccgaagctgtaaccctgccaattccctatcatacgccatgtctcccttagctcagggtctgaatcgacgatggagaccctgcccctggcagggaaactcaccggtaccaagcgaggcccttgtcgtagctgcgatcgaagaaatggggctcggcgcccacggcgcgcacgtcggggtgcacgcgcagaaactccagcagcgcccgcgtgccgcccttcttcacgccgatgatgatggcctgcggcagctgcttgctcccagacccactgaaaaagctggagatggggcttggggagtccggcacctcgggactctgctcctccgggctcgcagcgccctcggccatctccttgcctgaagccagtggggtggctggcggcgcccggaacggcagcctggggggcgtcccgtccggagctgtggccagggctggcgggtcgtgtgcggcgcgggacccagagcccaggagcagcagccccggcgcggcggcgcaggagccggcgcacgagtacaggaacatatagagccagacgcagagcatggcgaagagcagcgcgagcttcctcctcaccggcggcgggggcggcggcggctgcggtaggagccggccggggacatcgaggcaagatctgccgccactcaggcgctgccccatgcgctgcccgcgggcgcggccagggacatggctcagcacatggcgtgggtcccgccgggcagtgagcgcagagagggttccccggcacgctggacgcccgggtggctcggtttattgcccccgtgtgcccgcggccgccgctgctgctgctgctcttccccaggtggcggcggcagctgtagcggcggcggctcttgacatgttgcccggcaggagctgcaactggaacggaaagtcgggacggcggtaactgctgggcgagggtctgctcccggggcgcgacgacgcgctcggggccaggaggacgttgcactctcgcgccctggccactctagactgtgcgcaccgccgcacgccggggctgcctccttgcagtcctaagaactgagcctcgagcagccccggcacttccccgcagaggctgcagaggcgaactgcgcaggaagagagctgtggaccgaggtggagtgggcggtcccggccttccagagtgacgggctgctctacctaccaaaaaccccgaacgccatgcaaatacaggcgcttctccgagagctcagcagccaacccgctcccaggacgagggggtgtggaaaggcttctgggcggtgtagggcggtcaggggttgctattggcttcggaacaaggggcgggcccaaaggggcgg

SEQ ID NO: 5926 - DNA, 2896 bp, Homo sapiens
cgacccccggccgcgaacccaagcctgccgccttcgccgcgcccaccccccagccccctccctgccccggcgccatcccaggtcgacgtctctaaccaaaacaagcccctcccccaggagccccctccccctgcccgaggcccagggtcagcagccccaggagggacctcctccccaccccactccccccggcagaggtgcgagatttcattgtcagcctggccactcgaccgcgcgtgagactggggcgcagggcaggggggccactgggcaggctctcgtgcggggagtggggaggggtctccaggggaagtgtttgaagccactcctgcagctctgtccagatccggaagccgccgaggaagggaggaaggcgggggtggggagagcgcgaccttaagcgctggcgggcggcgaggaggggccgcagcggcccgaggaagcgcctggaggcgtcaggggcgccgagtccccagggaggccgcgctctcgggaagtttcccatcggttgcccggagcaggatcggacgcgcggatcgccctccccggtccgaccagcttcggggcgcagattgcgaacttgaacagaactccttccttctctggcatctctcgcctccccatccgtggccaccagccccgccatctcagccccatgccttccgccaataccacattcgtcaagaccgctcaccaatgctttgtggaggaaaggggaggggggaatccccagcacaaccaaactgtggccaaaagcggccaaaaaaaaaaaaaaaaaaaggaaagaaagaaattccttcttctgagaccgattccctcaaccagcgtggaaaacccccaaacatgcaaatccgcaactccagccaagatcctggcgccgcgggaggggtgtccgcggcgggcggcgaccccagcctgcagccccggactccgggcaggtctgcgcgcggcggcgggccgggggctcggggagccctggcgcccacagcagcccgccgaaaacacaaagctccgccgccaacaatacctgcgggctcctcctgggtctcccgggcgccggcgctgcgcgtctcgccgtctccctttcccccgccgtctctctcctctcgcgcacgctctccctctcgcctcttccagaacgcggtggccagatgagatccttgggagaaacaaatgtgagcgctcgcacgaatcctttctctcgccagccgcttgcaacggccccaggctcgctcctttccctcgcgctcccgcgcgcgccgcgcctctcgcgccccgcgtttccttcttagcagcccctgcgagcgccctcagtagccattattcacaggccgccgggggtcaggaggtaattagagacggccccgtggccgcatccactcggtaagcgcgatgctggcgcggggcgcgcgcggggaggggcgcgcgatgagggggcttggctgcgcgcagcccgcgccccagactcgggggaagggaggaggaggagggggcagggaaggaggaggcgggcgggggggcgagagatgagctcgggaagggagcgggaggagggggcgccggggagacgctcccttggctctcaccgcggggcctcggggtcacccgctgcgaggctccgacgcgcttagggacggggggtgtgagtgtaagagtgcgcgcgcgcgcaggcgtgtgtatgtcaaagatagaggaggggagggagggaacgctttaatatttttccagtgacttacgagcctgcgggtgaggtcttggctgtgcgtttaggtccgtgtgtgtatcaatgtggctgtatatttctggtctgtcctacgagtgaatgtcacggggcttgggggggggggtctggatacaagctagtgaatgtgtttctgggtctcagtttgactgaatgatgtggcgctgcgtggggctgtgtctgtgcgattgtttataggggggttgtgtgactccgtgaggtactgcgtgggtgggattgcgcctgtgtgcggttgtgtgtatatgggattgtgcctgcgtggggctgagtgtccagagggcagttgtgtggccatgtgggcctgtttgcgagtgggctggtgggtgtgtggggccgtggggctgcgcatgtaggggcagtgcgcctgtacggggctttgggttaacttaaagggctgtggtgggtatctgcaggcggttgcgtgtgtggctggatctgcgtggggtctgaggcctggcgggtgggggttagtcctcctggcgtcggggatcgcaccgcggcagaagagccgcttaaggcgccaacaggcagcgccggggtcgcggcgcagcgcgacgtgtagtagcggtggggcgtagagagaaggcggagaagaggggggccttcatcgcgcgcctcccctagccgcatcagagacgcagcttggagatcctgccgcttgccggccccgcggtcctagaagcacagggtttgggggaccctccccagctgggggagacgcctactggccgggaaggcagcgagaactgagactcgatgattctggcgcagcacagaagcatgcggcaaggaccgccaggagaggtgggtcgcggcccggagacagccgagaactaggccgagacaaagaagagcgggaccggggaccttggggccaaaccgcgcctctaggtttcccggcggccgaggggagcgcactcaaggccggcgcgtggagcctggcggaggtggcgcgggcccctcttcgctgcagtcccagcagccgctccagagccctgggggcacgtaattaggcgccacagggcagggccacggtgaggggggttctgagtgcagctggcgggcgccgagccccggggctgtgattgagcgctcagctggcccgcccctctcccggccgctcaccgcccacgc

SEQ ID NO: 5927 - DNA, 2567 bp, Artificial Sequence
  Description of Artificial Sequence: Synthetic polynucleotide
gygttgggygatgagggatygttgggtaattgggggtataggatygggtttygttgggttyggggtagaagygtygaagtttygattyggaaygyggtgattttattaaygtagaagttygygtagtygagtagaggagtttttygtaggygattttyggatagaygtttttgygyggttygygtggtttagtttygttttaggaaatttttygygtagttttygttttatgygtttttatttagttttttttyggggtygttttttttttaaagtagtttttygggtttattgggygttttygtaatygggtyggaatttygaayggtttygygtgttattyggttattttggtaatattattyggyggygttyggyggtttaattttagtttgyggtttttttygagtttttygtaaggtggggatygggaygygatyggggatggggaagggggttgtaggaggtttygtttgygttgtygtttttgttgggtatagygttttttattattygyggygatttyggttttygtaaggtggggyggygagtaggagtyggggttaggttaggggttygagttttygttygaggggyggggaaggygggtgaygtgagtygggtygggygggyggagttgggatyggtttygggaggygggggygagygygyggagaggtagaygygaggagggaggyggttgagtagygygggyggttttgyggygggygyggtgggygygggyggyggggtttygggattttygygygtttttttygygyggygtygtygtygygygtttttaygtttygygttttayggygttttygtttygygygtttttygtgttygttttttgttagttttygggtygyggtygtttgtagagygagygtttagayggagttttygggtaatttgagtggygtygatyggyggyggagtttttggtagagtttttygattyggtagygyggaggggattygygttygttygygtygygttattttaaattttaagtagygtygttttatyggygyggagtttyggttggaggtaagagtygygygtygggagataygtatygtgagyggtagygtygtyggttttttttttygtygtttyggagggygaagtygyggttttttagttttttgttgygtygygatagygtyggaataygtttygtttygttgtygttttygttgtgtygtyggyggagggggtygygagtttygygtttyggtyggaggatgtgygttttygygggtygtttagtttgagttatgygttttaayggyggyggygygtyggtyggtatggagtttygygyggtygygttttgattygttgtgygtttygyggtyggygggyggygggaggyggyggatygagagtyggagatyggygtygygggayggaagygagygggygygggygtygygtagatggtttgggygagttaggtttgaggtttygtttttygaaaygtgattatgtggatttaatagtttttaggatttaggtgagygattyggtyggygtygggtgygtgtgggygygtgggtgttaggttgggyggaagyggygtttttttttatgttgtaaattaagggattttttttygtttttygtaagygggtaayggggtgtatyggtagtyggaaaggggygttygttyggagtttggagtagtatygyggttttggyggggagyggtygggtttttagggtttygygygttyggggtyggggtagyggygttygttttagtaattygggaagtggggtyggttaggygygttygtagttttaggagttagtagygtagtgttttggtyggttgtttyggygygtttttttttyggggttyggggygaggygtyggtygttgggygyggygggygygggggtyggggttgtyggggaaagttaaagtttygggtttttagygagagtttygtaggyggagttggaggaaattatagttaaatagttatttygttttttttttttttttttyggggtttyggggttgagtaggggttttttaggtttttagttgtygatttagttgtttgygggtgattttygggttygaygggygtttatagttggygggtagttggggygggagagttggggtttttggggagtttyggyggttatttygttgtaaatatataygtatataygttygtyggygygttyggggtttgtttgtgtttgggattttagggttagatggaagagggggttygagtttagagttygtggtgggggtgtttagaaagatttttttyggtaaattttgttagttygtyggggttttygggtttttttggtttttgtttggggtggtttagggtttattagagtatagttgtygtttttgttgggtaggttgtttttgagttttygtttttttgtyggggtatttatygagttygtgtatttgggtttygggttggaatygygagyggggaggatagaggtggaggyggagagtagygtgyggttttygagtttgtttattgggatgtattgygttttygygttggggayg

SEQ ID NO: 5928 - DNA, 573 bp, Artificial Sequence
  Description of Artificial Sequence: Synthetic polynucleotide
gygtttaagaagtyggggttttttttggttaygygttttygggggygttygygttttttaggttttggttgtttgggygtygattttygggaygygtyggtygatagtaggggaggyggtagtagggatygtagtagttttygttttygtayggttygtygggtygyggtgagtaaggygggtaggygyggygggaggygttygaygtttatttygggtttggygttttttttyggttattaygyggygtygtttttygggattttttagttttyggagtttygygygtttagagtygttyggagygygggyggggttagtttgggtagtygygggtygttgttgygtyggaagttttygtygttagggagttttttgggygttaggttttgggtttttgggygaagtygaygttagaatatgtttggtttygtatttagtttatygtatttttagygygygtgggtggggggygtyggttgaggtggggagggtatagtttagttttaggttatagtgtttygggyggggtagygyggtgyggggtgaaygttatyggttyggyggatagyg

SEQ ID NO: 5929 - DNA, 383 bp, Artificial Sequence
  Description of Artificial Sequence: Synthetic polynucleotide
tyggtttttatagyggtttygggttttyggatggygtgayggtttgtggggtttgyggggtgygttgttttyggatttgyggggggaggyggttgagttggyggygttygygggtttagtggtgagtgyggygtttttaygtttagttygaygttttyggagyggtygtygygtaggggtgggygygggtttttaggagggagggyggttgtgaaygygttttgtttttygygttttygtagttttttgygtagttgatgatttttataattagtttygttagttttattttttgtggatatttgggtaaggtygagtyggaygttgttaygttygtygttayggtgggtgtttgatttygtttttgtaggagtygaygggyg

SEQ ID NO: 5930 - DNA, 853 bp, Artificial Sequence
  Description of Artificial Sequence: Synthetic polynucleotide
tygttttaggggtatttygtaggygagatttttgtagattttagttaggaaaygttagtgaayggtagygtagggaayggggyggggtygttggtttygtttatygtygyggtgttgggggttgggggtggttttygggattggtgtggagtttgggtttgatttattgatttggttgagtggggagattggagggtygtattyggagttgggttyggggaygttygttggtgggaagggtgtgygygygtyggaggtygyggttgattttgtttyggygttgttaggtayggtattagttyggatagtattattttgtatyggtagagtatyggtayggtgtttatygtggatttggtttygygttaygagtgtgtygyggtggtgttgtattygtygtttatttygggtatgygygtygttttttttgatattaagaygatttattgtttygaygttttttttaagtgagyggtttgggyggggayggaggyggggyggggayggaggyggggyggggttygggtygggygttaagttttattygttttaygtttttttygtagtatygagaaggtgttttagattaygtygttygtgtttattatttayggtayggaggaygaggtgatygatttttygtaygggttggygttttaygagygttgttttaaggyggtggagtygttgtgggtggagggygtygggtataaygatatygagttttatagttagtatttggagygtttgygtygttttattttttaggagttgtttagttagygygtttagyggyggttttaatyggtyggattttagtaataaggyggttttyggattttatttygygtyg

SEQ ID NO: 5931 - DNA, 1062 bp, Artificial Sequence
  Description of Artificial Sequence: Synthetic polynucleotide
tygggatgaatgtagttayggaaygygttaatgtaggaggtttttaggatattttgagygttygggagaygttaggygyggtagygggtayggatagyggaaaggggygygatttygyggaatttttyggtagggtagggtttttgggtggtttygggtgtttagaggaaggggtgggttyggggaygyggagggaaattggggaygyggagggaaattgaggtygyggaggaygyggtygttggtagttygttgygtttgtyggtttygygtgggtygttttattygggaggaygygggttttttttgtttgtagygttttygtygtygtygttttygtygttttttttttttttttttattttygtygyggttttygtttttttttttttygttttttattgtttttttttttttttttttttatttttttttttttttttttttttttttttttttttttggagyggttggggttgyggygtygttgttgatayggatyggtygyggtygttatygggyggaggttgygyggygtagatttagaygggyggtttyggagggygygyggygatggyggyggygggtaggyggygggygyggygggygaggggttygggttgagttgygggtyggttyggatggygggyggygygggttggtygggygttttygyggttttgttgygtttygtgygtygtttgygygaggtgttygaggtgtgyggtygygatttygayggttttttgygygtggagygygtygyggygttyggattgygtttyggttagggygaggaggtaagttggttygattttagtttyggttyggggattttagtttagtttygtygttttttttttagttttttygtygggttattygygtggttygaggyggtggttttttttttaatttttttttttygtyggagtttaggatttyggtttttttygggtatttttggtttagtygggttttygtttttygtttttyggygttygtgtttygagygttaygygttaygtttagggtggtttttgygtttatttttttttttyg

SEQ ID NO: 5932 - DNA, 918 bp, Artificial Sequence
  Description of Artificial Sequence: Synthetic polynucleotide
tygtygtttttatagygygtttttaatatygttgtttttgtttygygttttagagygtttttagtttttttttttattttttttatgagtggagtygggtttggggygttttaggyggtgaygatttgtagaagtttttgagaatgtaagattttttggagttttyggttygttagggtygggtttagttaggaygtttygtttagatttttttttagtttggggtgggtttaggttygtttgtttttattgttttgtgttttaggagttttygttyggagtttagattyggtgttygaagatgagagtgtygttttttttygtygggtgagaagttagtttaygtttygtyggttaggtayggtgtttttyggggygttttaygggaatttttgtgtttttatyggygttttyggyggyggggtagttttggygtttttttttygtttttggtttaggttyggttygygggtgtagttttttttagggttttttttttttttygggtygygygttygtttygtatygyggyggtttttyggtagtgtttgtttttattggaygtatagtgatygtgaygggtayggggygygagtttttattattataatgggtgtgtatggygyggggyggggggygttgtyggtttygagygagggaggggagaggagggggtgygttygtgttttgttygtttygagttttygagttygygttttattatygtagygagtygtttttttgggtygtttttttgttttttttttttattygttttttttgtttyggttgttyggagatatgtttggtggygatyggggatttagagttyggtagtygtttttgtttttgtttttgygatttttgttttttttttttgttttttygygtagygtttttygtygyggaaatttygyg

SEQ ID NO: 5933 - DNA, 865 bp, Artificial Sequence
  Description of Artificial Sequence: Synthetic polynucleotide
aygtgygygttygtyggagattagggatgaggttattaaatgattgtttyggttaatttttatttygtttttattygtatygttttttttttaattgatttaattttttaattttagtttttygtttttggtatyggtttttttttaagtttttagattttaattttggttttygattygtttygttatagtttgggaagygggagaagtagygygygtttttttgyggatttttttttagggaagattgtggtgttagttgtttagggggattagggggttatygggatttagygtaatttttgtttygttttttaattttyggaagygttaatagtayggtttttaygtaatgtygggtttttaagtatttttaattygtatagttttyggggaggtygygtagatatyggggttttttatagtttattattttggtgtttgaagttattttggagtttttatygtaggggyggggattagtgttaatgggtagyggggtttggtttttttaattagtattttagaaagagggtttaggggygggggygggtggatagggagggaaygggtttgggtgaaaggggtttgtggagtttaaatttagtgaatagggttttaagtgtygtgttaggaygaaaagaaggyggaggttttgggataggagttggttygggggtygggggaygtttatttgygtttygggaagtttttagtttygggyggttttagygtagtygggygtttagygtttattgtttgttaatygttagttyggtttttaaagyggtaaggttttttygygagggggyggaggttyggaggagaggggaggtgaggagaaygyggaggtyggtataattyg

SEQ ID NO: 5934 - DNA, 408 bp, Artificial Sequence
  Description of Artificial Sequence: Synthetic polynucleotide
gygttyggttgttaggtaattyggttttyggttttttayggyggttttttyggtgtgttttattaagagygatagggttggtgattygaggggygygtgygyggtygttagtttgggatttgtayggatttttttttttttagtaygttygttygggggttttttttttgttaygtygttggggttygttygttatttatagttttygtagagtttttygggtatatygyggttggtygttyggggttaaggatggggygggagygtttatttattttygygtyggtyggggtatttaagaggygygttygtagttatayggygtttygtttttygtttygaaaaagtttttgtttttttggygyggtgtggygttttygttagtttagtyggatttttttygtttyg

SEQ ID NO: 5935 - DNA, 2245 bp, Artificial Sequence
  Description of Artificial Sequence: Synthetic polynucleotide
ayggtttyggggtttggyggggaggtttatygttgtttagagggttyggtyggtygggagggggygttgtgttttttttaygttttgttygygggtttttagtagygttygtygygttgtaaygtaatgygygttyggtttttttttgggtagygtttagtgttygtttgttttgtagggtatygtygttttttttttattttggggtttttaggtttaaagggtttttagatttagttttttgtttgaattaaagtggttaggtatttagtttgtaagatgaataaatgaaggaaagaaggaaygaatgaataagggtttattttgtagagygttygygttttagygygtattaggtatattagtgttaaaggtgttgggggtygggtttagygttyggygyggttggaatgggggyggygaggagttttttttagttagtygtagggygggaattgtttaaaygtaggtygtagttttattgggtttygyggyggtttygtttagtagggatygttttgttttttagtttttaatagtttygtttttataaatttatttgagtattttggtttaagttattttagatttttgggattttttaggtttygatttyggtygggygggaggttgattttttatygyggttttttttttttattttyggttttttttygggttgyggyggtygttattgttgttagygygtttygaggattgtygtaaatttygggygtagggaaaggggattttggyggygggatatagagagygggtygggggaaggggagggaayggaggaggygaggaggagttgggagggagtygaggggygaggygyggaggagggatygaaggggagyggaggggagagggagggggaggaaggggaggggaygagttgggygagggggyggggagtygaggygaggagyggygyggatygtgggggaggtggygggggygaggtyggtaagaggyggtygygggtygggttgygtygggaaayggyggttagattttttygggaaggggygagygagagtygggtygggtygggtygggtygyggggtygggaagygtygagtygggtatttttttattaggtagygatygaggagttyggtygtttatttygtgtygttygagttygtagtygttygtyggtttttttgggatgttygtaggattygggtatttaggayggtagtygagygagttygaggatgggagggtattygtagtttygtttygttaaggtaatagttygtyggttatttttygagygttggygttttyggtttttggyggaygygggayggggttgggttgtgggtgtgatgggggygggggygttgggagagtygtgtttaggtyggggaaggttgggtttyggggtagtttaattttttggatttttggagttagggttgggtaggtagggggagatttaggtgagaaaagaaatygtggygaagtygtygggatgttggyggaggagggggttygtttattygggtagtyggtttygygttaagaatygttttaggttttygggtagaygtttaggggaggggaggttttattttttaygttttttttgtagatttyggtttygggattggagattttgaagyggggtttttatttygttttagygtttttaaatagtttttygatttygtaygttttygttttagttttgggagygygttttgttttttttttttygyggygagttgygagttyggagagatgaatgtygttygygtttgygagtttttgattaatatygtagtttygggggaggagayggtgtttttggyggtagtttttgtttttygatygyggttgggagygygaygttygtttttygagtttgggtattygygattttygygttgygyggtygattttgygaygyggatygggygttggagtttaggaaagtagttagatygtaygtttagygtttgttygttgaagttygtgggyggtgggggyggttygygggttgtgtgagttagggaagggtygggaggtyggtagttyggttygtygttygtgttaggygttatttgtagttttaagygttttttagagygttttggttttgtagggtataggygygttygttgtagtyggtyggagaggygggtgggtttttgygttgttgtygggatatttygtttygygttagtttgggtatygttttattyggggttygggatttygtagggttyg

SEQ ID NO: 5936 - DNA, 2972 bp, Artificial Sequence
  Description of Artificial Sequence: Synthetic polynucleotide
gygggtygtagtyggagaggaataggaatygtagtggggaygttttggttttygggtttatagtattygggayggaygygtagtagygygggtygggaattgggtattagggygggatgggtgagaggttttaagggataaggtagggagaagygtagyggggtgyggggaatygtaygttttttttttgtttttgttttttatttygaggyggtagggygggygggygyggtttygggggtgggygggttgggyggggyggaggyggggtygtagtattggttttatttagtttttttygttygtagttagagygagtygagtygyggttagtttyggygggtagggggggygttggagygtagygtagygtagttttattagttygtaaagyggatygagttggaagtygagygttgtygygggaggygggygatgggggtaggtgttatyggtygygttatggaygggtygygtttgttgttgttgttgtttttgggggtgagtgttagtyggagggggttygttttttttttygggattagaatttygagaagagtygggygtygttattaaggaaatagaatagagtattggggttttagatattgagggtgggtggtgggaaaggatttttgatgtygggattaygaaggagggtttagggttttyggagygtagaggygattttttagggtggagatgagggtaagatyggagtayggatgtyggtttttaggtatygtagggggyggtgggggagttgggaggggttttttaagagggggtatggggtttttygatgtttaggtttttyggaagaggatattygaatgtygggatttygaagggattttttttttagtatttyggtttttggagagtygtgggatagaattaaggygagagaaggagggggaattggayggggattagagatgagaggggygagttgggttggggyggggagttygggaygaygggatggaataatggaggaggtyggagggattggaggtagaggggattyggtaaggataatggggatyggttagataatgggggggaggggygtyggagggagaggttggggagygggagagaggttgagaagtgggttagggagggtagaagaggggygayggygagggyggtagagagatggaagtagaaggaaaggagatagagyggggygyggattttgaagtggtyggggtttygtttgttygttgagggatagtgagaygagaagagagagtagaggtttggatatttttagygtttgttttygygtttttgttygyggttttttttagtttyggaattggggttgyggatttaaggttgggaggggagtgtttatttygtyggggygaattygttttyggggtttttttayggtyggygggttttttygaygygygtgtttttayggtttgaagtagygtagyggatygygagggayggagygggtgtgtttttattygggttggyggtggttaygtttyggggtgtagagygtyggggygtattaggyggggattttttttggtygygygtagttttggttaygtaggygggaggyggtaggtagggggygttgyggggygaggtaagtgtagttygtygttgtttgtttgygagtttggggttgygygtygttttttatttagttgygygattygagygtygygtttatygygtttygtgggttttygygtttygaagggtygggattyggtttgagttttttttggttttyggtgtaagtygttgggtatttaaygagaygggggygttyggaygtttyggattttgtagygyggtatttygggttatygattyggtaaaggtyggygggtttttygggtggttygaygagattgttagatgtggtttgttttatggttatgaatygaatgttttggaaggtttggtaayggaggaggygtttttatttttttygttagtattttttattagagtattgygttttaaatttyggttttatagatayggagattgaggttttgagagtttaaaygatttggttaagattttatagtaagttgggttagagtygtggttagatttttygatttgatttttagttyggtatttttttatttttttagggggtagtygttgttttagttyggggttayggttgygttttttagtagggyggggggggttgatattgtttttagagttygtyggyggtagagtttgygggtgaggtgggtagagattttgttygggtgygggttttagttygaaagtttagttttagttttttggagttgttaggatttgtggttgygttyggggatttgggagygatygygggtaygtttgttgattaaygtygttggttagagaygttgtttagaygygggtgggygagygtagattaggagagyggggaggagggatyggattttagaggggtaaygatttgggtttygggtttgggtaagagygagggttttygygygaagatttaaggaaggaggggagttgggygtggaggatttgggygtttgggaaggtgtatttygataggaatttgtygtttgtagtttttgyggttttygttttygtttyggygygyggttgttyggtttgggatggttgtgygyggttygagtttttttttgggtygyggtgagagagagagggttgaaattagagygygtttyggygggtyggttggygggtygygtyggtaatggaggtattttgttatttagaygtttgtaattagagtygtygggttggttaatgygtttaatagggatggaaygagggtagtaaatgggygtgygtgagyggtygggttgagttgggtggatggtggatggggaggtagtttygygggggaygggtttttatygtattgttttagtttagtttggtttaagygtttygttttttttttgggggatygygtggggaggygggaataatyg

SEQ ID NO: 5937 - DNA, 1026 bp, Artificial Sequence
  Description of Artificial Sequence: Synthetic polynucleotide
gygggygagtggagtgttttttagatttygyggattygaygggagggattttgtaatgtttaattagaatyggttgttatggygatagtttttaggtagygtgggttgagtttttygtaggaataaagggtgggtygtygttggattttgygygygttygttattaattttttttttagattygagaggggyggygygtttygttttygggtygygtaygtyggtgttyggyggygygtaygtttgygggagttttttttaggtaatttagtgttgatygttygtgtyggtgyggtygttaatygtttttgtyggagttttaggtttaaaagtagttttttattttttttgggttttttttaatttttttttyggtttgttttggggtatgagtagygatggtyggttgtatttttgaggagaaaatttatyggygttttttggagttatttttgggygagtttygyggatygtgyggyggyggygagtyggagtyggaattygaattygaattygaattygaattygagttygagttygagttygaatttgaattggtagaagttgaggyggtygaggtttyggtagaggaattyggggaggaggyggttayggtagtygygatggaggagggggattaggagtaagattyggagttygaggaggaggyggyggttgagggtgaggaggaggaggagggygyggygayggyggyggtagtttyggggtattyggtygtgtygtygtygtygttttagttgtygtttttgttttygttttygygatygttgttagagygtattattygygaggaggtggagggygaaagtttggatttgtgtttgtagtagttttataaatagttaagtagttgggtttggttggtggtgggttygyggtttttatygygtyggtttyggaygyggttttttyggttttttaaattgtttttttttttgtttttttttttygtattygygtttgtygtygttgaaagygttttygttgttyggattygggyggtyg

SEQ ID NO: 5938 - DNA, 10207 bp, Artificial Sequence
  Description of Artificial Sequence: Synthetic polynucleotide
gyggaggyggtatagttggagttyggattgtggtaygtygttatygtgttgtttyggggaatttygattygttttttgygaaagygttttygaaygygaatttagagtttgtgaaygygtyggtaagttttttatttttttatygtygttygtygtaggtgggttygttttaggggttttttttgygttttatttygttttttaagttatttagtygatygtttygtttaygttttygtgattttagatatttataattaygatttygtttttatgtatatttaaygtaygayggtgtatagaygtgtatttgatttttgyggattaggtgttttaagygtatagyggttattygyggaatygyggttyggggttagtgagtygtttgtagtttttygggttaggggattttttagaatttygggaaagttattygaagtttattygggatgyggttttggttttyggtygygtgatttygtttttaggtgtagaaygaygtttttttagggtttatagttgttaggttgggttttgttttygtatttttygggaagattagggayggggttatataggtygtggttgyggagaygttttttygggttatttygygattaggagggagtygagtygttygtttttttygygtttttygttttattttagttagttggttttattttgygygggataattgggaygggagggaggygaygggagggyggyggttttagagagattgygygtttgttagyggtaatttgtttaagtggaygggaygggtygggtygttgygggttggggttatygaggtygyggtttttattttaattagatttgggatygygggggagttyggttyggtygttaaatygggttggttggygttagggtttygggaggtgyggttyggyggggaagtygtgatgggaagygattttgtttagggagtgttttttattattatattttttaygtttaggtagtgatygayggtttggyggtatttttatagygggtttatagtayggggttatataygttttttgagtttagtttgggtatattygtttgttatygagggtttaagttagtttgtagttygygtttygttattyggaygtaagttygtygttygttttgttaygyggtygtatagttygagttttttgttgtttattgttygyggggttaygtaatttyggttttgtatatagaggaggaagyggyggggattttttgttatttggaggtttaattyggggaaggttttagtagtgttttttaattttgygagaggtgayggggtyggaggayggaagggtagttaygttaggtttaggatygyggttttattyggtttaggtygttttygttttygttttattttattgttgygggaagygyggggygtatagatygygygttattagtttaagttygttygaygttttggtyggagatygtttgygagagggaggggyggtygagygygygtttttygtttgtttgygggatttggtygatgygaagtgataggggtyggagttttgttgtggagtttyggtygtttggygttagtygttttygttygygttttttttttttagtttygggyggttygygaggygtttttyggggttttttaaaggaataygtatattyggttttyggggtttygttaggggagggggtttttgggaagggggagggggtyggtttaggtgggggaggggtttagyggaggttttayggygtygttttagggttttttaggtttttttagygttagttttyggtgagtttygggtatttttagttggagagtttggttgggggtygttatagattttttagagyggttgtagtaggattttagggtgatygygggatygyggggyggggygagtggtgggattttggttyggatagagtttyggaaagttagagggaaggtyggtgttattgtaggtggggtygtygtttttagatgtagtygttgtattgtygtygttaggtttttyggttaaataatttaggtttgagtgttttaaattttttaggtttyggatttttggattagttatggatggattaatgaaatggattaatgtttaaaaygtatatatttagatgtatatatatttttataaggataaaagtatgtgtttatatatatatatatatatatatatatatataygygygygygygygygygygattttgygaatgtatttayggatttttaggtyggtatttgggttttyggttaaggaaagttgttttggttattatttggttattttatyggttgygtaaaygtgtttataaygggttttttttygagaggttatatttygtttaaggtggagttagtaggtatttgtttgtggaaaattgtagtggattttgtttygtttgygtagattgygtagttyggagttaaagattygttttggttagagaggaggtattaagagaggtgygatttagttaagaaygaggtygtggagaaaattttgtgggggyggygtttatatatgyggtgatgaggagttgtgagggttttggggtyggtttygaaaagtagggataayggtygtagaggttatattgttttygtyggtttygaattygtattgttaggagagattyggtttttaaaygttgtttttaaygtttaataaygaagtgttttgygatyggtgtgygtagtgggygggygtttgtatgggttaatgttggatgtaygygtttattaygyggttgtaygggtgggaatgttattygtggttagtgtatgttttgtttttttttttagaaaaygatttttaggaattagtttgagtgttygygttygagttygattggaagtaggtgygtggtygttttatttttttygtgtatattttgagttatagttttygttgygtatagagggtattatayggggttygatatatatatatatatatatatatatatatatatatatatatatattattattttatgggggggaaattgaggttgtyggaagatagaaaaygaagattgattatagaagagggggttttaattataggtgttygtagatattttaatttttttaygygttatttagtattttttaatttaggagaygtgygttttygagagatgagaagaaattaaaaaagtggttggtagggygaagagaggaagtyggtatttyggaagaaggagattttygttttyggtatyggatagggygaaaattygttgggtygygggtggagaattyggggttygttygygyggtgtygttttgtgtttagygaaaggtgygtttatttttttggtttygaggattygtttttttyggtygttggaaagtttagggyggggttygggtttgyggagaattttaggtttttttygagtttttyggtgaaggygggygygggtagggggttttygygtttttttagygtaaggtygygtttygttttygttygygtyggttttagtagggttyggttatggttttatttattagttttygttatttgggattygttttyggatttyggtygttygagtttttygattygttygtttatyggtttygttttttagtgtttgttgttttttttyggggygtagggatttttaggyggygttaygattyggagttgggtyggaggttaggttggggttygggttagagyggtygggtttttgggygygggagaaggagggygtttttttttygttyggggtygtgttaatgttttgtatttggggtyggygtgyggttgygggtttttttttaaggtttygggattygggtttttttygttttaggttttttyggygggttaggtyggtttttygygttttttagttyggygtaggtagtygtaggygygggygggyggtgggggtyggggtaggaggaggggtttyggggttyggyggttygttattggttaatattttattttgttgatatgtttttttattgttgaggttttygatatttttttttaggttttttttttyggtyggagtttggtttgagttgttaaaatttygttttyggagatttataattggtttaaaaagygtaaaattagtaattaaggggggtttggttygttagygtaggggattygagttgggtaggatatgtgagatagttatagttttttagagattaygataagatttaattagtygygygtggttttyggygtyggagygggttagtttagttyggtttagttyggtttygygtagagttttygtygttttygygtatagagtygggtgttttttgyggtgygtyggaygggaagtttygaggagtagttgttgygttygttattygggtygttygtttatygygygygtygtygttygggtygggggttygagtygygygttttyggtttyggtttyggttttygggygtttgggtyggatgtttygatgagagagtyggygttggyggttagygttatggtttattattygttttaygygttayggttygtygatttttttatgttygtttttttggyggyggygtagtttttttttttttyggtattygygttgtygttyggygygttggttaagtygttgttygattygggtttggygggggyggyggtygyggyggyggyggyggtagtagyggtygaggyggggttgtaygtttyggtattgggttygtattygttygtygygtatttgygtttttttaagagtttggagttygaggaygaggtggaggaygattttaaggtgaygttggaggttaaggagttgtgggattagttttataagttaggtayggagatggttattattaagttygggaggtagggttgtyggtyggttggaaggygygygggygggygggygggttggggtaygggattgtayggattagagtagagttggggattttyggttttyggttttyggttttaggttttggttttgaygttaygtttygtttttayggataattaagttgatttttttygtttggtatyggagygatttttttttaaaataaaaaygttaaaatttttygaatgaaataaaaygaaaatatattgttaaagaatagttttaatygttttgagttttagygtagaggaggtttygyggtttggttttggyggtttttttygtttygygttttygtttttttgygttygggttygttttygagttygggggaaatttagttttttttagattttgtttygatttygaagtttttagtgggatttgggtttagttaattttaygttggttgttyggtttttggtagygagtttygggttagtygagtttttygttttatygggttgggagttttttttttatygygggtattygagttttggaygtattygtygttttaggttttaaagtttgaagaaagttatagtttyggtttttttatttttygatttagttatygagaatttaggtttygggtttatttttttttttygaattgtayggttaggatgttttattaggttttgtagtttagtttttaatataaatattttttagatttatttttgggagttttygttttaagtgggtattttttttgaaygaatttyggggagattaaggagaagygagaatatttttagagggtttagattttttttttgggtattagtttttattttagattagggagaaagagggtttttagatttgagtataaggtttaaaggaggttgtttaggagagggtttgataggtagaaatgggattttttgggagtaataattataggtggggtygttygggtagtgatgagagggtagagtagtygattataggggaaatagttaggyggtagyggtgtgygtaaygaggagggataaataaaggaggagtggggttttggaatttagaatagtyggttttaatgggattttttttttttttttttttttaggyggatgttttttttttttaaggtgygagttagyggtttggataagaaggttaagtatattttgttgatggatattgtagtygttgaygattgtygttataagttttataattygygttggatggtggygggtaaggtygattttgagatgtttaaaygtatgtatatttatttagatagtttagttaygggggagtagtggatggttaagtttgtggttttttataagttgaagttgattaataatatttttgataagtayggtttygtgagtgttggggtagggtggggayggtgtaggagtttgttgatttagtattgtagttgagtaggagagtagggyggtaggattttttagggggaagygttgggtaaatttttagagtgtttttgttygggttattgttttgtggtttaygtgggttgggtttgggtttgggttttagygtttttttttgtaagtttgggaaatggtggggttagtggttggtagtttataattttagttttttaggtygtggagggttttttgtatygttaatagggaggtaggtgttgttaggattgggtttgtagtgttggattayggaggttattttgtttttggtttgtaggtgtygagtttggaagatttgtttatgattttaatttgtttattatttttttgttaagattygygtttttggtttttttttaagattaggggatttaaaagttaaattattttttttatttatttttttagtttttttaagatttttttttttttttataggtagatgtttaattaggaggagagggtttgggggttttttttatttatgtttgagtaaggttttagygaaygggggtggtgttttatagggtaaaaggaattgtttattttgaggtagggtagttggtgagttttygaaggttggaattttttttttgtggggttagggggtttattagtgttagaaaggaagagagtgttaagagtggaattgtagggttttgttttgttttattttgtttgggttttttttgtggggaggggttgttttttggttggtttttttgttttgttttttgttttgttttgtttttgttttgttttatttttgtttttaattgggaaattttttttaatggtaagagaaaaagaagttgtgaaaagagaaaagygagaggaaaagtagaagaaaaagaaataagggtgagaaaagagtagagataggagaaaatggggaagaggaagaatygatagagagagagagagagagagagagagagagagagagagagaaagtggagaggaagaggttaggtatttaaagaatagaaaagttygggtyggggttggtggttgtyggttgatttttatttttttygtagattattttaaattttatgtataagtattagtygygtttttatatagtgygagttaaygatattttgaagttgttttatagtatttttygtatttaygtgttttyggagatygattttatygtygttattgtttattagaatgataaggtgygygyggygggyggtgggttaagtttttgtattgaygttttttaataygtgtaggtttaatygttygtttatygtttttygaagttttttgtaygggattygygtttttgyggttygttttygagtatygagtttygtatttataygygtagtatttayggaagtttttaaggygtttttttaattttatygygygtatatataggtttttttggggygagygaatagttgggtygtygttttgatggagatgtttatttaataattagttgagatttygggttygygttgatatttttatattttattygtttattttttggtttaggaatgagaatgtaagtgaagagagggygttygaggtaatttgtttaggttttatygatgtttagaattyggggtttagtttttattttttyggggggagttagagggtgggataggtgatatagttttttaaagtatttttggttattgttttgggttagtttaggttttagattttttgggaggygtttagagaattattttttaattaaagggttttttttgtttgyggtttttttatttttgttttagtggggtagagtattatttttttaggtttgtgtttttgtgygttattgtygagtgaaagagagggtaygagtgttygtgtyggtygttgtggttttgtgaattaaggtgtaygttgggttgtgygtgtttygtttggggtgtgttggatatttgtggaggtatgtgaattygtttggtttygtaggygtttgttatgtttgtgtatatttgygtgtgtgygagttygtgagtgtgatttggttttgtgtgtatttgtagttttgygtgtgaattgtagtttttgttygygtttgttygggtgyggagtygtttaatttgygtaagttygygggygggtgtgtatgtttgggttggtttygatattgtggtattgttttaggtttgtgtggggttgtttaggtttgtttagggataatttttygaatgaagtttttggaggatagatttygtygtttttygygaggtttttttatyggttttagttyggggygttttattttaggygggtgggtattaagtggaygtttttygggttttttttttgyggttagtattygttgatttyggggtgttatygattaygttggaagagttayggtttgatttagygtygtttttttggttttygtagattatatagttgaagatygataataattygtttgttaagggttttygggatatygggaayggtyggygggagaaaaggtgagaggtygaggatagtagttttgtggygggtgttygygggagtagygagtaggagggatggagggatgggtttttygttgatttggtttattygtttatttttaggaagtagttgaygttgtygtttttaygtttgtaygaggagtattgtaaattygagygygatggygyggagttagaygtttygtygtgygatttttttttygygygggaattatttattttttygggygtagygtttagttygttgygtttgtatygggttygaggtgagggtyggatyggaggagggatagggaggtggyggyggggggtttttaggtygttgggttggttttttgttgagttattygttaatttgaaaggttaggaaggaaaygtyggygagtgtttgggatggggttttygtttygggatttttttaygagggyggttttyggtagttagaagattyggtyggatttygagtttggttttttgggygtygtgtaattttatagttgtagggttttttttttagggttgggttttttttattgtaaatttggggttttggattaggtgatttgtagttgttttttgttygattttagtagttttttygatttggttttttygagagtagtttttttygagtgtttttgattttgttygtyggttttygtttaggtttttgtaattygygygtttttttttygtagttgaggagaagtygtgygtygyggatagygattyggagtttgagyggttgagygaggagygtgygggggygtygttaggtygtagttyggttttagatagygttagttttattygtttgatygaattygagygygttygggagyggygtagtttygagaggggtaaggagtyggtygagagyggyggggayggttygttyggtttgaggagtttggagaaggagygygtygaagttyggaggaaggaygaggggygtaaggaggyggtygagggtaaggagtagggtttggygtygttggtggtgtagatagatagtgygttttttttgggygtyggatatttgttyggtttggttttttttagttatttgtaygggtagtagttttttgggtygttgggagtyggttagtygttttttttgtattttggatagtttattatgggttttggygtttttttygttatgggtatgggttatttattggtttyggtggtaggyggyggtaayggyggaggtggygggtttgggatygtygyggggttggaygtaggygggttgggtttygyggttagygtagtaagtatygtygygtttttttygttttattttttttagtatatgttggtattttaggtaaggtttgtgatttygyggtagygttagygagggagaaggtttagggagttggyggygaggttagyg

SEQ ID NO: 5939 - DNA, 2392 bp, Artificial Sequence
  Description of Artificial Sequence: Synthetic polynucleotide
tyggattttttgttttttyggtgagtygttttttttttgtygtygggttttttttttttttttttgtttagttaaaattygaatttaggygttaggggagaggatygtygttttagtttgttttattgttgggggtayggagtttttgtttttttaaggttayggttttygttttygyggatttygttyggattttttttggttatygggaygtttygttttttttttttygtagtaattttttatattygggttgtgaagttyggggtatttttaggtyggygataaataatttatagggaaygtggtattaggtttttttygygggaggagggggygygagtagygagagttatygttattygyggtttaaggatattygygatgyggyggyggyggyggyggyggyggtttygggyggggattygygttaygttttttggyggttaagttgagtattaygtattyggygtttttygttttaygttgtttttygtyggygttygyggtttyggggtttttatttttatttttttaagttgggtygtgatttygagtttygtagtggggggattaagttagtttggtaggyggttttagtattattttaggttygttygggggttttgggygaatttaggtgtttyggatttgtttatttgtttttggtaygtttttatttttygggagtttagaaataggtttaaagttattagtatygttaagatttggaygggttttgaaatatagttagyggaatggtattttttttaaataagtgttttttttygatttttttgtggttyggggttagggattgaattaagataaygttattattygagggttgggggatygagttagaagtttttttggaygattagggttgggaaatygagtggaygaatggggtgggtattagggtttggygggaattttygttttgtttatttagtagttttttgtagggtygygggaygtatttgggggtttaggttgtygggtgtttttgtttygygtgttttygttttgttygygtaggtaggaaataggagattyggggtttttttttttygtygtyggggattttgggygaagtttttagagatyggygtaggyggttggtgygtagttagggtttagygttaggttttgttygtttagtgttttttttgtttatttttttttttgygttttggaagttygggagtygggtaygggttagtatttgtaagatgttattattttggaagtttatttygatttttttaggtygtaggaaggagagagttaggttggggtaaaggagatggggtagagttggaaggggaagaagygggattygyggygggggaaggggtttgggygtygaggygagtgygtagtaggtgtttagtagatttagggaaattggggtattgggttggggagtygtatagtttttttttattttttygatttttttttaatttttygttttggtggattttagtttyggtttttattttyggttttgtttttygtttttygtttyggyggtttttagtagtaatagtttgggttygyggtagtttagatttttttggtttygyggtgttgtygygttaagygaaggaggaggagggttyggygattttggggaygaaygttttggaygtttygttygygtttttttttygygttygtygygygtttgtttgttyggtttttttttygtttttttttyggtygttygggttaaaatttaaggttaggtttttgagggttygggttttttagtygttttttttttgagtttygagagttttgygtgggtttaatttttygggtgtttygtttttgttttygtygtttttgttygygygtygygggaatttagttttaagttggyggygaagttggtgtttttygttygtygttygttatttatygaggggaaggggygttgygttygygaygagagttygygtyggtygtttttttygyggtgtttgttttagagtttyggtttyggagggttggygygtttagttttagtttygygggygtyggagttygggygyggtggggygggggygggggygggtggygyggtttggttygttggtttygattygtttttgygtttygygattttttygaggttygtayggygttyggtttygtttygggttgggttgygtatygygttttttgtttttagagttygtagtygattgtgygggagtttttatygtygttygygagggttygtttygtyggggttygttattttygtttyggttyggttyggttygttgtttttygaggtttttttygtygtattttygggtttttttttttttttyggaatygygtttttagatttgatattyggggtaagtgygtttyg

SEQ ID NO: 5940 - DNA, 564 bp, Artificial Sequence
  Description of Artificial Sequence: Synthetic polynucleotide
tygattttttttygtggtygttagggtaggggtgggaggaatttggaagttaygtgygatgttyggagttgygttttttgttttggggygtgggttygygagygtygygtagtttttyggatygttttgagttgttgygttyggygttgtttttttttttttagtttygygtttttttttygygattttttttttgttttttyggttttggaagygttttaagatggggtgggggtatggagggagagaggggaggagggagttgttygggggtagtgtygttaggaagtgggayggggattttggygtttttttaggttgttgygygygggttggggatygtgtatygttttgygygttagaygatgtattttttggaayggtagttgaggtaatgyggggtgtgaagtggyggygggtagaggggttygtaggggttgggattygygtgtttttttttgtttyggtgyggagtaygatgtgttygggygggggygaggaygttygggaggggttgggttgygtaygttygyggggtygtygtagatgggyggtttggaggyg

SEQ ID NO: 5941 - DNA, 3277 bp, Artificial Sequence
  Description of Artificial Sequence: Synthetic polynucleotide
gyggttgtattgttgyggggtgtaagggygggggaaattatatygttaggygaggygyggggatygtgttggaaggttygyggygyggttttttttgggygattgygggggyggtttggtagggagttggggygagtggtygtygyggggtttygtaggygyggggaggtatyggtygggtattygygyggttgaggygagggygggggatgtttggtygggtagggaayggggtgggggagggtagaggggygagygagtyggagggggaatyggagtygagggygygygyggatttygaggttttttaggygggttttgagygattgtaaagtttgttygagttggttgagygtttyggyggtyggtgttygggataggtygtttatggtgtttttgttygagtygggttgtttgyggtygtygttygttygggtttygtyggtttyggggtttagygtgttttggttttygtagyggtttagtttggyggttagttygyggatggtttttttttggtttaggatggtttttttttgttgtagtatygtttygyggagttgtagtaygttgtttyggagtttttyggygtygtyggyggttayggaygyggygtatatgtyggygtttaygggtatygaggtgtagatgaagygygtyggttygaaattttgggtttyggygtttaggaggtagagggygagtagygtataggtgygygyggygyggtyggtyggtatggttgygggtatygggygtttygggttyggttyggttyggttggggttyggtttyggttgggattyggttygggttgtggtttygygagyggttygygttttgggygtygygtttttyggtygygyggtttatatygtygygttattaggtttttattgtygtttgygttgyggagttygygttttttatgtygtygygggaggggtttygagtygtygaygttagygggggaggaatttygttttaattgttygyggttygggttygyggygyggygggggttttaygagygygttatyggggttgttttygttygygtttttttygtttttttgggagttgtygyggtttttttttttttygttttygtttgggtyggygttgttgtttygaaggtttygagagtttagggggaaggaagtygggtttyggtttyggattygaggatggattatttgygtggtgttttygaattttygayggggttttaggygggygggaaattatygygttygggagatagaattyggttyggtttttttggttgtattgaatatttttgggtyggggtygtttggagtygggttgggtgtttaaggatttaggtygttaatattygagtgttyggtggttaayggttyggagtggggtttygyggygttattaagtttagagygggggttatygggtygtttygygttttttagatgttygtgtgttattgagaagtygtygggtagtttgggtatagggattttttaygggtyggggttttyggygtttttttttttttagttttygggttttgtggattyggtttygttttygggggattgttagtttttatttygtgygggyggggygttggggatttttyggaggtagatttagttgatygagttttttttgttygyggygtyggttygatygygggtaggyggygtygtyggggttggaygttygtagyggygtttyggaagggggtttygygggagtagtygttygygtttttagtagtttttttttgttaggygtygygygygttyggtattttygggtgtttatttgtgygtggggggttgtttttygtttgtttagtygygtttattttttaggtttaaaggttagtaggaagggtttyggaggtggttgggggygtttatttgagaagtttygttttygtttagatattttattyggtattygygtattygygtttttatttggatygyggggttyggttttygagatygyggttygggtttyggygtygggttgggggtttaggattagggttggygtagtygtttygtttygtttygtttyggggttattagagyggttaaagtttyggaaattttttygtttaygttttygtggtatagagaaggaaattgaggtttygagattgyggggtygggttatagtygtggtttttygattttttttygtygttttyggtttttttggtttttgygttttgtagtttttttttgygygtagtygggggttgggggtttttagttagtagggatttaygggtagtttygggtgtygggatygggygttygtttttygggygggagtagaggtyggttygatggagatttttttgagaaatggyggtttttattygttttttagttttygagygttygtygtttgygtttagtattttagtttttaagtttttttgagtyggggttgygttttygttgtttttttyggtygtygttttttggygttagagggatttygyggttygtaygggtttgttttyggtttygttyggagggtgtgygggttttygtttygttggtttygtttgtttattayggygygtttaaatttaygyggttygyggttttttgygtgttttgtygatttygggtygtaggaggggttagtttygtyggtttttaygyggggtttgygtyggtagygttaygggttggaaygygtttygggagaaattattygygyggggtygyggygttttttgttttaattttygtagggagtygttaggygggtgtttttttggttttagygttttggtttygtygttttttygtaygygtttagtggggaggtygygttygttaggtttggagtyggatygtgtttagtygagagygygygggygygggagaggagttttgttttgtttagggtaggttgtttagayggggygggaatttttagtttggtttygygtttttatttttagtagtygtggagtttttttagtygtttaaggttagggattttgtttggttttttttttagggtagtagattttagyggtttggtatttyggtatagaggagygtgtttttttttygtagaggaagggagtggayggygttagaaagggaggggagtttggggyggtgtttggggttagygggatttttgggtattgtggggttttaggagaggagattttygggtttagtttgtaattgttgtgtaggaggygttgggygggatatttgtaggygttgtatatataygygagggttattatgtygyg

SEQ ID NO: 5942 - DNA, 5692 bp, Artificial Sequence
  Description of Artificial Sequence: Synthetic polynucleotide
gygygttttygtagttygtyggttaygtatygtaygtaygygtttttttygygyggggtggyggtyggygggagttaygtggagtagtygyggtgttttyggttaygtttggttttygatgtygygaagggggttttggggtaggtttygtttttygaagttgtygttgyggtttttgttagtygggagaygaygaggggaaggggtgggtygygttgggtttttygtttattygtttttttttagttttgygggggttaaattygtttttaataaatttygygaaaaagtygagggggggaygygtygttgttggagaataggttagaagtgatagtagaatgggtygttgagattttygttttygtttyggtttttygtyggtttggygggyggygaygtggggaggggtygtttagaagtyggggtygttygggtyggggaattttttygygtygaygtttattttttaygggtygtattygtygaggggtygaaaggggttttagtggaggaygyggtgggagttgggtttygttttagttgtygaygtyggyggtgttygggttttygggagygtagtttttggtataaagtagygtygaagattttgtygggtgtttygtygyggttgtygttgtgttygygtagggtyggttygtgaatgygtgygggggttttygagggygttttttttattttgygygttygggggagttgttyggtygtygtyggtaggtagaggtttygggttttatgggtgttttygagatttyggatygtgygttgagaatgtygaygttttaaaygagttagtagagygggtyggagttttggtygggaatyggygtygygtgygtattggtyggygaggtttttggttygtyggggaaggagtttagagygtttgttttttyggtagaaattaatatatataaataattattygtattttttatattgggggattgggagtaaggagtaaggataggggaggggataggatttaattygttggttttttattttaaaaattatatattttatgttaygatygtttttygttaagattataaatatttaatttggtttggygtaataaaattagtyggagtttttttaaayggagttatttyggtgaattaagttgtgaaatttaatttattatatttataaaggagaatgtttttattgtaaatttaggttataaagaaattatatttgggtygtyggtttttttttyggatttattatttgaaggtttattaaattattttaaaatgttgggttattttttttatattttatggtaataaaaattaaaygtggtaatattttttttaatagtaggaaaggttaaaaataatygttataataaggggatataatttttaaaagatatttttttttatttygggatgtttttttygygtttggaagygttttttttatttttttaattaattygagtttttaaaatatttaaaygygttaygattttttttaggttttttttygttttaygaggygtttgaggygtagttttyggatggatygtaygtggggtygtagattttgggygttyggaygttagtyggaggygyggggatttygtggtttygttgygaatttgygttttatygyggttygtatatttgggtygagtyggggtygtttygggagtttttygttggtttttgggygttttattyggtttagtaatgttygggttagataaaggagtygttagggaggggttaattygttttttattttttttygttttttttttygttttttttttaggyggygyggaggagagaagatgyggtttttaataatgtgtttggtttaatttgyggggtgtgggtatttgttgygtttttttgggtgagggttgggtttttttttttttatttttttttatttttgtgtatgatattttggttggggtttggggygttttgygttggttagaagttagggttattagggatttttygttttygttttygaagaggggatttgygyggayggygaggaggatygatgygtttttgagtttttagggaaaygaggtygyggttgttgttaygtygygaggaagatttatgaggygygggtygagtatggttyggttyggyggaggtygttygygtatttaggttaatttttgatttttatttgattatttttttttttttgttatttttaagtyggygttyggaaaggygaataaagggaggaggatgggggatgggggygttaagyggtggygagggttyggttyggtaatttttttttttagtgggggtttttgggygttttaggttygygtttaatgyggggtttaggagggygtagtttgaaaggtgatygggttggggttgtyggagattygttttgyggggtggtttttttagtygttaggtttaygataggatttttagggaggggtttttgtaaatgtttttgggygaagagaggayggaaagaatatttttttttaaattgtaattaagggtgtgyggggygggggtgtttggggggtgttgyggtaggtygggttygtttaatyggaggtagtagtttagttttgggtygataaggtygagggaaaygggatttttttgtttttygtayggaaaagatttatttaagygggtaagagggaagygaagtttgtattttttatgttgaaaaaaaaatttaaaatggaaaattattttattggttattatttataagtaaattaaaaatagggataattagagtgtggggatttggagggattataaatttgyggygttttttttattggaattaggagtttttatggtttgttgttttattttgagagaaatgagatttttggttttggtgtaggygggtgtgygtttygagygtttttyggygggggggaggggggagtaggaggggygaggagatttgygtagttagggagtygygaatttygagtttyggttttygaaggyggtaggagaaatygygygttgtgtttygatttttttygttttggttaatygygatttgggaygagttggaggagtttttttygggtttyggaygttygygtygaaaatygggttatgggtattaaattygattttaggyggttatttattttgtttttatttaaattttgatgagttatttgggagtgygyggggattgggaagtgagggatttttataatatttttttttygatttyggttttygagtttattatttattttgtttttttygttttygttttttgttttaaattggggaggggggaggggggagagaaaaggatataaaattatygttttttygttaaatttttaaatttttaatttttygtaaaatggtttggaatttattttattttataggggttttattttttatygggtggaggttagttttttaattttttatataagtaggatttttttttatttttgaaagtttttaaatttagttattttaaatgtaaatatygtgtgaaattttattaattaggtaagaaagtagggagagttttgatttagttgtttttaattttgggaggagaaagagaaagtgagttttttttttattaagtattttaaaataatagygttttttttttttagttygttttaatygtagttttgtttttgttgaaagatttttgttttttttaggaaggggggyggggaggataggtttatatttygaagagttttgtttttaaaattgttygaagatttttttgtttgaygtgtatatgggggaggggaaggagttygtttaggttattyggttttttyggatttygtttaggttattyggttttttyggatttygtttaggttattyggttttttyggatttygtttaggttattyggttttttyggatttygtagaatatttttaaagtttatgggygttttttaatygtgtaagttyggggtttygggggttaggaggggttgttttaagataagggaagttgttygttagattggggttaatatygggtttttttaatttaagtttttttygaaaataatttttttaaaattgagtatttttattagaaaaaattygtattttttaggaggayggggtgggagagtttyggggaataaagttyggtttttttagttttgaggtygaggtagggygtatttttttttgggygaatttaatyggagttgtagaagagataagtatttttaaattggtattygtttygagtttaaggtgagggtggagaagggtttttggtggaagttgtaggaatattttgggtyggggtttatttygygttyggyggtttttygaatttygtagaaagataygtttgtagygaaaggtttttatatattagtygggattttattygttttttatygagagtgygttttgggagygygggaaataaggaaaaygtaygtatttggyggygtttygagggyggtttygygggtttttygttggygaaggtttttagaagttatttttygttyggttgttygttttayggttagttttttttttttyggygaygtatttygtygagttagtttataggaagygttaggagtyggagatttggttygttttttygggygttgygttygttttygatygttagggttygygtttttttttyggttayggtttattagagggatttygyggygggttttggttygggygygtttttttgygttygagtttttaggttttyggtygagttgyggagayggaygyggagttttyggggaagaygaggyggyggyggtygtygttygggtaggagtttyggggygggaggggtgtagggyggaggagygggygggattttagygtttygygtttygyggtygtygtttttyggggygtttagttttatttaygtggaatygtttygttttygtygtttygtttttaygagggaaggtattygagtttygtygtatattygygtttttyggtttygggttygaaatatygygttttttttttagygtygtgtttttygtttttttagygygyggttttygttygattygygygttygttygattygtttttaatttygtttaattatygtttttygyggttgttttttttgtttgagttttyggygtaggttaatggaattaygyggaggygygggyggtttggttaatggaaggtttagggggygtggttggygggaggggttgygggyggtygggttttatgygttgagattygagattgygtygtyggygggtgygtttaggtygtttagttagagtyggtaggatttygtygtygggttgtgggtttttgatttttttttygttgtygggagaagygtttgagtggggagggaggtgggaggaggtggtttygygtygggggtgyggggagygggayggyggtttggatggatayggttagtttygggtyggagagggttyggtttagagtagtttgggttttgtttagagttttattgtgtaygttttygygaggatttgyggagagaygtgtaggygaygtaggtttygggaaggaaggagggtatttgggttyggaygagygataaygttgtgttttgtgatttygtataaayggattttggagtttagggaaagygttttaggtttttagttygggtagggttygtgggattggygttyg

SEQ ID NO: 5943 - DNA, 7937 bp, Artificial Sequence
  Description of Artificial Sequence: Synthetic polynucleotide
gygtygtttgygaggggygttttgygtggattyggggtttyggggygygtttatttattygagttaggagagattgggttttayggtgttagtttygygttygggttygygygtygtttttagttygygttttttttattttyggagggtttygygggttttyggygaygggtttttgtttagggttygggaattttttttttttttttttttttaagygttattttttyggagtygggtyggtygttttyggtgtaygygggaagygggtagttttygtttgtattygyggggtygggattyggaggtattygttttttygatatattygttggggtygttgttygttgttttagtttttygaggttayggtaagagttygggggtyggygttatatatttttagtyggygatygygtttagggatttaatttaatygtttttagtttaatgaatagtygygygttaatyggattttygygygtttyggggatttaygtttttyggttttttttttygtgtttygyggttygttagaygtygttttygaaggygtyggtttggggtttggttaggggttyggtygyggggggtttyggtygtyggagtygggagaygtyggagaygggagtygggttygygygatygttattttygagttagtyggggtgggtttygygttttgttttgygttttyggttyggttygyggagygtyggtgtttatttgygagtttygggtttttyggagttttttttygggtygagtygttygaagygggygtyggygtaggtttygatttaggtaggygggaaatttyggagttttygttygyggttygtagttttttattttaggtyggygtggtttgygggggggaaggtyggtyggggtyggtygttygttttttttttttttttagatttttttgattygygggtttttygtygtatttyggttttygggttgtttyggtyggttygyggggattttggaaayggtttttagtttatttttttttattaagyggttttgggtygttttgaaatygyggagttagtaattgttttttttaggaggtttagtgyggattggataatagttaattagygttttgtttatattyggtgatggatagtttattggyggagtgttaattaattttagyggtttygygggagygggagtgggggyggggaaatagagagataataggttttgagtttaattttttygtgtttttgtyggaatgagayggtggagaatttygaatgygtgtgaatttgttagttggtttttagtttaaatattttttttttttttagagggggaggtagagatttatatggagaaagaggagtaaaaataaatgtatttatygttattaagatattatttygattttttgagaataaatagtatttgggtgggaaattaaattttaatagaaatatttgtttgyggaatattttagaagtggtttgtatttgattaygataaaaattgtttagtggtttgttttagttggagtgaggatttagtagataggtagatagggagtagtattgagaaatattatatatggtttattatattatattygttttttttattattaaattgaaaatattttttaaatttaggtgtagatgaagaaagggtaatttttgtttttttaataaatttttgatttttattttagtagttgttttgttgtaaagtgtggtagagggagataaaattgagagttagtaatgtagayggttggagatttagaatttattttttagggtttgatttttaggttatggggaggagagagtyggaygggttatttaaagtttttgttgtttaagtagygggygtgygtgygtgtattygygagttygggttygggtaggtagtagttttagagyggtagatgggttaggtaatttggggaggtttttgggtttggaggtttggtttatttgttatttgttagatagattttagggagaaaaagtagttatttttaaggggtggtggtgtttttttttttggttttttgtgyggtagaagttaaaygttagatttgttggattaaatatatatgtgtgtgtgtgtgtttgtgtttgtgtttaygttttttttttygtygggataygygtattygttygttttagttttttttttygttttgygttattatatttttatttagtagtaatgatttgygtagaggagttgygtagtygtygggtttgaattaggygttatygggtttggtagtagtttygttgttttttgattggtagttttttggttyggygttagtttattgggaggtttgtttaygtygaatgagtggtaygagttttyggtygtggagggttgygyggttaattagygygttggttgtttygggttgagtggtaygagtttattagtatgtagggttygtggttygtygygttaggttgtaggtttgagagtygttttggatgggttygttagagtygttgttgtggaagyggtgtatttatagtgtaatagttagtatattgaaaatattaataggaatataaaataaagttatatttattgatttaattgtattgtatttagttgtatttaggaaatagtttttagtaagtaattgaaattgtttttattttttttttgtttttgtatttttattattattttattttttattttggttttggggttttatattttttttagtaaaagaaatttaggattgtgatgttaagaagtatatatttttttttttaataaaattygttaaaatgttgaggttttttttttttttaaaaaatatggattatgagygatttttttttttttgaaaaattttatygatyggtttaaaattattttygtaatgtatttttgttttgttttgagygtttgttgtttygatygatatttagtattaaaaataaatattygaagataggatagggatygttaggttgygtttggygygagtygygygggtggtatygggyggatagtaggygaagttygggygtygttagygtgygtttagttttgggtgatttaygaaygaattttaatattygtttttttattttgttttttttttyggaatagttttgggttggttttgttyggtyggttygyggygaggggaattggtygggtygtggtatttayggtygttgttttgaggggtttttygggtygaagttaggggtyggggaggggaatggttatggygagtttttygggttttygtttttaatttagaatttttttttttyggagaagtgggggtggaggagggggatygagtaaggtyggygtagyggggygtttttatygygygygttygggayggygygyggggttygggttayggttygtgtggyggggttygygggttggtttttttygggygygggggttaggygygattttagtttttatgatttttttagggagygggtgyggttgtttygtagggagygggttttgyggygayggtygagttattygygttttaaggygygtttggttttagttyggtttgtaggttttatygygttygygttttyggagaygaygtyggagggaggtagaygggttagagttttggttttyggtaggygggygaggagagagygggtttttagatgtaaaagtaggaaataaagtaaatttgtagaagttttagattttggagygygttagttaygtttggggtygyggtaagagggatyggyggttttagggttaygttttgttttttygggagggagttttgtgtttttaggtttagtttttttygaaatgttttygttagygatttttygttygttyggggttttttgttygtygttatttttygttttatttttttttttattttagttygatttggygttgyggygtygttttygyggtttttyggygyggttttttttggagttgggttgggagtgggtttygggtttyggtattyggygggtggyggygtygtygttgygggattgtgggatttttagttygggtygtgtggtygttttttttygttttattttttggtygttttaggttttttaggttttygaagttyggygygggtagaygyggaggygyggygyggttttttttygggaggagagaatataaagaaaagttttttttaattyggttagagtygtggyggygtaggtaggygatagtaatttattttttgtttgtttaaaaagtygagtaggttggtgagaaaggaataatygggtttgygattygttygtagggggtgggagattaaaattgttgtttygtagtygagttygygtttygagaatygtyggtagttygygtttttttaattttgaaattttttattggagagaaaaaaaaaaaaaaaaataattataaaataaaagtatagtatataygattttttggaggtygttaggaagtttggtattttygygtgygtagttttyggttttttttyggttttyggygtttttgaagttgtaggtttttgatttttttttttttttttttttttttttgtttygttyggygtttttyggggttygggaggygtyggtyggggttgggggtttttaygtttttagtttagttygggtagttttttttttgatttttgygttygtagttttttygttagagtatttttygggttttggyggtygggygttygttttgtaggtygggatyggggtttgggagtygagttatttgttagattyggggagagagttggygatttttagagggaagggagttttaaaygtttttgtatgtagttgttagataaagagaattttttgtgtagatttatttatttataatgtaaaagtttttygaataaatattaaaaaagtttattagttgagtaaatatgtatttatttaatatattatgttttyggttatagattaaattaaatataaaatagtttgtaaataagaygttttagaattyggattataaaatatygtaatttaaaaaggtatttagtagatggaaaatattttaatygttttgttgttatggtggaatggttataaaaatataaggtttttygtaaagtttttaattaggaatattaagtttatttattttttttttgttggaggtgataaatattaaaataataygtatttagaagatgaggagtaatatgtgaagtgygtttagggagygttttyggagggaygtttgggagtayggtggtgtaygtagtttttattattggtttygatttttygtatttagagtttaaaattgtttttaatttygtttgagtggatgtttygygttgggtgggggtggaagaaaatggaggtgagggttattttaggtggtygaggttygggtagggtttgttggtagaaggttgtgttgggtygggtttatttttttyggttagagggtygagttgggygtygtagatttygygtatttaggtygttyggtattgttyggagyggagatyggtttttgttygyggttttyggtaggygttgaaggaagaaattttagggtygatttgggtygttgagagagagtattttgattttgaaagtattttttttatatatatttttaagtttttaattygtagaggaagattttgggygaatttgattggggggyggggtgattgttatagttttaataggaagttttyggtttygggatagtaggtygggtattgyggygtggyggtttaggtgatgtyggtggyggttgygggttttyggggttttgaggagtyggtttggggttttagygygatgttggggataggagttggtttygttggggttggggaggggggattayggtggatttagaagaatgggtygaaagatgtatgagggggatgggagtggggagaaaaggaaggttattaaaaaaaaaaaaaatttttgagttataattaataaaattattygtttaattagtatggttattyggttaagyggaatgtagtaaaagttggatttyggtatgaggtggggagagggggagagttagtgtggattttaggttttttttttygagatatttttgggtagygggggaggggagagggtgtgygtgtgagtgtgtgtgtgtgtgtgtgtgtgtgygagtgtgygtgatggtttygtagatttgggtttttattatttagtagagttagtagttttttygtygyggygttttagttgtagggattygyggggaygagaaygggaggyggygagtagtgyggttgggttttttyggttgtttygggttaagygtggtygggayggtgygtgygygygyggggtttygggtgttgggttgygygygygtgyggyggggagatatygagygtttyggtttygttattyggtttggtygtygttygttygggtyggygggggtggggggtggggggagtgggtgagygggyggggyggggattttygggygagtygagttttttagttattygtgttttttttgtttttgtttttatagattatggattygtatagyggtygttggttyggtgygyggtygttygtygagaagtttagttttttygygtgttgatyggtttygtygttattatygtttgtgatttyggaygtygtygtttttgygtygttygygygtygagtygttttygggtttyggtygygttgtttygaggaagyggyggyggatyggggtyggggttyggtatggatggtygygattttgygtygtygtygtatttgttgtyggagygygggagtttgggttatygtagygtygttgtygtygygygtttygtttyggttgggttygtygygtagtttttygtatatttttagtygggaaagtatttttygtygtygttgtttatggtttygtatataggttagtgttyggtyggggygggygygggaygggagygttygagagyggaatagggygtttattttttygttttygggagtagagaagttttggttttatttttyggtttyggtygyggtggttgtttgggygttgagyggggtygygygtttygttagttttttaagttgygtygtygyggtttagagaggtttttttttggttattttttttygggggtttyggaggggtagtttyggagtyggttgaaattaaagttttttygygtttygttattttttttygtttttttttgtagatttaaattttayggaaattttttttttgtattttgtatttatttttttaagaygtttyggggttgggataaygaggygttttttgyggaaataaaayggttgttgtggyggggggaggggattagggtaygtygyggtttygyggattagagtggtgtgtgygtygggygagygttaatagggattgttggtgtaagaygagtaaattttgtttttatataaagttttaaagtgttagggygagaatgggtttgtagggatgtatttgttttaaygagtgtttttggtatttygttaaagtyggataaagygtggttagagtgyggtttagttttttagtttgyggttyggggaggagggtagygygggygygggttgggggtggygyggggyggygtttaggatttyggtgtaggygagagtgyggyggatttgttttaagaggagagygaggyggatttgttttaagaggagagygtggggygtygtgttgggtttygtagggayggattttttygggyggttttttttgattttttgttygagaggattagtttttggtagagygggtttaggtttttagggtagtttttttttyggtggttttgatatgagtgtygagggaggttagggtaggggtagttattaygtttgaagttttagaggttattaggyggygygggtagattygggggaagygygtagggttgygttagggattygtyg

SEQ ID NO: 5944 - DNA, 1408 bp, Artificial Sequence
  Description of Artificial Sequence: Synthetic polynucleotide
tygaggtttttygaygtggatatttaaygtttttggaaagggagtgaattggtaggatattatygtttyggttagtttygygggagttgttttttagaaaaaaaattttttagagttaaaagttattttttaagygttttggggtttttygggygtttttttyggayggtaattttagaagttaaagygattgtatygttaggtttgtggyggttggaagyggggtgatygyggttagatggtatttygtatttaygtagggttgtgttattttagtatagaattagtaatttttataygaagttttgtgtaaatattaygygggtttatttttgaaygattttttgatgttttygttgyggttatttattttatatataaattaggatttygttgataaattttygtgtttttattaaatagaaggttgttttgtagtttttttygtgtttttttttaaagtaygataatatttgatatttttataaatyggtttgtagaggatatygygtagggggygattaattagttgaggtgtgttattttaaaatattagtgggtatattttaaggygggtaygtggaagggaygyggaatygagggtaattattttttagtyggtgaatttgatggagaaagatgttaaatgtatttttygagttagttgaatttttygggtatttaattattgttagatgtggygagggygtayggagaatatttttagtttyggagaaaatattyggtygttagygyggggatygttygggtygggaaayggttagaggygggaggagagaggattgggygagygtggggagygttgyggygtggaaaagygatygggagggatggygatgtttttatttttttyggtaggtttttttaattaaaaagttggaaaygggaattygtaaataaygatttagggttttaaattatttgtaaagaygygatggggaggggaatatttgygygttttaaaattttaatttygaggtttttagtygygtttgattygggagtygggtgygtttttagtgttygygtaygaattyggygttttggtagtttygatttttygggttygtagtttaagggaaggttygygygggaggtattttygtggtttttygygygtttygaagttygtttttttygtttagagtttygyggagttgtygtygttttattttttatggtgatygtggggaygtatygtyggtyggggagtttygygygagygtygygtagtygaggaagtygtttygagyggttgtttatygtaygtttatggtagtygygtygygygtyggtygtttgygttttygttttttttygtygtygtyggttygygtttttygygttttyggtttygygttttgttgtttyggggttgtygygygyg

SEQ ID NO: 5945 - DNA, 208 bp, Artificial Sequence
  Description of Artificial Sequence: Synthetic polynucleotide
gygggygtgggggggaaggggaagaagttyggygagattagaggggaaattygaaaaagtaagtttttgyggtagtagttaggaaatattygttaggaattggttgygattttaattttagyggttygaagttttagtttttttatttttatygyggtagagtygttttygtagatatttttygaggagaatygyggtttygagggyg

SEQ ID NO: 5946 - DNA, 805 bp, Artificial Sequence
  Description of Artificial Sequence: Synthetic polynucleotide
tygttttttgtttttygtattttttygggggaggggtyggttygygttygtttttagttygaggggtaatttaaaatatggygtttygggygggggatttgtgtaaattggyggagaagggaygyggggatygagtygttttttyggttagggattttagggaggtttttaggtyggaggtyggggtttaggttttgygygtyggtttagttattattgygtygtggygggyggagygggyggggggygyggygygtaggttyggttyggtgggggtttyggygagygggagggyggttggggatttyggtygygtygggygyggggttygggattygggagatygygyggygtygaagttaygygttagttttattgtttygygygtttygttttaggtttygggtttttttttygtatttygtaaagtygagattttttygtagttttttatttygagaggyggaaaagttatttgggattagtagggagttygggygygtygyggygtggggattaggttygggygygygttttyggyggyggtgygtaggagattygggygtggggaggaagtygtagtttagggttgttygtygttgtttttttygttttttgttgtaggagatatygaggtttygyggagttgyggygggggtttaygtttagagatygtgygaggaaagttaatttygttttgtttgtttttttagtygygggggagggggttatygtagtattttaggatagttatatgggtatagtttttttygttttggygtagggttaggtttygyggaygayg

SEQ ID NO: 5947 - DNA, 2462 bp, Artificial Sequence
  Description of Artificial Sequence: Synthetic polynucleotide
tygyggtttagttttaatttatygtattttagagggaattaygagggagttgyggattggygggggygggggtttgtaattaatattaggtgtttgtgagagagttttaagggygggggtagtattttttggttgggttgggttygtttggtttygtttygttttygggatttttggygtttagygtygttttttygttattgygttattygttagagttyggygttttttttttttttgttttgtggaygtygtttttygttttygggaggatttygtttttagtattttaggtttttttggygtaaaggtygttagttygagygagtttaggyggyggttttatttttgtagagggaaagygaaagaygyggtyggygggtygagggggyggtygaaygygtygygtggttgttgttttygaattygtagyggyggygttagggyggttatygagttttgyggatttyggtttaatttttagygttattygggtgtttygagttygtygtagttttyggygygttttttagtygyggtaygtagtttttgaygygttyggggygttttttygtagtattagttaggttattttatttttygygtygygttttttygttagtygtyggttaggagtttttyggtttttgagtaggaygygttaaagggagttgggaggtttagtagtttttagygtygttttttygggtgaygtgaygttttttttggagygygggttygttttygttaagtttttatygtaggtttttatagtygagttaygggaagatgtaaygtygggygaggggygtttttyggattttgaaaaatagttttattygtttygggaaygtttygattttttattygtattttttggttagatgattttaattttgggatttygygttggtygtgggggtatygggagttggagttggaggagaggagtyggtagygyggagttgtyggggtgtagttgygygtagttggyggygaggggaggyggtttttgyggtttygtygggttgggggaattggtttttgygtttttgtttttyggaggatygtattygtttatttttatatattatatatatatatatatatatatatatatatatattgtygttagygttttttaygttataagtyggaatgyggaggttagagttattgtttatttgaaagtaggaaagtaggggttgaaaygttgagatggaggyggaggttttggttttatttgygaggttygtattttttyggaaggtttttttttttttygygtttttttagggygagtaaggtttagtttttgagatttygttttttgggttagyggttygagttgtaggggggyggggayggattyggagggagtattagagagagagttygygtttatttttgtttttttygtaaagaattggttagttttattygygtttagtttataattaggttgtygggatyggggagttagattttaggtygttttaatttyggygagggyggggaggggagtgatagtagtaattagygygygttggtaaaagtatagagtttyggaataggttaaayggtyggygyggaggggtggaggtaagagggggyggaggaggagttgttygagyggagagggatgaygttttttagggttttgggtttygaggaatygaagattggtgygttygtygggtttygygtattagttttggggttygtagaggygtygygttyggttttygyggtagttttaatatagygygtaggyggtygatttyggttagtttaaatygggygtaagttttttgttttttttaaagtatttttttgttygtttttagtttttaggtgttygtttgagagtttttgtygttttygggyggattyggttaggtagttttyggtygggttagtttygtttttttttygtttttttttttatygatttygagttaagggtaggyggttygtattygygtttttgtttayggggttaggyggygttttyggtttaygttyggttgttaagaagagaaaggygtttatttgagttatygaagtttttttttggggtttttttyggagtttgttygtagttygtaggtataattttttttggagaaaaaaagtagygtaagggtagagagaggtagggttgtttataggttttttygtaggggttttttttttygaatttttyggggtttagtttygggttyggyggygggaaagagtttttggaggttggaaggggtygttagattygggtttttttygtagttgyggtggyggtatttttaagttgttatttgtagygygtttygggygtttgtgatagttygygtygtttagttttygygggttygtttttttygttygttygttggttgygttyggtgttygggyggttttygygttttgtttygttttgagttygttttttagtygygygttyg

SEQ ID NO: 5948 - DNA, 990 bp, Artificial Sequence
  Description of Artificial Sequence: Synthetic polynucleotide
aygtggtgtgtgtgtgygygygygagtgtgtgagygttaggggtygttygttygtygyggtttttygtgggttggtygggttaatgagygygyggttgtaggggyggygggyggggagggggygtygagttttgyggatggaggygygggtagygyggygygtttatttygygygggygttgttggyggggggyggygtagttattggattyggatyggggtygygattyggggtggygggtggygtgggyggygttyggggttgggatgygtygggggtttagtggyggyggyggygttggyggtggygtyggyggttgtagggggaygagttagygtygyggygttgggagttagttgagttyggtyggygagyggaggyggtagygtaggtagagyggyggyggtagygggagttygagygttgygygtttattatggtygtttagggagagttyggttatttggyggygtagtyggatttyggttttaatagygagygtagtatygattttttagtgttyggtttygaggaygatttggtygtyggggygattttgtatagttyggagtggagygaggagygttttygygtggataggaagaaatttgaggttatgttataaggtaggtatttttygtgttttyggatttttygattgagtttttaattttttttyggatatttttatygygygtttyggygttygttattttagtttayggtyggtyggtttagttttaggttygttttttygyggagtyggaggatatttagggattggagatttygygggattttttatttttttaygttttttagatttttaggygttgggggttttgtgygaatttgattggttttagaaaagtygaaggtygagtttgtattggygygtttaagttgygttttggattttggagatgttaattttagttyggatatttgggttgtgttattyggattattygggtygtatagagtatgyg

SEQ ID NO: 5949 - DNA, 2274 bp, Artificial Sequence
  Description of Artificial Sequence: Synthetic polynucleotide
tygtttttygtgtattgtttgyggttygtttygggtttataygggatatygaggtatgatgaggaygtagaatagtagaagygygttttgtttttygggygttagtgttyggggttagyggygtgtattyggygggttyggtygggagygggttggygatygyggggttyggygttttyggttttygygttatttttyggygttygttaatttygtttygttygyggygtagagaagttygtagtttttyggagttttagygattttttggttygtttttttygtagtygtygagtagygtaggttyggygatttygggtgtagttggttttgtgyggtgatatygtygttyggygttaggttygaagtygtttggtygygttygyggggtygtaggtygttggtttygttyggtygygtttataaattattygyggttygtgattygggataaatttttggyggyggygtagttttttttatagttattttttttagagttagttattaaaatagaagaygyggtyggggygaggaggtgggyggggggagttyggtggtygttttttttygygyggttgaygttygtttyggyggyggtagtggttgtggtygyggggtygtttttagtygagttttyggaggygttygggygygggtyggyggggtaygggygtttaygttttttagygggtygyggyggygtygggyggtygtgaygtgagygttttttttagtyggtttgyggggtatygttagttagtyggggagtaagagtttygygygtagtyggygygggttyggttatyggygygtygtygttyggggttgggtttggggttgtttgtggagaggyggygggyggaaygygygyggttayggttayggttatygttayggttayggttggtagttygggtttygggtttygggtaggggaaggggagaggyggygagtttagtaatyggaatygagggaagattttggtttygygggttygtttttygttttttttgttagyggygttagaygtygagtggggttagggataggggaggaggatttaggattttgtgttygygtttttggagtygttggagttyggatttttgtaattgttggtattttgggggtttggtttagygttttgttgtttattygttttttttygttgtttyggaattaaagttttyggtttttttygttttygygygtttatttatygtygtyggggagyggttyggttygtatttagtattatgaggggatttgggatttgtttggygattttggtyggatttttgttaattgyggygggygagaygtttttaggtaagygggatygtttttgtygttttygaggygygygggtyggygygggaygttygggaygtygatagttttttggtggtagagttttaaggttggygtyggggtygggyggggggygyggygggtyggatatygtttttgtttgtgagtygggygttgggygaggggtygtggggttggtaggtatttagttttygggygggyggagyggayggatttygagggygagttttttagtygggattgttagttyggtygtygttttttygyggtttgggttagtgtttaaggttgggyggtttgtatttttgagtttttggtyggttgtaaaaggaatagtagaaaattttgtttgaagtttttagttgtagtygtygggtygtttggygtaggygttgygyggttttygtygatttygagtagyggtygggtttaggtygttggtgttyggttgygttygtagygatygtygggaattggyggtygtttyggyggyggygatttttyggtgttttgttttttttgtygttttttgttyggygyggttggygatttygggaggttttygyggtygtgtagygtttgyggagaggttggggggagtttttygtyggttttagyggtagggtttggyggtygyggagggaagygggtaggtttttaggttttggttayggttttgygtttygttgggttttttttttttattttygtttttttagyggagygtygyggttagttgtaatttgtttatttagttyggttgttygggggttttaggtgggaaggagaggtattggyggtgtgygagtaagygtgtgagtgtgtgygygtgtgtgtttgtaygygygygygggggygttttaagtttagaggaattttttayggagaggatttgtggatyggagtygggggttyggygtgggggygaattyggtayg

SEQ ID NO: 5950 - DNA, 882 bp, Artificial Sequence
  Description of Artificial Sequence: Synthetic polynucleotide
gygaagtgattttttaygtttggataaagygttygaaagtttaggttygygggttagttttagtygttgggtttgataggggttagggaggygggtyggttttatagttaagttatagttttagggtttggtygtatttgagtagygyggtttygggttgttgttggygttgtaggtttygygtttgattttttagtttgygtagygggtattyggtygggaagaatttttttagtaggyggtttagtattaygtttaygygttygygttygygttygygttygtggtygygygggttttagttttaygtagygtttatagatygtgagttygtagggtagtgttatyggtttgtgtagtagtttygggtagttaagtaggtygyggggygygtygggygttagggtyggttttttttagttttgagttygtygttyggttttttygttaatagtggtygttygygtaggtygggatatattaggtygttygttagtttttttagttttttyggtygtagygtttttagtttttyggttatayggaaygygtttagggttatygggaggyggtyggygygggttagagygttttttagttttaggtatyggtygyggtygggttgygttagtygggttagtatggagyggaagagttygattgttttttggtattygttygygyggaaggtttygtygtttttttttaagygttgggygattggtttttygtagtagtagttygttattggggyggyggygggatyggtttagtgttgattttygyggggttgagatygtgygggtttggagygaaggygyggagtaggggygatgagttgttgttgggaattggtyggygggagygyggttatagttttyg

SEQ ID NO: 5951 - DNA, 4359 bp, Artificial Sequence
  Description of Artificial Sequence: Synthetic polynucleotide
tygtgttttayggaaattattattatygtatttataggtttygaggggyggatataaagttttttgggggaagtggggtygtagatttttttygattygaatatagattygtatagggygygtttgggygtagtttyggattttaygtygggttygatttggttgtttttggggaggatgtaagtgttttttagygagggyggttgggggyggtggtggtgggagggatgggtgggggggtggtgggagtggtgtygtgtygtttygtttagagtttyggygtagtagttttgyggggygggygagtttagtttggtgttaatgttygygatgttgttgagygtggygatggagayggygtygatgtagtggttggtgtaggttttggagagtttggtygttttggagagtatttgtattygagtgtttagtaagtttttgtygatggttttgttttygtattaggttatatygttttygttgtagtggtttyggggtygttggaagaaygttttgtagagagggttgygtttygataggtatttgaygaagttggygtaggggtagaattyggtgttygttttatatatgyggggtaagtttttttygtygttgttttyggygygttttttgttttaygaygaygagygygatttgtggtagggttygagggatttgaagtagaygaatttgygatygttttygtttatggttagtttaaaagagtttttttttaatttaygttggttttygyggtygygggtatagaagtatatgtaygtttygaattagattttgttgagtagttygaagggygtgttggtgttgaagaygttggaggtgtatagtttgygtaggtyggygygygtgatggtttgtttttgtattatyggttyggygttttgtttttygagtttgyggatgatygyggttagygttaggttggygttgygtagttyggggtttttggtgaggtygagygtgyggtagtaygggggtttattgaggtagyggttgagggagttgyggatgttgatgagygaygatttgttgtagagttggtygtttttggagygggtttyggtatagaaggagygtagtaygyggtatagygtttttttgtttatggtttygaagttygggttttgygttttttygtttaggtattttyggaagatgygtayggygtagygggtggttagtygggtgttttygtttagtygggttygttyggggygttgtagtaygtyggggtttagttyggagtygttttygggyggtttatygygggttyggggygttagtagtygyggyggygtttygggttttagygyggygttttggtttatattgattatatggatyggttygggttttagttttttttyggtygagttttygggttttaggggttygttttagtttagttttattttttttttttttttttttttttygtttttttttagttttttattttygttttttttttttttttygtttttygttatttgtattttttggatttygtttttttttttttttttttttttttttttgttygygttgtagtagtgyggayggttgtggyggyggtygyggtttttygygtygygttygttttygtttygttttttattgttttyggyggyggyggyggtagygttggygttgtygttygygttggtgttatagttttygttgttaggtattttygttatattgtygtttttttgttagttttygggtagggygtatgygttatattggatygtagygttgagagtttttgtgtttaatgatttttagttatygggaggtaaagtygggtttttaaaggagtygygttttaattgttattttygagygtagtttyggaggggtagyggygygtaggggatggaggggaggggggagggggggataagttagatyggagagatagggtaaaggayggaggttgattagatttttttttttttttattyggtttttatttttaagaaaattttgaaggaaaaaaaaaaggaaagggagggagagttgtyggtgggggygaaatatttttaatttattttttggyggagaattgygygggttygggygggagagagggagggtyggygagagggygggayggtttygtttttttaagtaatgttygaggagtagtgttttttttattgtttttttattgtttttyggagtyggggggtyggggyggyggttgygtygggygggtygygggtgttgtygygggaaattygtgtttggggtygttyggagyggagyggagtaggtaggttaatgagtagggtggaggaggtayggygaggtttygtattttttyggygttygyggttagggygtagygggygaggtttgggagygggatggggttggyggyggyggyggtttttttatttatttgttggyggygaggygygggggtttggggttagtygygyggtttttaatttttttttygatttttgtaaaggagygaaataygttttaygttagttatatttttttygatttttttaatagttatatttaagttgttattaaagatttggggygtttttygtaggtttggggtaagttygygtyggtttagttagtttygggaaggagygaggtagagaagattgggaggggtyggtgggaggggagaygagggaagaggygtttgggattttaggggttatagggatttttttttattygtttagggygtygttttttttgtttttgagtaaagtgatataattttttygggygaggygttttattaagttggagttgaagtttttttaaggtttatygggtaggyggaaaaagygaatttgtgtttyggtygattttgtygtagttataattyggtaattyggattyggagygtatttttatttaaagtttgttaatygttattygttygtttttygggttgygttgttttaggygygygggggygggtatttyggaaattggaaaagtagttaaagagttygtygggtttygtttttttataggagatattgttttatttttagttaaaygttygttttyggygygtttaggtttygggygygtttttgygtygtygtttttygttttttyggtttaggggtagttttttagagtygtyggggatttyggttgtttttttaggaggtatagtttaggttattttyggagttygtgttgtattttaatttttattttttttygtagttygtgtgtattttggygygygggttagttgygagtttttggggtgaggggataygagggagttaggtttttagtagtgygtttyggtgttaggtygttttgttgggaggtagtttygtttgtttttygggtgygttttygaatttatttttaagttygaattttyggtagttaggttgtgagagttatgttaattgtttgttttttttttttttggtttttttgttttgtttttaagggaagtattttaygtattaattgaaatttatttattaatttgtattttttttttttaagaaagaatgaaagattaggttttagggtagtgtgggtttttgagtgggagttgaygatgtttttttttgtagygaaygttgttggtttttygygtgtttgttyggttttggaygttattygagtttyggggaaatygygttaggtgtgaaataagttagagtaagtttttgtttygygggtygttttyggttttttagggaaatataagatatatagatatatatatatatatatatatatatatatatatatatattaygtttttattygttyggtttttygyggagaatygttygggaatygttttygaggtgyggygygggaggtggtyggttttgtttataatgtattgttygtygtattygttttggataygtgtagaaaggygtgttygttttttygaggttgyggtgagtagttaagttagttgtatattgggatttttatataygagttggtatatattagttatatayggttaattttagagggttggttttttgttttgggaygtttttaggttttygggtygyggtgyggagaatttaggtgggtgttyggtaagttatttattaggggttgttttttygygattttygttataagygtagggattygggggtygygttggtttygggttgygtttttggtttggtaggggattaggtttaygttgtagtttgggagyggagtygttttttaggtttttttatttttgygggyggyggggtttattttttttttattagtttttttttttattgggygagttgttttgaattgttygtagtttgtyggaggyggtgtgttgggttggaygtttyg

SEQ ID NO: 5952 - DNA, 2762 bp, Artificial Sequence
  Description of Artificial Sequence: Synthetic polynucleotide
aygattygggaggagagygtggagtygggtagggataggygtgtygtattatggygtattatggatagggtttygygyggyggyggtttaygatygtttaggggttgygggagaaagygygagagattgyggaggttagtttygtttagtttttgttttygttttagtagtatttatttttyggygggtyggagygygttaggttttgattygtgaagattayggagyggggtaatttatattatttgtttttattttyggagtaggtattttygagttgygttygtatttttyggggttgttagttggtagtagagtatttttttttttgtttygagggygataggtagggggatttttygtggatttttttgtttygyggygagggtgggtaygtttttttttygtaattttygagggattttayggtaggyggagatygatttgggattagggtattgtattygtttagttagagggtttyggtygaggttgtgtgaagtggtttttaggtttgggttggttggtygggaggagtttgggggtattttygggttggaggyggyggaaagttgggttgttttygggttgggaattygtagygtgtagtggygagggaatttgygttyggattggagtaggtgttttttgtygyggaggagttttttagtagagattaaatgaaaaggttygttggttttttttygagggtatgaaaagtayggaaggttttaggtaaaggygttttyggggygtatatagggtataggtagtyggatagagaaaggagtagtygygtaayggaatttttygttygggggagatattaggygtgagaggttagattygttttataggtaggygttgatyggtagagattttttygggtaagagggttagattttttttttaggtgggaygaatatagaatattgtgagggtaagagaagaagaaaaggaggtaattttagattgggataaagataataggatagtagagtttttgagtatygggaggygtaygggtgtagggtggggtaaggtggaggtaagtttygtaattaagatattagagtgagaatttttattgtaaattygygatttatttttgtagaaataaataaaaaaattggagtaaagtattatgygaggggygaaaggtatagaaaattgtaaaatttgggagttattttgttttatttttttgttgtttggggatatttttygygagtttgttyggtttygaagaaggagtagaggggattygtaatttagtttttagagtttygttaggaaaggygygagagatttattggtttyggtaattttgtttyggygttyggayggagttygatgtttgygtagttatyggttgygyggygyggygyggygyggygtggtattttttttttygggtgygtagttyggtttygtagyggygyggggaataaagggattyggygtygttygttttatttygttygtggttyggttygyggggatygtygygtatttgaagtagggtygttagtagyggtagtagggttygtagygttttygttattyggtatatggaggyggagaggggtygagygaagagtyggaggaggyggyggyggyggyggyggyggyggaggaggaggaggtagyggtagtattaatagyggygyggagaaayggttttaggtagtttttattttttttttttttttttttttttttattttttttttygttgtttttygtttttygttaatggagagygagttgatgataaatagygggtygyggagttygygggattygtattaggagtaataaaatagatttagagattaaggagttggggagggggygggggaatagggagggagagygtgtgagygtttgygagtgtgtggaggyggttgttgtggtagygtaggyggttyggtttyggttyggagygtagyggaagtygygagggatgtagyggyggggattttggtyggtggaggatgtggaggtggaagtggagyggatggygttttttaagagtttygttaygygaggtttygggttygtggttttgtttttttygggttttygttttagggtygttyggygygaygaagaygtyggggatagygtygyggggagggygtttygggtygtgygtgttgtatttataaagagtagtagtttygttatttygygttttygttgygtgggggtygaggggygtttttyggttttttttttyggtttttyggygagttggagattgtttttyggtttyggtygtaagggggtgaggygaggggtyggygyggtttttttygtygyggtttygtttygygtagttgttgtygtagtygtttttgttgttygygtatyggtattygttygtyggttttygttttgygtygtttattygygygygtygtttttygtygtygatygygtatttygttyggttttygttgygygatttgggygagtygtygtygtttttttygygttygttttaygygttgtttggttgygyggttygttttttttttttatttttttygtygtygtygtygttttygttttygtttttttttttygttgagttttttygttygygtygtggttaatyggaggttattaagttgyggttgtagtyggtyggattygyggtagtygttygttttygtttygtygaagygtttygtattttgttgtagttygyggggggtygtyggagggaagtttagagtgygtygagtatygtttyg

SEQ ID NO: 5953 - DNA, 338 bp, Artificial Sequence
  Description of Artificial Sequence: Synthetic polynucleotide
tygygggagtygygtaggygggyggttagggggagtgggygtygttyggtagygtttygygtygaggtataagygttygygtygaggtataagygttttygatttatyggtttygygygttttttygygygtttttyggattygygtttgtttattttttyggttttgttgyggtygaggttttaagtyggttatttygtgtttaggtaatygygggggyggyggyggyggygtgaggagygggyggttgttgtttyggggttttttggttygagtttttagttttygattttyggygtttyggygttygattagygttttaggtygttttygtttyg

SEQ ID NO: 5954 - DNA, 1435 bp, Artificial Sequence
  Description of Artificial Sequence: Synthetic polynucleotide
tygyggtaaygatttttgggagtgatygaggtattygggttgtttygtgtttttygggtagygatttaaygataaaatttgatagtgttttggggaaaattttatatttatygttagygttatattygggttttatgttaataaggagatattgtagattatygattagattygtttgtttttagagygtgyggtygggtttttagtttggtttttaggygyggtggyggyggtgggataygygttaggygtttagagaaggatatgggataatggtttagttygaggaygttagaygtygtygttygattyggggaaggaagtttttgtagtyggttygggaattygaggyggggagggaggttagttttggaggtgygttgtygttttaaaataaaggattataaagattgtatagtggggaaaaygygtttggttaatgygagtggggaygatttggggagggggttgaggaaggtagggggtataygagttaayggyggtttayggttttttttttttttygtttttttttttttttttttttygtygggttgtttyggtagataaataatagaggaaggygagttatttatygtggttttgataggtaygtagagtatttgtttggygtygtygtttttttygyggatttygttyggttggtttagttggaagtttttygatttgatttagaatttaaatttggygttgttygtggagttygattyggagttattgaggagttggaygattygttygtattttttaygggttatygttttggttttgtttgagttttygtaagttttgaggtattagttttggaattggyggtatatgtygygttygttttttatgtttttygygttyggtygttggtyggatgtttttagygtatttygtatttgtttattttaggtttatgaaaaatgtagtttyggttaygttgtagggatgygaggtttyggtygtagygggagtttgttttgggtgggggaagggatgggaagaggggaggagggttyggttgggtattagtaattaatgtttygtgttattaagtttggtttattygtaattgtaayggttgtttyggaygttttttttgtttttttagyggtyggtttttttaatattttgtgattaggattattttaatattattttggtttagaggagttgggtttttaataattaaaattttattttttggtttattaaaaattttaatattgaattggggtggtttttagaygtttygttttygggttgygttyggggttgggtaggtggagygtagygtygttttttygygygygttttagaagtttttttagttattggtttygtggtttaggagtgagggttgygtttttttygaaagtagtygttygtttagygtttttgagtttygaagggtataygggtttyg

SEQ ID NO: 5955 - DNA, 510 bp, Artificial Sequence
  Description of Artificial Sequence: Synthetic polynucleotide
tygaggygygatagtttattaaagaygagggttggttttttaaataaatygyggtgattttatttgyggygtttttttttaygtyggttttttttttttttattagagyggttygygtygattygatgggyggattygatygygtaygyggttygygggttyggyggaggtagttttygtttyggggattygggaygygtygttttttygttttaggttgttygygtaggaattttayggttayggttaagtggggtttttgtttyggatttygttgggttyggayggtygagagtttagggatttgggggggygygygggttttygagtttaggyggggyggygggygttttgtygtttttttttygygygtygygtygtygttyggtttttygaagtygttttttgtyggygygtyggtygtttgygttayggygggygttatttatttygggtagagttttttgttygtgtagygygttttgggtttttagygttgatttaygttyg

SEQ ID NO: 5956 - DNA, 2722 bp, Artificial Sequence
  Description of Artificial Sequence: Synthetic polynucleotide
ayggygatggatagtattttyggttttyggtyggttaggagttygygagttygttygtttagygttttgggttygatyggtgtagttttttttatttttattttttaggtygttgtatttaaaaatttaagtttygttttttygattttttttttttttttttttatyggygttygttgttttttttatggtatygtttttattagtatttygtttaaaatttagttttgttttagygaatagttttttaygtattttagttttggttttygttgttygagygtttttttttatygygttygttygaggttttttttygtttagttygtygttygttagtygtyggtyggtyggtyggttygttagttygtttttgtttttyggtaaagttgggagggaaaggtgtatttatttttgtgtatgtttgtgaatttgttttttagaatygtaagttygtagattttgttaaatttttygaagaggggtttgaggttttttttatttaggttgygggggatttgtttaatgaatagtttgatggtatygtggttttttatgggaatggtygaygggtttttygggttgtggtttaattygtttatgtgttyggtattgttygggttgttgtygagttygttggtattgaggtttgygttgttagtttgttygtttgttaaygtggttatttttatatatatagagaaaattttttttttttttattttttttygtttatattttttygtttttttttttygttygttygygtttatataygtataygtatatatatattygggttttttttttttyggtttttttatatttygtttttygttygttttttgttttttttttttttttttttttttygttygttygygttygygttttttttttgttttttttttttttttttttttttttttttttttttttttttttttttttttttttttttttttttttttttttttttttttttttttggtttgatttgatttttttttttttttttttttttttttttttttttttttttttttatattgaatagataggatttttgtttttttygtttaaataggttggatyggtttaagtttttagttagattaggggtgggggtggygagtgtgygygygyggaggagggygyggggggtygggaatgggygygttgtgggggttygygttayggygggyggyggtygggggtagggyggygtggggyggyggttatygygtttttttygtyggyggtttygygtygtggygatggtatagttygagayggttttyggttataaatagygttaggygtatggtttttygggaggygttgagatttygggttyggyggtygyggggagygggtgttygtgaggagtygggtagtyggttttttttttttgttttttgggggttttttttgtaatagtagtaggtgtaattttttgtattttaaaaatagtgatttttattttygtgtgggtatgtaggggggttttatttattaagttatgttttattagggygttaggygggygaagtaaaggtagggatggygggyggggyggyggyggaggtggaatgggygttttttttttttatttggttttatttatttatttagattagaaaagygagtyggtttggagggagttygttyggggattygagygygtatttattagtgtygagagaaaaaaagttatataaatatatattatgtggataaatttatagataagagttttttygygygygttttttttttgtttttttgtgtgtgtttttttttgttttttttttttttttgtatttttaatttgttagagtagttttatatttttttttygttyggtatttatygttatttaagttatttgttaggatggggttgggagttgtygggtygygtyggggggtagagggayggggagtagagattyggggttygattttygttttaattygttttygaaggyggaaggtgggggttttygtttygggyggtttttttygtttyggagagygyggttggtttttyggtggttggygggaggaaggtaggagtygggygtttttgttygttygttygtyggagggggaggaaggygttgggygyggtggtyggtgagttagygygggggatggtttgatttgttttygtttgttttaygggtttaaatagaatatatttttttaattattattaaaagaataaagtttttgaatygttatttgggttgtygtyggatygagattygygyggygtgygttgttttygygggtttygttttyggtatttatagttttygaggtgygaggttgagtygtttttgtygtggggatygggggtygagtygttyggttyggatttygtyggatttttygttaggtttattggggttggtatttyggttgygygggaaagggagtggtaggygyggagtygggagtagggttygagyggtttygtttgtaggggtgaatattggtggtgaatttggttggggtagtagatttttaygttaatgatatttatttgtatttygtttttttttatgtttgtttttttagggtagttttttygttttagaagtttggtaaattgaaataaygygttygttttttygygggttgyggggttggggagttggggyggyggggttgagyggttggtttaattttygtyggttttyggttagttattttyg

SEQ ID NO: 5957 - DNA, 1133 bp, Artificial Sequence
  Description of Artificial Sequence: Synthetic polynucleotide
aygaygyggtgygttaggtagagagtttggggagtgtgygtgttttatttgtgtttgtatygtgtgttttttttgtgtgtttttgagaatgygtttttggtaygygttttgygttaataaggygtttggtgtgtgtatgtttgtgtgatagtgtttgggttttgtttgyggttgtttgttygtattttagttttttttgtgttygtagttaggttttataygtgygttagttttygagygtaygttttygagtgattygtgygyggtgtgtagggattttagggtygtgtgtattaagggygttygtgttygtttttttgtattaaggaaygtatttttatatgtttgagtgtaygtttttttttatgtgtgtaygtttygtgtttaygtygtttatgtttgtgtaggggygttttaygygygtttttttyggttygygggyggttagggattygygttgggttttaygtttttygtggggttgatttttttttygygtttygtagygggtygtagygattggtygtyggtttttttttagtygttattttttttttttttygttattygygygttygyggttttygttgtttttygyggtttyggygaggtygygtygygttgygtttygtttttattggttgygygygtttttgtgtggyggtagttgyggttttagygtttttgaatgtygagaggggtygggaagggagtttttttatgggttatttgttttttygttagtygtygttttatygtygttygygtttygygtttygtttttygtttyggyggttttygtagtttygtygtygttygygttygygttttggagtygygttataaagggttygygygtagtygtygtygtygtygtygtgygaggagttaggatggttttggtttaygtyggttatttygtgtttttagtgtttggttttgtgygaaatagaggtatygtttttttttttyggggtttgtttyggagygtggatygtygtaggtatyggggygggggygggygtygygggyggtygggggtttagggtatattygygaggaygtagggygagyggtggtttttttttattttattttagggggattttygagggtgggggyggtygttttyg

SEQ ID NO: 5958 - DNA, 2401 bp, Artificial Sequence
  Description of Artificial Sequence: Synthetic polynucleotide
tygaaggtgtygttagttttagtgtyggtgggygtttgtattaggaatagttaaagtygaygatatttagttatttygagygttagggaagaygtttygygtaaaatygyggttttaggyggattttygttttagtttygygttgttggtggtattttyggggatttaaagtgggtggtttgggggtaaaggaatagaggtygaagaatttggggtatgttttattagagtatttaagggayggagtgggaggttatattagatatgygatttygatatattttaaaagtggtagtttygtgggttatttttaatagtgggatggatttttttaatttttttygtttttygaagtttttttgttatttygggttatgtttttttttygggatttttttgtgtaaaattatttttttttttgtttaaaggattttttttttttttttgattttaygaatttatttttttaataggtttttaaagtatgggyggatgtgttttttttygtttatygttaggagtygagtttyggtaggtgagyggtgtaaaataygtatttagttgtttttagtttttttygttttygttgagttggttgtttttatttygtattayggtattygagtttgtgagttttygatttyggttttagtygtagtygttaataattttataataaataagaggataggattgagygttygygtttyggagygtattggttgggggtaattttttattttyggygygtygttygttgtttygattygagagtatygggagagtygagggaagggaaggyggygaggggaaggtaggyggggatggagggaggtayggygyggygyggagygaggaggtgggttgtaggggaygtygagaagyggtggggttggygtagagggygggygttyggggygygygttattttygttttgttttygtagtggtagtatayggtttataggtatttgagygttygttagagtaagatgatgaagaggttttygaagaaagttattatggaggaggttaggaaagtttattatatgygttggtttyggttgtygtayggtatttttatggttatygggatgatgagygtatttattttgggttygtggattgaggaygaggaggaagaggaggaggaagaagaagaagaggaagaggaggaggaggaggaggaggaygygtttaggttgagatggttygygtggatattgttatttattttaagattgttgttttygtygtygtygtygtygtygttgttgtygtygtygtygtygttattatttgttatagttagtaaygggtagtyggygtaggggttygggggagtttttttygtygttagygttattttaaatatttattaatagttatattgttgttattgttgtygtygtygtygtygtygtggagygygggaggggggyggggaggygtttgggttyggggygttgtgygygatttggyggggtgygtygagatatatatagygagtygtygtygttygttygggggggagggggatggagtgygygggtagtttttttttttyggttygygtttygttygtttygggttgygttggtttygagygtygagagttagggggygtygygggtygttygygttyggggtttgygtygttttygggttygtttyggtttygygygyggtttygggtgttttyggygtygygtygttygtygtgygttaygggtgtgygttgygttyggtyggtgattttttttttygagygtttttygygyggttaaygagtygtttttygtttattaggtggtaattygttaataatggataatyggtttttttygttygggygtttttgygttagtttttttttttyggttgygttyggtttyggttygtygygttagtgygygttyggtygyggtaggtttatygygttyggtygtyggttygtggtygtttgttagtttatgttttygggattttttagttttgtygttaygtygttgagtttttyggttttygttygttttttttttttgtygttttygattttttttygttttygttttygtygtttaagttttttyggygygygtttygygtttttygtagtygttagtagtagtagttgtagtaattggagygggygyggatttaggaygatttaggygggaggggaggaggttygtygygttggttygtttgggtttygggttgggtaggggtgggtagggtttttyggtagyggttyggtaagygtttttgatttttagggygtaaggtagagygtttttagtttaggygyggggttaggygtttttttttaaggtgttgygtttttagtygagagyggtggggtatattgggaggayggyggggygtttyggttaggtyg

SEQ ID NO: 5959 - DNA, 769 bp, Artificial Sequence
  Description of Artificial Sequence: Synthetic polynucleotide
tygggaaygaaygtgygtggggtagtttaaatttttgagtttagatttygtttttygyggttagatggtgyggtyggtggggttygagggatgygtatagttgtgtttgagaggtgttgttttttygttatygaagtygttgggaaattttgttgtattgagatattttaatgtyggatgttttaattttgygggtaaaaaaaaaaaaaaagtttgaattaggtattgggtttttgttayggtgaattttattygygtttygygtygtttttttatttatttaggygaggtggtttggatttgtatttygttgaagaagttttttatgygatattttygttagtatttygygyggatttggttgggyggyggyggggagttagtttgttatygtayggyggtygggatygtagtttttgggtgygtagtgygtttttygttgygtttttttagagygygggtttygtgtttgtgttyggygygaygygatttttttgttagtygggtttygygtgtttttygygtttttygtagttttygygtagttygtagygttttttagtttygtttygyggtygygggaattyggygtttgtagtttygttyggaatygatygttaggygttgttgtygtyggttaygtaaygyggggtttttgtttggtattagttttaggtgttttgtttygggtygtgttgtygygygatattggggatttaataggtygtyggttatttagttggtttygtagtttttttgyggtttagyg

SEQ ID NO: 5960 - DNA, 1169 bp, Artificial Sequence
  Description of Artificial Sequence: Synthetic polynucleotide
tygtgtttttttygagtggatttggtttyggttttaaatttagtygagggtyggttygtttttggggattygyggatgtygygagggggygtygygttattgaaggttgggaygggggyggtgygyggggyggygtyggagttygggatgtyggttttagagaygtygygtttygtttygaggaggtygtyggtygggtaagyggagttyggagttygyggagtttggatygtaggtaaagttgagygygtygtggggtygggggtggggggttygyggygaaggagtyggggtygtagtgggyggtggggyggggggygygggtttttgtttgatggtttygygygtagtttttttttygggtgygyggtgygygygggygygggagggtygaaggggattttggaatttttttgttygggttaagggggygggggyggttyggggtygggyggggttggtgtttttttttttygtttagygtttagagttygggagtygaggggggygtygggtyggaggygttygtyggtttggtygygtygygygygtggatggaggtttyggtygyggatygtttygtttattygygttggttttgygggagttygggtgagtygaaggygaggaaggggygygggtttygggaaaattygattttttyggygttygtttyggttyggttgggggygtattyggttygygyggagagygggyggggtgtgggygaatgttyggygygttgygtttttttyggtttttttttttttyggagatgaaygttttattttygttyggatatayggtygtatttttattttgtttttttygattagtyggggygyggttygaattgggggagagaagatttagttttygtagtygygaattttgtaaattyggagtttatgygtttygtttttyggttyggggagtttttagttttgttygtygagygtagttygggttyggattgtggttattggggaygagaagggttttttttgyggggttttygggttyggatggayggagggggygttyggtaggtgaattgggttygtttygygtttygaaygtttttttaaatttataagtttyggagattttggggtattttgygatttyggagtgatyggtggagttttygttygygygtttggttttyg

SEQ ID NO: 5961 - DNA, 6036 bp, Artificial Sequence
  Description of Artificial Sequence: Synthetic polynucleotide
tygtatagtttgattatygtgagtaaygygtgyggtaygttttggaatttgtyggttygtagygttygtgattaggagttgttgtgggatttgggygtygtgggtatgttgygtaatttggtgtattttaagtataagatgatygttatgggtagygtygtygttttgygtaatttgttggtttatyggttygttaagtattaggyggtygttatygtygtgtttttaggtagttgygtgtttagtttgtaygtgygtaagtagygggygttggaggtygagttggaygtayggtatttygygtaggygttggagtatttggagaagtagggttygtyggtagtygaggtygttattaagaagtygttgtygtttttgygatatttggayggtttggtttaagattatgttttygattygggttgttttgaygaygaygatgtatygttatttttggttgyggtygyggttatyggggagttagttagttttgtygygttgtttttttttttgggtagtttttttttgtaggggtaggygttggttygtatttygtttattygtygaggyggtaaggaggtagagaaggatattagtggggaggtagtygtggyggttaaggttaaggttaagttggygtttgtagtggygygtatygattagttggtggaggatattttygttttgtatatttygttygaygatagttttagttttagttttggagattygggataggaggygttaygggagggtygygtttagttttgttygttatgtygyggttyggagggygggyggygagaggtaggaagtygggygtattygttgttgyggtttaaggyggtttaygttagtttttttaaygatagttttaatagyggtagtgttagygaygggtattgtttaygygaatatatgttgttttgttygttggtygtattggtttygygtygygaggattttaggtgtgggtagtttyggtttagtyggtttgattttgatttgttyggttgttaggtygagttttyggttygygaggttattttygtygaygttygygtgygtattattaagttgtygtttatttattagtaygtgttattgtttgagggtgttttaagggygggtgtagagtttttygyggggtttggaatttttttaggggttyggaagtaggtttggttgtyggtagattatttgagtaaggttttygagaagttggyggttgtttygttgtttgtggttagtaaggtattgtagaaattggyggygtaagaggggttattttygttgtttygatgtagtttttttttttygttgttttyggtyggtygtttaggttttagygagggtggtgatttggatgatagtgatttttttttggaggggttggaggaggtyggttttagygaggttgagttggatagtaygtggygggygttyggggttatttygttgttygtagttatttyggtttttyggygtaatygaggtyggggtttgggggtggaagaygttaygtygtttagttygtyggagaattaygtgtaggagatatygtttgtgttgagtygttgtagttttgtgagttygttgggtagtttygagagttygtttatygttagttttatttttagtgaattttgtagygggtagggtagyggtattattagttttagygagttgttygatagtttyggatagattatgttttttagtyggagtaagaygttatygttggygttygygttatagggttttttygaggttatttagtttagtttgtagtgggagagttaygtgaagygttttttggatatygtygattgtygggagygttgtyggttgttatttgagttggaygtaggtagygtgygttttatygtggagaagttagaygagaatttttygtgygtttttagttttagygygttggttttgtaygagtattaygtgtagtaggaygtggagttgyggttgttgttttyggtttgtttygagygyggygggggygtygggggygtyggtttttattttgtagggtatyggyggygggaggaggggtyggygtttaygggttttygttttygyggygtygyggattaggagttggaattgttgygggagtgtttgggagtygtygtgtttgttyggttgygtaaggtggttttygygttggtgttaggtygtygygtatttttygtgttygtttatatgttggtgttygtttyggtttyggtttaggaggaygatttttgtattgatttygyggagggtaygtyggttaatttttttagygtygtttygtttagygaygagaygttgtagggattttttagggattagttygggggattagygggtaggtaaagatttatyggtygttttatttttgttagataggttatggggtatyggtataaggygggaggygtyggtygtagygyggagtagtttyggggygygggtaagaatagagtagggttggagttgtttttgggtyggttttygagygttttygtagataaggayggtttaaagttyggtyggattygyggggayggggygttttagtygttgtgttttaygaygtttattgaggaggtygtgtattgtttttayggtaaygattyggaygaggagttttyggyggtygygtttaygttaatttatyggygtatatyggttatttttygygtttttaygygggagygttygtagggtyggaaggaggtttttgtttygtttaaggttgtattagttgtttygtygttygttyggatttagtttagttttattgttgaygagatttygttttgttattttttgagttttttygttagtttttttagygagttygagttttyggagtygtyggtygtttatttaygaggtygggagttygyggttattaaggattygggtttaggaggyggaygygatagttygtttagttygygggtygyggaggagtttttgtagyggtgtattagttyggttttgtttaggygtyggtttttygtgtttggtttgyggygtygtaagtttygagttattyggttggatgagyggttygtagaggggtttygggaaygyggygaggaggtagygggttyggatygggttttygatttggatagygtggagtggygygttatttaggagggygttaatttaattgttaygtggttgtattaggtagtagttgttaygygggaggtttygttygagttygattttattttgtttttygtattygggttgttagtgggatttattttatagttttttaagtataggaagggaygataggyggagggagaaatgggtagtgttyggyggttagagaaaaggggygtagttttagttaagattagygggagttttygtttttttgtaggtttygagaagttaygtggtatatagaagattaygttyggggtgttagttgtgtttyggggaygaatagtgatttaygtttttagttyggtatttygtgtttagtttaaagggattttyggttttygygttatatygyggaaggtggygtttttttgtttggtatagttygyggttttagttaaagtttygagtttygggtagtagyggtygyggagtttatatyggtttgttaagatttyggagttggygaygttgagttagttttttagaagygttatatygttygttygtttygttaagatttttttttttagttttttttagatttygttygttttttagtttttgtttagaaagygtttttyggttatttaggttgttggggttttgttyggtttyggagttttttyggtgtttaaaaygtyggygygtatttttttggygaagtagtataagaygtagagatygttygtgyggatttygtttatgtagaggtyggttyggygtgggtygttatygttggttygggtagtttyggagtygggttttaggggtygggyggggatygaggygggttygggggygygygggggtygtttgggtttggtgygtgtggttttagttttttttagyggtagygagtttttygatygttygggttttyggygatagttaatttttattaaggagtygtygggtttgyggygtygtygtttygagttgttttyggtygagttygyggtttttgttttttagggygtttygtttygtygyggtyggttygygttgttygtygtttttttttgtttttygygttgygaagagtttygagyggtatttyggtagggttyggtttyggttyggtagyggtttttygyggttygatttagttttggygagygttttgttyggtgtattattttygagagttygtttygtttgtttgtgygygygttygtygttyggtyggagattgttaagygttaygygtygttgtygtatattagygtggttygtaggttygayggygtygttttygyggtttttgttttagtygaygtygygygtygtagtagygayggggagtttyggtygttttttagggtggtygygtygggtaygatttggyggygtattygagatgaggaygtgttttatattttgygtagtaygtttttygttayggttttgttattgyggggttttaygttygaggaygtttyggtygggttttygtygygtaagattagygaygtygtggtttagatygaggaggtygtygtttttaagattaattttagtaygttttygagtttggagattagggagtttttyggggttttygtyggyggttagtttttttttttyggtagygaygtggayggttttagtttygttaaggtttttattttygtatttttygtgtaygagggtttgggggtygtygtggggggttttttygttagtyggtayggtttttttagtygttyggttygagtatttttttttaattatgtgtttagttttatggtggtygtagttattatygattyggtygyggagaaagtttyggttattgttttygttatttttttggaatagtggtttaggtyggttttttggaaygttttttttyggttttgyggygyggtttggttgttttatgggtttgygttgtagaygttttttataggtygttttagggtttttgtttattygagttttattatttttagaattttygtttagygtayggygatttygygttttatyggaagattttgtttttgtgtygyggaggtttaggaggaaayggggyggtygttaggttttaagtttygatygtggagygttggtaagggygttttggtttagttttgagygygyggttttttttttgtyggaagtygttgtttgatttygggygagggaggyggtagttttygggttygggtttgggtttgggttygttgtttygtagggatagygttggggaggtgayggygttygtygtaggtggggygaggttgggggagggyggygtygyggygggtttgttagttgggggtttttgyggygygtaggggygaagtttgtaattattgtagtygtyggtaattygttaatgagggttttgtagggattgtttttatttttagttttagttgtgggagtgygggtgggggtgtggtygagtttyggtaggaagtttygtttagayggtgtttagggaattyggagtttaagygtttyggyggagtttaaaagggtgggggtgggaggggtagaggttaayggatttttttgtttgtygtattttttggygggagaygggaaggtagygggttgygtaygatgggattttggtgtagaygtygggtyggttgatatttggattttattttagaggagatgttggttattagttggggygattttaagggtygttggagttagtatyggttyggygtagtygyggygggygaggttaatggaaaggagattgaggggagtttyggtagtgagttygaggttttgggatttggagttygygttggtttttttttagyggagtttgtaygttayggagattattatatgtgggygtggttagtgtttaggatygtatyg

SEQ ID NO: 5962 - DNA, 3400 bp, Artificial Sequence
  Description of Artificial Sequence: Synthetic polynucleotide
gygtagaattagtggygatgggaggaaggggatyggtagagyggggttgggtaagtttttatttagtygggttgagttttggttttygtagagtttttgtttttttygagatattygttatttggtgttagyggtggatygttttgygggggtttggygyggtttygggttggttttgattttgtagtttygyggagagggtaggttygygtggagagggayggggagtygggtygattgttttygggtttttagtttttgagttagtygygtgtttatttatygtagattttyggttgagtatygttyggttgtaggtattgttgttyggygaygattatygttgttttatayggatgatttyggttttgtttttgttgtygyggttygagttygygtygttgtttgygtayggttagttggatatygtgtttttttygtygtttaggtgygygtaggtatygggatayggggtaggagygggygggggyggygtggtttygtggtygtttttaatttttttaattgygggttttaggttattygyggaattygaggagtygttatttagygtagatttttttttggagaygtttaygygtttggtgygggygttgygggttttttyggttygggttttygygtygygtttggttttggattyggaygygttggtyggtttttygtagggtttagttaatttgtyggatttygyggygttggagygtttattygayggygaggagtygttgttgttgttgttgaggtttattgyggttattatyggggattttgygtttttgtaygattttaygtyggygtygtgggttayggttttggygygtygygtggttgttgaattgtaagyggyggttgtygagttgygaagtttttygggtttgttttyggttatagtttygttgttggygygtttgttygygttttgtttaggtggtttyggyggtttyggygattttttgygagygttgttgtttttgaaggygttgtagggtttgygygtggagtggygygggygggattygygygggtygggtygggtatagygtagygygggggttatygtygtygaygggtygtgygygttgygygagtttagygtagattttygygtygagygtttygtatttattttygagatttattaggttaataattgttagggygtgtgyggttggttttagttygatygtaattygygttayggtaattaygtggtgttgttgttgaagatgtaggttygtggggtygttttggygygtttattttgttgygtgtttatygtttaygygggtaagttgtttattagtttgtyggaggagygtattagygygtattaygtgtttaatatggtggttatygagtgtggttgtyggtgatttttgygtygygyggatttttgtttygagggttyggaygygttttagttygygtttttttttatatttattyggattttaagtatygttttaataaagattagtaagtaatyggttggggtgttygtgygtgttagggggttygtgggattttttttgtygttttttttygygtayggttygggttygttttgtagygttygttgttttttttttgtttgaagygttttattatygttttttaggtttyggatttggtgtygggtttaggygtaaaggagtaggtgattttgyggtygtagtattygttttatttygttagagtygyggggygtttagaaggggtttttggatttyggygyggggtyggtttagtttygttttttgtttgygyggagtttttggygatttttaggtygttgtttttygtygggaygtttyggggatatttaggtttgtttttttttgggttyggygtttttggagtttygtgtttayggtyggtggtttttttygygtgatttttagygttggggtagggtttttyggggttttttggyggttygtggtttttttttttttygyggttttttttttttaggtttttttttttttygyggttttttttttygyggtttttttttttttygaggtttttttttgggttttyggtttgygagggttatayggttttttyggayggttttttyggtggtttygtygggttttttttygtygttttttgtagtttttygattttygggaattttgggtttgatttttgtttyggttyggggygtaggyggygttgatggaggygtttgggtttygaatttaggttgtaagatagagtggggttttggggtaagygtttatttttttttyggttygggttttttttttttttggggatgaaggttttaatgttygyggttagtggaaggaagtttttattaggggygaygatggttttttyggggttgagtttggygggatttagggttygggtataygtgtttggagtgttgtttttttagggayggygtttgtagygatagggtygggattygagttagttgggtygaggtayggtttatattgtttattttttttttatttttagagtttttttttttggatagttggagtggggttttttyggtayggttgagattaaggatgttttygagtygtgggaagggatttygggatttygttgtygyggygtttttttttygaatttygtttttttaattggttattttttttttygattaygggttgtaggaggtttttagtaagggaggggtygtaggagtgttttyggggggygtttaygagttgagyggtttttagagagggygtaggggaaaggyggtagaaygttaygaggtaggaggggttgtataaggtttattyggaagttagaatttattygyggygaggggaatgggtttygtaaaaggtttatatygggtgagaggggygygtaaggttygttatttaaggggagatgtataaattaattttgggggygtgtaagatttagttttggagaggaggtttttagattttattttggyggtatagygtttttttttggaggaataggygtataggtggattttagtttygttttatttttggggagtttgygtttatygyggtatagttggaaagtygagtttagtagygttattagygaggygagtattaggtatttgttgagygataggtttttttagggtagtttttygtttagggtygggggyggyggyggyggttgtaggggyggygyggtttgygtttttttgygygyggggaygtttygagggtttgygggggtaagtgygygttgygttgtggttattggttttgtgtygttttttttttygggygtaggggataagagataggtttgtgttttgaattyggttttttttgtttgtttgtgyggtttygggygtaggtgaatttagtttygggtgtttygtagttgtayg

SEQ ID NO: 5963 - DNA, 1143 bp, Artificial Sequence
  Description of Artificial Sequence: Synthetic polynucleotide
tygatygttagtggttgggaagtgggyggtgttggggggtgagtttyggtttttttaagatgygttttttatgaaattttttagttttaygtgtatttataygtatayggatgtatgtataygtatagaaatatatagggttyggatatagttgygygtagataagtaaaggattaygtttaygtggaaataggtgtgygtataygttttygygtattygygygtataagygttttatatttgggaaygtgygtatttgtttttygttttyggtatatatatagtygttttatattggaatatttgggygttagygtygggttattygggtaygtagggygttaygtagggtygygtataygtttttyggttataygygtatagttttttaygtggaygygygggtatataygttyggggttygtagtygygtatattygtatttaggaaattttagttattattaygyggggttygatygtttttgagtatttttygttttagtygygtattygttgygygttygggaygygtatattygygtatatatyggttttttttgygtaygtttygggtttattttygtttagagttttyggggtttttttttatttyggtttyggggtttttttaygttttttygtygaygtgtttatttgtttagggggygttttygagtygygtttygygttygtttttaggagggttttygygagtyggttgtatatttygaggyggtttyggttgtataatttggagygagttgtttygtttttttattttgggggygaagaagggtyggggagtgggggaaagygggaggygtygyggtttgggaggttttygygggttttagygtyggtygtattgyggtttttttygygygtygtygtygtygtyggttttttttygtttygttttygyggttttyggygtttttygygygtttygggyggggtttyggggygtaygygggttttaygtttggttttgatttggttttgtygggygtgtattttttatttattttgggaagyggggtttttggagygtggaaygggygtygttagtgygygyggyggggatygggggtgagggagagtgagttgttygttyggggagataagtaaggygttaagttyg

SEQ ID NO: 5964 - DNA, 220 bp, Artificial Sequence
  Description of Artificial Sequence: Synthetic polynucleotide
aygtgtyggtgaygtttygtggagttggygagtttygtttgtttygygattgagtttgyggtygtttygattttttagtagattttggygtggggtatttgagattttygttattgaaaaggygttatagaaatgtaaggaattatgattttaataaaattgttttatttaggagygagtttttgygttgtttttgtygtyggagttygggtttgttayg

SEQ ID NO: 5965 - DNA, 1860 bp, Artificial Sequence
  Description of Artificial Sequence: Synthetic polynucleotide
tygygatgttagttayggttygyggyggttayggagttattttagtatttygygatggatagtgattttyggygtggygygagttttttgyggtttttaygygggtttgggyggygggtttttttayggtttygtttagatattyggaggtatttgttaaagttgyggaggtggaygatygggygtttaagtaygaattttttygtygaggtayggttgtygggtttygttttgagggtttggggyggygaggatygtyggggaggagggygygygagtyggaggttagagtygggtygggtagggygygtttaggagtaggggagayggygattygggtygaggygggayggggataygttatttgttygtggagygyggggaaggggtgygyggyggyggyggyggyggagtttggygtagagggtagyggtagtagygggagtatyggttygttyggggtyggttagtyggggagatyggggagtagyggggtygygggyggyggggtygaggygagtagtatygggggaattaygattttygygttgagtyggagtagttyggtygagttyggtattatttagatttagggyggyggyggyggyggttttgygtttatyggttagaggagaggttgtygtygtyggggttgttgttgttgtagttgtygtygtygtygttggaatttggygttygtttgtattttatattttygygttgayggyggyggygggggyggygggygttygagatgttgggtyggyggyggygyggtttyggagygaatttatttggtttygyggygyggtygttygtttygtttttgtttygygygggaagtttttttttttttygttygygtygtygtygttttyggattyggttttygtttyggttttygttygttygygttttttttygtyggatttygtttygttttygygtttttyggttttggtyggggtttttttttygttgygtttttggattygggyggtygyggaggaygtgggtgggagagggtygagggygygttyggttgggttttygtygatgtyggttttttggtggtttttggttttttgggatttagygtatygygagggaggtttygggtttygtatttaagggtaagyggaagtygaggtggyggygtyggagttaggtatgtttygttgtttagygyggggttgagggygtagayggggatygygygagtygttttttatttggttttttyggagtttagggygyggagggtattgggttgyggattyggygtaggyggtttyggaygttgttaggygygggyggatttttgttgtataaatgggttaaataggttygtaaggttttygygggttttttggttyggaagttgagtygygggtgtttggtttgaagtttygygttttatagtggttygygggtttyggyggtttttgttttaygttttttaaggtattaggtaggtggttttagggtttttgtttaygatattttttgggtggggtaggattatttttttgtgaattygttttggatgtttttaggtatagtttgtattttttttttttttagtataygyggtttttgaygttgtaygtygagttttttgggatttaggaygaatygggttttaaggattttygtttygttyggattataygtaggtagygtyggtygagtygagtttgggttygtattggttaygygtagttatygttagayggygttagttttttttygttgtagattttgtttyggaggtygttagttttttttttatttygggtttatagttttagtgtagtttttggygaygygygttgatagttgggtagagattttygtgyg

SEQ ID NO: 5966 - DNA, 441 bp, Artificial Sequence
  Description of Artificial Sequence: Synthetic polynucleotide
gyggggttttaaaygttatttaatyggggatattgggyggggggtygtttaattaggttygtagttggagtagatagggyggttttygggatttggygyggtttttgtttttygttgtygtygaagttttaattttygtttgtttgttttgtgttttttgtaygtagaagtttagtttgtgtggttttgygatttgygggtattgggagatttatagttaagaygttagggttttttggaagtttagaaatggtgagagtgtyggttygatatttygagagagggaayggggttggttggaatyggtgggaagyggttgtggygggatttaggttttttygtagttagttttataatttgygtttagagtttttgtttagttyggttttagttttttttagttataygatggyggtygygttgatagtyggggtttyggyg

SEQ ID NO: 5967 - DNA, 5587 bp, Artificial Sequence
  Description of Artificial Sequence: Synthetic polynucleotide
gyggtgttttygggaggttggtagtyggggaagtaggtaygtgaatttatygggttgttttattttaatttgaggttagagttgaggygtaggggtyggggtaggggtagaggtgtygaaaygtattagttggggattttygggggaaggagataggagagatttaaggygagttttaggattygtttttatgattatgattaygygttgygttygaattatatgtttatttygtatttgttttyggggattagatygygtttttttagatggttggggagggagtagatttygggtgaaggttgggggaggtatygggatgtygagtaygttagagtaggygggggatgggtttyggttttttgtygtttyggtatttygttttgtatygggtaaagaaggggttaygatyggygaagagygygtggagatatagggattygygatttaggggtaggaatttygttttttttyggaaatttttygggttttgagtygtgttyggygttttttattttattttattttygtygtttttgtygttatttayggtygttgygggttggttagygtgtgygtttttygygtygtaggtatttgttygttgggygttgtgygtttatttttttttygygtattgtagattttyggygttgtygtygttatttagygtagttttyggttgggtatagygtttygtttttttygyggtttygggygtttatttattygttatggtttaggtttgggttaaatagyggggtagttggttgtttaaattggggtaaggagttgagggttgggagttgtagagaggatygagggatatayggggagtagggatgagyggtygtttygagtygtgtagattgggaagaagttagggagagtttgggtgggaggatttttaatttaagygggtgyggggyggggttgtattttaattagaaagayggtggttttttygagygattttygaggagagagggggagygttttggggygggggyggggygggttgtggtaggagaggggagggygggggygatgtagyggtggaggyggtttggygtttagttattgatygttttttttttttttttttttttttttttttttygttttttttyggtttygggttygttaygtyggattygtttttttygygttgygttgggtyggaygttaggtttgygygtygyggttgagygtttattygttttgyggaaagagtygyggaggaatyggygggggyggttgygggagtygaaggaggtggtaatygggagtagaattagaaggagatagggaggtagaagttygyggtttygtggtaygtattttttyggttagggatgggtttyggygyggtttagtttttgttyggttygtygggtagagattgaatygyggatttttatygttttgtggaygatyggatagagagaggtattgatygatygttagtagtttttyggtgggatygygttttttgtatatttygygtagygtttttygtyggagtygtatygggtaagtyggygagggagyggggttgattggyggtygtyggyggttaggggagggggygtygygyggggttatggtaggttyggaggygttttagttygagtyggagtygattygagtttaygyggtygtygttttttygttttygggttttygtygttatygygtttttygygggagatggaatagyggaatyggttyggtgttttyggatatttgtygtttttgttgttgtatgttttgttgtttttygtggtygayggtgagygygggaattttgttgtygttgtggattygggggggtttttgttggggtygttatygagaagaagaagaaagagaaygaatygggaagtttygyggtttttagtaatttygttgtgtagtttgggttyggaggggtagggagaggygagyggygaagggtygtygtagtagtagygtygygttygagtygtttttagtttygtyggggtttyggttgyggaaaggatgtttgyggggagygggagtaggygygttttagttaggttttggyggtgyggttaggggygggggagaagtaygagtygtttttgtygtttygttttattyggagggaagtagtaggtagtygatggtyggtttttgtttyggttttgtagtygttttttygaattttgttagttttttyggtygtgygttagggagtagttgyggggtggggggtataaggttagttagttagagatygattgtttygttttaggttgttttaggttttygatttatagttggttaygtttttttttttttttttatttttagttgtatttatagaagtttttaaagatgtgatagtaygggagggagaygatatygaaatgttttgygygtttygggttagyggagttatttygtattygttggagatttagtggtggtattttaaggagttatttygggagttgttgtaygagttggygtttagygtgtygggygttyggagtaaggtaattygtygtttaygyggtatyggygygygttyggttygygttyggggyggygaaggttaatttagggagggaagtagygggttttattygygtagggygtygttttgtggygtagtttattttttattttygtattttaaagtatttttaaagttagtagtggttatttttaaatttgttaattattttgatagtatygttgtttttattattttttagaattttatttaygtttagtttttaaagagttatattttagtttggtygtttgttygtgttygttggttgyggttttttgatgggtgttgggtagtgaaggaagtttttttggttttattaggtttttttygttttttgttattttgaggattttagggtttttayggttgygttttagaggttattagaaaatygagtatyggaaagtyggtaggatttttagtttttaggggtatagaggggttatttttttgtggtygaaaataggtttaygttgtttgtttgttttaaaatttatatttttttatatattttagtgtgttygygtgtatatatatttatatatatatttatatttatatatatttatatttttttagggttttatttagagttatttttattgagtttttygttgggtgttgtttagatatagyggttttttttttagttttttayggtttttagtgagttgggggaggattttgagttaygyggtagggtttaaggatgtttagagggaaggagaggggtttttttttttattttggtgtttatttagtttttttagtttagtyggtaggtgtgtattagggtagttattygttggttaggtattatgttagttttaaagttygtttttttttgggaaatttttggaaagtyggaygttttttgtgtttttaatttttatttttygggyggtttyggttttagtttgtyggaggagggtgtttttgtttaaaggyggattygagtttttttagttagaaggtygygagttttaygtttttttttttttttttgtattttaggtaataaataaggatgtaattaaaattagygtaagtgtggagtttagygygggtygygggagattttttttggtygtttygggtttygtagtttttttttttagtaagtygyggyggtygygtatgtggggtygygtaagtagggtagygatygtagttttgtatyggtggttgttyggygtgttygggygttatttgtygtyggttgtagggtygggtttttttttgtgtaaattaagggtttaaggtttgagttttttaattyggttyggygttgatttgtaaaattttttttggtyggattgygygtttagggtttttygygtttgttagttttygttttgygggtattttttttagtatygggagygygyggttgttygttttygtygygatygtggygttagtttttygttttttttgtttygttttgagtatttgttttgygtttttygttgtaattttttatttttygtttggattgygggtttgggtgyggggtgttgtaggtttgtaggggayggggtagggggtggttgtgttaggttgygaggggttygggttatggggttgttaattttgggaggagatgygtttaagttttttatttggagygtagaaaggtttggagatgaygaagttttttygtgggttyggtttagaggtgagggttttttgggtgtttgttgagagtygtagagtagtatttttygaagtttttatyggggygtaggggaggagtatttygttggggggtttttggagatttygyggaaaggygggttggtagtaggtggttagggagttaggtagtagttttagygttgtttgtttttttaagaaagtatagtgttagttgtaaagggyggggttyggtgatagggtggttttttttaggaagygattygggtaggtttttygtgtttygggaggtgaggagggtyggttggggygggattgtyggttggagygygtyggggygggaaagaygtggggaagttaaggaataaggaatttagtttggggttttttgaaggtgtaggagggaggaaggagaggtggattttgtttttttgaagygttagttaygggaagataagtagtgttggtttgtatgggyggggtagatgtaaggtgggygtttggttaaygtgatggggaygtggggatatagtttaaagagttggttgtttggygtttaygtagagttggaagttttatgttattgggtagaygygggtgaaagggaagtyggatygtgatggtgggtaaattaggattygggaagtgttggggtgygyggatgagggggygygayggttagggtggttagaagagtaggtttgggagttgtttagttyggtttttaattttgtttttttgtagatygtaygygtttagggtaatgatattttatatyggtttyggttgtttgtygtgyggttgtaggaygagggygtgtaygagtgtygygtgtyggattatagygaygaygataygtaggagtataaggtttaggygatgttgygygtgttttygygtttygygtygtttaatatgtaggtygtygaggtygtgttttatatttagagtagyggttygygtygttayggtttagttagygtygttaaygttaataaygygggygtygygagtygtattattttygagttyggtygyggygataagagttygtygttygggagttttttygtygttatygatttygtagttttygaggtygyggtagtttyggyggtttataygtttattattatagtygyggtagttgttgttgtttygttagygtygtygttatygggataggyggttttgttgygttagaggtayggttygggtaagggatygyggagagggggygtaygygyggggatggygtagggttagggttgygtygggaygtttyggggggtttyggatttaggattygttttttgggygtatttgtatatgtatatttttttttagttaggtygggagygttttttttagggtttttttttygyg

SEQ ID NO: 5968 - DNA, 3643 bp, Artificial Sequence
  Description of Artificial Sequence: Synthetic polynucleotide
ayggggygattttgaaaagaggttgatgaaaatygagttygttttgtttyggttgggttgggaatagttygtagggttttgtygagtgggygagtgaggygygygagtagggygttygtttttttttagtttyggaaaatgattaagttaatygtgtgggtatgttttattatttattgaatataattttttataaygtttygtttaygtgttygagtttgtttttgaygttygygttttaatgtttaaggtaaggaaaataaaggtgggggggggattgyggggygyggygyggtgyggggggygyggygygggggggyggyggygggtgggggggtagtttyggygttygggaggtggtaaagtgagtttggatttttggygyggttttttygttttttttttttttttatttyggygaggtttgtygttyggttttttttygttttatygygattaaaaaatayggtttaattaaatattygtggttgtgaygttggygagagaagttgttagygggtggggggtggggggaaagaagaggaaaatygagtyggyggttgyggtygggtatygtatggygttagagaatttyggyggygagygggatttgygtttgggtygtygttttttygttygyggtttygggatygttattttgaaaaggagtttygaggtttggygttyggygygygatygggatttygygtttagtttyggggattyggtyggygttttttattygygagyggttygygagttatttttaggtttygggaaatttttaagagggtttggggggtggggggagtaaaaaggggagggggtaggttggggtygyggaaatttttgtttaagtgattttttttatttttttttttgtttgggaygggggttygttttgygttttttttttggttygygtttattgyggggtttyggttttttygttygtggagagagggtaatttgtaatttttttttttttttaattaaagttagttgatgtttataatgtgttaaatttgygggygtygagagtygttgagatttgttattttgtgattgtatyggttttttgtgtttygggagtttggttaggttgaggtyggagagttggttttagggttgaggtgttagggttygaattygygattttaggaaaggtygtggygtttgtaagygtaggyggygttygtagtatttgttttagtygggtttyggtttgggggtttagtygggggttaaagaggaaataaataaataaataagtaataggttatggagggaaaagagtyggttagttttaggttggagaaatgaggttaattagagygaggaagtgygggygtgggggttttggaaggtagaggagaggtagggtttgygyggygtttgggaagagtgtaatttggggggaygtttttygtttttttagygtagatgtatgattggggtaggaatgatttttgttgataagtttttttttgtttgttttaagatattatttttygaagatgaattgaggaaaatagtygtaggygagattyggggtgtattttaggtaaaaaaaaaaaagttagggttgggggagagtttttttttgatgagtaggaaagtgtttagatttygaygygtttatttgttgtagttttgtaaataatttaaaatatagatatttttatatagayggatgtatgtgaagtggaggaaggtygaaaygyggggaagttagggaaaaagaaagaaaaagggttgggtagagagagatttgtgttgtttattttttattttgyggagtgaatttyggtagggttttttttggggataggtggaaagttaagtttttttttttttatttttgtattgtgagtggtttttattgtgtgtttgttggagaatatgtttatygttttygagttaggtggaggattggaatgttggggggyggggagygttggagttgaggaygtagtggttaggggttgggggtygagaaagagtagggyggggttttagtttygygtgygggtggtagyggyggtygggttttgtttgttagatattgttatgtttaaygggtgtttygtyggagaygtgatttgttagtygttttygtttttattttagtagaaaatayggtagttgygaggtgtttyggtttgyggggttygggtattyggtgygttttgggggttgggtygtgtgygygggtgggagtyggyggtyggyggggtyggggygaggggygagygggaggggyggagtgagygagygygyggtayggtttttyggttttttttgygttttttttyggtagtygtygtygtygtygtygtygttgtgtaatttagtagaaattygataggggtygygtttgttgagygtattyggyggtygggtagttygagygggtygtygggtttggtyggtyggtgtagaggygyggagggggtyggyggaggggatyggyggggatgggygygggaagtaygtttgattagagtaygygtygttttttaattttggtgttttyggygagttgggtagtttygygygttttgattttgaygttttagtttttagttagggtttaggtgaatttggggtggggtgtgygtgygtgygtgtgtatgtgygtgygtgtgtgtgtgtggaaggggtggtgagattgggaaygygttgtttttttttttagtttgatattagtaattggatttttattttaagatyggttttgttttttgttggggttgggagggggggygatttttttttattatttatatttttgtttattgtttattgagtggaaggtaggygatttaaagagaygaaagagaggaaaaaggggtgagagayggagagaggaaaaagaggggggyggttagaagagggaaggagaggygtggggatagggttttygttttygtyggggtygggtttgatggtgaaatagtaaatttaygtayggagggtygttaggaaagtggatattatygttttaattaatttygagatgtttyggyggygggatttggygtagtygtgaygygtttttataaatttgttyggttyggggttgtttygagaattygtatagtagyggygttagatttatttygygttttttagttyggagtttatttgtataattggattttttttttttgtttttttttttttttttgaaatttgtttgaaaatttaagtgaaaatygygaygatttgtatatttaaaagtaagtgttaagtaagtgttttgyggtggtttyggygygtttyggggtgagygygtaaagtygggagygaggtgtygygagttgygygtygtttygggtyggtttygygtgtgggyggttgggyggttgggyggygggaggayggttttygygggtttygggattgttyggttggttgttygtataattttttttttttttttygtttgttgatttttygggttaggtgaagtgtttgggttaygygtgtatttgtggygagattygggaggygattttggggggygygyggtygtagttgggtattttgtttgggtygggggygggtagtyggttttagtggtygtygttgagggtagagttgygagygagyggggtyggttgttggtygygtygygtyg

SEQ ID NO: 5969 - DNA, 808 bp, Artificial Sequence
  Description of Artificial Sequence: Synthetic polynucleotide
tygggggagttgygaggttatttttagtyggygttygggyggattgygagttttygygggttyggtygggggagyggagattggtttttygttygggttggggygtttgtygttygygagtyggaagagygttttatttaygagtaggtagttttggtagagggttaattgaggattattgttgttggttttaggaggagygaagygtttggagatygggygygygggygyggttttgggagygggggaaggtgaggggaaatgggatatgatggtattaataatygttattaaagayggtgggagtaataaaggaatgygttttygagaygtygtttagtttyggggtgttttttggygyggtygyggtgtaggaaygygagtttygtygtygagtttttygtygtttgygttygttggygyggygttyggyggtagtgttatttygaggtygagygttgttttygtyggttygyggttgttagtyggttttgttygygttygggtttygygagyggtygtattttattttayggaggggagataatgagattaattagaggygtygttatygygtyggagatagttgtygtygtatagtaattattygygggttgggtgygygggggtttttygttatttgygygtttgttgtttttattaygyggtatygattygggygygttttyggtttttgttygtagtttatagttatatygygtattttatattttttttgygtttttgttggggagtttattttttttattygtatagtgygttgyggttyggggtgtgggaggtttyg

SEQ ID NO: 5970 - DNA, 3415 bp, Artificial Sequence
  Description of Artificial Sequence: Synthetic polynucleotide
tygaggggatyggttygtttattygttygygttttttggttyggyggatattaggtagtttttyggyggtyggtygttyggaggaygyggaagatgtttyggggaatttaggtgatttygttygttatttatagaaagagttaggtyggggttgttttttattttttttgtagtyggagagttgaggaggtagggatttggygyggtttagygygtttygygagyggttttttaaatgggtgygagagggaagagggtagagygyggyggggygttyggggggygttyggtattygaggygggygtaygtatttaaataggagagyggygttyggagttatttagtgygggtagaagagyggggygaggagyggggtygygttygttggaggygyggggygagtggaggaagaggaggaggagagtagaaggaaggggaagyggttygtatttgttgygygtyggggygtttgttgtttttttttyggtatgatgttttttyggygattgttattgtygtygtygtygtygttgtygggttgaggatagggagggagggggyggygggttygygggggggygaggygggtttgtttttagtttttttttyggagagyggtygttygtaggatgttgttgygtttaggtttttygygtttttttygygtygygtttygtygygaatttygaaygtgyggagggaagaaggagggygggygagggaggttyggggagggaggagtaygggggggaggaggaggtagaggaggaggaggtggaggaggaggaggaggatygygttgtyggyggaatgggaagtttgataaatygttttagaggttagaggaggagggggyggggaggagyggyggttttgttttttttygtttygtttttagaygaggtgygyggggttyggggttggggggyggggagagggygggtagagyggtgggaggaggagygygggagyggttyggatyggtattgtttyggttttygtttttaggtygggggttayggtattyggggggaygygtagtygtygtygyggttyggggttyggyggtttagttttttgttygtggygyggttggagyggyggygtyggtaataggtaagtttaaaggaaaaggagatgatygtgttaatygttygttygygggggygtygygttttygttttyggttttaggttygygtgggattttygtttygttagygaaaggggtgtygttttttygttttygtttygtgygtataygygggggygyggygttagtttygtygagttygtttyggggygttygttattttttatttttatttttatttagygttygtttttagttattttttagttgttttattyggttygtatttttttttattygtygatttyggagtttttagygtggttttygggtyggggttggygtttttyggggaagttagagtttaygggtaggttttttttagggaggaggygggygygggtyggggygggtgggggtagtttttagatttygygttatttagttttttttttaggattygtygtagttattttttttaatttttttttttyggataaatttttttgggttygtttygggggtyggtgtgggagggggtttttttaagtttttttttttgattttgggatgattagggtttttttatttygtttttygttttygggagtygggtygygttttttatttayggygygggtygattttagggygggaygggggygggagaaggaaatygggtttttttgtttatttttygttaggggtttttttygagagtttagggggtygtygygtygtgtttygygttyggtttgtyggggttgttggattagagggattgattattgattggtgatyggggtygttgaggtttygggtyggttyggtygattggtygyggtaagaaggagttggttgggyggygtgggyggyggggygaygygggtttatttaygggyggyggtgagggygygggtgggtyggagtttatgygggygattttygggyggyggyggttgagygggagtyggagttygagyggygygggyggyggygtatygatgygttgygggttygattgygtttttttgggttagtttttaggtygggaatggggyggtygygtyggggtyggtttygggygttgtygggyggyggttgttggagygygggggyggttttygggtttattattttygaggyggttttgygttygggygygtyggttggggttttggygttttygtaggtttygaggtygatagtttyggygagggygggygtttygygttttagtatyggttgtttgagygtttttggagtagtaaattttagatttttttttttttttttttttttttttttttttttttttttatttttttttttttttagtttttttttttttttttttttgttttgtgttttttttattttttttttaygattgtttttgtaagtttgttttaaaagtttatagtatgttttttttttttttagatygggagatagtgattttatttatayggtaagattaaaagttttygttygtttagtttgygggtttgggttgggtttagaygttttttaggatgtagatgygtygtygttggttttttyggttataaagtygtttttagygttttttygygygtaggagygttyggagttgtggggtayggattttaggyggggtagggagttygaggygggttgyggyggggttttygggttggyggattygggggttgaggygtygtgygygttgggtgttygyggtygtagaggttagaatygttatttttttaggtyggggagaygyggtygtggagygtgaaaygttttttgtaagygaggaaayggtgagttggtygatatygtyggyggttttattattttggtggtygygttgagtttttgtygtttggaggygggttgygtygtayggggttagttttygtyggtttttagtttattttygaagtttttatttaggygygttyggtgyggygtgtgtatagygyggggygtygtatayggaagygtgtagttttttttggtygygtttttttttttttttttattttttygttgtttttgtaaatttttgttttttyggtttttttttattgygggtygyggtttgaattygggttttygygtagtyggtygtygtygttgggtygttgtttggttttttttygtttaggygtygagygttgtgygattygttttaatatttgttygtttaattattggygtatttattagtgttaatgggttgtatattgtagygatagttygttaygtataataygggttatgyggagtgtaygtagtaattatattgttatgtygggataygtaaaaaggttttyg

SEQ ID NO: 5971 - DNA, 3415 bp, Artificial Sequence; identical to SEQ ID NO: 5970
  Description of Artificial Sequence: Synthetic polynucleotide

SEQ ID NO: 5972 - DNA, 1592 bp, Artificial Sequence
  Description of Artificial Sequence: Synthetic polynucleotide
gygaagygatttagygygaggattagtttttaattaattygtttttagttttgggygttttttttagtagttagatgggggttttagaggtyggtgygyggttatatggtttygggttaggtagggggtygtggggaygtatttgygttaggygtatagtatttttgggygygggaygggygaagygtygtgggttttaagttgagttgggtyggttttgtagygtyggagagtaaggyggygtagggaagggagatggggygggatgtggggaaagttgtygattgtttggattttttyggttyggatggygttagttgtttttagtttagtttgyggaaattygagttttttttagyggttygayggttygggygtttygtagattttgggtttttttygyggtgttttygtygttygtttttgygttttggttyggtttttaygttttttygaggtttyggygtagygyggtygtygttattttttttatattttagaggtygtagygtygttttttttttygtatttttgttttygtaaaggagttttttygtttygygygaggtygyggygaggagggggygyggttyggygtttgggagtttatattttttygtygygygygtygtygagtagggygtygygtttttyggttygygygtggtygtyggaaygatttyggttyggygtyggtttygtttygtttygygtttaggggtttyggggygggtttygggtttygggyggaygatgyggyggttyggtyggagyggyggygggaagyggaggyggaggtgaygygttagggtyggygggtygggttatgtagygttttagggygggygyggaygaggyggttttatttttggtygggttggttttgygggagttggagttygggtgyggttttttyggtygggggyggygggggtygyggtttgggtttggagaygaggyggygttygygttgggtygtagagggaagggtagyggyggtttygaggtyggggyggayggattgagtygyggggagyggggttttyggygygyggyggtttyggagtttagygygtagtttgygggtagtttaygggttagtttggyggggttygayggyggyggyggtggyggtagygttygatttagyggtattagtttgggttaygattagygttayggtagttygygtttyggtygttyggattygygtttyggtttygggtygttttyggtgggtagygttygttttagygtttttagtttyggttttyggggttyggtyggygtttaygttgattttttttygttyggygtttgtttygygttygttygtttttyggagtttgyggggtyggtttttttttygttgtttgtattttygttgttttttggtygggagggyggtttaagygyggtygagyggyggttggaggygtttattygggagttggagygggygttygaggygygtayggygygggattatttyggtgagttygttyggttyggtagttttttgygygtatggttggggttyggggtttygagattgtttygggtaggyggtyggattagyggaggagagtayg

SEQ ID NO: 5973 - DNA, 903 bp, Artificial Sequence
  Description of Artificial Sequence: Synthetic polynucleotide
gygattttagaattygttttttatttygagttygtttttygtygttttttygtttttgggagggyggttttattaattttygygattygggtygtttttggyggttttgatttygttatttygtttygyggygggggtttgggggtgaggggygygttttggggtagaggattgygyggtagggtttgttatagggtagaggttagggtttttygggaaaaaggtaggygtatatatgtttttttttttgggaaaagayggggaggggggttttttttgggagattttaggtttygaaatttttygttttttatttttyggttttygtattttttttttttttygttaygtatttttttttttttttagttatttgttttatttygtagygtygygataaatayggttttagttygttttygtttttgtttagttttttttttaagtttyggggagtgggggagtgagtagaygttttttttttaggaggtyggaatttttgtttttattttttatyggggttyggttggttagaggtaagtttygagattttttattaattattattatygttgygagggtyggtgaggttgtagataaygtttgtaaggaygggagtyggggagggtgtagggygagtttaaaggaygggtagagtaagtttygggaagaggtaggggttttttttttygggtygtygtttttygtattttyggagttagtygtagttaygtagygtygtttgtygggtatattaaggatttggygygtaygtggygtttatttttattttygggttygtttttggttygygtttagtttttttagattattygtaaattgaggatttyggatatagagtgtagagatttyggtaagtttattgaaagttagtygaattyg

SEQ ID NO: 5974 - DNA, 1592 bp, Artificial Sequence; identical to SEQ ID NO: 5972
  Description of Artificial Sequence: Synthetic polynucleotide

SEQ ID NO: 5975 - DNA, 382 bp, Artificial Sequence
  Description of Artificial Sequence: Synthetic polynucleotide
ayggattgttygtttagtaatatttgattaygttttttattggttatygttttyggaagttygttttttygttttyggaattttygtaggygttgggtttgtagatggygtttaggtatatagtggygagtgtgatttygtagttttgggttgtttggttaagygttygtyggatatggtaygtygaagggttatyggygtggagttttygtttttagygttygyggttgggaaatyggttatygttayggygggaattgggattygggttgygtttyggtttttttatatyggtttatygtattygtgggygttygtattggtgttgatataattttttgatttttgattygtattgtttygygattaaaggtaaaaaayg

SEQ ID NO: 5976 - DNA, 665 bp, Artificial Sequence
  Description of Artificial Sequence: Synthetic polynucleotide
gygtttttaygaaattygtttayggataygatttyggggttatatttagttagaygaatgtttggtaaatgatagttattttaygttagatttttatagttttttataygttatttttattgttttagggaattataagtataggtatygtttygttyggygtttttttttaaagattggggtattaggatygygggtttttatttttatttagtataaagagttyggygtttagagttagyggtttttygaggatttattattaagttygyggatataggtttygattttatatttaaygttgttaaagtggtagagtyggygygggttgggatagaggyggtattgaggtyggygttgtyggtggttgagagygttataagtttyggttygttatattaggggygaygttttttagaggttttygyggtttattygggygggattggttttattgtttgygygttttgagaagtagattayggtgttttagggtttatagtttygygtaggggagtttagtttaggttttgtaygagyggtttttygygagtttagttttgagagattgggagygtaatttggtgttgagaagaatygaatygtttygttgttttttgygtygaattatattttttagaggttttygyggttttattttttyg

SEQ ID NO: 5977 - DNA, 764 bp, Artificial Sequence
  Description of Artificial Sequence: Synthetic polynucleotide
aygygttattagygygtttttaygtataaattttttttttgyggttaatttgygatttttaatttttygttttggttgttaagggaggygygtagagygtttgtgtttgygtatttttatattagttygtgtagtgtgaygttgggtttygtttttgtgatygggttaggttyggagttgtagggaattyggattttygggttttttggaaggtyggggagaggttagtgtgggaggatttggtggggaggaggtygtgttataaattttgygyggagttgtatygttgttgttagatattgygaygtygygattttttttatttyggattaygttttttagyggatttygygggagttgggtyggyggtttttttgtgtttttygggggyggaggtagttgaggygttttttttygggttygtaagggttgggttttatttaattaagggtagyggtgagattygagtgtagatttttygagttttyggggtaggaaggagattttttattagttttgttttgtaggtygggagtgggttgaggagtggygtgtgggttttyggaagttygtygtaggttatttgtgtgatttyggtgygagtggaggttggtatygtttagtgygaggttgttatttygtgtgtttgtttaygttttgtgtgattgggtgygaggaagttaatggtatygtggaatgtgaggttgtgagttgaggygggagygggygattgttygttgtattttgttgggtygatattygyg

SEQ ID NO: 5978 - DNA, 1394 bp, Artificial Sequence
  Description of Artificial Sequence: Synthetic polynucleotide
tygygtttgggttygtagtttygggtaygttgtagtttygtattyggttgtttaygttygggattatttattgtgttttttyggaattgtttagygtgtttttttagattttagatatttattttaaatttaggttttagygttttgtaggggatttttattttggggygtttatttttgattttttttttgggttttttygttayggtygagtttaagtggttgaagygyggaygaggatgygyggggtttyggtttttaattgtattataggtygtatttaygaatttggttyggtatagttattatygttygggtttttaggttttagggttgtagaagtttagtttygggaaaaaaagtatatyggtttgaggttttataggaattttttttttattttggttyggtttgtaaaatttggtttatttygygttttttttttttagaaaagtagyggttatagtggygttyggtttttagttttagttttattygatttagaggatagtttagttttgggagttagyggygttagaataygggagagygtttgttttygtygygaatgygttagygygygggggggyggaggtaagtttygtagttgtttygggtygggaggggygygtggggtygggtttyggyggggatagtygggtyggggagayggagttagaggggtygtagtgtttttygttttaggtttttatttgtaatggtygtttygtgattgattagtgttattaaagataatttaggtttgtttttttgtggatattgyggtttaaaatttaaaaaaataatatttygtttttttattttttatttggttttyggttyggagataggyggaggttgygagtttygtttygtttttagygaygttttatyggaatttttggaaatyggtttttgtttygagtgygtaagygygyggggggygaaygttggggttttttagggagtaagggagaagtgtggggtygtatttgtygaggggtygggaggtttggaggagggtggaggttggttataggatttygatggggatggagtgtttaaatttaggtttgtagtygtgattttggygtgagttggatggaggaaattttagtatygygagtttggattaaggygyggygygtgttgtttgtggtgtttgttgagtgayggtygtygygttttygygtatttggatygagtgtttggtygttggyggagtagtgttttygtgtayggggttgttgygtgygygtgtgtygttttttagygggggattaggatggtgtygtagagaaggttgygyggtggtgtttgattttgaygttggttgtagygggtttttggggtttttgyggtttgtgtttgygtttgtgaygtatttgatatyg

SEQ ID NO: 5979 - DNA, 949 bp, Artificial Sequence
  Description of Artificial Sequence: Synthetic polynucleotide
aygtygtgtttygttattttaaaaaagaaaagttattttygttaggtttttttttttttttattttygtgtgtgtttygaggtygagatgtagagagtaagaaaaaggagygaaggggatttttgygygttttaagtatttattagygtttayggtgtgagatgaaggygtattttttgggygygaagtttttaaagtatttgtttagggagatatttttgaagttgttagggttttttttttgtttttttttagattygggttttgtataaattttggagggttagygggygaggyggttatygtagyggtygttaaygagtagttgtayggaggtgtagaagaaggaggttattgttatttttttgataagttgggggygtgggaggtttygggagttygaagtygtttygagygggggtgggyggtgagyggattttygggtgttgattaggtgtttggtggtagagtagggaaggggggaayggaygtygattttagggattttttattygtttaygttttttggygttggttataygtygtygttttagtattaattggaggtttttagtggaygagtagtygttygagggtagtygtttgagtyggtagatagyggttagttggggtagyggttygaattgttttygtaataygttttttagtatttyggtttgyggggtgtttaggagygygggyggygyggygyggggatttaggaygtygggygyggggtttatggtagggtygaggtygttgaggtygggtttttatttgygtattyggggtygtaygaggtttgggygggggyggggygggggygggagttggattatttgtaattatttttyggttgygtattttaatttyggttttttttttggaggttgygtttaggtatygygttgaataagtygtataggtgtgattygggagygttggagyg

SEQ ID NO: 5980 - DNA, 1365 bp, Artificial Sequence
  Description of Artificial Sequence: Synthetic polynucleotide
tygygyggttttaggtgaatttggtygaggtttttgygttaaggayggygygggttagttgaggttaagatygtaggtattgttttatygttttttagattatagtttygtttttgtaaggtttyggggaaaygggtattttttttttagtgagtaaaggagaaagayggagttyggtggttgggtgtttygtttaggattattagygagtttagagttttttttaygatygttttagggtgggtatttttaaaagyggaggaagggagggaatatattttttggtgttgtgtttattttgtttygtatagagygggygtttataggttttgggggtttygttyggatygtagtggggagaggtygttttatgtttygtttygttaaatttaagagttttygtygagygttaggaggtttttagataatyggttttgttygttgttttttgtagaatttttttatttttttygagtttttttttttgygttygttygggtaayggtygygttatgtttagttttaggtygygaggtagttygttattygttttttygggttttygggttygattttygygttttggtygtttttyggygtttaggttttttattggttygaataygtttygygttttyggaygtttygagttttttttttyggtygaggttattttggygaggttygatttttgygygtyggyggttttttagtygtygggtttygtttgygtttattyggttttttggatygttgtttttttgtgygttatygggggtttgttttgggtttgttygatatygtggttgttygtttatttgagygtaggtttttattttgtgttagggtygygygtggttttygtttgyggtttgttgggtttyggygttataggtattgyggtttyggygttygtaygygggggattgggygggggttggagagtttaggtygttattgtyggygttttagtgtaggagagggtattgagtgtgagaattatatayggttggagtgggaaggggttttgttatygtttattttgtagttgaagtygaggatygygatagttttgttgaaaaagatttyggygygaggtttttttygtaygttgttgaggtgggagagggtgggtgtgagggyggygtagygtttgaatgyggtgggtaggaggttagygttggggttgtaaggggatttagttttgttttyggttttygygttttttgattttttygtatatttyggggtagygtttagtgatagagaygttttttaaagyggttttygattygaattaatggttttgttttttttttttayggggtagggggaagtggaygtttygggyggtgttgttgagyg

SEQ ID NO: 5981 - DNA, 2638 bp, Artificial Sequence
  Description of Artificial Sequence: Synthetic polynucleotide
tygggggtygygttggaattttataggaaaaaggygyggaaagtygtygggtatttttyggggttttatagatgtttttagtgttttagttygtgtattagttygygtattyggagggattttaggtagggggagggtttygyggttagtatgtgygttygaggttttttygtagggggtagtgtygttygttygygygtygatayggtgggagggggtgggaatttgygyggagttttggaggttttttgggagaaagttaggggatgyggaggggtgggygtaagatttttaggattttagggaggtygtggggagggtygtygagggtgtagtgtgaggygtaggagggggttgggggyggtgtaygttgtagggagaygtagtttttggaagatgygagtgtgaatgtgtgagtgtgagtgygtgtgtatgtgtgtgtgtgygygygtatygtagtttttygggtttygygaggygygygggtgttagtttgtagtyggggttttttttttyggtttttttgtttagttyggyggtttttttttttttttttttygttygttttttttyggygggttaggggttgggaygtttyggyggagtaggyggyggyggtggygagttggggagttttaggttyggygttgtyggaggggttygagtygagtygtttgygtttyggtygggtagygtygggttygtttttygyggggttaygttttgttaaattttgttgyggyggttagygtagygggttygtaagygggygggaggggygtygggtygggtygggtagggygygggyggttaggggtttygagagyggyggtttyggttygyggttttattatgttttagttyggyggygggggyggyggyggyggyggyggtagygggggaggyggyggttttagygtyggggyggtyggyggaggggaygatttyggggygaaygaygagttgatttttttttaggaygaggggggygaggagtaggagtygagtagygatagygtttyggygtagygggatttagaygaggttaagtygtttttggttaaygagtyggagaattagagtagtagttyggattyggaggtaaggaagtatygyggttattttygggggatttyggttttgygttygtttattygtttttgtttttgtgtttttttygtaggyggagaggygttygtagttygttygggatattttttagaagtygygggattatttygtygaaggtatgtgttygttgggatagttttttattttygattttygttgygtttygttgtttagttygggyggtttatygttttttttgtttgggtggaygtatttttgtttttygtttttattggyggtagttttygtggggygygygtggggggygttggggtttttagttttygtttygagttttttgtygyggygttgttagtttygggggtttgggttttatttygttttggttttgttygtagtgagaaggttttaggatagygygttttttaaaggattttygtattttgggtatttttttttgatgatttyggatttgagtagttygtatttttttaayggatttttgtttttyggaggagygygtatygtgagtgttygtygggygygtyggggagggtgggaggtygyggttygtaggatgygttttygggtttggttatggagtgggggatggggttttttgygtygattttaagtagaatttgtttgyggagttgaattattttttggyggtygagygygaggttgygttggttagtgtttggatgaaagtaaagttattttaatttttttttttttgygggttgaggttttggagtttatttttgggattttttttggtttttagaatttttygtttgtatygaaggaaatttggatttgtgttygttttgggggggtttygtttttttttttggaaatyggttagttttttttggtagtggggtaaggggtttagggagttgggttggygaygttgtttttygatttygggtttattgggyggttgtaggttggtttttaagaaatttagttttygtggygggttatttatagttttygtttttatttttagttttygtatyggggttttagtttttttgyggagttagtttygaattttaaattygygtagatgatttygaggygatttaaggtattttttaagttgaggaatttggtttttttttttttttgtygtttgttttttttatttaaagygagygttgygatattttaaatttgttaatgggygygtattgtgtgttgttygttggtatttagagyggtgattaagtaaattgatygggttttagaygaygtgtaaatgagggyggattttttygttttttttttttggttttaaattttygtttttygygttgygaggggygtagttgggggttggygaggtttttgtgttttttaagtygttattttatttttaggttttttgtttaggtgttgggttygatgatagatgttgggtgaaygtttatttattgtgtgttaggttttygygtgttgttgtttgggygygatgtgaatygtagtagttttttgtttttygtttagatttttattgtttgttatttygttgtygayg

SEQ ID NO: 5982 - DNA, 1531 bp, Artificial Sequence
  Description of Artificial Sequence: Synthetic polynucleotide
tygtatatygatttttgygtyggtttttgygattygygttygtttttttyggttgggaagtatttgttagyggtttttatttgggtygttttygtygyggggtatttttttgaagtagtygttgagygataggttgtggyggatggagttttgttagtyggttttgttgygttggtagaaggggaagttatyggygaygaattggtagatgtggttgagagtgagtttgygttygggygygttttgaatggttatggygatgagygtygaataygagtagggyggtygtattatttttattaggttttygyggttggttatggatagttagtttagtttttygggtttygygggygyggygggygaggygggygyggygggygygggttgygygaagggtygttgagagtagtygaagtgtyggyggtaggyggtggttgtagaaagggttyggtygyggtttyggggggyggyggyggyggyggagygtttaggtaygyggyggyggttgyggyggyggyggagggygggttttttaygtygggttygttgagttataggtaggggttggyggyggyggtyggyggygyggygtagtyggttagttygtaaggygttttggttgtygggggggygttyggggyggyggyggtggyggygggygggggtaggtygggttgygaatatatttygaagttgtygtygtagtagagggttatgtyggyggtygtgggyggttgyggygyggtygyggygaggggygagyggggttggtttygtygttygggygagagtatttttttgggggttaattttgyggtttygtttttattygygttgggygttyggtgtttygggtyggggtygggygggtgttagyggagygtttgttagtyggttttttataatygagttyggygyggttttttttgggtyggttyggagyggggyggtggtygygggtttgggttttttaygttttygttaygttttatttgttygygygtttaaattyggagttygttygtttygtttttatygtttttttgttygggttygggagygtttgggaggtyggygtttttaggtttygggtaaaaagtagtattttatttttagtttaygttttttaatattataataagtaaagttaygaatattaaagagaagataattygaatagtaygaatgatttttaaaaagttaatttggggtggtygttygggttatttgtttagttatttttttggtttttttatttttttttttttaattttttgtgatygagtygyggaatttaygtttagttttaatygatyggtttttagtygaaaataatygatgtgatttataaygttttggggtatayggtagaggttattaataggttygtttggygtgttttttttttttyggggattttgtgattggaggaayggaaattagtgttgagtttttttaattaaattgtaggttygtttatattygggaagtatttattygttttttgtgyggtttgtaygggttttyg

SEQ ID NO: 5983 - DNA, 2045 bp, Artificial Sequence
  Description of Artificial Sequence: Synthetic polynucleotide
gygaaayggtagaggtyggtagttygyggtttaygtgtatttgtttagggaatygttttagygaaatttgattyggatyggaattttttygtagtatagyggtygtgtttatyggaatggaaygttataagttgttatttgtattttttttttagttttgatagggaataygygttgtttttaygtttatatygatattyggatttttatttagttyggttagagttttaggggttagggattagtgtagggagaaggttttttattttagtttttaggatttttaattatagtttattygtttttattttgttyggttttaggtttagtygaatttatatgttttygtagtgtygagygttattatttatagtygttttttaaattgtgatttttatttgggagattyggaattatttaggattttggtgtggggggtagtattttttatatttgtttttygaaaattgttatggagtagtygygtttyggygggtaggtgagggggtygagtttattagygtygtagtttygttgtttattttttttagygtyggttgtygttttygggtagatatygtyggttttgattttggggttgatatygttaaagggtagttagtgttygtttaggttatttygggaggtttaggggtayggygaggggtyggggaaaggygatygtttattatagttygygygtttagattgagggaggagtygggttgtagaatyggyggyggatggagaygggagggaggttgygaggtygttygaggagagattaaggttttagaaayggagaagygggygttttgygggaggyggyggygttgtygttggtygttaagggygggaagtgttttgggatttttattaggggtygygagtttygagygttaaattttygyggygttygtttagygygttgttgtggygggygyggagggygygygtyggtagtgggggttgyggyggyggagggtaygggttttygtttagygtttttatttttttggtgtagttgtttttygygagtygagatatttttgttagggaagaggagygtttyggttgtttttttagagttttttgttggggggatatygtttttatgaagaaaatttttaaataaattttagtttaggaggaggttataygattatgttygygggttgtyggtyggaggggygaggaygygygggyggaggygyggttgtygtgtttaggtagggagtygagtttygggtgttygtygygygtttttygtyggggttatgtattttygtttgygttygatatygygggttggaggygagtgtagyggygatagttygttagygtygyggttygtttygtttygggttygtttttttygtttygggygttttgygtyggggttygttttygtagttttttttagtttttttttagtttgggtttttttagtttygttttagtttgtggygygtttggygggygtttttttatatatgttagtatatyggttatyggttgattttttyggtttgtgatttygygtgggtgtagttygtaggagtttatyggtttgtgttaygtaygggggtttttagtgtayggataygygtttttttygttatttgtttatttttattagattttattttttttygygtygtgttygyggyggaaggygtttttgtagygygtgtattygyggagyggtggygattttagtttgagtagaggagttgtagtgatttttgtttygtttttagyggattgyggagggaattttttattttattttattggggatagggtggtaygtygtagagtgtygtagttgtataaatttggaagtttatagtatygtttgattttttgtgtaatttygaaygttagtttgttygggtaattttgagtgggtttttgtagtyggttatgttagyggtttttgtatatttgtattygyggttttygttgtttgtaggttgtagagaygggggtattttaaaygtgaaagagtaatgaaggaaaatgtagatagagygaggaygtyg

SEQ ID NO: 5984 - DNA, 476 bp, Artificial Sequence
  Description of Artificial Sequence: Synthetic polynucleotide
tyggttygygygggaggagtgtgatttaggtgtygttttttttygtygtygagggttaggagttygggagygygattttttttyggttyggtttggttyggtttggttagttttygyggtttttgttygggttgaygtttaggaatgtggtygaygagaagttttaatagtayggygtggttttttagtttyggtgagtattygtygtggggaagggttttggggatttattggaggtygyggttygtagtagttaggggtygagttayggttayggaygttttggtgtttyggttygtgtygggtttttaggyggaggaggygttygttgggtttagattttygattttagtttyggtttttyggygtttgggttgygyggagtttttgtttygygtttyggatttttaygygtagtttttaygygtttygagttggagaagtygttagttygtttttttagggygtgtygttyg

SEQ ID NO: 5985 - DNA, 455 bp, Artificial Sequence
  Description of Artificial Sequence: Synthetic polynucleotide
aygygggyggygttyggggtttgygggtaggtaggyggtttggtygyggaggttttttygagttttgygtttttttagagagggaggggtttatatyggttggtatagttattaygggtatygaaatttggggaygtgttygattatgtttttttyggtggttygggggttatttygtattgtttagaagtttygtttttygttttttttttttggtttagtttattattttttyggtgattttgggtatgttaygtttattttttaggttttagtttttttatttgtgttgtgaggagtggaaggaaygggatgattaggagttttttaagatygagtattygaggtttttttyggtttygyggagttaggaggtgttagtygagatgygygtgtygygygygttttttagtgttyggttttygtttttgtayggttttygttgggtaagggyg

SEQ ID NO: 5986 - DNA, 749 bp, Artificial Sequence
  Description of Artificial Sequence: Synthetic polynucleotide
tygggyggygygtttaggtgtaggttygttttgyggaggagggygggggtygggtaagtagagggygtttagttygggggygtyggtttgggttgggygtttagagtttatttyggygygygggtygygggygygtggggtagtggtttttttagtygggaagttgttgtttaygtttyggtggttgttgyggtttygttagggttgtatyggggtttygygtagaygttttttygygatttgttgtagtttaggyggtggyggtggyggtagtagyggyggyggtggaggtggygygggygatagttyggttyggygyggtttttgaattgtttaatttttgttygygtygggtttaagygttyggtygttgttttygygttgagygtttgygtatygggtttygtttaggtgaggggygtgtgttyggagttygttgggygtgttyggttyggttyggtttygtygtaygttygtttttttggtttggttgaggatttyggggtttggaygtgttaaygttattttygygygtygaagttgtgayggtttattaagtagagatttgygaggtatatagagagggaatgaggyggaatygttygggggttygttgatattgtagagtttttygtagtatygttgttttaaatttygtttttttaggygtgygygtatagygagttagaggaggtttygtttygatttggggtttttygyggtttttagttygggggttygggttttyg

SEQ ID NO: 5987 - DNA, 1134 bp, Artificial Sequence
  Description of Artificial Sequence: Synthetic polynucleotide
tygaaaaataygttttaggygtygggattttagatatttgggaaatagagtgtaygtagttgttgagaggtttygygtttggttttttttattattgaggygtagaggtgttgtggatagtttagatttatayggygttygaggtgaaatagaatttttagtttttttatgaggttattggtattttyggttgtttttagagtttttygatttagagttgaatgtaaagtaagygttygaaatgtagaagtagtyggggtygtttayggtatttgtttygttyggggygagagaagaygttaggttgaggttttagygattttaggtattagtttygaaggagggyggggagatygtaaaggggaagtgttyggagggttaayggttttygygtattttgygtttttttgaagygygtygttttttygygtyggggattgggatttgtttttggggaattygtttagaagayggyggyggattggggtygggtattttttagggttgttaggttttttttagttttgtatttgtygygtygttttatttygttaggaagttttagagatttyggggatggggtgggagygtttttttatygygggtttaaaaagaaggaaggaygtttttaggggtygtagaaggaggattagttttaagttataatttttttyggatttaaggtaggtyggttggggtttygygtttatayggtttttggygggggttygygygtttygggagtttygyggttyggggaggaaagaggagataagagataggygaggattayggggttgatttagtyggggtagggattatygtggaaaaattttggygaggtggggggaygyggaaagagagyggttygygttttgtattttgygtygggtatttygygttagtgtttygtttttagtgtttygygtttygygtttygygttttgtttttatttygggttagttgtatygygttygygtygtaggaatygtggagttggaaagtgggggygtygyggttggggggttgttttagttgygtttyggttagygatyggygggtygggtttaaatttagttaggttgggtaggyggtggtygygygattggggatygggygtttygtttttttyg

SEQ ID NO: 5988 - DNA, 1645 bp, Artificial Sequence
  Description of Artificial Sequence: Synthetic polynucleotide
tygygtatygaattygagttaggtttggttttagggtagatttaattatttatttygatygagttttygaggtyggygttttagtttttatgtttatttttyggagaygtttygtggagattttggygtttaaaattgygggagtttatttattgygtttaggtggttagtttttgagttttttttattygtggttttttgtyggtatgtaggtatgtataagtatatygtygagtaggaggatttaaygaatttagtttgtggatatgttttaatttttattttygttttttttaggtttgtttaggtgaggatgatgggagggaaaagyggtgtatagtygtaatattggtattttgtaagagtygtyggggtattgatatagagggatatygtattggagatgyggtgtttayggagatttattgygygyggtgaaatattttaagtatygygyggaataattgggtttagtttttttatttyggattttttttaggattataygttattttttattttygaatttaggggtttttttaygttgygtttatttgttttgtttygtaatgattattttagtttggtggyggtggaatttgagttatagaggtyggttgtataggtagaygtgggtayggaagttagaatttggaatttttaggttttttagtttttygtaagatttygtygttgyggttttagggtayggttygtagagyggagttttttggttgtattgataggtgttygggtygtygttttygtygttgttatygttygygttattgttygtatyggtttttgggtygaattgygttttttygggtgggtatatagtygyggggaagtygtyggggggtagtatggagtygtaggggtagygygtttygttaggagtygggtatataggttygtggggygttttagtygtygtttggtaygggaagagtgagtagggygtagttagtttygatttttgaggatygggggattggaggtagtatygttyggagtttaggttgtttatggagtagygtgtagtggtygtagtygyggyggyggyggyggyggyggttgtagyggyggagggtagtttttttttttygtagggggagtttttgyggtygttygggggtttyggtttggttattgtygtagygttggtaaatgygttttyggygtyggtgttattaagtatggtygygggggtttttgygttggyggttgygggtttttygtttatygtttygtaggagagattgtyggaaaattttttggaygttttgtttaagtttaatttttgaggagagggggtygygttggggaggtggttagygttttygtygttgtygtttygygtattttttagygggtagaagtgygygttaggtaggtttattgagtttattaagagttgtttttttaattgtatgttttgtaaagygtagayggtagttggttgttttttttttttyggtggttttattataaaggtaggatgggggagttagygttttttttygaggggaaggtaattttttttttttttygygtyggggttatttatttgtygattygygggtygttattgygygtattggygygttttgaatttagygtttttttyggaaggaaagygtyg

SEQ ID NO: 5989 - DNA, 4698 bp, Artificial Sequence
  Description of Artificial Sequence: Synthetic polynucleotide
gygtttygggaaygttttttygttgtattttataggaggtygtgggyggtggtttaatagttttagtgtagagtttgaattttatygtttagaaggaaaggtgagtgggggattygggygggaggtgaggtttgtyggtagyggtttttaggygtgttgggtagtayggttagtagaggyggygtttggttttggatgttgtagyggagaygttaaggagattgaatgtagggagygaggygtagyggtygyggagggtggggtygttyggaaatttaggyggygttagttttgtagtatttgtaggtygggggygygtataygaggggtaygtgggtgtggaggaatyggygyggyggggttttttttttgtagygtygyggyggtygagtgttygtgttggaggaayggygagtggggtgtttgtttygygtaggyggtattygtygttttagtttygtatatagtaggtayggttagggatygggatygtggtttagygtttggaggygttttttaygygtatttttttygatgtyggggygggaagtygagtggttttgttyggagatgttaggggatgtgggtaggggaygaagaggttttttaattggttaaattttggtttgaggaaagattgaggtggttattgattygtgggagygttttggggtttygagggaayggtagtygagttygggagattggtgttgggtattygygggggtyggygggttttaygtgggtggatttygagttgagggtagggtagggtygyggatygttgatttatgagtttttttattttygtataaggatatttgtatatggattygggtttttattygtttttggttgggttggygtygggagygygtaggggagggayggyggyggagtgyggggtttggygggtgaggtgggtgaggtgtggtygygggggagggggygaaggtattagaaggttgyggtygygttgtygttgttgtttttatygtyggygyggggygyggagggggygaagaggtgtttgttagtygtattgyggtttaggggtgaaaggaaaagggtttatgtaaaggagaaagggtaggtagagatttttgttggtgttagtaggtayggaaggatgtggtygyggggatttggagtttagagggtaaygttgggtgttataatgtyggagatgatttygggtgtagaggygattttagttgggtagagttatagagaaygtggttygagaaggggagtttttttaaattagatatattttgtgttgttttaaatttagtatttatttttttttatttygtttttataatttttagggttttagyggagttatttaagygtttagtattattagttttattttaggtaaaaattaagattaattttgtattttattaattttttygtatttaagttattayggggtagttttttatagttttaaggygtggttattttaagtttatagygagttgttygtgttttyggtttttgtttygtaaatttyggaygatgttatyggaggaygttgaaggtaaaggttggtggggttaggygtyggygagattgtygygttagtatagttttygygggagtygagtgttgaygggtttygygattttttttygagggtaaayggttyggttttttagggatatttggttagtgttattttttttttatygggtgtygygtatttttttaatagaaygtgatttygtagayggatgaattyggaatyggtaaaattygtttgtttttgtttagtttttttgttttattatattattgttttttattgyggattgygtygtgtgygtttygggatygtttttgtatttttgtttatagttttttattattaaggtagtyggaggaagattttttygagttatttgttttaygttagtagttatatygaggyggtttttttygtattattttttaagtgtagagtttttgaaagttygaggtttttgtgttaygtatttttttttttgyggggygatttygygtatgygtgtgtgtgttaygygtttaatygtatagagtaatttttagaygtgtaagataaagtattttaagtaaagatggtttagagtttaaattggaaagtatatttygaggygttgaatttgttttygtygtttgtttyggtttttggggygtygtatttaggagaagggttttaattttttgttagattygttyggaattagtttttttggyggtgtagtaataagtggtttygtygttttttttgtgtattyggagggattatatttttttttttttttagtttttagtttaaaygggagtaggtaatggyggggaaagggggaggtgaygagagyggggagaaggaagtatatattttttaattgtgaaattgtttgtttgygtgttgtgttttgggatttttttgttttaattaattttaattttaaygtggtygtaaygttaagattaagatttagaaatgaaaaygtatttattttttttattataaaggtygtttgttgttgttgtttttttaaaatattaagtaattttttttttttttttttayggatttatattttgtttatgagatttttttaattttggtggtttggagaaatgaggtgggggaggggaggattaagggtagtaagaygtttattaygaaaataagatatttattaatttaatagggtygtttttttttatataagatgtttttttattttttattaatttataataggtaaattttgagtttttttaaagtttygttatttagygtttatgttygaagttttaygaataaattttttttttaggtaaatttgtttaatttttgttttatgtttagygaagtttaggtaygatgggttaaggatttttggtttttatattgtttgagttaygttttagttggaaaggttattttgggygagggaygtgttgttygattggtttaaataaggaaagaaagtggagtattaaagaattaagggtttttgtttttttttatttygttattattattatyggttttygggttttgttgagygttgyggyggttttggttgaaaattgygttttygtttaaatygagygtaaaatttttttggatagaagtttgaaagaatttagtgtagaaatagattttttygtttaatttggttttaattagtaattatataagtatatttatataattatttaagtggagagtagaygtttagatttayggtttttaygtgttgttggagttggygtagaygygtgtgygggtatagyggyggaygtgatatygtatttttttygaatttttgttatttagggtggtgtygttttaagagggggtygtggggaggtggggtaataggttgygtaatttatttgttttgggggagtttagggtttagagtagagygtaatttyggggggttgtygtatagttttatttttttatattagaagagtaatgttttttatggatgattaatagtygggttttttttgattatgyggygygtttttgtyggtattatttagttgttttaatttgatttttattagtaaygtgtttttagaggttgygagttggattygtattaygataayggttttttttttttttattyggtyggttttttgggaaggatyggggattgtagttttygygaygttttttttttttgygtagggagtaggtttgagtttttttaygtaatgatttgggagattttaggtatttyggggtttggtyggagggttttygggttttggagttgggyggtgtttgtagtgtatygtygtgagtttttttygggtataatgtgttggtgtgtagagaggaggaaaggaaaaaaaaaaaatttaatattatttttaagtggtattggtatttatgaagtggtagtggtttatattgagygtgtttttgtttggaggtgtagggggyggttattgtagtygaggggagggtattgyggttaagggtagggygagaggatagttaaggtyggttggtygygtgggagtttttttttttygggtttagyggtyggaattattagtattgyggttaaaggggttggtaggtttttttgtatttygygtgttttttygttttttttgtgtttttyggtttttttaggaggaagatggggtgtttatygygaatggggygygtygggtygtttggtygggyggttaygtgttttttttttttygttattgyggygggagttttaattagagygygttagggggtttttttygggtaggaattattyggttyggyggyggagggtgggtygtygttatttgatygttygttttygtttttygygagtaaggggyggtggtagygtttgttyggttataaatggtttttttygttyggttygttygttygttygggttyggygyggattygtttgggygtgtttttttygtyggttttaggygttttatygttttgttyggygttagttygyggttttagttatttttgagggygygtygggtatttagygygtaggttygtttayggaggtygatayggaagtttggatygtygaggygtgtggttygtttatyggtaggtgagygtgtatygygggygtgggatgttgtggggatagtgygggggaygtgtggggttttyggatgygaaygygagttygtgyg

SEQ ID NO: 5990 - DNA, 462 bp, Artificial Sequence
  Description of Artificial Sequence: Synthetic polynucleotide
tygttgggattttgtgygyggggtaygttagygattataaaygtgttttaattttgttgagttaaagttttggtgttaggygttgttttttttttgttygttygagtttygtattttttggtttttttttagttggtgttgtgtttagttttttttgggtaatttatttaggaattygttgyggttatttttygttttttttttaatttgggtygagtaataagtggagttagaattaattttatgggygagaggagtayggaggygagtggagygygttgtygttagaggttgttaaggaggyggggtggttagygyggggggtggaggatgggggtaggaygygggagggaagggtagggggtggggggygaggtttyggggattagygygygagagtgtttagttgggaaatgtagtttygaattaatatygtatgttttataattagtttaygagtyg

SEQ ID NO: 5991 - DNA, 300 bp, Artificial Sequence
  Description of Artificial Sequence: Synthetic polynucleotide
tygaattggtttgttygtggygggtttgtttaaagtataggggttttygttttyggtgygygttgtttttaggattagtgttgttgggagataaagagttttagatattygaggttgggagygtyggagagtttttaggtttygggtattttttyggagtaygtaagtatagttttaggtttttagggatagatgggttagagtygtttgtatttgttygtattttttgggaggttgygatgatygtagttagggtggtygagygttyggtttattgtattyggyggttgttttgtagyg

SEQ ID NO: 5992 - DNA, 554 bp, Artificial Sequence
  Description of Artificial Sequence: Synthetic polynucleotide
tygagatatttygggygygagyggtagtgttgtttgtttgtttttttttttttttagtttttttttttygtgatttatttattttttgtagttttygttygtattttttttaatatttyggtatttttgtattatttgttygggtagtttyggygggttttgggatttgttgtgygygtygagaggaaggtaagttttaaatttttgtttggaagaygggttgtygyggttgtattattagtaggaggaggaggagaagaaattatttygygatattttattttgygggtgttttgtygttgtygtttttgttgtygtygattygagttygygggttygaatatygtagyggtggggayggtgggttyggygggygtygggaggaggatattagyggagttttgtattttygtgtttygtttattagtatttatttgttttttygttttttttttagttttttagagaagggattatgatttggaaaygtagygtygtttttygtttttatagtgtttgygggtttttgttataaggtaattttygtttyggyg

SEQ ID NO: 5993 - DNA, 1153 bp, Artificial Sequence
  Description of Artificial Sequence: Synthetic polynucleotide
tygtttttttygtagagatygttagttgaggttgtaatatttgtttyggtaaagygttttygtagttttttyggtttgttygattyggtttttttygtttttgtttyggttgyggtattattttttggagttaygtttyggygagygggggtygyggagygagggggtygttgtgtygttatttattygagtygttygggttggtygygagtygggattygygagggttggygggttttggttttygaggaygtagatatgtggtttgaattttygtttttttagtygttgtttttgtgtatttttttgggygtttttagygaatgygagyggygaggygagggygagygygtygaggaagggygggagaggygyggagtttggtygygtygygttgygtygagygtygggtttttttygygagtttttygggttygygygygygttttttattgttttygtttttygygyggygygtgttttttatttttygtygygygttttygtattygttyggttttaygyggygygygtttgttttggyggtagyggyggyggyggyggygygttttttttygaaygtygtttttagggttgttggttgygttttttattgtttygyggttgttgttyggggtgggyggygaggygggggggaggtgtyggtttggtygtyggggagggtttatygttygggyggatttttattgygagagygatgygggtttaggygyggygygygggggttgtagggygtttagtattgggggttgtyggygygygggggtttttttttggtttttaggtattygttgttgttgggygtttttygtattttyggttattatggatatttygttttttygtygtttttttygygtatttygggaggtygtyggggyggtagtagyggygyggtttygygggtgtttaggtgatyggttyggtagyggtagagtagtggtagtagtygttattgtygttgttattgyggtygtygtygttggagagaggaggaygaggagggtaaggggtagaagtaggttttgttttgtttgttttagaggttatttygggtttttttttattaattaagygatttygtgtttatttygtaggagaygtttyggtagtttttaatttgtgtgygtyg

SEQ ID NO: 5994 - DNA, 1603 bp, Artificial Sequence
  Description of Artificial Sequence: Synthetic polynucleotide
gygatayggtttttttgaygygtttttaattaaggygttaagtttagtttgatagtattttttttttttttyggtttttggtttgatgagtygtttttatttgygagyggtgtaggtatttttgttgtygattaattttttttagygtygaattggyggtattygagtygyggttgttaggtygggagaaggttgggtttggtygggttttgtagygtttygggtttygtttttgttttgggygttygttttygtygyggggygaggtggtggagatygyggaygtygagggtttttttagttagtaygtygygttgtttyggttttggggygggggtygyggagttttattaagtggttygygtttyggttttygggagattygagygyggggagggagtgggtgtygygagggggyggttygygyggggagagtygttagtttayggygtttttgygttgttgtggatgtggttaygygttattyggtttttggattgttaggagagygyggttygaygttattaygtygtggaygttyggggatttttgaattttagygttaaggttgygaygatgttygtgatttttatygygaagttattttygtaaggygaygtaaggatttyggygatttygggygtygtatattygttattttttagttttatgtaattttttttttgttgttttttttyggygttttgtttttttataattggaagtygygaaggyggttattgygttgagtygttygttttgttggttaagtttgggygattygygyggaggagggtygggttgattgtygtygttgagttgttttyggaygggagygtttgtttayggtatttattttttttagyggtggaaatgtggagaagtaagtgggaggyggtgtygggaattgattttttttaaaayggtyggygtygttgttttgaaatgggyggttaagtgtttgtgggattaagggyggttttagagatgttyggaaaatygttgttayggttagagtgyggygtagaygyggtagagttggaggtgttygyggtgtaggttgttgtttaygtygtttaggttaggtgttgagggtttagttygygtttyggtygaattatttttagtttygttgagttatttygttygttyggtttttatygtatyggttagaggaaagttttygyggtttttaygtttttttatagttgtagygttttttttgtttttggtttygtaagtgtttatttgagtygggagaggttttygggtygttttaattgttygttttatttggtagttygttttygttttygttttygyggtgaggygtttttygttttttygttttttttttttaaattatagttygagttygtttttgygygygygygtttttttyggtttaagtgaatagttttygygtaagygggatattgtggtggatgtaatttttttygtttttagtygygaggagtttttyggygtygtaggtagygttttttttygaagtagttgtatttgtaattgggtagtttggattttygtgttttgttttygggatttygygtagggggygtttygggatattttttgygggtyg

SEQ ID NO: 5995 - DNA, 1411 bp, Artificial Sequence
  Description of Artificial Sequence: Synthetic polynucleotide
aygattagygttttyggtgygaggatggaaagaaattttagaaaaattttygttagataattyggtagtatttggtttyggaatagagaggagagaaagatttgatygtygtatttagggttattygtygtattaagtttgagggttttttttgtttttaggtttttgtygttygagtttaggtttttttaggtgttttagggtygggttgtattygagtttygaggaggttttgttagygttagygyggyggtgataatygagggaggtgggtgagaggtgyggttgtygaggtaaaygtagagtattygtttagttttttaagggtygagagtygggagtttygaaygtygtttaagtagttttttgtttttygtagttygtttatatttttgygggatttttggaygtttygttyggggatttagggaggagggagagaggagggagggagtgggtagtttgggygtaygttatyggttttygtaygttyggtatttttygtggygyggygagttaatgggatttgtatattygaggtgtaatagtattattgtattaattattatttttattttaygtttagattgtttatttatttgygggaaatatatgtygggagaagtttatatttyggattttgtttygttgtttaaggtgtaatttyggggaggyggygaggggggaggggagggttttagattttttattatattttttagttttatttgtygttgtaaattatgaggattttttattgagyggtatatggagattatatatttttttgaatatygttttttaaagtttgtagatttttattttgaaatgaaataatttttygttggttttttyggggataggygttttttgygttttttygygyggtttgggggatttttttygtagagtaggygygtattttaatgtygtggtyggygtttagtggagattttttttatagggtttagaataatttttygyggaatatttatttatatgtagtgtttgagaattaaggtagtttttttgttttgtttttttgygtttagttttyggatttttgtgtygtttgtagtttttttttatttygaatattygtatagaygygagtttatttttgttttttttttaygttgggyggttttaaattygtygygagggttgaggtgtttatatttgtttayggtagtttgtttygtttttaagygttttaaagttttttaagygtttatattggttttgggatagtygattttggtttttttgtttgtttgagggatygyggaagtggyggggaatgtgttttygtttgagatygtttattgtgagtttttaayggaaattttgtayggaaggtaatygttttttygttygyggtaagtaggatttattygagtagyggggatyg

SEQ ID NO: 5996 - DNA, 2629 bp, Artificial Sequence
  Description of Artificial Sequence: Synthetic polynucleotide
tygtyggggttyggaggtgttygaagygaygggattgatagyggaggaaaygtagttttttttygygttygttygyggtgtaaatygagtataggtygtggagttaggttgtttyggttttygttgggttttaattttygtttygtttagtgggtttygyggtaagyggtttttgaatagttttaagagggttygyggagtaaatataygtattggttygtttttttttygggtagygyggtttygttattagttttgttyggygygtttagttatggattgtayggtagtygggyggggaaygyggagagygagygtatygatttgtgagagaaggttaagaggtttgygttgtygaygttyggtygtattttygtttygggtttttttygyggtgaatttgggtaggagaygttggggtttyggaaagagaygagtttagtagaaagygygtagagaggtagttttaggttaggggagtgtaaggttatagaggttagggaggtgagtataggaggatataaattgaggggataaagaggagygataggagtttaggaaagygaaaaagtatagagggattttgggygttggttttagaggygggtttagagggtgtgaggttaggttggyggyggygtygtyggttgygatyggggtyggygtygygygtttttgtattttygtattygtttgtatyggtatgyggtgggtttttagagatygaggygygaatgtagygygtyggttttgttgtygtggttttagtaagagtaatgtattatggygagttygggttgtygggtataagygaattgtaggttyggygtattggtgggygygggygtygggggygyggyggtggttgggttggtagggttgagttggttyggyggyggygyggyggtttygtggtgyggtggggtaggyggyggtgyggyggtygygtgtagatggtgtgygtgyggatgygggtgggggtgyggyggaggygggggtgyggtyggygggttttttaggttattgtaygagtttattaygtyggggggtagygttatgttttgtaygygtgtgtayggttygtaygaggyggtygggttygttagttttttgattatagyggtygygttagggttatyggggttygyggttgtagtygtagttgttgtagtygttgyggttgtygttatttggtaggaggtatagggtatgggtgagggaggttgyggtagyggttaygagttgttgaggaagttagattgtaggtatttggggggygttaggtagtygtagtygtyggtttyggygttygttaygtygtattygtttgyggygttttyggtttygaagagttttttgtygggttggaagtgygygggyggyggtyggaagggtttttttatgyggyggyggygtyggtagttgtttttttygaatatgttttygtaggtygggtttagygtttagtagttgtttttgygttygtygtygttttygygyggtattttgatgaagtattygttgaggttgaggttgtggyggatgttattttgttagttttttttatttttttygtagaaygggaatttygygatgatgtattggtagatgtyggatagygtgagtttttttttygygttttygyggatygttatggygatgagygttaygtaygagtaygggggtttttgygtygggttyggttttttyggggttgtttygtygttatttttatygtttttgtttgggttyggyggyggtttttttggttttttgattgtgygatyggtttttggggttagtagggttttygtygygttttygggttyggggtagttggttattatgataaagtyggygygtygyggtygggtygtttttgtttttygttttaggygttggygyggtaaagagttggggygtaygagttygtttayggttaagttttaaatttttggagattgyggatgtygttygygtttgtttgttggaggtttgtygttgttttttttttttttttttttttttttagggagyggtyggygggagtggagtttagtttttggttatggggagttygtttaatagagaggggtttyggtttygtygttttttttygtttaggttagttttygttttggtgggtttttttttttgygtttttttttttttttygtttttyggtttttygaagtaygattygygtttttggyggagttgttttttggagtttttagtgygttaggagtttygttttgttttgattygtatgggttttatygagtttygtttgygttaggygttttygtttttatagyggggyggttagtygygtaygggygagtttatttttaagttattttttgtaaaygtttygtatagtttggatyggtttgttttygtttagygagttttaggggtttagtygatagttaggtttaygygtttttgaaatttgtyggtattygttttgygggttgggttgggagatgaygaggatttyggtggggtttgttygtattyggttaaagtttaggaagttygggttttagygaggaaaggygttttaagttttttygyggtttttaggtgaaagaaaaygatttttttgttttgtygtttgttgtyg

SEQ ID NO: 5997 - DNA, 1686 bp, Artificial Sequence
  Description of Artificial Sequence: Synthetic polynucleotide
tygyggttgtttttgtttttyggagatgaygyggagttttgttattgttatttaggtttaaggttatttattttgttygataatttttagtattattaggygttgttttagtgtgygtttggygttttttttagattagtygaygtagaaygtttagagatttagttaagggtaagatttttagygaygttygttagtttttttygtttagatattagtttaaagggtatggtaggttagggtttttygygttattttagatgatttttaggtttygggtggttattttttgggggagttttttattttttgyggtagttttttygagagtyggagtggaggygyggggttggagggtttttyggagtygtttattagggttttttgggggttyggtttygattgggtagggggatttggatagggtttyggagygtggagayggttgaggaaagttgggggtyggggttttggggyggggagygyggaattyggygtygatgttygygtttatgaatatgtaygagttattttttttttttygtgaygttaygggtygtttyggggtgagygtttgagtygtttygggttygygttagtgagygyggttgttgtyggygagttagyggygtagyggygggaattygaggtygagygtygyggyggtagygttagaagygtatttatygggtayggygaggyggtttayggtgyggtaggtatygggaggygagagtyggygyggatagtaggyggyggttgtagttygttggyggttgttgygaggatgttgtttgggyggttgtgttgggtgtygtttttgttggygttgggygtggggagyggtagyggyggtggyggggatagtyggtagygtygttttttygyggttaaaggtgggtgttggggaagtttgttttttttttaggagggaggtagggtaggtttgagggtgaaagyggtaaggatttaggtttaagttggatttgtttatttttttttgtygtagtttttttggtttttgtgygttttggattttygaagttagttttttgygtagyggattagagaggtttattygyggaygttaatttaatttttgggyggggttygggggttgagtagaaggygaggtttggggagtayggataattttgagggttgtttgtgtyggggtgggagygtagtgggtgagtttygagttttggtttagggayggttagagtagggygttggygygtygtggggataagtaggtgtttgtttttgtttgggggaaggattagyggyggtgtttttaaggagggagtygagttgtgatttgttttttagttyggggatggagtggaaatttgtaggttttagggaaggtttygttgatattttttaagtttttttagggygtttttgatttttyggggaaygtgtatttttygggtaggyggyggggttyggaagaagygygggatgtgaggtttttygttgttttttttatttygttttgattatygaggatygaggagtttaatttggtattatttttttgtttattttgtttttttgaagagtttgattttttygygtttttygttyggaaggaagttagatttaagygaaygtttggttttgttaggygagtttggaagtyggygaatttyggattttgatagttgtttgggagygtyg

SEQ ID NO: 5998 - DNA, 1686 bp, Artificial Sequence; identical to SEQ ID NO: 5997
  Description of Artificial Sequence: Synthetic polynucleotide

SEQ ID NO: 5999 - DNA, 2132 bp, Artificial Sequence
  Description of Artificial Sequence: Synthetic polynucleotide
tygagaaagtgggtgyggtaggyggygtttggaggaattggygtaggtttttttttaygtagtatatttggtygtagatgttgaggaaggtgaagatgtggaagagttggtggttgtggtygataatgtygaaaagattyggttggatgygttyggggattttgtttaygttgaagaaggyggttattattagttagaagtagyggyggtagaagtgtaygaagagtgtggggttttttttaygtaggtygaagagttagttttygagtataatggggtaggttatgttgagyggtatgaygaagaygaaggtgygtagygygaaygggtaggtatattagtyggtayggtttttgtagtaggttatagtgtaagttatygttagtaygaaggttataggtagtattagggygyggtaggyggygataaggygygtgtagtttaygtgttagtttaggygttgttgtaagtatggagttatgattttggtatttagtaagttgaggtttggtaataggtagtagtagtaggttatygtgttgtygaagtygtagtagttgatggaygygtagtttaggtagaagaaggyggygygtagaygtagygataggtagttgaataygtgygtygtgtagtttatggygaaggttagtagtattttygaygygtagtattataayggtagtagttaygggtggtggaagggtaygtygtygtygtttaggaagaatagayggtagaatttgtttaggaatagtagtagygggatgaagtgygtttagaagttgagygtttygttggtaggttttagtatygaggttaggtatttttgggtygtgtayggtagaygtyggtagttygataggatgaagtattttaygaagtygtygggtatttygttttagygtagtagyggtttggtagaygttggggggtttygggaggyggtagagtgggagtttygggyggttttygaagttgtyggggtyggggtyggagggttttttgtgttygygtttyggggttgtaggygtygyggtatggtgttyggggttyggttagggygygygtaggygatttttggygtyggttttygggygttgggtagttttygtyggtygtygtyggagtttttgtgtttaygtygggggygtygttgtaggtttaggagaagattygtgttttygagtagtygtttttaaaaattaaataaattaataagagaattaattaataggtagygttgygatygttaggagygyggagygygygaggtttagyggttttttygttaagtttttgttatyggygygyggtygttygygttgyggtagyggyggyggygyggttgattgyggyggtagygyggtagyggtgattgggtatygygyggtgygggtgttttygtygtygtygttttyggagygggaggtggggatgtgygagtygaggygyggagggagggaygggygtatygaggaagggygggggttttttaggttagggtttygyggtygtttygggggatagagttgttttttgtttygagtttygtattattttttttttygggtygtygtagttygggtygtttygttaatgattgatgygggggtygtaggttggtyggygaygyggyggygygygygtygagtattagagtyggttttggggttygaaattygatagttaygygggygttttggaggatattggggagtygygttygyggggggyggggagttgyggttgyggggggaggggagggygtyggagtygggtagggyggagagatgygttagyggtaattttyggaggtygtyggggaggggggtatttyggaagtyggggggttttaagttygygttyggatyggggtygtgttattgttagttatttggggatgygtttttygtttttttattgtttttgygtgtgtgttagtgtgtgtgtgtgtgtgtgtgtgtgtgtgtyggtttgtttaygtattataygaaggtttagttggttttttttygtttagtgggygtatttaggtgygttattattttgtygtttttttygtttttgttttgttygaaagaatygttygtaagttgttttgtggtygygtttattagtttttygagtyg

SEQ ID NO: 6000 - DNA, 2954 bp, Artificial Sequence
  Description of Artificial Sequence: Synthetic polynucleotide
aygttaattatagtggaygtagtatygygagyggaaatgyggagagtatyggggtttygtatgtggggtataatgaaataagagtagtttyggttagaggtttagtaaagyggaaagayggtttygttygtatattttttyggaaaattgaagygttttttttgatttttaaggttagaaagatttattatttttttygagagggygtagttatagatttattagagagggygggtagggtgtyggaagttagagaayggygtttygygtttttttatygttttagggygtagaggtgtttttagtgttyggagaggttggtagtgtyggtttygagggaagygtggagyggayggtygataggggatttttgtttaaattttattattaattttttttgagagtaaaaatatggggtygagttyggtagttgtaygtagaatttaattttttggtagttttyggtatygaygagttttagatttygygttygtatttyggygttttgygygtagagttaagttttyggattygtggattgtagttttygygygtygyggtaaagygggtygygtttttagttttygaggygtagygayggtgggagtyggttyggygttgggggygggggyggggtyggygaagggggagggttgygyggyggaggggaggagtygyggygatagayggyggygygtattaatygggygtyggttggtaggagtygygtagaggttggttygagygygttgygggygttyggygtaaggggagtygggtagtagtatttttttgggygtygttttygygyggyggyggyggttgyggyggggtttttttttgtttaaatatttygttggttagaagygttggtatygggggygggttgggtygggtygggtagtgttgtatatttgggtttttttgtttagagttgtgtgttyggggttttttggtttagtyggaggttgyggagyggygggggttgtttgygttgttygttygggtattttttyggtgatggaagtagtygtygtygtygttgyggggtygygttgtgttttatttatygttgttagagaggtgggaaaattygtygtayggaggtygaaagygagaggggttgygtygttatgtygggagttgagttttatataagtygtttttagttatygtttttagtyggtttygtttttttgagygagataggaagttgyggtttygagaaagyggaggagaygtygttggagtygggaggygtygggttyggyggagygyggagyggggttttgggtygygtgaaagttttttttttygagtygtagggygttygttgttyggaaattgtttagggataagtyggtygattttttagatttttygaaggtgyggggatttttagyggaagygagagggagygaaatygaggaaygagtgatagtyggatagttygtygggyggtgattyggggtygttttygggygygttttyggttttaggtgagyggaggaatygggtagaatygagggtgggygttatttaggaggaggaggttgggagggagattggggygtattygtttatttygttttttttygtaggttttattyggagtygttgttatgggagagttagttttgggygttggggattagtygtygygttygtttyggagtygyggttygagtttyggygttagtagttagttygttgygtttttttttygggttgtagggttgttttygtygygtygtyggttyggattgtgtttgtgatgagtygtagttygtagygagttttgttttygggygygttttttyggttgttttaggttgygtttgtagtygygtygygtgttttgttttygtagtggtttyggygtttaggaygtygttggttygygttttttttyggaatgaaggtgtttygtaggaaggygttggtgttgtgygygggttatgtattgttgttggtgtttattatgtttaattttttggattataagtggtataaggagtygttgtagtagtgtaatttygatgggtygttgggtgtygtagygggggtagtyggaggtagttgggggygtttagggtygttttyggtygggtygtttygtgtttatgttygtttggattttygtattttttatygttttttygttgtygtygtyggggyggtttttgtagtygyggtagggatggygggggttgyggtttttttaggtaatggtattyggggtatygggggygtyggggataagyggtagttggtgtaygtgtttattaygtggygttttggttygtygtttttyggygagttatttaattagaatttygaggtgttttttttttaygagttagtgtggtatgtatggtaaaaattgtattygggggaygtygtttttttgtagggggtagygygggatatgttgagygttttttatygttgygatttttttgttttttagttgtatagtttygygggtagyggggggygtaattttattaygttgggtattttyggygtagttattaataaggtggtgtgttygttattattttgtttygtttatygtaaggaggtygtggggttggtggaygatygygtgtgtaagaagtgttygttatagygtttggygygtttygaggaggagtgtygtaagtatygtatattagttataaagggtgtgygygttttygaygtggyggttttggygttattgttgygagattyggttttggattttaaggttatttatttggtgygtgattttygygyggtggygagtttayggattygttygygttayggttttattygtgagagtttataggtggtgygtagtygagattygygagtttatygtatgttttttttggaggtygygggttataagtttggygttaagaaggagggygtgggyggtttygtagattattaygttttgggyg

SEQ ID NO: 6001 - DNA, 2954 bp, Artificial Sequence; identical to SEQ ID NO: 6000
  Description of Artificial Sequence: Synthetic polynucleotide

SEQ ID NO: 6002 - DNA, 885 bp, Artificial Sequence
  Description of Artificial Sequence: Synthetic polynucleotide
gygtaygtttgygtgtttattttttagagtttttggtttygygatygtgtattgattttttttagaattttaggttygttttggaygtggaaggtagtygtgtygtttgggaaagtggagtygagttygggaygttgtyggtttaaatggaaygtyggtttyggggttygtttttyggygggttttygagttaaattttttaattgttttatgaygttatygggttttttttttttgtttyggttygygyggttttagygtggygttaaggagtgtggyggttttygygygtatygtgggttatttttaatttaggatttggttagtaggttgtttttygagtygaggttgygttgggyggaattagggatttatagttyggagtggggttgaaatagagtttttggttygagtagagagygtgtataygtatgaaatygtgtttttgggtgygtyggyggttaggtgttygatgtyggttttggaagtagygtyggagttygtttgaatttaggttygggaggttagaggttgtyggttaygtttaattgtgttttttttgggaagataatttttttagttttggtttttttttgagttaygggtggttggttggtttggtggaaggtaggtgtataggtaatagagataaggttaggaggtaaagtatatttatgtgtaaatgagaygygttagggaatttgtaattttttgtattttygtttttgatgtttygatttttataattatagaattttaggtagaggtygtygattttttygttttygttaagagggattyggagtatygaagttttttagtyggtgtyggygttttygygtttttttttttttttgygtygtgattttaaaagggyggygggyg

SEQ ID NO: 6003 - DNA, 2174 bp, Artificial Sequence
  Description of Artificial Sequence: Synthetic polynucleotide
tygttttatyggttttttgyggtygttgtagaagygtattttgttgaatatttygaggaygtgtttttygtatagggagygttygtttttgttggggttggagyggygtttggaggtygatattyggtygttgttggattttttygtttgtygtttttgtyggattaaggagttggttatygtygtagttatagttgtttagygagggttttaggttttagtttttattgygtttttyggtttgygtttygtyggggygagggtaggatttgggyggttagggaaagggtagtygyggggaggtagtgttaaaatttgaggaggttgtagtatygaaaattyggygtttataaggttagttaaagtttgggtagtggygataaaatgtgtgaaaatttagatgtaaatttttttaatttttggyggtyggggggyggggyggggyggttttaggtttttttgygaagtagaygtttgtattttaaatttgtattttaaggygatyggygtttaaggggtagtggggagtttagttatattgygttyggggtattaagtggaaggggaagaaygatgtttaaaataataagaygtgtttttgttggagaggygtaagygttgtaaggtgtttaaagtatatttatatatatatatatagaaaattygtttataaagtagagtttggatttaggygggtagygygttttyggtagaaaatattaaaaagtgaataaaaygtttttttagaaaataagttattaatygtaygagagaaggagaggaaggtagtaatttaattttttgyggttygyggttttgaagattaggaggttygttttagtagggtgaggtttatagaatgtatygygtyggttgyggttttttaggggtyggttattygagttttggaatttygagaggygygaagtgggagyggttattyggagtttgggtaggggygyggggygggggtagttgtttttagttgyggtgagagtaattttyggttagtagtattgtaaagagagtgggaggygagggaggggggagggygygagggagggagggagattttygagggttaagtatttttyggggagaaattagygagaggygatttgyggggttttaagagtgggygtttttttttttttygtttgtttttyggtaygagaygggtatagttggtgattatttagggaattttaaatttggaatgatttagtagtttaaataagtttttttaaaaggtagygatgtygaaggtgttttttttagttyggygtttataygtttttaattggagtttttygttatggtttattyggggtygtygtatygagttggttttygtataggtttagagggagygagggaagggagggaaggaaggggygttttggygggttygggattaggttatygtygygttgttgttygtgttttttaggttygygygtttyggtagttagtagtttataggtagtagattagatggggattattygtyggaygtaaggtygattatttagtttygygtygtttatttyggtygaggaaggaagtgattygygygttgygaatattygygygttygttygggtggggygggggttggttgtaggygatgttggttygyggyggttgaggtttttggtyggagttgtttattatggtttggygttaggggygtaggyggggtttttaggttttttggggttatttygygaggtagtygagggygtaattygggygtttggggtyggaggyggaattaggggtyggggttaggaggtaggtgtaggyggttgttaattygtttaatttgttgygygggtggtygtttagagtygygggtttgyggggygtttttygtygtygygtygtygtttttttaggttygggagggggygtttagggtggagttttatttatgggttgaggttttgggygygyggagtygtygtygttttttyggttggtttagttggagtgttagtttygtaggaaattyggggttygggygagagttatygagatggtaggtgggaygtagagttygyggtagttagagtttttttygtayggttygtygatttayggaagagygaaagagygtttaggtggggtygagttgggggtygggtttttggagygttgggaagtatagygyg

SEQ ID NO: 6004 - DNA, 873 bp, Artificial Sequence
  Description of Artificial Sequence: Synthetic polynucleotide
tyggagagttgttatygatttttttaaygttttaagttttagttttgtygttygygtttttttttttttttgggttataattttggttttttygggtyggttttaygtagttgygtaggagttygygggggaagatttttygtggggatttygagtaygaygtgygattttaaatttttatattttttttgtygtttygtaggttatatgtatygggagtygggyggggtaggygyggttygtaaggattttygygatggagaygtaatattgtygygattgtatttggggtagtttygtygygttttagtygtttttyggtaggaagygtaggtgtgtgagtygattyggagygagtygygttttygggttagygtgggtagggygtygtagtttgygtagtttygaggatttygygtygttttttygagttagggtttttaggagygggtygygtaggagaygttagagggggttgttagyggttgttgggagaaygggttayggaaatagttttttttaaagtyggggttatygtggggtgggygagttygtttttttaggtygggggygyggattagaggggaygtgtgtagayggtygyggttagttttatttygttygggyggagaygtatagttggagttggagggtygtygttygttgggtttttaggggtttgaaygtttaggggtygyggygagtttattyggagygagttaggtgagtaggtygttatggygatgyggtttyggagagygtaygtttgtygyggtyggtatggaaaygttttygttaggttygggggygtygttgattggtygatttaatagaygygggtgggtagtttagtygtatygttaagttyggtyg

SEQ ID NO: 6005 - DNA, 2174 bp, Artificial Sequence; identical to SEQ ID NO: 6003
  Description of Artificial Sequence: Synthetic polynucleotide

SEQ ID NO: 6006 - DNA, 510 bp, Artificial Sequence
  Description of Artificial Sequence: Synthetic polynucleotide
gygggtatttygtaygttaygtaggygttttttygatgagtttttttttattttatagtttagggaaggtgyggggttgygggygtagagttgtataagtagggttgtaggttgggttaaagtygttttgyggggatygatatgaattygggttttttatyggaagggattaaggattgagggttgagyggyggtagyggagatttygttygtagatttygtttygtygtygttatttttygtyggttyggatgaggtttttttagttttgggaygttttgtttttatatttattatttttttattttaggggtgtagyggagttttagttaygaattatttaatattygtaggttatagagygayggaggttgaggttgtgatygaattatygaygtttttttgaggggtgaaagtayggtygtggagattttaatygagtttaygttggygtaaaaggtaaaagtygygttagatttyggatgtygttttttttttttyggttgygyg

SEQ ID NO: 6007 - DNA, 511 bp, Artificial Sequence
  Description of Artificial Sequence: Synthetic polynucleotide
tyggagtttggggtygggttttttttatttgygtgttgttttygggtttygtttygtttygtttyggagggatttttaggtygggtttagatttaggagttatttggggatttyggggtggttgygygtygagggggygttagyggggaygtgagttggygtygagatagtttyggttttttagygttagggttattgttaggagattttyggttagtatttaygtggggygttttygggagttygaggggtttatygtttgtygggattygttattttaaagyggygggtgtygtygagtygttggagttttyggattttaggttygtttygtygtygagtatgtttagtgygagtygtygtygaaagttttttggaataaatattygtatttggggtttggygggttaggaggtgtyggaygggygtgggagggggagagygagttggygyggtttaggygttyggyggttaggtttgggtttgtttgygtttaaatygaattagagyg

SEQ ID NO: 6008 - DNA, 417 bp, Artificial Sequence
  Description of Artificial Sequence: Synthetic polynucleotide
tygygtygtygttttggyggggayggtgtagtaggyggygggatgyggyggggyggtagtttgagygtttyggatggttygyggyggggyggtttgtaagagygaygygyggttgttgttggggygggaygygttgyggtyggygttygttttgttggttttygtygtgttgttgggygtygygttyggtttyggtttyggtttttggtttggttgtygygygggtygttagygtaygygatattaggtgggtyggtygagtagatagyggyggggyggggagygyggggygygtggtttttgggttttgygggttyggagtttyggttttgygattttttgagtttggttgggaatttygtaygtaatygtttaggygtygggttttttttttgttttaggagggaggtggyggyg

SEQ ID NO: 6009 - DNA, 1748 bp, Artificial Sequence
  Description of Artificial Sequence: Synthetic polynucleotide
ayggaaatattygaatyggtgaaatgtaaatygtgtttattgtataagggaatygtgtagggagagtygttttttataaggagttaattagygtttgtttyggatattttygyggggtttttagyggggtttaaattggyggyggtttagtagggggygaggggtgttgggaaaygtyggggttgygaatttayggaagaaaatgtattyggtgtagttgttttagattttgtygtygyggtattggttgaygaaggyggyggtgttygaggagttataygttattatgtggaagtyggtttyggataggygattaaaggtttgttttaagtaggtgaatttgaggtagaagygggaygtgtattttttyggttgtyggtyggggtygyggttttygttgagygtgttttygaagatttttttggttagygygatgygttygtatattatgatgygygttataygtyggaatttggygtyggtttggttgtygygtayggtggtgtaggagtttyggtagtttagygtgaggaagttygagygtttgttttgygygtygtygtygtygttattatygtgygttttygggttygagggtayggyggtygtygtttygygtagtagtagygygtygttgttattttgygagaygttgttttttaggtygttttggtagttttygtygttgagagagttttgtttggtgattttgggygatagtagtttgattaagtyggtgagttggaaatattyggtttygygtagtagtygttttttttyggggaagtgtttyggtagygygagttgtttgtttygtagataatttagtaygtatttgaaaaggaagtygtttyggtygatgaagaagygygttyggttgtttttgggtagttygtttyggygtygggygtygttayggggattagagggygagaatatgttggttaaagtattgttygggaygttgagtagygtygagtgtttggttatataaatttggtygtttaygtttagttttattattttagggaagggygagggtgygtagggtttyggggyggyggyggtygaygygtygggygagttggaygaggaaattatttygttaatgggtaggatggtgttgtygtygttgttygtgttttttagagttatagttttttygtygtyggtttagtgattygagagagttgtattttttygttttyggagttygygttttagtttttygygtgtttttggygttttgygttttyggattgggyggygygttttttygatyggggyggtttygtttagggttyggggtagyggyggygtyggyggygttygagttttatyggaggagagaygygygagagaggagtttygtyggtgyggyggyggtaatggagaggtaagaaggagttgttgtttttttggggygagggyggggaagtgtgagagagatttgygagaggttttagggttgttgttyggtttttygtggggagggygggaggaggggtygaagtaaagaaaattygtygtttyggtagtttgtaagygtgtygygaggtyggagygtygayggtggygttaattatttttggtagtaygggaggaggtattgaygttaagtttyggattgggattygagttttagttgttatttaaagagataggttgtagtygyggttttygggtttygaygttagggggyggggtygagagtygagtttgtaagaggtgtagtttttygattygyg

SEQ ID NO: 6010 - DNA, 1748 bp, Artificial Sequence; identical to SEQ ID NO: 6009
  Description of Artificial Sequence: Synthetic polynucleotide

SEQ ID NO: 6011 - DNA, 648 bp, Artificial Sequence
  Description of Artificial Sequence: Synthetic polynucleotide
aygaaaygttgttatatygagygaatgtaaygygtatataygtttatattygaatagtataagtaagagatyggttgggtgtggaatagaggygtatatygygtaaygtatttatagtatgtataygygygtatttygatttygttttttttygygygtttttatatttyggygtttaagattttyggtttaygaattttattagatagtygggtaattttttaggtgygtagtttgttatttyggygyggtygtttttgygttttagygtttttttttaygtygttttttttagtygtttgyggygtyggagtttagygtaggttagtttagttagtttygtygtgtatayggtgygtagygtgggttyggggttgtyggtttagtygtttyggttaygtgtgagtygggggygygggttagygygatgygggtaggagttgyggyggygtyggtgttgtygtttggtttygyggygggggtyggtgtagaggagataygtagggagggagggaagagaggagggaaggaggagggagggggttagtyggggttattgtttggatagttgggygtyggtttttttaaaggtggggttattygygttygtaygtatattagttygaatttttattttygatatagtyg

SEQ ID NO: 6012 - DNA, 863 bp, Artificial Sequence
  Description of Artificial Sequence: Synthetic polynucleotide
gygtataggaagggyggaggyggtattygggggggattgtttttagaggaggtygttgtgagtyggygaygygaggttgggggagtgggaggtaaattygttaatttgtygtygaatggttatttttagtttttygtttaygagggtggaaaggtagaaggtttgaaggtaaggygtgagggagygtttaggaygttttyggaggggtygggtyggggtttgygttgtagttygtaygtattttattttygygtygyggygttyggtygttygtttttttttttgggttttttttggtygtygtygtttttttttttttagtttttttttttttttttttttttggtttttygtttttatygttgatttgttagygtttttgttygtttttttttyggygttygttgttttttttgtagygtgtttttygtttttatttyggatggggatggggtagggggygyggggtgagttattaattttagtygtttgtttggtygygtaaggygggaaagtgggggygtttttgygttttaygttaagtttagggttaygagtatttttgtggagatygggagyggttgggttagggatgatgttttttttttttttttttttttttttttttttgttttygttttttttttgggttttttyggggattattttttatttttygttagagtygttttgggagagtygagggtttgagggtygattattaagggtagagtttattttttggggagttgttggaggagataggtagygtygggaggtggtttatatygtatygtygagagygttttgttttygtatygttgaaatttaattayggttataggttataaygttaggggtyg

SEQ ID NO: 6013 - DNA, 1288 bp, Artificial Sequence
  Description of Artificial Sequence: Synthetic polynucleotide
gyggattygagagyggygattttygtttggaggtygttggtttttatatttaggtataggtaagatattayggttattattgataggagggtygttaggayggtataygggggtatggttygggtataatgttgttyggtaggggtygggttttyggatttgggttttyggtttttttttttttttgygtgtttttttagtagtatygtggyggggtyggtygtttyggtttygttttttattttttatattttaaataattttaaaaggaaagaaaaaggtygatttttttaaagtttagtttttgtggttgtataattagttggtggagttaagtttaygagyggatayggatttttgttttgtttagygtttagattygtaggygtgtattattttygtttttttttttttttttagttggaagtgaaaagtatttttygttyggggattgggtggyggtggggtaaaaagtaagaygaaatttatttagatagttttttygatttttagaggatygatatttttttygagggttttaatagtggtygtttagggttygagggtaayggtygaggygttaygyggggtygyggttygttttggttayggaggatyggatttgttgygtttttgtgagtttgttttatttttatttattyggtgtttttyggtaygtygatttgttttttatttgtatttagtttaaggtaaaaaggttgtgagagtaygttatagygtagygygaaaggggygattaaggtggagaagagagaggaaaaygaaataaatttaaggaattaatgttattygygaagtygaagtygyggttgttygaaggattttygtagtttygygtgygygatttttaaatatttttygygatgttygygtgagtgtgtgtgtgagtgtgtgagtgygygygygtttygagtaygaygtttttttttygattttttttyggygttyggygttyggtttgtygttttygttgttgygygtttttttttygaaggtaaagtaggagttygttttattattataatgtatttattttggtttagttygygggtyggttyggggaatttttaagggaggygggaagtttgggtgggagyggggtaggaggtttgttattagtataatgtatgtaaatagttggagyggttatygtgattggagaggagtttggygatttttttttttgygyggagtaattttagtattttygagggttatttttttggtttgggtyggggtygaagyggggtyggttgygtaagaggyg

SEQ ID NO: 6014 - DNA, 1275 bp, Artificial Sequence
  Description of Artificial Sequence: Synthetic polynucleotide
aygyggagtaaaatttaatyggtttagggaatttagataygtttttygygtygtayggattttttagaaggagtttggaggtaggygttggatttttttaggtattttygttttygtyggtttttttttttygygttygttgggttatttattygygtggggtatggtgatggtttygttggtgttggagtttaygttgaagatgattayggttgaggygttttgtaggaaygygtttyggattttatttttgtaygtgtagttgtttttggggatgagggttatttagtttttgtygygggtyggggyggygaatttggtgttggggtygtaggttaggyggtygtgggtygagttggttatgattattttttygygggygttttgtttgggygagtgtttttygtagygttygtatttygtttttttygtgtgtagtttygygtygtygtygttygtygtttyggtttyggggttyggygygggttyggygtaggtgatgtttaygaaggyggtgtattatttttttttttyggttayggtaaagtttaggtagagtagatgtaygaaataaaaggaaagtagttatgttgagagagttagattgtagtaygtttggatgagagatattgttatttttattygtyggggtttttttttygttttygygtttttttttygtttygttttttttttttagtttyggttaatttygggtygttgtttttttttttgttgttgtttattttygggtyggaggggtygyggtygggaygygtagtygtygyggggatyggatttygggygagyggatggygttggttttttttttttttagttgtagygyggtggttgtattttgttttttgggygttyggggggygygggaatagagggttygyggggtttgyggaggagttttgttgtygagygttttgttttttygttyggtttygtttttttttataagggtggtygggggtttaygaatttgtagggtggyggttttgygttttttagtttyggyggggaygggtaygattgttygtagtttggggtgttgyggtgyggggtgttgtttagggtgtttyggtygtygttattgagygttggggygygygaatttagttgtagtygttgttgttttgygtyggtttttttaggttgygggygttgygtttttgatttygtyggtggttgygtttgggtaygtatttgtygygggyggggygggtttggggatagtgggagygagtaggtagagyggagtaagyg

SEQ ID NO: 6015 - DNA, 1071 bp, Artificial Sequence
  Description of Artificial Sequence: Synthetic polynucleotide
gygagyggtggttygatttygggtgtggtaggaaggggtgtttygygttttagagttagtgttagtttttattttttygggaagtygagatttagggggaataggttttttagagtttagtttgtagggaygyggagggtaggagtygtyggygaggagtagttaatttgttatttttggyggttgtatttttyggyggttataggttgttygatagyggattttagggttttygygayggtatttagagtgtttagaagggaggtyggggtyggggtgggtygggaaaatygagggagggaaggagtttggagaagtttygtttaggyggggagggggygattyggggygtatttttygattatgatttttatagattttggygtygtaatttgygttttttgaggtygaagatgygtattttggagaagatatttattaggttgtygttgtagagttygyggtttttgttggggttgtttygttttttgttggtagayggtyggttttagtgttgttttygygtttgtygtttttggyggattaagtygttagygatggtygyggttatggtggtttygggaaygggttyggggagggagggygygggaggayggygagtygggggtatyggaggggaaggyggyggygtagatygtggttygttttyggggtagaggagggggtgttaggygggattggggagaggggaaggggggtttagttttgatygggatttatygtttttttygyggggygyggggttaggygygtagatgygtttagggygtagtyggaygatttygggaagtyggaygtygtggtygtygtygtttggttaygttygagtggagagygggatygyggttgygggygttgttggttatygttygtygtaggaatttyggygggggtygttatygttattygygttgttttttygttttgttyggttttygggygggaggtagagtyggtyggyggtttttygggygtyggttggagggygggtttyggtagggtttttgygygttygtyggttygggtygygttgggtaggatttagygtyg

SEQ ID NO: 6016 - DNA, 694 bp, Artificial Sequence
  Description of Artificial Sequence: Synthetic polynucleotide
aygttttygaatttyggattttagttgttattttatttgygtygtttyggaygttatttggttgttgaygtggtttygagttagtaaataaygttagtagtttttttagatttaygtyggttygttttttygtyggtttttttttygtagtggttttttttgtagtttttttgggtttygyggttagtagtgtagttygtggagtygyggttttgttygttttttttgggtggttttagtgygygggttgatatttatttagtyggggaaggtgaggygagtagaggttggtgyggaatttgtygtttttagtagygtyggygggttaagtttagggtygggtagataaaagaggtygttygygtaggaaggtayggtyggyggyggyggagygtagygatggtygggygagggggtagygygttgttggttttgtgyggggtattggttgtttgygggtggtttttgggygtygaagtttaggagttyggggygttygyggygggtatgaggyggygtyggyggttgtagtaagaggayggtatttttttygagtattatygttatttygagttgygygaggygttygtgttygtgtggttgtagtgtatygttattagtaggatttatayggtggggygtagtttygagggtygggagtttttggttatygagttgttygataattttggyg

SEQ ID NO: 6017 - DNA, 694 bp, Artificial Sequence; identical to SEQ ID NO: 6016
  Description of Artificial Sequence: Synthetic polynucleotide

SEQ ID NO: 6018 - DNA, 1424 bp, Artificial Sequence
  Description of Artificial Sequence: Synthetic polynucleotide
tyggygggtaygttggggatgtattygygtagttyggygaaggygttgttgatgttttgagttttgygtygttttttgyggttggyggtgtttyggygttttatygggygyggtttttttaggttygggggttyggygttyggyggtattttttygtaatgggagtggtttaggtyggyggygtygttggtatattyggggttgtaggatagggttatgttgtagtyggggggygatatttyggggtggtygatgagttagttatggaagtaggggttttttttatggttgtagyggttggyggyggyggyggtagttgyggyggyggyggyggtaaaygggtagttttygtggtgtattatygggtggtggggaaaattatttattagatttatttygtttttygygtttttttaygygttttagygtgygygtagtttygtygygttttyggttygggtttttgttttagygttyggygtttttttttattttttattttttagttttygggygttygggttygttyggtagtygtagagggggttgttgtagttygggtttygttttttygtttggttagtygggttygttttagtagygttgyggtygtyggttttttatggggygyggygagttggttttggtatygtgygtttttggtygtygtygtygtygttttyggttttygttttgttttayggttygygtttyggtttttgtttttygggttgttgygyggaggtagaattttttygtgtttatataaaggtgtyggggttttygygaggttggtaygyggagtttygggaatttaagttygggtygyggttttggtatygaagttaattyggaatttaggggygagtttgagtygyggttggaggagtyggtttagttgtgtyggggggyggyggggtygattgtttattgtaaagttattttygtgygattttttttttttygtttttttttttttttttattagttygatttgggtttttgggygtttattgttttaatgaaatttttggttgttgttgttttggtttttaaatgtgattttagttgygagtaaygtgttttygtttttttygygttttttyggagggtttttagagaggttttagtgtatttatttttttagatttttttttttyggggtaaggatttggggttttgaatgagttttggagttygaagatygyggttygggttttyggagggttttgygyggtggtygaggaagtttyggggtgayggyggtggtttttttgggttggaygaygtgaggggagtaagyggatttttttagtaagatttttatgtatagttatatttttagggtygttygggttaatatatgtygttagaggttttttaygttaatttyggggyggtaggggyggygtttygagttttyg

SEQ ID NO: 6019 - DNA, 1215 bp, Artificial Sequence
  Description of Artificial Sequence: Synthetic polynucleotide
tygygtaggttttygggttygtygtagattttaaygtaaattttygggtttttygtaaattttaaygtagatttatygtggtttygttygygtygggtttygygttygagaggtygagttyggattygaaggyggyggyggyggygggygtttygygaggattygggagtagygtagyggygagtagagaataygttatagagaagaagtttagtaagtgtatggtggaaggatygggggtgggggatyggttygttggygggggtaggggtgggggygygggygtttttgygaggtygygggttttttttggtttttttttttygggtttttttyggygattttttttgggygagtyggaggyggygggagygggttyggggtttygygtttttaattttgtagggygtttttttagttagtgtyggggaaaggyggygggtgttaggtaaaagttttataggaaatyggatattygagtttttygtattyggagttygygaggtgaagygagggygagggaggaygtygtygyggttygygtyggtgtagttttttggagaggyggggygggggatattagaatatttygygatgtttagtttttttaaattygttagagttttygtttttttttttttttttttttttygaagtgagaggagtygggtygygggygttgyggygggggygttggyggyggtgtygggggygggaggagggyggyggggyggttggyggyggyggggttygggagygtygyggygtaggattttttagagygygtygggttgagyggyggyggyggyggyggygggygtaggggtagggtatgattgaygygttttttgtttgygtttatgtgagagaaagyggtygagggagggagygtgtygagttygggttgttttttttttttattttttttyggaagtygtttttttggagtttttygtttttttygtttttttttyggyggttttatttttttyggtttttttttggattttttttttttygtttttgttttttgyggggagygggyggtyggaggggtaagtttagtttyggggttggyggttggygggatyggttttagaggtgatgygattattttggattaygtgtagyggggagaaattgggtatygtggggtggagggagttttygttttattttyggttattttygagtttttgttttttttttygtayg

SEQ ID NO: 6020 - DNA, 1184 bp, Artificial Sequence
  Description of Artificial Sequence: Synthetic polynucleotide
tygtttttttttttygggtygygatattgattygttaaygttaatgggggttygygattgttgyggggaygagggygtagagtagttttygttaygggtyggtttaygtaggggtygagaaagtggyggagaggyggtggtygaggtttaggggygagygygggttgagttggtttttgttgygtttaygagygatatttattttttygttgyggaygtttygygggygttaggttgggggttttgygatygatttttttygttttygaggtatygtygggttygtttggtaggtagygygtttygygagttggagggtygagtttygyggggtygtggggygtgtgggtgaaggygatatttyggatgygggaygtatgaatggtggtagagtaggggtygggattygtttatgggttgggagagagatgtttttgtgagtaygggaaagtagygttgtyggagaatagttttgaggygggattaaaagtygtyggygaagtttygtygaggaatayggtygttgttyggggyggttygygagygtgygtgtgtggaggggaggatgtygtttygyggggttttyggagggtgtygggagygggtttttagtgtagttttttygttttygttgggggtayggttgtttataggtttyggttygygtgtgtggagyggggygagggggtgaggygagggggtgaggyggyggtygagtyggggygttgggygyggggttggygggaggyggyggtggyggttyggygygaaggggttaagyggygtatygttttttyggyggtygggtgtaaatagaggagttttagtttattatgtttggtygtygygygtagttygagttyggagttaggygttgtaataygataygttttagatttaggtaatttggtagygttgggttyggttttttayggttatagygagggygygtygyggtaaggtgggtgagyggyggyggyggyggyggtttggggygggttggyggagygyggttttyggtgaggtttttygygyggtagggtygttygttygtttyggggattgyggyggtggyggtggyggtggtggyggyggyggyggyggyggtttygttttttttttttgtggtgtyggaatgggaggaggttyggygygggtttgaatyggtgyggaggtaatattyg

SEQ ID NO: 6021 - DNA, 5820 bp, Artificial Sequence
  Description of Artificial Sequence: Synthetic polynucleotide
gygagtagaaggyggaygttttygagtygtaggttaygtagttgttatagttttgygattygttatagggatttttatagaygtttagygtygyggtygagttgagttygtggygygyggtggttagtagtyggttttygtagatygggtagtagatyggygtttgggtygaggyggygggttyggagttygttagygtgyggttttyggattygtagtaygtgtttagggagttggtggttattaagaattgtagagagaggtygygaggattggygggaagtygggttggaggttggggttttgggttttgttaatttygygygtygtttaygagggygtgtttygagtattttygggtttttygtygtttatattaggatgttygtttttttttattagtttgtgygygtttggtttttttygttaygtggggtttagtygagtatttatattttttttyggagggtttttaaggtttttgaygttatttgygygttaagtttttttttttaggggttttttggggttttaggatttttttggggtatagtttgagttttgtggtttaaatattagggaattygggttyggttygtyggatttttttagygtttyggttttttttygggggtttggggagtaggggttgggygtgaggggygygygatttaggttttgttagttyggaagtygtaggtagtygtaggtyggatattttttatttttygttttygttttattygttttatyggtatttgyggtggtttgggyggggyggggtttygtttatttggggagtygaggagtaggggtatttaaattgygggtaggatatggygggygyggttyggggyggaygggyggggtttgtagggttttgygygttggggtyggygtggygyggttattgtttyggagttgtaggtttttaggygttgggagggygaagtaggagagtyggttagtttattttygygtttygtaaatttttttaatygggtaataaagtgagtagyggtggtygtygygatttttttaatttygtatttyggaggttygagggggttttgggatygagyggtttygtagyggygatagaaatatatattttaygaaaaagaaaaaaaaaaaaaygagtygygygaattygttaagttagatgtgygyggtttgaagyggaggaggttttgaygttagttttatttygygtagttyggtttggtygtagattygtyggttattygtyggyggtttaggtygggaggggttaggatagtttyggtygygyggtggayggaggggttattttttygggygttagtaaataaattttattygagttaatatygtttagygaayggtgtttttttttagttattygagaaygagaggtatttttaattagaaattaattaatgagtagttgttttttttygttttattgtaattattygttttaattataaatgagatttatgaaaggataygttgaagatgtaattaatagttaaaattagttyggygttgygtaggyggtyggttyggtttygygttggygygttttgtttygagtggtaggaaggggttygtaggygtttygtaygygtttygttattattgtttaatygagaattagtaaygtttttygtyggtttttattttaygtyggaatggatttttagaatttattgyggtygtaagatagttygtaagagttggttaaaatgtttttaggtgygtgggggtttyggggttttagttggagttygatattttgagattggyggttygagggttgtagggtygtttygggygtgygtttatyggttttgtatttttgggtagtygagtgtygyggagaaygttttattttttttatygyggttttttaagttttygtttagtttatygtttttatttygttttttygattttttttttygatttttttttygtyggtygtgtttygtyggtttttttttgtttttygyggttaagtyggggattgtygggyggttttgygygttyggaagagtaggttttttaatttaggtttyggtttttttygttaagttygtttttttyggygtttygtagggttggttgygagggagggggygttgggtgtttggyggaggygtttttttttgtttattttgtttagttttttgtttggggygtayggagtaatyggaagaggggatygagygtttattttaggattttttyggttagtattttttttgggattttgtttaagtttaaagyggaggttagtgagtaggyggtaagggggyggtaagggggygttygggttatttygaattygtttttygttttttgygttatygtttttygggatygggattygtttyggttgttttygttttttgggtyggtttttygtggtaagttgggaaggaagtygtgtaaggtagygttgtgtagatttgtttagaaagatttttgggtttagatttgtgaatygttttagggttattttttaattaatgatgaygttttygttttttttttagttgtaagtttgttttttagaaaygaaatttgtttgtttttttgatagttyggttgaaggtgattgatgattatttggagattatagtatatattatataatatttgttgygtaattgttttaatttatagatgaaaataygagtttttygatygygttggatyggagygggttaygttygagttgtttgtagagggaaattatyggaaataatgaatagtygttttatgtaaattatttagatagtttagygtyggtagtygygagaaatatataaagaataygagttaaatgatattaataattgtttttgaattttgtattgatttygyggtaggtygygttttttttttttttatttgaatygttaatattatttttttgtaaataataagaaattagttatyggggtttttygttagaaatgaattttttaatttttttttttttttttttgtttttttttttttttatttttttttttttttttttttatttttttttttttttattttttgtagttttttggtttttttygagtatttttttattttttattatttattgtttataaattattygttttttttaggtaatgaggttyggttgaaggaggggtgtgagtttagtygggttaagggttgggatggggagtagagatttttagaggggaggtatttagttgtggtttgttttttttttatttatattyggggatttggtttyggygattgtgagtatttygtyggttgagggggagagttagggtttaggggtttagttatttatgttttgtatttttgggttttagtgtaatagtttagtttatttagatttgaggttggtgtatttttttttttttagattyggyggggtttaattggagtygaagttttagaataggyggttatttattttttgagtagagtttgggagaagtagtttttattttttagggtagttagtaygtgggggttttttygggggttttttttgattattatygttatttttttttgtttttttttgtttttttagtttgtgtgtataaatygaygttttagtttttattagygggygatttttttttygtgatttagaaatttggtttttgaatyggtttttttaggtygtygtatatataygttttattttttgttygttagtaggttttagygtttggggttygggtttagttatagttattttgtttygggaagttygtaattgtttaggaggttttttgattygttyggttttatttaggttttattatttattttaggatatagggttaatttagtttgtggattggygattatygggatattttattgaaattttgtagtttggtttaggttygtttgtttaaatyggggatttttattgggttattttttttttatagataatattggaatattttttaagtgtttttattaaaaggttaagtttggagyggaggtatttagtgttttttttattaaygataggaygtttagtattttaggtattagttgaaygygtttgtatagattyggagtgttgagtttttttttttttagggattttyggtattaaatatattygtgagtaggtgggttagaagttagtyggttttyggagtatatagtatyggtttagtttyggggagatgaggtgttttygttggtttggagygtttygaagagyggaggattagggtyggagtaggtygtaggggaggtaggggatggttagtttttaaygygaagygtaggygggtygtttattttgayggggttatygttggtygtyggaattatggaaggttttyggggagataggtygggttttgattttttttyggttagtttagttttggtgttttaggagttattttgggggttattagtttttygtattaagagttygttyggagggagttttttttagtttagagaagttaattttagttaaaggygaagtygggagttyggggtattaggtaagggtttttttttttgagatttggggttagagattttgggggygtttgtgttygtttatygttygggatattyggttggggtgtgggtttgagaggttttayggtygttgaygtygtattggygaatttygaggttggtaggttatttttttatagtttygaggttttttyggagttagtggtaggagaaggagttatagggataagyggtgaatttttggatttttaatygttttttatgggggttygyggtttttttttttttttttttygttgygttttygtygtttgttttttgggtayggtttgaggttggayggagygtygttygggygtttaggatttaggtttggttatttygagttttttatttttygtttygygtyggttygygtattttgtttttygtaatttgtagtaaaygtagyggtttttggagagtttagygaygggtagtaaattttgtttttttaagygtaagagtaattttygtaaagtttgtgyggyggagtttattttttatttgagttggggaagttttygttygygtygtgtggttgtyggggtygyggggagtagttygtagttygggaygtatyggggagtygtygtagtygtygtygttygtttttttyggyggtygygyggagttttygttttttyggaaggggggaggggtttyggaatttyggggygggggygggagygggggattttatttatttgyggtggygttgggtygttttyggtagttygygagggtttygygyggaagttyggygygygygttttagyggggagtyggygataattaatggagatatttttaggyggagtatttggygagyggagygygtyggygtttttaggygtygyggtygttagtygagttygtatyggygtgaygtgggygagygagygygttgtttttattyggtygtttattaaygttttttttygygggygtygygtttttgttaattttttttttygttyggtttgygygyggygygtygggtgtaggagttggggtgagggygtttygggtgttagtaggggygttgggagttgtttgggyggggaygtagggtttygggaggttatatagttttaataggatagtgggaaggygygygagttagatttggttaaaygttaagttygttgyggtttygggttttyggtttayggggttttttttttygtttgggttgttttatttagggaygtttgggtygggygygaagagttyggaaatagttatttttgtygtyggttyggttttttttyg

SEQ ID NO: 6022 - DNA, 1233 bp, Artificial Sequence
  Description of Artificial Sequence: Synthetic polynucleotide
tygygttgggttgygtttttgtaggagttaggtttttttatgttttgyggygatagtygttggggtggggttayggggaagtygygttgtttttygtttgagygtgggttagggtttaggtggtgattaaggttyggygtagtggtttyggagygtggaggggtagttgttgggyggtttttygggggagggtgayggttttattygttaaygttgttttttttttgggattaggtyggaggaattttggatygttygaggttggtgtttagttttttttttttattttatttttattattyggygattttygtagatttgattggtaggttttgtttygatttttatttttttaggttttygtttyggtgtttyggtgttyggtttygggttatttttgtaggttttgtttagggtagtyggyggtgtttggaggygggttygtttyggttgttttaygtttaggtyggtttttggtattttagttagtgggagggygttttygtygttttygtgttttttygtaggggttgygtygygttttygggttttttttttygtygtggtttggtttgtttgttttagggygtagttgygttygttttagygtttttygggtttgygtggtttgttyggtttagaggtttttattayggttygttttttgtyggaygtygygttgttgtggtygyggtggttttgtggttgtgagggtygtttttgttygtttatatygttttttttttgtaggtgaggaatggggtttgtttygtttggaatgtgtttttgtygggttttgtttgatttttattttttagtygggaygygygagttttttygtttggttgagttaaaaagggatygygygtatttygtygttttttattaygaagygtagatataggaggttgtagggttagtgttgyggagaattttagayggttttatagtygtygttattygyggggtattygttygggttttgtygaggatgtgggggttttggttttygtagagttgggattttygaaggttttattagaaatttaggagtagttttagttttgtagagttygygagggtggagaygggagattygttgtggggtttgaggttgagatgtyggtttgyggtgaagtyggygggaygttttaattygtttagattygtttatttygtagggttygggtttatttttyggtttgtggtttgtgttgggttgygtagtyggyg

SEQ ID NO: 6023 - DNA, 2865 bp, Artificial Sequence
  Description of Artificial Sequence: Synthetic polynucleotide
gygagttttagttygttgttygtttagagtygtttaggtgygagggygtttttattagaaatyggtgttttygygygttttatttttyggggttttgtagatgtygggtygggggtygttagtaggttttttggtttttgttggagatattggaagattaggygattaggatagygggtygggttagtgyggtgtgataygagggttygagyggtttygtagtttaaaygtgtttttattttatattttttayggttgtttyggattyggtgttttygtgttttttagtttgtttagyggtaygtgggttttaagtttggtttttagyggttgygttagtttagttgtgtttattttggggtygygagggttttttatyggttggtagttggtggataygttgttaagatygggggaaaaaaaggaaggaaggaggttagggggatatagggttggtggttttygtagtttttgatttgygaygggygygagygtattttygygtttttgygtagagatttttttttaagattggtttaygaygttttttatttygaagttaagggttttttgtggtaaatttttataygtttttttttttttygtttattttyggygttaggattgayggggagagggtaaggtygggttagaggggttgtgggtttggattgyggttgtygttygyggttttgtttttttgggtagttagaygtggggttagygtttagtygtagttttygggggtgagttygtagattttygtaygtgatataggttaggtatggggayggggagtttttygtygttygtttttatttagatgttttttgaggtttyggaatatttygttttttattttaggatttgattaatttttaagttayggtyggtttyggtttygygagaygggggattttgaggattgttttttttttygggttgggatttttttatagtagtygatygtttttagtttagagtggttyggttygtagygtttttygggtataggttttaggtggayggtttygttttygygttyggtttttttgttygttaagygtttyggggatttttyggtttttaagyggtygyggtygggtggagttagtttygaagttygggatttttygaagggagaaaattygttttgtttttttgaagyggygggagaaatyggttttatttaggttygggggttygaygttttyggyggaggtyggttttaggggttygaggttttygaagttggaggtyggtttygtttyggygttttttygtygttattttygtttttatttygygggtyggyggagggaggggyggggtygtttgtygttygygattygggttyggtttttttagtgattgtttttgtttttttygygttagttgtttttagttttggggtaaygttgttaggtgtttagttttygygttygagagagygtttgtttggttttgaattttggttaggaaggggygygaggggaaggtttygggggaaggygtgttttygygtttygtttygtttygtttyggaaagttttygyggtttygtttattttaggggttygtttagttttyggagatttttttttttgagygtagtygtttggtgtyggttttygtygagttggagygygygggttayggtttttttggggaygtagaagygagaagyggggatttyggygygygtttygygtttygttttttttgttygygtttyggttttyggttygygtttyggtygtyggtatggtgttgttggtygggatygggtyggagggyggyggggygygttgtatgattttattatygtygtttttatttyggggygygtaggtygaggaggatttygttgattaygaagagtttgaggatttttygagtttgttagatattygtagtatygtttyggaygattttttttattttttygaggaygaggaggagtayggygtygagagygyggagagygtttyggagggygtttyggaaagygtttyggagayggygatttttttgygygtygtttgygttaataaygtggggttgttgyggaygttggtgyggygyggggtgagygtygaggaggygtaggagattgatygtaayggtagggtaagygggygttttygtaggatttgagtttttttattgtttttattttttttttttttattatattttygygttttttagtttttggtttyggatyggtttttyggttatttagtygtygtttagagygtttttttttygttgtttgggagygyggtgttttgggtggttttttygttttaggttgggggaygyggtgyggggagggagtagtygaggtgttagygyggtagaaaygttagttyggygtttttatygtatttttttttygtttatyggttttygtggattttttgattgaattygygttggttgttygtgttgtaatttaggatgggttttttgyggttyggtttttttttgattattatttttttttaggtttttggtaggggattatttttttttttttgtaggagatagttttttttgtttagygttttatttggtttttgggtttttygygtygtttttgttttaataygttggggygtagatyggtttttttagtygtaatgatttggaagtaatagttttttttttygtygggatagtttggttttttattttattttygttgagttttgtggttygygtygygattagttaaygtgatttttgattggtttgttygtaggttattttygygagttaatgttagtyggggttttttagagttagggtatagggagagttttagagtygygggtatttattygggtagggtaggaggyg

SEQ ID NO: 6024 - DNA, 1154 bp, Artificial Sequence
  Description of Artificial Sequence: Synthetic polynucleotide
tygttttttttygtatattagggaygttatgaatgtatygagtatgtttttagggtggyggggagtagtattgtyggtgttgttttaaataygttttttttyggggagatgggtggtagggagggggagtaygtagggtagttatttggtaatygttttaagaaaggtattaatttyggatttttttttaggtatagyggttttygagggggatttggygygatygyggtttttttygaggtaggtagaaatttygtagtagtygtygtygtygtttgtyggtygggagtttaggattatttttattagyggtaagaggaggaggayggygtygggaggaggttgygttyggtttyggtygtttagtttygtaatttatttaaaggygyggygttyggyggttttttygtaaatatgtatttttygtyggygatagttttttagttygggaagaggygtgygyggygtygttyggttttagggtaaggttttgattttgtttaattgtagtatttttygtttttgttgtttgagygyggtygygggataagggatgttggygggyggtaggggygagygtygygggygagaggyggttttygaygygagtgygtagygttyggttyggyggttttttygagttyggygagygtagygttttttgtttggtttygygggttttaygggtttttgygggtttttyggggtttygggygtygtygttagtyggtygggttgagagagtagtygtygygttygtagtttygtttagtyggttgtygtygygggygygagtttggggtygtygyggygttyggygtygagygttttygagttgygtttygygygyggttygygttatttgtgtygtygtygttttagtygtygagggygaggtttttttygyggygygyggtagttttagtttttatttaaatttyggyggtyggttygggygttyggttagtgagggagygttygtttygtygtygaaatyggtttygggtgyggagtatgtttagtgtygtygygagagyggygtttygtygygygygttttattttttttggttttygyggtagtagyggtagtygygggagagaggggaggaggtygygggttgggagagggtygagtatttttgggaaygtayg

SEQ ID NO: 6025 - DNA, 1154 bp, Artificial Sequence; identical to SEQ ID NO: 6024
  Description of Artificial Sequence: Synthetic polynucleotide

SEQ ID NO: 6026 - DNA, 396 bp, Artificial Sequence
  Description of Artificial Sequence: Synthetic polynucleotide
tygttgggaagggaaaaayggtttatatygaattggatgtyggatggaaatttttttgygttattagattgygtttagtatagtagatggtaygagtaygtgyggygtttagtttaggttttyggaggtagttgagttggaaatttygayggaaagtatttataagtttttattttgygttggtttattygygtgtaygtttattttttaygygygtttttggtttagaagygtatagatgtttattgtttagagtyggtatygttggggagatygagygatttgygyggygtatagtgyggygttggtagggttttgggttttyggtygggggttygagyggttaagggatgggggtgggggyggggagagtggggggagggygaaagatygtyg

SEQ ID NO: 6027 - DNA, 438 bp, Artificial Sequence
  Description of Artificial Sequence: Synthetic polynucleotide
tygygtggagagaaatgagttggagagttatatygagttaaygygggatayggttttyggttygggtygggttaggggtgggaggyggttttttatygtaggyggygggatttttatgygtygagggatttaagtttttattttatttataygtttattyggygtyggggygttgyggtttygttttaygagtttagagtaggtygtagtttgggttggggattyggtatttgggtagggtgagtttggtyggatatttttttttaggattattygtattttatagtygygttaaaagygttttatttttttgtttttygtygygtaggttttttatygaygttygttyggaaggygagagtttttaygtggttyggygyggygyggttttyggggatygygagtaataaaagttyggttygtagtttttgtttttyg

SEQ ID NO: 6028 - DNA, 438 bp, Artificial Sequence; identical to SEQ ID NO: 6027
  Description of Artificial Sequence: Synthetic polynucleotide

SEQ ID NO: 6029 - DNA, 411 bp, Artificial Sequence
  Description of Artificial Sequence: Synthetic polynucleotide
gyggtggtgtygatttatttgagtagttgtttygygtttagttygtygygygtagtggygtgygtyggttggatggtttggtttatgattatttygtygggygtyggtygttttatggttagggygagagygttaygtttgyggttttygatattttattatgttygtttygttygtttygtttttttygtttagttttagagggtattggygtygttygttygggtygygaatttttggtygttaggtggtgggagttgygagtgagggggttygtattgttattttaggattatygygagtgggggaaaattagygttttygggttttaggagaagtttgggaagtgygyggggagggggttttygggtagataggtttggaaggyggtttttygagagtyggagygyg

SEQ ID NO: 6030 - DNA, 1137 bp, Artificial Sequence
  Description of Artificial Sequence: Synthetic polynucleotide
tygyggttaaaaygtttagygtygggtttgggtttgygaayggtttagtttaggttttgygttagagtatygtattygggggyggayggttttgtagttttttagttttttttygtattaattagttgaygttygggygtattggtttttttygttttygttygtaygaaagttttgttygaygtttgtagttagtatygttygtattgtttagggagggtttgygtygagatttagtggtygagtgagttatagagtygttggttttggggaygttgttttttatygttttttatygttttttttttttttgtattttatttyggtatttygtattttttttttygttyggtttygygtattttgtttagattttataagtattttttyggggtatttaggattygaygtttttttygygtygttagyggygttygttatttttggtaygtyggagggatygttttyggttttttgygyggygttttttaggggatttttagtttattttttatttagttgttygggtttygaygttttatttttgtygaattgggggatatygaggttgagttygattaagagttagayggttatygagygttttatgatttygtttttyggaygtgatttyggttggttaggggtygtygyggagggtagtgtagtygaggtggtagygtagggtagtagtagatttygtttttattaaagaatttaagaagaygttttttttttttagygttttgttaaataaatttttggagagggygagagtggtgattaaagagaggagttttttttttttttttgtttgygtttyggygygyggaggtgggtgagtttyggggagtygtyggygggtttagtttttygttgygggtgggtttyggtagaggygyggygggyggggygygggttttygyggtygtttygggtttgttgygygggtaggtagatttatyggtagataggyggatygggygttyggttgtygttgtttttygygyggyggttgyggggtttttgatttggagaataatgaagygtgagttggaggggagygagygggtygtygggagygtattgtgtataaatagaggyggygtgygtgtgagtttgagtttggtaggygyg

SEQ ID NO: 6031 - DNA, 2383 bp, Artificial Sequence
  Description of Artificial Sequence: Synthetic polynucleotide
tygaygtgttaaggaaagygygtygtaaggtggagygttygggttgaygatgagaaggtgagttgtgaattttgtataygtttttaaataaaaggtttaygagyggyggtttygaygtggggagtaagtaggtttttttggtttttgtagtaggyggatttaggttygtttgtygtyggatatttagaatttgttttygtagygygagttttgtataygttttgygatyggtatttttggattttttaattattygtygtttaattttyggagagagggtttttygttygttgagttgyggggttgggaaggaaaagggggaygygtttttgggggtttttggatattttggtaaagggggttgtagttttaggttttagttaaagggtttgggayggagtgggttagaaagtygttaaattgaggattttttttttttttaagtyggagttttaggtgyggagtygtttgtttatttattttyggagtaygttttgttgttttygtyggyggaygyggttggttattgyggtatttttttygygatattygggygttagaaattygtttttagagtttgttgtagyggatygaatttgttgyggyggyggttggggtyggggyggtttgggyggaggaggttgaggttggtyggtygtgttttgygtttagagtattatatagtttagttataggaagtagagttggagatatagttttygttttttttttatygtyggygtygaaagygygyggtygtagattygyggagagggagtgattaaagataaaatttgygygttttagaaaagagttagggtttaataagtttttygtyggtttyggggattttttygggttygggttttttgttttagttggagatttygatagagygtyggttttttgattgtttgygaagygagaygyggggygtygggtttagygtagtgagyggygaggygyggyggaggtgtagtyggtagtttygagyggtataygttgtataatyggtttaaagtttygagygattttaggatygttagygggygggggaggaaattataaaagttttggygtaaaattttaaaaaatgtgaattttaaaagaaaaaagggtttgtaygtagagttyggyggattttygtgygtttygaagayggatattggaaagttgtaaaagttattagaaagaaataggtaagtaaataaaagtygtttttagaagaagaggagggtttttttygggttygttyggagttttatagggtaaygaagygygggtagyggttgyggagtygggyggaggtgygyggggtyggggygtgyggttagtaagagagagggygggaggttgggygttggagaagatgyggyggtggagggygyggygygggggttttagaggttyggyggggygyggggygggtyggygggyggyggttgttagtgggggygyggtygtttataygtggggtttaattyggattgagaggtyggygtagagtgggyggggatagagtaagggagagatygggattgaggaaygaggggaattagggttgggtgaggggaagaggaaggaagggggggagggygaagggagggaagaggayggagattggggagaaggggggygaattygagaggaaggtygggttggaagagggatttggaaagagggattggygagttygggtgygagaggaaatgagygggggatgggggygaagttagggtaaagagagaagtgggaaaggagagggagggttaaggttygggygtygagaggaggggttyggggggtyggttggagggggygaggygttaggyggttttgtttttygttttygttaattggtygttagttttgttttgattgtttgtataaagygagtagayggygggggatggggygattagggatyggatttgggaaaggaggtagtagttttttttttttttttttygttttygttyggtygyggattagggattagggtgtttaagygygttaggtttggtyggattygtagttgaattgattygtagttgaattttttygtyggatagaggtygtaaggttgaggatgagaaygggtttttttgtagggtttyggtttttgatttgggatggggggattygtagttagttaggaatagaggtttayggggttgttggttgtagttttaatttaagaaggaggagattttttttttgtttttttatttttatygttttatygggagyggygttagtttgygggattaaattaggggttgggagtttttagattgaaatgygttttttattattaagagggagtttaygyggtygyggggggtygaggtagttagtyggygtygyggttttggggagttyg

SEQ ID NO: 6032 - DNA, 2367 bp, Artificial Sequence
  Description of Artificial Sequence: Synthetic polynucleotide
gygatttyggttttggggttttgtttttgtygygggagaataggttttaatttaygaagttggttaattttagaaattygagattyggtttttgagaagygattgygtgtttygggattttgygttaataattaaatttgggagaagtygygggaatgtttttattggaygttaygaagggaattggggttttttttttgggaagaaaaagttygatttgtgtyggygagagtaggttgttttgggttgggggtattttygagygttgyggygggaygtyggggttyggggygaagagagttagggygyggatygaygtttgttgtttttttgyggtattgttgttygaaygaaygaaygaaygaaygaaygaagyggtttygtttaggaaaaatatttttttgaygygaagttayggttgaagtttygggttaygtagaggggttagtaattttatgggtggtggggttttttatttttggaygtagyggggagtagygggyggtttttttttttgtttattttttttgggggtgggggagttttgtgttattygaygttgygaggggttgttaygggttttttaggttgtgtttttygyggggtygtggttygtgttttygaggttgttatttttttgaggtgttyggagttaaagtagagggttgatttygtyggttgggtgaggtagtattyggtgayggyggttatgattgtgttttgggygtaggaaygagtttttygygttgtttygaaggtttttgatttttygygttttgygttgtttygygtygtygggtggatttatataygttaggagtaaattgygtaggattyggtygttatttttttgygtttttttatygyggagattttgygtttttagtttagygttttttattttatttgggtagygttgygtttgyggttygtgggtttygggttygttygtygyggattttggtttaggtttyggtttyggttggggtttyggatttagttttggttttggtattgtayggtttttyggtttttgttggttygttatattttagygygygaggtyggggttttttyggttyggttygtttttttygtygtygtygttygtygttygyggggaaggyggggatattggtygggaggygggaagggtggggggaggggaagttaggtgttygtygggatttgyggggagaggggyggygygtagtttygtyggttaggggttttggtttttttyggggygtaggttggggttygygyggttggyggtygggtttygaggtyggggagygygttttgggattttygtggaggggttttgtygtatgyggaygaagttagagygggttttagtttggttttggggtattttttttttttgggtttagttttttatttgattygtgaggggttggttttattttygtttagaygggggttggtggtygagtttggggttttgagattggattttttttttttttgtttagtttgygggagggagttggttttgygtgttggtagggagagttygttgtttagagygtggtagttagggaggtttgaggatagattttaggttttttgtgtttgggggtagggggtgttagggtggggtaatygttygatttgttttggttgggggaattgtttttttttttttttttaggggttgggttggtgaggaaagggtatattaattttttaggatagatatttttggggttttttgtttaatttttatgtttgtatattttttagygattattttgttgygggtttgygaayggtgaygtttttatttttgtggtttygtaggtygtttttggttggttgtygttgggagaygggttggaygtaagggaattgggagtttgttttttgtttatttttaggttatagggttttttagygttgtttygtggttagataattttgtgygygaagttttatggtggaaattagttggtygaatttatttttggtatttygaagtgtttagtttgagtttgtttgttgttgggattatgggatgggattatagggtaggtygggttgtggtttgttttttttagggattggagyggttaagtttgttygtygayggttaygggttttagagygatygttttyggygtaaggtgtygggagatggtagygyggtagtygggtttgaattttttatgagatgtagttagtagyggygtttttttgtttggttttygtygatagttgttgygggagaggtygygattygygttatttyggygttttgttagttygtgtttttagggtygtttggtttgggaaygtagagatttaygattttttttttaattttygaagygggaagtyggttyg

SEQ ID NO: 6033 - DNA, 1235 bp, Artificial Sequence
  Description of Artificial Sequence: Synthetic polynucleotide
gygttagygygtgttttgtttagagagttyggygttagtttatttttygtgtagttattggttgggattttgtgtgtygttgtyggttaatgaagaygttggagatygggtttttgttygttttttttttgygtttygggatgaggtagagattgaatagtyggygagtaaattaayggtatttagaaagttatgtyggattyggygtttagygtttaagygttaattygttgaaagttttttagygaaattttagggaygatttggatttygttgagaggaattgtttttgagtgagatggttttagaggtttggaggagyggattggtaagtatygggagggtagtgggagttttgtttttgtttggtgttttgaataaggtttttayggttatttattatgagatttyggaggaaagagagaagggtttygttgtgggtaaygtggtygygaattttggtttggatttyggtagttttttagttygtaggtttygggtggtgtttggagttagtygaagattttttgaggtgaatygggagatyggagagatgtttgtgaaygatygtttggatygagaggagttgtgtgggatattgtttttttgtattgtaattttggagttggtagtggagaattygttggagttgtttagygtggaagtggtgatttaggatattaaygataataattttgttttttttatttaggaaatgaaattggagattagygaggtygtggtttyggggaygygtttttygttygagagygygtaygatttygatgtgggaagtaattttttataaatttatgagttgagtygaaatgaatattttgygtttygygtgtagaygygggaggatagtattaagtaygyggagttggtgttggagygygttttggatygagaaygggagtttagtttttagttagtgttgayggygttggayggagggattttagtttttttygttagtttgtttatttatattaaggtgttggaygygaatgataatgygtttgtttttaattagtttttgtatygggygygygttttggaggatgtatttttyggtaygygygtggtataagtttttgtaayggatttggatgaaggttttaayggtgaaattatttattttttyggtagttataatygygtyggygtgyggtaattattygttttagattttgtaatygggatgttgataattaagggtyggttggatttyg

SEQ ID NO: 6034 - DNA, 3043 bp, Artificial Sequence
  Description of Artificial Sequence: Synthetic polynucleotide
gygagggtttyggggtggtgggggtgtyggttttagtatgtggaggygataggattygtaagattttaygygtygtyggggtaggatygtatagggtygttatttatttatttggggygtttttaatgggtattygtgtattttagttygtgyggtgagygtaygtaygtygtygttgtygygtttatayggttttttaaagtygggggaggggtygtggagygaaggagttgtaggtagatttttttttttttttygagttgggaaaagggttagtttygtgttttgtaygtttggttttgttttgtagtttgtyggtgagttaagagtyggtagagtagaggaggygtayggttygggtygtgttattattttttggtttgttgatttggttaggagttggggatggyggtagtatygyggaggtaygttttgygttgtttttaygttttttttygaaagtagtgtttttagggggaaagttygtaatgttatttgtttygtyggtaaagttttgggatgtygggtattttttgaggagggggaagaygyggtatttttattgaggtyggtaggttaggaagagaagtttttygggygtagggygtagtttagtttyggggattttttgggtttttygygtgtyggtygggatgaagygygttttgtatyggattygggattygggggygggggttggygttggtagygttagaygttgttttattttttttygattttggggaggatagtaataagttttgttttagttattttattattttgttagtaygtgtagatttygggttttyggagttyggygyggatttygttttgtttygygtttttttttgtaygtttygtgttattttaagagtttgygtggttttgggtgggygtttggttttyggygaaaygtttggggygygtygygtgggtgtayggtgtttttttttagtagttttyggttgygggggtatatgtatttatttgtattttgtagggataggyggtttttttgttgggagtttttgttttggggattttygggtgggttggtggygtyggtttttygygtygggttaaaggtggttaatattaaagttagggttatgaattggtttagtygttyggtatatatggtttttggtattaatttttygtygggagatttggattttttgtgttttttttttttttttttttttttttttttttygtygtttttttttttttttttattttttttttttgttygttttttttttttttttygyggtygyggttyggatagaggttatttagygttttttygtagtttttyggagagtatgtgattaggtygttagtagygtygygagtgttyggtaatggtagggatggtgttttaaatatttttggaagttttggtgttatttgaatgaaggagtygagtaggtgttgtttyggyggttggattaattygagatttyggtttttttgataatayggtygggaggyggggtttgygtttaattattataggaggaagtygagygtygttgggagygtyggataaagttgtygatttggyggyggttaygygtttgygtgygtgtgtatgagtgtgtgtgagygyggtyggagatgygtgygygtgtgygggtgttttagggtaatggtygaaaggattgtataatataagagygaatttaagttttagttgttgttaaagggggayggtgtgttttgggatagtgtttttggggtttttggttygygttatatttatatygggttgggaaagtttttttttttygtygtttggaatttagtgagatttttagtttagaggatttgataaattgaagtagttttttaggtataatgatgttgtgggttaattgagtatatatgggaatttttggttttgtgatattttgtattaaaaagaattttaygattgaagataggagtagaagtattagatatagtatttggtttgagtaattgttttattttttygttttggtgggtygtgtaatatttggagtgtygtttttygttttttttttaatttagaygtattttaggttgggttgtagggatttaggtgatagttaggatttgtattatttttaggagggtggtagggaggtttaaggtagttttgagttagttygtygyggagtatygygtgttyggaggttagagtttgaaaggtaattttaygygtttttaaatatatttttgtatttttttaaagygttgttygttatttygtttygggtttttttttattttttagttattygatggaagtggtgagaataaaaataaagataaaaaagttaaattyggggaagttatttttattttttttttttttttgttyggttttttttttaagaatygtygggtygggatagttttyggttatttttttattyggttygtggagggaaggagaaagttgggygtygtttggagygtttttttttttgttgtgtgtgtaygtgtgtaygtttaygtttttttygygtyggggtyggggataggaattgttttyggtttygttattttayggygtagttyggggggttygtagggttgggggagggyggggataygagygtygygtttaagygttttagggtaygtattyggygttggygygtattygttttttttttygtttttattttttttttggagaataggtgagtttyggtattagttttygattttttattttygtttygygtttygttygygttttttgyggtaatgygtttgggaagttttattatttattgtttaggygaygyggttttgggttttygyggyggggygtattgttygtttggttggggtygttatgtgatayggttgggggagggggygaggagataygygggtaggttattttttggtyggygtttgatttttaaagtttttttttttygtgtttyggttgtaygygggagtggggaaggyggaggyggggggttaggatggttayggttggtygtagttattyggygtgtygagtttttttgagtyg

SEQ ID NO: 6035 - DNA, 864 bp, Artificial Sequence
  Description of Artificial Sequence: Synthetic polynucleotide
tygtaggygyggagttgyggttgtagttattagtttagaygtggygygttygtagtaagtggttggatatygtagattaggttygygtttttagtagygyggatttyggggttagtygtttaggtagtaaagttaggyggtyggtttygttagtagtygatgagttttattttgtggattgtttagygttagggattaggattyggagaggtgtttaggaggagtagatttttagattaggtaggttgtgtattyggtgattttgaygttatttaagggaagtttygttatttygygttagtgtttgagttgtaattgtaaattgygygttttggtaygagtagyggtgggggygggtgggggaaggagygagtgattttttaggygtttttygttatttgatattagttaggtagtttttagggttagagygttagygtygaagttaggtttattygggaagttatttyggtggtygyggggtgtttatgttagtattagattttttttyggaaggaggagyggggygggttatayggttaggygggttttttttttaaggyggggtgggtygygygtttgygatttttygttygtggttttggggtagttygggttagttaggagaattygygagtttagyggygtttgtatttgyggttttygggagtygggyggttttgygaggtttattaggtttgagaggtyggaggtygttagtgtygttgttgaagggtggattaggygggatygyggattttgggttagatygtagatttggtatygyggattgggatttggatyggggattttgagttggattayggattgggggttggatygyggattgggggttggatygyg

SEQ ID NO: 6036 - DNA, 2071 bp, Artificial Sequence
  Description of Artificial Sequence: Synthetic polynucleotide
gygagagtagyggagagaaaggagttagagaagtgygtatttattagtttatygtagttgttgagygttatagaggaggtttyggttaggtyggttaygttttygaygtagagatagttttygagtaggggttttaygygggtggtgtttttttygttttgttattttatagtggtttygggygttaygaggygggygttgggtygtagtygtaggtgtaggtttyggttaaagatygtgatattgtagaagaggtgattgttaggttttttttygttgttttyggggaagttyggggttyggatyggggyggttttgygggttygtatttttgttttggaygtagttgtygatattaygtgggatattaagyggttttgggygttagtgygtaygggtatygttaggatgygtttygtttygtgttttaggggttygtttgtaaygggaaggggygttagatyggyggagattayggagttttagtgttttagagattygtyggtaagttaygtttttttagatttygttttattgygaagggaaggggtatttygttaggygattttagaagttagtttgtattttttyggtttttttgtaatygggaaggggygttaatagggttattatttyggggtttygttattttttagtygttttttttttyggagattttgtttgttaagagttttgttttttgtttygtttagggttggggttyggtgggaattttttygtgttygaagggaygatttygttagagagtttttygatttttgtatttatygtttttggtaggaygtggagttgttyggaagttatttygggttggtttttttattygtgtgttaygatttttyggygggtttttgtygttygagtgtttttatygttagttttyggagyggyggagtttyggttttttygagtaygagyggtttgttttgtttgtttagttttygtttagttygttgtyggtttygttttttygagygttygaggattgggaggggtggaatagggttttttygattttyggggattttttgyggggygttttaattaatttttagggtttaaggttaygygttyggtagtyggttttttyggagygttttyggaygygagtttyggygtygtttygttttggtttttttttyggattygttggggttgattttgygtttttggtygyggggtttttttyggtttttygtttttatttttygygatttaggagtygttagtgtttygaggttttttyggtttaaggygttygggggyggtgyggggygttttttgygygattaattyggtttygaagttggttaatttggtttygggyggggygygyggagtttgtttaagttaggttggaygaygtttggggagggggyggyggggtaygygggatagggttaggtyggygggggtttyggggagtaggggtygggtygtatttatttggggggtyggyggyggyggygagtttggygttygygggyggyggyggyggyggtaggagyggyggyggtagtagtagtagtagtagtagtagtgyggggtagagtaggyggygagyggttttygtyggyggatttatggtagtyggattgtagtyggggtttygtattygtagtyggygygaaagtttttygygagtygtttagtttatatttgggggtagttggagtygttygtagttgtagtatygtagggygyggggyggaggaggygaggygyggaggggygggygggggagygtggagggaaggyggggagagggaaggagygagygagygagggaggtaggygggagggagggaggygagygagggggagggyggggayggygggygttttagtttgyggtgattyggygtattttggygyggtygtygtygtygttygttttttttttygygtygtygtygtygyggtgtygggttygtagygaagtagagatatttygaggyggyggtagagaagygtygygggtygggtygggggagtttygtygttagttattttaggggtataattttygaggagyggygtyggtygaayg

SEQ ID NO: 6037 - DNA, 1170 bp, Artificial Sequence
  Description of Artificial Sequence: Synthetic polynucleotide
tygggttggygggtattgagttggggttattaygtttttttagagygtttgyggaggtggygaaggtttggagagtataygaggyggaattyggatygagtgagttttttgagtygtttgygtgggaygtagggagagggygaataaygtttttaggygttgaatgtaggggtaaggagttagygagggtggttggagtaggttttgttagttgttattaagtttttttataggtttgggggtttggggttttttggaaagattttttygtygygttgattagtayggggttygttttygtattttgaaggttgtygyggtttttygttatttataattaagtttaagattaaggttgtaagttgaggtyggggtattgataaygggaatgaagttataggggaagaggataattgggaygggttggatttatatttgatattygggaaatttttagagygtgtggtgtttttgttagyggtagttattggtggagttgaggttatygttattgtygtygttggygttttgtttttggaattttttagtaagatggtatttattgtttgttttttttygattagtatttttagtygygttttttttttttygggataygtattagttatatattgtggggagaagatgggttatgtaaatgtaagttaaygygtttttttagttatttttgtataatgtaataggaatagygattygygygtaygaatygggtagtgtgygygtgtgtgtgttygygtgtgtgagygygtgtgttagygtgygttttygygygggygtgygtttgggtggatttttgygtggtttgggaggtaaatygggygtttttttaagtygttttaatatgatttaggtttttaaataygtgaaagyggtagatataatagggatgygaaggaaataaaaaataattggggaagtggtgttaagttatttaggttttgaattgaggaygagtagtgyggtygygtttggggygygttyggaaattatttttagtttgtggyggttattgttttatttaaatttttttgyggggagagttgagyggatttttggggggttggttttgggttagttttaaatttttyggttgtatttygygtggttttatygayggygygtttyggygtagtttttggygygggttyg

SEQ ID NO: 6038 - DNA, 2168 bp, Artificial Sequence
  Description of Artificial Sequence: Synthetic polynucleotide
tygygttgtagttaggtagagtttyggggtagttygtttatygyggaggagttattttggagttttaygttttttttatattttatttatggattggaaaggatgtttagttattygygagtttgtttgatattgggatggaaagttatagttygtaggttggagtgaggygygggaagatgtttggtttttgtttygyggatttggtagtygygttttgygggtttgtttattgaattgttgaggattygttygtgtgyggggattygagtgttatttttyggagygttattttgygttttagtttttaggttagataatatttggaaggtagggtagggttgttttygtttttattttttgyggaaggatggtaggattyggygtagygaygtagtagygggagggtatagygatttgtatttttagtttttttttaggatataaggttgattttatttttyggatagttgtaaagtttttgttagaattaaatygaattygygtttyggagaggggtttttggggtygtttygttgtagggygtggggagtggagagagggaaggggaagtttggggttgggtgtgygygygtgggagygygtttyggagygtttygtatttttttattttattttygggggtagtttgggaaggagggagtggtagtygygggaatgagggagtaagagaaatttttttaaagtgaygttttaaataggttyggatttagaattygaagttaaaggttgttagaaattgggatttttyggttttttttgtagttttttttttttygtttygaagttygggyggtttgttggttgtttgttttttygttttyggtttagaggtttttggttggygggygtttygtyggtygtyggttttttttttgaaattygtyggygtatatgaggtygttgttttygtygtaggygttggyggttttttygyggtgttygtggtgatgttatgtttygttattaygygggaggagaggagggyggygtygtygggttttgggtgaagagyggygtagyggyggyggyggygggyggggggygtttgggtagyggtatgaaggatgtggagttyggtyggggtagggtgttgttgaattyggtagtygttaggggygayggtttgttattgttgggtattygygyggttaygttyggtggyggyggyggtggtttgagggagagtygtyggggtaagtagggggttyggatgagtttgttggggaagtygtttttttataygagtagttagagttgtyggygtaaygttaagtatyggygggtgtagaattatttgtataaygtgttggagagatttygyggttgggygtttatttattaygttttygtgtgagtattygygttttttgttatgttygttgtaggggattattgtttttggttttttggggygtgtttygygttygygtttttgggttttygygygygtgtataygtggtggtttttattttttygtaygtgttygtggttttttttttggagtttttttttttttttagttttattttttttatttttatagtttgaatttttttttygaggatatttaatgaattgttyggtagttttaggttttyggggygagagttaggtagaygygggatttaggttgygyggataattgggagtaattaggttttaagataygtaaattttaatygaayggggygttygggagttagggaatgtaaagggaggataggygttygtgtgaggtttgagagtatattggagaggttaggaggtgatggyggggtaggayggggagaagtgagggggtatygagggttaggtttttagttttaggggyggagtaggggaagttgttatttggagagagttgttaggttttaagygygttyggaaataygtttygttattatttagttattattaayggaaaatttgttagtgtatgtagttttttttgttayggagaaggtggttaaggtttagaggaggttagtaggttaggygaagtaaygttttygygttgtagggggyggggaggtagyggggaatttggggygtaggaaygygggyggaggtgygatagtagaagygtaaatgggtygtttttgatagagatygggtagtgggttaagttttygtttgtggygyg

SEQ ID NO: 6039 - DNA, 2053 bp, Artificial Sequence
  Description of Artificial Sequence: Synthetic polynucleotide
tygaygtaygattygtttatayggaataagaattttaygaaggatatttggggattatattggtygtattygagggggygggaggyggaaaaagtatttttaaaygtaattttgttaggttttatttttygtattttttggttttygggatagaagtttttttggtatttttygtttagtttaggggttggttgttygttagaaygaaatattttttattgattayggagagttttgtagggagtygaggttttygttygggttaagggaaggygttggygtygygggagataagaagaggyggaggyggaaaagaagtggagaaggaaggggtggtagagggagtagygtgygggaggyggygtyggygtygggttgttggygaggyggggtggggtggagtggggtgtgttttyggygggyggttagtaagttagttygttygagygtyggygtttyggtttttagygttygttygygatagygatygggattggygtttygttgtttygatygtyggygagtttygtttttttttaggttttttattgggttttttygygagtttygtttggttyggygtggggtygttygttttygttagttygggygttygtygtttygtttygttygygtagtttttgtygtttttttygttygygttgtttttggttttttttygttttagttttatttatgaagygyggttttattaygtgttaatgagtttttgttttgttttggtagyggyggyggtatagatttygtygagggaattgygyggggagggatttgagygtagygttygtagttttaaattttgtttggggygggggattygtygyggygttagttttggggttagaggggataagttttttyggttygygttatttatttttttttttttttttttttttttgtygtygygttttyggaggttttygttgttatgatttygttgtgttttyggatatttttatattttgattaggttaagaaggggttggtgtatgygtygtttaygatttyggggttattaattataygttttygggtagygygtatygttaatatttttygygggggttaygtttggggtagygggttgagtyggaaggggaaggggagygggagtttagaggtygaggygygtygggttygggggtgyggtttygygtttttttttttygygtaaggtygttttygtggtaggyggtagygagttgggttyggggtygggttgagttttgggatygygttgygtagttttygagtygttygttatttggttgyggtygygyggttatttgtttttygttttyggggygtygtttagtttygygttaggygttttttttagygttygtygttttttttyggygagattattygggygygtttygttygtyggttttygatgtaaatagttgggtttygtaggyggttggtttygygtttttyggttyggygygtttttttttyggttattyggggtttygtttttygtattttttygttggaggaggaygttttattttagggtyggattgggggttttgggattygggggyggtagyggygggygtttggggagtygyggtgtgtttagtagtygyggtaggaattaggggatatgttygttaattgtttttattattagtygtygtttgttttttgtgtgtayggattaaattttaattggtttttatatttattatggtgaattgygaatttttaaataagtttgggtygtygtttttgtygaggaggygtttttttttttttygttttyggggttttgtagggtgtgyggyggyggtygtggttatttagatatttttatttttygtgagttggatygggagaggatygtayggtttttatttgayggagttaygttaygtyggttataagggtttygtgttgggygttgggttyggttttyggtygtttttttgtggtygttttggygtttattttatgatattttgtyggtgtttttagatattatttygtatygtttygttttatygatttttaggttttttyg

SEQ ID NO: 6040 - DNA, 1679 bp, Artificial Sequence
  Description of Artificial Sequence: Synthetic polynucleotide
gygtttttattgygtgtttagyggyggtggaggyggygtttttttgtattaygaataygyggttygttaaggygtygttttagyggttgatggtttyggtttttttttaaaattttyggygttygatttygtygygtttttttaggtaggaattttgygattttattttttgggttygttattagtttaggtttgyggtgygygggagggtattaagygygaggtttttttygygttttyggttatttygtygattttaggtaagtgggggtagtttaagaagggtaaggagtagttggatygtgttttggatatgagyggagtygttygaggataagggtattttttyggtatygtgggyggtttttyggygggggtyggtagtttggttttttatttyggygtgygtttagtttttaagttygtyggtttagygagggyggyggyggtygtttayggygatttttatygggaggagagtagtagtaagtaaggagtyggtttygttttgggtaggttgttgggygggggtygggygtgygggygtttygggagyggggagaattyggyggygggyggygygggttattattattattattaygygtattattattattattttaagtgtttgttygttggggattygtygtygtygtygtygtttggtttgttttgttttggggttttgygyggtttttttttgtttttygttttttyggaagaggygttygtttttaagtaygtggagygygtttygttygtagtygtygygttgttaggagygygttatgygtagttgttttttgygtyggggttgtttttygagygttgygygttgtygtttttygattygggyggttttaaagtttattygggtggtgagtgtagttatttgttygtygttatgtyggtttttatagtttataayggggagttgttttayggtttatyggttattatygtttattattygtttaaattgtatttyggygggttgttgaagtattyggagtttattttttattttagygggtttgtagyggtygttttaagtttygtygagttggggtygttggttagtatygatygagagatygttatgtataattagtagttgttygagatggttgtygggaagggtygyggaygtttggattyggggaygttgttatyggtygtygyggyggygggaggtatygggggyggyggtagyggaggtagyggygtaggtaagtttaagatyggttatttgtgtttttattgtggtaagttgtattygygtaagtatgggtttaagatttatatgyggaygtataygggttataagttatttaagtgtaaagtttgtttgyggtttttyggygattttagtaattttaataagtatattyggttgtaygtygagggtaataygttttatygttgygagttttgyggtaaggtatttgtgygtygtygggatttggagygatatgttaagtttygttattttggttagagtttgttygttaaagygggygayggttygggtgtygagttyggttatttttyggagtttggggattttaagagygaygatagtgaygtggaygtttgttttatagaygattagagygatttygaggttgggggyggyggggagygygatttgtaaygagttttttygggaaggggyg

SEQ ID NO: 6041 - DNA, 1474 bp, Artificial Sequence
  Description of Artificial Sequence: Synthetic polynucleotide
tygtttttaaaggttyggggaaggaggttgygggtgggtggygyggatttygggtttttagttatyggygttttttyggggttttttgatttygttttttaaaggaggagggttygtggtaayggtttttttyggttaggygttttygggaygygggggtgaggagtgagygtygtggtttattttatttttygagyggggayggagtgggygatatygygygttyggttgtaygtaggttttgygyggttygaggyggttttatagggggygaggaggaatttyggagattyggyggagagagtagagayggagtttattaaggggtttgtygtygtagagygygggagtyggtattyggtggggtygagggttyggggaygttggggttgtttgatttgagyggyggtygttgatygttgagggtttttgtggtygtagygtttagattyggggagaagggyggtttttaagggtygggagtttttygagggygyggttagygaggagggatagagggyggygttttyggttgttygggygygtagaataagtagttgtygttagggtygataaagttgtttttygaggggttgagatttaattttygtttttygatttagttaggggagygygaggtygtatataattyggygyggggggaaagtyggttgtagttgygttttttatttttattyggttggtttttggyggggagtttgggtagygtygattaaagttyggagyggtagtttyggggygygggaygyggggtataygggtttagttgttygaygggagttygaygygygtttttyggygggtyggygggttyggaagtttygttgttygggtygggtttttaagttygtagtygttttgattaaaataggtatygygayggyggyggtaggyggyggtagttagggttggggtygtatygygtaygygtatgygttygtygtttygygtttttyggygggyggagttyggygtygyggttaggattttttatttygttttygygatttygttgygggtttgtatattygaggattyggtttgaaaygttygtttatttatttttttgtygtttygttataagattttatttttgtttgggtatgagtggggggyggtagtttygtgggatyggyggtattygtygtttttttttayggggataattygagaagtgyggttygggtagggagagaaattaggagagaaaatgagaaagagaattttygtttttttttaaagttggaygatttattygtatattttttttttgggagattygtttataatttagtataaatagggaatagttyggaaagygygygagttttygttygattgtggygggggaggttgaaygtttggtttataygggtgtaggaygygggggttaggttttttgttgyggaggaagagggggaagaggtygygygggagggatttttgataygyg

SEQ ID NO: 6042 - DNA, 675 bp, Artificial Sequence
  Description of Artificial Sequence: Synthetic polynucleotide
tygyggtgygaagtttyggattygttgggaatygtatagttttyggtatttttggtygtatgtttgttagaggtgggtttygggaaatatattygttgtttttttaataagygtttttygttttttattggtttttyggttttygttttttatygttttttttygtttygtagttttygagtggygttagtaygttygtygggtatgggttttaaatgtttattagygggagtttaggygtttttgttttggagygyggtygggagtaaaatygtaggagtgggagggtagygagttagttggatttygagtygyggagygygttggttttgtttygtttgatgattttagagygygggtttaagygtygtttatgtagtatttttgagtttyggggaaggagagttaatgaaaaaatatttaatygttttygttgyggagagttatgagttgtttggatgttatgtattaagtttatggtttttygtagttttatttygtagtygtttatattttttattattaggtaygtgttttttttggggattttgggaaggagtgygygtttttygtttgyggyggtatggtttgtaygttaaggtttgttgtgttttygygygtttygggygttygattaygatyggygtagtygggatgyggggattgtyggagtyg

SEQ ID NO: 6043 - DNA, 1133 bp, Artificial Sequence
  Description of Artificial Sequence: Synthetic polynucleotide
tyggtttygtagtttttygygtttygattttttagattttygggagtttaggggagttaggtgttgggyggtgygttyggtgtygtygygttttttttygttatttttggttttttygttattygggtttttyggtygttttggatgtttyggttgtatttttgttttatgattttagtttttttttttaattttttttttggttttttttttttygagygygygygtatatatatattyggttygttttygyggagtggttttgggagtaygatygattttagtttagtaaatygyggttatgtygtttagatttttygtttygaggtttyggttttygtygtygtygttttygygtygttttttttygtttagatatygtygtttgyggtygtttgggyggtagtttttgyggtttttaaagttggttttttgggagggggyggtagggagtaggatgaaggatttgttgtaggaggaggatttatatatttgggygaagggaggggtagygtygttgttgggaygyggygyggattygtattattgygygtagtagtygttgtagtagtygtyggggatygyggagtygggaygttttygttyggttygygtttygtttttygttttattttygttygtygggtttagtaaygtagggtgtttaggagtygygggttgygtagggaggygggtagyggttttygygygtttttgtygttttyggagtyggygygyggygagygtagggygagygygygtygggyggyggtygygttggggggygtgaggygagyggygyggagagyggtaggggygaaatttygygggttagatgttygagggygyggyggygttgttaggttgtygttgttgtttttgygggtttygagygygttttygtaggyggtattgttygyggygyggygtgtgtatygagygagtgaaggtatgtgtggygggygyggttggagttgtygtygtygtygtygtygtgttagtaggttttaatgtttgttattttttaggaygttggtagtagtagtagttyggagttttygagttttyggtaggtttgygtgttttttttygygatttgattggataaagtgggggttygayggtggtygayg

SEQ ID NO: 6044 - DNA, 1808 bp, Artificial Sequence
  Description of Artificial Sequence: Synthetic polynucleotide
gygygtyggygttggggatggggtgggggygttggggtataagggygtaggggygtayggttatygatagtygggtgygtttagtttgaggtygyggagaggagtygaattgggatgggtggggggttttyggttttaatattgtttgttagttttagtgygtttaagttttttygttagagttgtttttttggaggggtttttygtaygtattgttttttttatttttttggttggaatttttyggtygttattgtagtgtttagagatgttgygttgtagattygggattttttaggygttttttttygtttttttgttaaagygtaaygtttgtatttttttagtttttttttttttttttgaaattgaaagttattgaggtygtttagggttgttgttttagtagttttttttttygttttygagttttttttygttttttatagttatttttttttttttttttttttttgttttttttttttttttttttttttgtttttttttttttttttttttatgtggtgttttygggagtttagtttaatattggagygttttttgttygygtaygttagaagtagttyggggttttttygtygttttttggttatggtygttgtgtygayggygttygtttttttgygttttaggggttttygtygttgtagtygtagtygtygtagtttttgagtttaaggggtygtygttgtagtygtygtygtygtygttygttygttyggatttygtttgyggtagttgtygtataatatgttatttgyggtygtttyggyggtttttggaatttyggttygyggygatgttagttattttagygaagtygtygtagtttagtgtttggataatttgaaagtataatagttggtttttttgtttattygttttatttygtttgttattatagtaygtttatyggatgtgagaggagaagtttygttgttygggtattgtttatataygtttaatatttatatatattttaaaaatattaaatataattaataattaaaagaaagaggagaaaggaagggaagtattattgggttattatgtatttgygattgattttttggttttttattattttgaattttatggaatatatyggtagttaaaaygtttttyggggaaggygttagygaagaagtaagtgtagggttttttaygygtttgttttttttygtygygtttatttgtygggtygttttgtttgttyggagtyggtttttaattgtagyggttttttygttttgygtttygtagaggagatgtaggttygggttttgggggtatggayggygttttttatttttgtttttyggygtttttgtttttygtagtattttagtyggtgygaggggygggyggaygyggygttaaggtggttttygttttatggtaattttaggttygygggaaagttyggttttgggttagattygtattygggatttgtgttttttttttgaggatyggataggggtatttagtygaaggtatttgggatttttagaygtaggatgtttttgatygttgagtaaatgataagggaggygyggtygyggtattygtttatttagygtaatygtttygygyggggagatttyggttgggtttttaggttggatttyggtagtygaaygttygttattyggttaggaagttagggagygagygtttgygyggtygtattttygataygtattagyggagttaaagggygygygaggygatggggttygygtgtttgygygtttgtagagttgtyggaygtttttygttyg

SEQ ID NO: 6045 - DNA, 1323 bp, Artificial Sequence
  Description of Artificial Sequence: Synthetic polynucleotide
tygaatattygtattgtttatygaagattttygtgttttagttttttttgttttttatttttttygtttatggttttygtttttttaagtygtttttyggaattttttgtygggtyggygggaagygtggatygagygggttttggtygygtttttttyggttaggtttggtttagttygygtagygttygygtagttygttagggggatttyggttygtygggyggtatttgaggagaaagygttygaggggygtggagttagggttttgyggtgtttgtttygggaatattgygagtyggttggagttttttagtygtttyggagaattgggggagtygggtttttggttyggtaatyggtggtttygyggtagttagaggygggttttaygggtgggtgtgttygttttygtaygttagttttttagttygggaagagygtttgtaagygggtattttgtttttaaagatgggttttgtttgygggtgatttgggttttygaagtgtaattttgtggtygggaygyggatyggtyggtttgggtttttgtagagtagattttgtttgygttttttaggaggagtgggtggtaggattggggttttttataggttttggggyggyggygagattggtayggttyggggtygtaggygygtagttaygtttttggaagttygtttyggttttygtttttaattygttttttyggggttttatggygtgaggtttggggttgggatttatttggagtygagtagaaaattttttttttttygttttyggttttttttgttttttttggaygyggtggyggygtygtttgagyggygatttttttttttttgttyggtttgttgygttyggtgtttttygagggtaggygygtttggattttgygttyggatggyggyggttttttgtgagtatyggtagyggygtattttttgtttygaggttttyggtgttttttyggygygggtataggggygtttttatttttygttygtttgtattttttgttattygttttttygtttgatttattygttygyggtggtygttygagttttgggatggggagggagatygyggttgttygyggyggtygagattttygttgaygttttygattttgtygtttttttygttygtttttagaggygttygaygtttygatagtttttggagtgagattaggattgagaatagggagaggygattygatttttagggttyggtgtttaggataggtgaggggaaggaaagggtgttgaygggagtggggaggtgggtgggyggttatygtagtygaaatyg

SEQ ID NO: 6046 - DNA, 1501 bp, Artificial Sequence
  Description of Artificial Sequence: Synthetic polynucleotide
tygatagtggtttttyggtttagggaggagagygyggtygygggtttttttttttagtttggaggttgtagtygttygagtyggttygggtgggggyggggtgggggyggygyggagggtayggagattayggyggygttattygggatatttagggtttygaggttttgggyggtttttaygygagatygtaaattatgataataggtagttattygaggttaaataaaaayggagtgggtttttygygygtygtygtttttygygtttttggyggtttttttygaggttttyggyggttttaygagttygtagtagtyggtggygaygtygttttygttttatttttttgygtaagtgygaggttgtyggtagygyggygtaygtttyggtygttttyggttttygygtaaaatttttattttgtttaygtgaagttgtygttgttttagagagggggaaagagttgygggaaaagtyggggagtgaygattgyggyggttgggygygtttttttattttttttttttttttttttttttttgtygtagttyggagttttggttttttttttttttttttttttttyggagtyggttttttttttygtttygtttttttttygtttgtgtaygttatttgttgtggggtggtygaaggggatgttttgtttttattagaggtatagygygaaggggaaatttygatattggaaggaaygagaataaatatttaattayggaygtattgaatygyggttgggatagatatttygggaattygaggyggatygggygaygaggtgagtgatttttttttttaattttygttttagggttttygggggagtttgagttgagagaatttttaaatttttygggaaagtgygygaggtttygtyggggaygtygagygttgggtattgaggaygygtagttggayggtgygtgggygtttgygttttyggggggygtttggaggtygggtgttttaygtttgagggttygggtygttyggatygtagyggtgttttttgttttagaagaygtttttaagttttaagggtttttttygagtttgtttgtttttttyggggtyggygyggagtttgygygtaayggagtttatttagtagtttagygygyggtttttatttgtatttygtttttatttggtagaggygygagtatyggggttttttttatattttttttatgaygtgtattattttttgatgattttttagatggtttaggygygaggatgttgatttagagtttttyggagggttataggygtttgggttttttyggtgtygggtgygtgtgtattttaaaggttygygttttaatttttaggtattgatygggttttttaattgyggygattttattttaatagtttttatgtggygtggattgaatgttttttgtagtttgttagggtyggtgaaattagaggygttttgttagagtagtygygtttattggttygagtagyg

SEQ ID NO: 6047 - DNA, 1744 bp, Artificial Sequence
  Description of Artificial Sequence: Synthetic polynucleotide
tyggtgggtygggggygtggygagattttgttttagtggagggagggtttatgtattgtygagaygtygattattagattttgattttgtygtttttagaaaaattattggtagaagattyggattatggttaatttgtyggttataagtttttttaagaagygttaygtttgggtgtagttggtagggtatattggtgagtagtggggygggtgggygggtgttygygaygggaaggggttgggyggygttgayggatgtyggtttttagggagttttaaggyggygggtattagygggttgattttgaagygttgttyggagtyggagygttattgtttggygyggttgatggttgaygygttgygyggttgygtgtttgttttttayggygtggtggagygygayggygaaagttatttgtagttgtaggatttgttygatggtttygayggattttgtgtgttygattgtaaaatgggygttaggtatgygtgttttgttaggtyggttggggggattaagtaggggttyggggtygggatagttgtttgagggggattyggggygagtgttygaaggggttttygtgtgygtttttttatgttttggtygttgtttgygtttttataggatttatttagaggaggagttgattaaggttygtgagyggtttaagttgyggaaggatatgtataagaaaatgttggyggtggattttgaagtttttayggaggaggagtaygygtagygygtygttattaagtygygttatatgtagtggygggaaggtattagttttagtattattttyggttttygtatygagggtattaaggtgaggtaggygygtttygttggtatygtygtagttttattgygygttgtttttttygatttttygttttygtttygtttgttttttygtttttttttatygtttygtygttttttgtaattgggaggtatygttgttttaygttgtttttttttttattggygggttyggggtttttgatatttttgttttatatttagaaagyggayggtttttgtagtatygattttaagattaygygaagtygagagtaggtgtttygygtttttgaagagtttgtgtaaggagatgaggaagtgttggtgagagygggattttaaattttgaggtgttggggagtttgaagtygaggattgtttttgttatttggtttagtgttttyggttgtgtttttattatggtttttatygygttggttygtaattgttttaygtttttttttttttgggttaygttgggyggggttttgggttttttttttggyggtatttgttaagtatagygtgggtttyggttttttatygttagtaggggtttatttggygtttagttaatttgttttttttttttattttattttttgtagaggyggtatttgaatygtttgtagtagattygggatattttggaggtattygagttttttaggaggtaygaggtaagyggyggttgttygggtgttygggtygygagggttagggygggaattyggtaagggygtttttgggtagggtygyggtttgayggtgyggggttygtaggtgatyggtagttygtttttttttgtgtaygattattgttatygygtyggygtgtggtttatygatttyggtaagattaygttttttttygatggttagattttggattatyggyggttttgggaggagggtaatygygaggayg

SEQ ID NO: 6048 - DNA, 1801 bp, Artificial Sequence
  Description of Artificial Sequence: Synthetic polynucleotide
tygttttygggygataggggtttttttaygtgaatygaygtttygggtttygggygaggygtagggtttagggygtagggygggtttygtaygtagggygggygygygggtatttttgtggttaggygatttyggttygttttttyggagtttagggattttygaggttggygygggttgttygygataaggtgttagtagtttygggttygygaggagtagtttttattygyggttttygagtttagttttgttttttygttattttttagtttttyggtatttatttagggagatagggaggtagagagaagaggagaaagyggtygtgtttgtatttagtttttgtygtagtattygatgagggatagtagggaggttggyggggaggtagagattaaattatgattttatygattayggaaagattattattatttatagtaaaggaggtttygatgygtttattygggtagygattygyggttggtgggygtttttygttttygttttttyggtggttgtggaatttatttygygtygtataygttaggatttttttttttttgattaaggggaggggaaggaataaaagagattttttattttttatatatatatatatatatatatatatatatatatatatatattttttyggtattttattgttggttaaaggatttattttygtaatttttttttygaatattttttttatttgagtagtgtatttttttaaaggtaaagagagataagggaggaaatatagtatttaaggtgattagtygattggatattgttgatggtatatttttttygtttttaattaatygtataaaattygtaatatttygygttttygyggggtttttygygtttttggttyggttttttyggtygtttttagtaggygtttygtttttygygggaattttgggatttggtygagygtttttyggygggtaggatattygttyggttttttgtagtagttgagggyggygagyggatygygtttaggtagygaygygggatttaatttttyggattygyggygyggttttygttttygtttagggygtygyggttatagttgagattttagygtygygtagtygttttygtyggggtatgggyggtygygtttttygtttttttttttttttattttttttttattttgaaaaaaatttatttattggtgtaaagtagatattttgatgttatttatttagtatygtttgttttggaggtagygttttattyggtygtttggaggtgtgggtagygygtygatgggttygggggagyggggttgggyggttyggttttttagyggagtyggtttgttgttattygtttaattttagtatttagtgggygaggagagagggagagyggygaggatgtagaggagggggagggggaggagggagyggtgggyggggagggagygagagtygttyggtagygygtatgygtttygygggtyggygtagtttttygttyggygyggtyggaggggtagttttttagtttttgygygyggtygygagagtttyggtttygtttttttttygggyggttttyggtttygttygatttygygygttygtttgggygyggygtttatygtgyggaggggttyggtygggattttyggtttyggtgaygttygttyggagtttygygggaggttyggagtttygagagtttttttgggtgatagyggtttttygttygggtttttgtaattttattygttygtagttygygygttgttgttttgggttgygyg

SEQ ID NO: 6049 - DNA, 1801 bp, Artificial Sequence; identical to SEQ ID NO: 6048
  Description of Artificial Sequence: Synthetic polynucleotide

SEQ ID NO: 6050 - DNA, 1684 bp, Artificial Sequence
  Description of Artificial Sequence: Synthetic polynucleotide
gygttgggyggtgagtttagttaggttatttttgygaggatatyggtyggyggyggatagtagtaygyggygtttaggattyggtttttttagagtttaggttattgtagtttttaggggygtttygagtttatttggagggtygygaggtttttaggttggaaggaggaatagggagaaggaggaatagggagatttggggtagtgttataattatagaaaagggagaggygaggttygttgagtttttggtttgggtaataaggtatattgaaaattgggttttttttygattygtatygtgygygttttagaaatgatagttagayggagtagggtttaaggaygttgaaaatttttgaygtgggygygtygggtgygggtagggaygtggaaggattgggttagttataggaattatagygttgyggatygggtgaggggtttyggttygagtttttatttggggygtagaggtgtttttgtaaggggataaagggtatttttyggygygatgggygatttttttagttagaaaatgagagggttagaygaggggaggaatttttttagttatttggttyggtatagygatygttttaagtttagaatygttaagttagttyggggygtttyggttttttygtttygygtttygttygtttttagttygggtttygtygttttygtygtttttgtygttygggtygttttygtyggttttggtttyggtttygtatatyggtagggggygttygagygtagttaaaaggttyggygggaggtyggyggttttagtggyggagygyggttgtyggtgtgyggtygggagygatygtygyggggtaggggygyggygggtatygygtagagygygtagaatagayggayggyggyggggattygayggyggygtttyggtattttttagatttyggttagygtttttttgttagtygtaagtatttagtttyggtttatttygggttttygatggttttygaggtyggggygattttgygygygtygygtyggttgttttgggyggygttgttgtttttggtygygttgtttttygtygttttttyggyggyggttttaggtaygygtygygttygggttttyggygttttttagtttttygygtatttttttgygttygggtttygtygtttygtttagtgttggttaygggtygtgttattagtttgtgygttttygttattygygggtyggggtatttggygttttgtgtgggtggygggagyggggaygtttyggtgttyggggatygtagygygttggygtttaattttgtygtygttygttttggagtygggaggttttagtygtttaagtgtttygggagatttaggtatagyggggaaaaaaggaaaagaaaggygatttttagygtgyggattggggtaatgtttttttttgtttagaatttttygggagygtaggtggttattttatttttttygygtttatttttygygaggtaggatgaygggygtattygggagatyggagggaggtagagtagggttgttttagaaggtygtgggggaaaggttgygagttgtygtagggygtygggtgtttttgygttttagaggagaagygttttagtgttagttyggttttaggyggtaggaggttygygygttyggggggaayg

SEQ ID NO: 6051 - DNA, 6657 bp, Artificial Sequence
  Description of Artificial Sequence: Synthetic polynucleotide
tygggttyggttygttttgtttttttgttttttggaggtttgggygttttygygtagggattaagggttggatagtygtaggtaggggtttygtttttggtttttatttttygtgtttagtaatttygggagtaggyggyggtattttttttatgtttyggttttaattayggttttagtttttttaatttygttttgtaggaataagtgtggtagaggttyggggtyggagggygggyggtygtttygygggttggayggagtttttgggttgyggagaggtygttggatttaygttyggataggagtttygygygtttattttyggttyggttattttyggggygygttgtttgyggtttttygygttatttttatttttgtttygggatttttttygggaaagatattyggggagtagtttttttttttttagtagttttttttttttttttttttttgtttttttgayggtgtggggtttttyggtyggaggggygyggygttggtagyggggtttagagtgtygygtttagygygygttgggggtttygggtttygtagtttygtaygyggtyggtttgtgaagyggygygygggggtttagtygggygagggygtttttgagtttggtttggaatttttagtttataygaaagtygtaggttggggaaggggygggtgggagygggagaygttttgggaagtygtgagatygttyggygagggttygggattattagggagygaygggggatttttyggtttagagttygagggygygatttyggattygttgggatttyggaggtatatgaagggagagggaaattygttaaatygaatttttygggaatyggaaggygtygggtygtttttaygttttttttttttttyggtygaaaggyggggggygaygygtaayggggagggaagggagggaggggtyggygattttaggggagggygagtttttggggaygyggggtygttaggggttygaygattttttygttttattttttygtttttaagtgtttygtttttttttygtttygtaaaygygygttttgygggttgtgttttggttttygyggaygygygygtttatagagggtttgatttggggttaatttttaygaggttgtygggygtttgtgagtatagtygtgtttttatttaggggtttattttttagygttattagggtttygatttttagattttyggaygttttttttttaaatygaagtttgggagtttttgggtggtttggggygggggtagggggygagyggggygggttaggaggagggggygaggtygttattyggttttttaygtygttttygyggttggttttaatttttttttyggagttttttttyggttattttttagtttatygaygtgygggtagygatttygtttttygttttttyggtygttttygtygyggttttygttttttttttattttttttygygygtttttttatatgaaattttttattaygtttagaaagaatgtgttataatttyggygttgtygyggtygttattattgygttygygttygagttygagtyggagtyggagtygtygttttttygtttgttyggttagtttygggtttygagygygyggttttygtygtygtygtttygygttygtttygygtttgaygtagtgagygtygtagtttggttttygtyggtttygttgggtttygggtygtaggtygagtttagtygggygggtttygggaggggtyggtagggygggagggggaggagggttgtttggagttagygagttyggaggaggaagaggaggaggaaggaggggaagtygtygtygtygtygtygtgttyggggaatyggggtgygygygttttgttygttygygatagtgtttttagttyggggttygtatttyggtttaggtaagaaggggtttgaggggtagggggttgttyggggtygggggatttttttgtygtygttgygggatyggagggttttygtttttaggggaggtagggaagaggatgttttttggggggggyggyggggggtagygtagggtttttagyggttttygtagttygggttattttatttttggtgttttgatttyggygttygygttagggtygagttttttygttygyggggttttggatgyggygttyggggttygyggttttygggygtttttatttatttatttaggttyggaggygggygtattygaagttagyggtygtygagtttgggtyggataaattttttttttygaygtygyggttggaagggttaggatttyggatttttagggttagggaggygtygyggggatttygaaatttttyggagygygttgagagtaaaaagtyggttgggtagaaagagggggagggggttgggygygttttygagtgygttggggtagtygyggygttttaagttgaattatagaygaatttttttttatttgaaatttggtttyggagtyggaggtggggagggagtgggttgtgggtgtttygatttygtaaagtyggygtgggggggygtagygtttygtttygygtygtttgaattttyggagggggtgttaygggattttygtttttattttagtyggtggttgggttttgtygatygttgyggagttttygggaaggattygttygyggttattaataggygtyggtgattttagtttttttyggttygggaagttggygtggyggggttgggttgggttgggttgtygagtggggygggatttyggggtttagagyggatttttagtttttttggtttttttttygtygtttttttttttttgtygtttgttttttttttatttttttttttygatttyggggtgtyggttttttttygaattttttttttttttaaattgtayggtggttattyggttayggttttgggtygtattygygtaattttagtattattttygatygagtttttygtygygggttgagygygagttttyggggttaggttgtttagggaggagtagggattttttataattygygtttttttttttaatttayggygagygtaatatattygttygtttttgyggttttatttgagggyggggagaggtygttgggggtagtttygggggttgtggagggtaggggggattygygaagtttttggagygtttagggatgtagttygggyggygtgtgtagggaggaagtagygtttyggygttttttttttagygtygttttygygygtttygagggtttaggagggttyggttttttttattttatttggatatttaggtttgagtttgagtggatttgaggatttgggggayggggaatayggagtttttttttttgtttyggtgtttgtagagtttagtttttaggtagygtggggatttttgtttttagggttagygtyggtttygtttttygtttygttaatttygggatttygtygttttttaggttttaattttttagttttatygtygygtttttttttyggttttgggtttgggggaggggtagggggygtggagygyggygttgggtttyggatagatgttttygyggyggyggygtyggygttygggtaatagtaggtygttaatyggygyggttaygggggaggggygattyggtygggatttyggggattyggtygtagtyggayggygtagttttygttyggggtggggggggggggyggtygygaggattygatttttgtygtgtagttyggtttttagttttttgtygtttttttttttagttttaggtttygttttttgttggggttttggttttttaggttgygggatttygttttttayggtttygygygygtatttttattygttttttaagttgatttttgaggtttttygtggattttagatttygagtgatygtagaattgatttttggggttaggtagtatyggttaagggygttttgaagaggttttyggttttagtttgtatttygaggaaatggatttattatgtttgtttttgggaagtagtaggaygttttggygyggttttttygggtaggygtttagtatagygtagggtataygggggatatttgygaaggtaaaggaggtttattttagagtttyggttgtatttggttagtataggtttgggggaatttgttggaaatggggatttagtattttttttggggtttatgtttggtaggyggagtggataggttggggttyggagttyggtggttattttttgtataaggttggttaggttagaagttggagggtagtttattgggattttttaagygtgattaaggaagttttgggggtygattagtttttttttagtggagttgtagttggggagattttatagataggtagggaggagagggtgtttygtttatygtyggtttygttttataggtttaggtttggtatattttaggtttgtagtatttatttggtgggtaaataaggatttgtttttggtttgyggtttggttttgatygtggtttaggtyggggtagagggagaaaggttatagtttaggtgttttaaattatyggtgttttttttgtyggtttttggggttgtgttgggtttttagggtttttgttttttagtatttgtatgaaatygtgggggygtattggttttygttttagtatttttttttaaggttttgtatttttattaygggagttttatttagttagtygaaggaggttataagttttaaattattaaattygggttagtgttgggggtttgggagttaaggtagtttagagtttatttttygattttggtttttggagaattttaggattygggygtgttaggttttgtagtygggttaggtyggtttatataggattgaayggygtygtgggygtttatttatatttttttttyggtttttatatattataggatttattttgatttgttgtttttgaattgagttaatttttttgtatgttygttgaattgtttagttgttggyggygagyggagagygtgtygggggtattgaggtygggaattagaggygggygggggataggaagyggggagggggygtyggyggggaygygygggttgygyggggattggagagggtttttaggygtyggtygttttgygaaygygggtttgtttaggtatygtyggggtttgttyggtttgagygtggagtttygaggtttttgtygggggtttaggttgtttttggggttttgttttygaygygttgtgtagggttagattttgggttttttttgatttagtttttttttttgtaatatgyggaygggggttttygtataggtaggttgttagggtgaaattgagtygaagagtgttttagaattttttgaagtttttatagaggttggggtgaatgaaggaaggaagyggggttagggttgggtagaggaggttyggtttgygttttgygtttttygtttttaggtttttgttttttyggataaggggyggatygaygggaggatttgagaaygttttggttttgtttgaggtggtgggagtygygggtagtttgtttagttaatagttgtygtttttattttttttatttatttatttattttttttattttttagatgtgggyggggagggtyggggayggatygygaggaygttttttgygttttttaggattttttttttttttttagtttttgygygtygtygggagagggaaggagygggttgtygyggggagtygaggagagtagggggttygggaggttagggagagaaggggagggttagaggtttygagtyggattygyggyggaggaagagggggtggaagggagygygtaggygggtgagggagygagggagggagagaaggagggagggagggagggaaggggggygggagggggtagggygagtttgaattttttttyggtygygyggygaggggyggggtygygygygtagatygatgggygaagttggggaggaattttaatttygggagygaagttagagtttgaaggayggyggyggttgygggygtagtttyggaatygaggtygggygggtaggtaagyggygagygyggtygggygttgaatttgggggatttgggattyggattattttyggggagyggygyggttaagtttttygttatttygaatttygggygttttygagtgygtagygtgygtttttagtttttgttgygtttttaggtttggygygygattygagygtagygggtaaagttggaggaatttggyggyggyggagygggygtaggtttagttygataaagttygggggttygggtyggggtygttgtygtagttygtaygttgtttygtgttttygagaggttttttttttagygtttttttttttttygttttttttygtygttygtattttgttyggygttttttagaygyggttttttgttttttttttttyggaaattagggggttgtttttattttttggtygagtygttgatttttttttaggttygtatygttttttttgttgggtygtttttttttygaygttgygagttttttygtttygygyggggatygtttagttaygtayg

SEQ ID NO: 6052 - DNA, 546 bp, Artificial Sequence
  Description of Artificial Sequence: Synthetic polynucleotide
gygggygtttyggttattttattttagygagaagaygaggttgtttgggttttggttttttygggygggggttaggggttygtygattttttttagygtttygggyggyggggttygagaattaaggtggttttygyggttttygtygtygygygttttttttttttttttygyggattttygyggtygtygtttatttygygtatttygttttttggaaatttagtagtyggggggygaatatygyggygtttttatgggaatttggtttygggtttagagygygggtagttggtagagtttggggggygyggyggyggtagtagtaggttggagggygygyggygggggttaaggggatttggtyggygttyggagtyggagtyggagttygagtyggagttggaggygttyggagtygtygaygttaaatttygagtagatggtggygggggyggggygggygggggtaygggggggttttygggttygygttgttaatygtttaagttyggttttttttttttygygatttygtygttttyg

SEQ ID NO: 6053 - DNA, 288 bp, Artificial Sequence
  Description of Artificial Sequence: Synthetic polynucleotide
tygygagaggaagagagttgagtygttgtaattttgggtttgggattgyggggaygggaygggtgggaagyggttaaaggygtagyggtttttggttagagtygtagaggtttgagaygtgggtygygtttyggtttaggagatttygyggtygygttttaatttttagtttttygattgygattgygattygggaaaaygtttaygtttttggaaaggaagttttattatagggagttgattyggtgttagygygtagtaygttttyggttygtagtgygtygygyg

SEQ ID NO: 6054 - DNA, 947 bp, Artificial Sequence
  Description of Artificial Sequence: Synthetic polynucleotide
tygtatttgtttygyggttygtttttttgtatataygttttygagtygggagagttttygtagtatttagagaagagatyggaatataaaggatgaaygaatggggagggggggtttggggggttgggagaaygaaaatattagttgygtttttaatatttaaggaaggaagtggtagyggggayggggagaggatgggaaggggatgttgattgygagttggggygggaygyggtgatgggaggggatygggtygggaatgygggaggygaggggagygaygggatttgtygtttyggyggtygggtagttaatygattygttttttttaggaaggagygaggggagggtggtttagagagaaagygtygygyggtttyggttgttttyggttygggatatttaaatagattaaagaggattyggagtggagttyggagyggatttygtagttygygttygtygygtatttattygygygttygttgttgggttttyggtagtygygttttttgygttggyggagtyggaggagtttgygttgggtyggyggggggygggygtttggggagggyggagagagggttygttygtygggatttttgttyggttygggygttttagagtygygggattggtygtyggaggttgygggaggggttygggttagattttttagaagttttagagagagtygttttttttttttygtgtgattttttgggagtygggttgttgayggtttagygtttagtyggagttttygygygtttttygggatttattygggagatgtyggggtttttygggaagagtgggttgygtttgtttttygyggtygtttygttttttygttgygygggatygtggggtttgagagyggygttttttygyggggtygaattygttatttatagtggagtgtggattgatatygyggttttayg

SEQ ID NO: 6055 - DNA, 1313 bp, Artificial Sequence
  Description of Artificial Sequence: Synthetic polynucleotide
tygtgttatayggygttgggttttgtaagttgttgtttgygtagtygttttygtygttgtygttttygggygggtgtattagggttygygtgggyggggyggggtyggggygggatyggggyggggtttgttttttygaygygtyggtttygtttttygtttygtttttttttagyggatygtaatgatttagaagtttaggaattttaygtgaygttatygggggggtgatgtaatgtattttaaatagaatgtattgtaatttttgtttagtttaaygtggtttttttattygggtttygtttttgttttttttatatttgtttggtaagtttttaaaaatayggttyggttatttttggggtttttgtatttagttatttttgttgtatttgtygtaggagttatttygggagtgtatttgtttgtaggggttggttttyggtagtagtygygaggttatttggtttagtgggtaggttatagggtaaggagtagggaagatgygatgtatttttttttggagggtgatttgtgtttgtaaatattttggyggattagagggaagttyggtttygagtgttggtagattgtggaattyggttgtgttttgaggttattttagagatttygygtygygtgagtgtyggagygttyggtggtygtygygtygygygtttggagggatgttaaygtggagtyggygtygagttygttyggygtgygtgygtgtgtgggagygygygagttttttgaygyggggattagttatgaatygggggtgtgtgtttgtttttagagatttggtaaggtgyggagttttttagaagtgyggttaagyggtagyggagayggygagttaggaattttttttygygtttttagttttttagygtggyggyggaattttyggagaaagtttgtaaatttttagygggygyggygaggaygtygggttatttagggggygggtgggygygygygtagggggttygtttttttyggtgyggagttgtagttgttatttttttygtygggttgtyggttgtagygggtgggygygygttyggggaggggaggtygttttyggagggygtttggttttygttttaggygtttygggttggagagyggygaggtttygttygttttagtttattttttyggtygttttttgttttygttgtttttttgttggtatygttattttttttyggtygttgttttaaatgatagtttyggttygagttttggyggygtttaggtaatttttaagatttggyggyggagtttttttttgyggtagattttyg

SEQ ID NO: 6056 - DNA, 848 bp, Artificial Sequence
  Description of Artificial Sequence: Synthetic polynucleotide
tygttttttygtttagttygygatgtttagttaggygyggygygygtttgttyggtattttttyggygygtttttttttttgygtttttagatttygatttagagyggatttygatygyggtaaattatggttttaggtgygtttyggaggtagttgygggaattagttatggtttygggttaatgtttagggataagtatagggatagggatagagatagggattgggattggattttagttttaagagaaagtatttygggtttattygtattttttttttatttttaaataaagttatagaagygattagygygtagttaaagggtttggaggtgaaaaggagggttgggtggggaggagagaaagtgagaagggagagaaaagyggyggttgagtaaagygggagtyggygygggyggtggggtttgattyggaygtygygtattyggtttygtttygygtttagygtttygtttattttttggtygygtttgttttygygtttttttgtttttttttatttattagtagttttgttgataagygagaaaattgataagtgagaaaagtygtttgttagygttygggttggtgtttgggttgttatygygggygyggagggaggggygygygggtatygtygtttgtygggtataygttgggtttygatttyggtygggtatatttattttygtagggtagtygyggttattatygatttgyggagttgygtgggttttyggaatttttattttaataagagttyggtttygygygtaagtaggagggaagggaaatttttattttttyggggttagggtaygtagaagtygygaggtttygyg

SEQ ID NO: 6057 - DNA, 2406 bp, Artificial Sequence
  Description of Artificial Sequence: Synthetic polynucleotide
gygtagygttatagtygygattgyggyggyggyggyggygtagggggygggggaggagagaagygtttatttygtttygttgttttygtagtagttttggttttagtttyggygtattagagyggtttttgggaatttttgggtttgttgtttyggyggtygttagttgggagtttattatygttygatggtatygaatygattygtgtagttttataattttagtttaatttygaggagttagygtagatygtttttygtttttagttgyggygaggtaagggttggtagygttyggaygttttygttttgttttttttatgtttaagygyggggaattataygttttyggtgtagaatagaygatyggggttattagggttgggyggtgggagtgggggttgggagtattatttttggttggaygtgtgtttagatttatygtttttggtttttaggattttatttttttttgtatttttaggtgtyggtttttttgtattygttttttayggggttygttyggygaagggtagtygtagtttatatttatttttygtttttaatttttgttttttttgttygtygtagttattygtttggttgggagtaagttttttttttygttgagggtgtagagagygtttagggygttaagagtagaggggttaaagtttaagygttattagttagtygaaggttttgagtttttagggtygyggtygggaygtagggaggttaggaygygaygttygttttatttgtttttttagyggttttttggtygatagygtyggtttgggggagggygygyggtygtagaygtagttttttagtaggtaaagtttygagggtygygagttygagtygttttygaagtagaagagtaggttttgtagtagygygaattatttggtttgttattttgtgttgttygaatttygtttgtttaggtagtttttgygygtgtygtttttgygygttagtagttttagggaygygaygtggttattatttagtyggatttttttttgtatggtgtttagaggttagygagattttaygygtttatatttttttygygtagtagtttttygttygtgygygttgygygttgtttttttttggygttygttygttygttttttttagtttttttttttttttaaatatttatattttaggatttggygtygagtygyggttttttgaatttagatatattatttttygttggaatttttttttygtttygtagagttttagtattyggaagatgtygttygattttttttyggtgtygggtaaattgagggattggygatttgygygttggygaggggtaggyggagttatgtgaygtygatttttygaagagttygttttagtagygyggatagggatataygtaygtagtttygtygaggygtagagtygygygtaggttgtaatttggtgttttttttttttttttagatatatatataygtataygtataygtatatatttaaattttgttttttttttttttatttttttttttttttttyggatgttaaaaagtaaattagattaattttygtttaatttaatgaaatttygaaggttygttatttygggagtttgygtttttgygttttatygyggygtattgtagatttggggttaagtgttagttgttatttttttttttaaaggttygttttttttttttattttatttttaataygaggtggaaggaggaaggtgggtggygaaatagagttgtaaaagygtttagttttagtttttgtatagttagtygggttatattgaattttagtattyggttgtattttyggyggtttttttagttatttgaggatagtatagggggtgagatggggtggtggttggtgaaygttggttattttattttatattattttattttgagagttgttataattatyggygttatttttygtgtattttgaggtttggttggygagtygttgttgggagttttttgtaaatattttttaaagtttgaaggygggttttaaaygtaggygtyggggattatgggagtttttaaatagttgygttggygtaatgatattttaatgatagatttttygtttttatttttagtttttattygtttatatagttatayggtatttattygagaaygttatagygttygtatgttgtatygggagggygygygggtygtygggygagtygggagttggggyggggagygygtatygttgtttgtygtagagggtagygagttygtttygattyggagtaagtygygtttggttygggygttttgtagyggggatgggtgttygygtagttttgtgaaggaaagatattattttttygtayggaaattgygtatatttttttttyg

SEQ ID NO: 6058 - DNA, 1218 bp, Artificial Sequence
  Description of Artificial Sequence: Synthetic polynucleotide
tygygtttgtagttygtgtattttttttyggagttgygttagggaattayggaygaattggaaggggtygagaagggttttggttattatttttagttttaagttttttygtttttttagatttgggatttttttyggggaggattttttggygttttttggtagtttttygtygtttagggtygatttttttatttttagttttygggygggggaggtttygtayggtygtttagaygggttggggygggaagattgtagyggttttgggtttattttttgtttttttataatttttagtggagttgggttaattttaggtatagtttattygagttaggygaggtttagaaaggtttgattygtttggtagttttaayggatttgttttygtagtygttgattagtygttgaygagyggatttttyggtygttatggygattgtgaaatgtagggtggagygtatgygttygaagttattygygygggtagtttttgygtgtttttttgygtgtttttttaygtgttttttagygygygtagtatttygtttttgygttttttygagygtgtagttttyggtgagggtagttttaygtatagtttttaatattttttttagygtttgtagttttyggtgygygtagtttttaagtttatatgygtagtttttattttgygygtagttttaygtatagtttttaataygtttttagttttattggygtagaatttattatygtttgttttttaygygttttattgggagtgtagtttttatttygagygygtagttttaygtagtttttttatattttttttagygtttgtagtattttttagtgygtatagttttgttagtagtttttyggygygtygtttttgtatygtttygggttataattttgttggygattaagtttgaagaattttttgtggttttatttttttttttaggtttagttttagttttgatattttaattaaaaggttataygttaattaaygaggtattaaaggggaagattttagttgaaagaaatgattgtaggaagtgtgttagggaagttaayggaatygttggttygtyggtggtgygttyggtattaggaaagtttttaygatygttgaggtatygggtagttagtgttygttgttaaygyggagggaaygggyggagattgygggtaataygtggtagagtyggygtgagttyg

SEQ ID NO: 6059 - DNA, 1848 bp, Artificial Sequence
  Description of Artificial Sequence: Synthetic polynucleotide
aygaygaaggygygtttttttttattygtttatattatattttygtttttygaagtatagttygggttggagaagttttagyggyggyggttttygyggyggaggttttygygygtatttattatgtttttygttttttttygtttatttygagygtygtgygygttygaagttygagtygtagagygttatygygtaaaggaaggagttaggygygtgyggggttygyggagtttttttgaattttttggatgggggyggaggygaggggygtygttattattgyggtaaatttygtttttttttygggaggtgaaattttttaattygttttyggtyggttygygggtyggatttttyggaaaggattttttaggaggagggagygaatgtaagttttgttyggaygttttatyggyggttttttaaatttgggygttttttgatagttatttttattttatttygtttttaygttggggattatttttggtttyggaggygygggygyggtygtaggagygggttgyggggttygygaaataaagaatttygagygggaygtatttgyggyggtagyggttgttaagttttygaattttttatagattygyggayggggygtaggttggyggtttttygtttygygyggtygygggyggttayggttattgygagyggtygggttgggygyggggtgygttygtygygggtatggtgyggygygggyggtygyggggygygyggggaaggygggagagyggygygggtgagtgggagyggygggtgtgygygagtgygagtgtgygagygygtyggtggygttgtttttgttygttttttttygttygtgtagtttyggtattagtttyggggatygtgtaattygattttttttgatttataagttttgagtgatagttttgatttggtttaatygygggagggaggggaaagagaaagaaagaaatttttagtygtaygttttttttggtatttaatygattttttggaaaaaggttttatttyggtttggtgtttygtgttgggtggagaagtttttygtttygatttggtatygtttgtattatttayggggtggaaaagttgtttttyggtttygygtttttttttygygygttttttttttttttttttttttttttttttttttttttttygygtttttttttttttaagttttaatagatgttgtyggatttttttygttttttygtatttttttttttttygtttyggttttygtttagtttttttttttttagttattttygggttyggaggggaygygttgagtagtaggaygtttgtygtygtagggggygaagttgggaaaatttggagtgttgttygttttatttttgttttttygttttttttaggtygygtygggagttttygtttttttygttygtygggtttttaagttyggagtgggttttagttgygaggygggyggyggyggttgggaggyggygygtygygggtyggggtygggggttgggggggagttygggygtygygagttaygygygygtttttttttygtttttygtygtygtygtygtygtygtygtygttttttttttttttttttttttttttttttttttttttttttttgttttttttyggtttttatatagatatatttatgtttgtttttttttttttttttatttgatttygygttttttyggygygtygaagttttatttattyggygaggggaagggggttygggygtgatgttattygygtttttttttttttttttttatatygttaggatattttttaaatgygygttttggtattygtgttgyg

SEQ ID NO: 6060 - DNA, 2119 bp, Artificial Sequence
  Description of Artificial Sequence: Synthetic polynucleotide
tygtygtttttttagtatagttttygtagttygtattygtttatagggttttygygattttagagtttagggaagaattgtygaggggyggggggttttttatgygtatggaagggaygtaygttttaggtttttattttttttttgatttyggggatttttggaygtygatttttygtttygtaggggygagggttttgggttygtagttagaygygggttttttttaaatttagtggtttggttttattgagtgggggaaggtatatattttttaagattaattgtttygtaatagggaatttygtaggattttagtattttygattttttaggtgaygttaagagggtgggttttattgtgtayggtggggaaattgaggttyggaggggataaggaaggtattygaggttaygyggttttttyggygggygggaaygtaggaygyggagttggggygygggttgtgygygtttaggttygyggttttyggggttyggttgtygtagygyggtygtygtygaggattayggtyggggygygggygggttttagtgygtaggygyggygggygggaggggaygygtttygggygygygygyggggtagtyggygttttaatttygttygtttygygtttygygtttyggygtttygtygttygtygttygttygtttyggygtygtygttygygtttyggygtttygggtyggygaggggygygttygyggtygyggtygttgtatggygttgagatggygggggygtygygyggyggaggyggyggyggaggyggygygggygagttygggggygtygagygggyggtygggataagtygtyggygygggtttygggygtgygaygaggagttygtttgtttagagttggaggygttgtttygyggttataygttgyggttggagtaggyggttaygttgaaggygttggtygtttttagtttgttggygggygygttggygttggtygagttgttgggygygtyggggttygygttyggtttggttaagggtttatattyggtgtattgygttttttttttggygttgttygtggtaattaaygttyggtttttgtaggtgttttagttgtagtaggtyggttagttggygttgttttttagttttattttygygttgttttgttgttttttygygttgggyggtttygttyggggtttygtyggggtygttggggggttagygatygtygaataaggggtttggtagttttttttggttattttygtgttttatgttttgttgttygtgygtagtttgttggttataggttttgggttygtggtggttgygtygtatttgttggttatagttattttggttttygttaagygtttaygtttttggaggayggtaagtgtagtygygtattttttatttggtttyggatatatttgttgggaygatgttgggaatgttyggagtygggygygtttttttttatgyggygggtggggatattgaggtttygagtgggggtgtgtttaaggttatttttaygagttggggaygtagtyggggttggtatttttyggttagggttttttttagagttataatttaygaagygtttttggygtgaagtgtggagaggggagataggtgtggagagagaaaggtttggttaaggttagggagttgatgagyggttagayggyggttagaggggttygtyggttttttgtygtatttatttttatagagggattgaaagtgggygaggagagtagatttttagggtaagttttaaggtyggttttgygygtagygttgggttttttttttgygtatttagagygygtgttgggttygttttttaattttgyggattygagggtggtatatgggtggtgggaaaggatttyggtttttttagttttgttggttatttttttgtggatatgttttyggtttagaaagagtggggtttgttaaggttaaatatagtttagtttttgtygttgttattyggyggttgttttgattttgttttttttgygttygaattttgttattgtttttttagtygggygggygagatggttgtaaggayggggaygttgtttgtttttygyg

SEQ ID NO: 6061 - DNA, 562 bp, Artificial Sequence
  Description of Artificial Sequence: Synthetic polynucleotide
tygtagggygaaggggtgygttgttagatgtggtattttygttttayggagatatayggtgttttataygttagggagaggtttgagaygtaaagagtygtygagygggttgygggattgtttygttgttattttygtttgtagttattttttygtaygtatttgtgtgtgtatttaggttaatatggaaggygttattttaatttttgtygtgagtaggtgggagggaagagagaygagaggtattttattggttgtttgggaaaatgaattgtattttttttttttttgyggaggattaattttttttattttttygggtgggtattygtattttggggtyggagtttgaattygggagttaaggggttttagttttagggaygtgaagttgagygtatagygggygtttttagatattggggaaagtgttttaygatgtttygagtttttttagtttygttagyggggygagygtgagggtgtttygatygattagyggtttygggtgtagggtggygggttyggyggygygygttttttttttttttttggyggttyg

SEQ ID NO: 6062 - DNA, 1404 bp, Artificial Sequence
  Description of Artificial Sequence: Synthetic polynucleotide
tygtttygttygaggygaaatygttgaaagttyggttatttaatttttgtttttataattyggaatttyggatattagyggttttagttgttggygygyggtttttttttagttttttggattttaaagttttttgttatagygyggygttttttttttttgttaatttttttttttgtattgtgayggaggtaaagtaatttagtttaggaggttgaattygagttattagagaaggagaaatagtgtygaaaayggttygtgygttattagggtagtttattaaygtattaattttaggttygttgggtagaagtygggaggaaatattttggggatygtatttttggttaaatgtttagtaygagttaaattyggtttttttaaagygagttaagtttattattataaagagatttttygagtgttttgttttaattatattttagatagttagttttgtggttgttgtttgattttaattttttttttaaatttaaaaggatgtatatttttattagayggaaygtygygatttttyggygaagaaaaaggygtygtttattttttttttaaaaygttataataaaaattattaygtttttttttttttttttttgtttttttttttttttttagattaataaggaaaggagygagygagggygtagatgttttttggttaagtatttttyggatgttttygattaaagygtttttaaatgaatttgtagtttgyggaagtyggggatatatttatagaygttttttgttgtttagattaggaggggtggtgggggaattaggaagttagggagagagtaaagtttttggaygygttttaggaggaaaattttgtgtagtgttgttaggyggaggttygttagaaggtttygtagttgttgaggyggggtgggattgygttttaggggtygygttgaagttggygtygygattattgygtatygatttygtttattttttgttygttttygggagttttttttgttttaggayggttttttattttttaaattatgttygttttttatttyggatttatagttatttttaaatttyggttattttygtttagtatygyggtttttagtatatttttttattggagtagtaggtgatttaaattagatttatttgttgtgaatttttttttttttttttttttttttggtgtttttttagggagaggggaaygggatgtaggttgaggtttagyggygyggtaattyggggtatyggygygygtttttttgagtygtagttttggttgagtaagyggagtygtyggtagttttggtagagtygggaagttgyggtygtaggggttaggtygggaggtagggggygttgttgtttttttygagagtygygttaggataggyg

SEQ ID NO: 6063 - DNA, 819 bp, Artificial Sequence
  Description of Artificial Sequence: Synthetic polynucleotide
gygagaygtgggaaattggygaagttgttattagtygtyggygtaaggagygygagagttttgggtgygygtagggtatttattttttattttttagtaagtatygtygtaagttttttaggtgtagaaattgttggygttgttttygtagttttygtataggaattggyggtagttttgygtgtatttgtygtagtagtaayggagaagtagggttyggtagggttygtagtttaggggtaggagatagattttygygttattttttgaagaaggggtagaaggagagtaaaagagagggaaagtggttaggygtagtttttaggaggaaagaatatttyggggagttttgttttttttygagyggaggggtttttgtagagaaagtgtaaatttgggagygagttttttttgttagyggagygygyggtagggatttggagaaagygaggtttggagggygtttatayggggttttatggttygttgygtttttttygtyggttggggagagaagtttttggagyggttagatatttgttggtttttgagtagtatygtttagtgtagttttygttaggaaaagtagtagaatygatagttttagggggygagyggggtttatggtgtagggggtygggyggttygttgggtaaggygttygagaaagygtttggygggaggaggtgygyggttttttgttttaggyggttygggtgttygttttatgyggggygagygttyggtygattttygtyggggyggagtttgaggggtggttgatttatgtayggggattgttatttygtygttttygyg

SEQ ID NO: 6064 - DNA, 1128 bp, Artificial Sequence
  Description of Artificial Sequence: Synthetic polynucleotide
gygttggygggygtattyggyggyggygagygyggaggtgttgyggtatttattatggtatttttgtttyggaaygtagtaggtggggttgttygtaatatgtagggaaatgagtatttygttttgttttttatttttttttagtttttygtggtgggtgtataggaaaaagaagggygaaaagygggggtaatagttagtygtygygygygtttttagygtygtttttagtaatagygttaggaggaaagtttgtygggtttagttattgygttttatgtygtygtygtygtygtygtygtygygygttttaygygtygttygtttatttagttttggagaygtygggayggaggagttaygyggagagaaggygagaagaaggyggaygggagyggaaygggttygggagygggtttgggagygggttttygtygagaagtttygygggagayggyggtttttaaagttattttgggtygygggagygygggatyggggttgygggygtygagagygygtygtttgtygttttygtgygtygtygtygtttttgygygaygtttttyggttaggtttgggaaagygttygtttygttttatatttttttaaagtttygggygtygygtttttttygtygtygttataygtgtttyggtygttttttygttttygygygtygtttygttygtttttygttttttygggttggttyggyggtatttygygyggygaggggygtaygygttttyggagttttyggttagygttyggttygtattygggaggatagggaggggygttygtyggggagygggayggggaygttgtygaggatygttgagttygygatttttttgygagggaygttaaagtttygtagagggtatttttygtttagttgtttgaaggggaaggttagtttttttggtygttagtgtgttttgttttttttgggaggatgygtgagggaaggagaggggyggtagggayggtygttggygtyggtttttttgtttgagtyggttgygtttygygtttttyggggttygtagtttgttagttygggyggttygtattygttttgggaattygttygaggtygygaatygttaggggttttygyg

SEQ ID NO: 6065 - DNA, 1128 bp, Artificial Sequence; identical to SEQ ID NO: 6064
  Description of Artificial Sequence: Synthetic polynucleotide

SEQ ID NO: 6066 - DNA, 1128 bp, Artificial Sequence; identical to SEQ ID NO: 6064
  Description of Artificial Sequence: Synthetic polynucleotide

SEQ ID NO: 6067 - DNA, 1921 bp, Artificial Sequence
  Description of Artificial Sequence: Synthetic polynucleotide
tygyggatttgggtttggygtttattttatygttaggattggatagaaaggttttggtygaggttattaayggagaggttagagyggagtttttggtttagaatggaggtagtagygagttttyggyggtttttaggagtattaaggtggaggyggtggaggagtyggaggyggtttttattttgggtttyggagagtttgggttttaggtttygtygyggaygtygtygtygygtagtttygtttyggttagggttaaggtygagttgtttagttttaygtygggttttagttyggtgttyggygagttgggtttggtyggggttttgtttttttygtagtaygtgttygggttygaygyggygtttttygtttyggagattttggttaagatgttygagttggtgtatagtyggttgtagtagggygygggygygggygtyggyggygygtagatygggttttttttyggggtttttaagggygttaygtgtttygagtgygagattatttttagtaaygttaataattattaygtgtataagygtttttattgtttaggtygtygtgygttygaggaygygtttgtygygygtaggtttaaggygtttttyggttyggttygygygtttttyggttagttygtygaattygaygygtygygttygttttygggtttyggagygygygaggagggggttgggggygyggttaygttygaggayggygygggyggtyggggtagygagggtagttagagttygggtagtttygtggaygaygyggaggaygattttagtygtaygttgtgygaggtttgtaatattygttttagtygttaygagatttatatygtgtataagyggtattattgygtttygygttaygattygtygtygygtygatyggtygygttttygggattttttgggtyggtygygttttyggttttttttttygtygygtttgtgygtaygygtagaygtygtaagttttaygagttgtaygyggtyggygtttygtttttttygtygttyggttaygttttygygttygagtygtygyggttyggaagyggaagyggaagyggtttyggtttygtttttgygygttygttyggtttygyggtygayggttttatygatttgagtaagaagtygyggygttygtttttyggagtttyggtatyggygttggtygattattaygagtgtayggtttgtygygtgagtttttatagtttygaggtttatttggygtataagaagtattygtgtttygttgygttatygttyggygygttyggtttgttygtygtygtttgtttttattgtttttygaayggttyggtgygyggggatttgttggagtattttygtttggygtayggtttgttgttyggygygtttttggtyggttygggggtygaggttyggaygtyggtygatygyggtttttygttygttttygttttygtygttttttygtagttygggtttygtggttttygggayggtttyggttyggagttttaggagtygtygttyggttygttttygttttyggtygtygygttygaggtygtgtygttttygtyggygttttttttttattyggataagggygtttagatttttagtaagggtaygtyggygtygttgtttaayggtaattatyggtattgtygtttttgtaatattaagtttagtagtttgtttatttttatygtttataagaagtattattgtttttygtaygtygtygagtaygtgaagtgagygtttatattatagtygtagaygttttgtaygtttygttgygatgyggggagggggtygtttttaggtygtayggattgtygtttttgggaatttygttaygtataggtttyggyggagggggtygtagggggtagygttyg

SEQ ID NO: 6068 - DNA, 2872 bp, Artificial Sequence
  Description of Artificial Sequence: Synthetic polynucleotide
gygtttttyggaaygttaygttttgygattgatttgygagtaaagtagygggtttagtttgyggygygyggaaaaggyggtyggygaagagtygttyggttygygggtaggggagggatyggagggagayggyggggagggagygttggtttttttttgggttggggtttyggaggaagtttttygttaagatttyggtygtgygtttttttyggggttygtttttttttttttyggttttttttttgttatygttttgggttttaagtaggtygtttagtygggttatattyggtggatagaagtygggatttagggttggyggttgggttygtgtattttttaygygggygtttyggttttgaagtgygygyggagtaggttttgatygttttttttttttttttttttyggttatttttgttttttttagttattgataggatttttttygaaaattttagattttttaagttttagtttggyggttttttttttttaagtygygtttyggtgatttgggttgygygattaygaggaagttygagaattttttggtttaagtgagataggaattagggtaataatgaagagaaagatattyggtttttttttattttaggtygtagaggygtatatygtgaaaagaaaggttaattagygttttaaygtaygttygggttttttttttygattattatgtatttttaattttttgttatygagggttttggattttttygaggttttttgtattttaagtggaattttttgttttatttgttagtagtttygtttgttgagaggaygtattttggggattgttaagaagtagtagatataattyggttttgttaatatagtatayggttttgttttygtttttttttttatttttttttttgattygtygtttggggygagttggagaaggyggagtaggaggtggggagaagggtgggggtgggggaaggtttggygtagtataaataagttttttagygggttgtttatatagtaggtggatttgaygttagttaggaggtttygttgtaaattygaataatattttttttygygtttttttttttttaaagaagttagggaayggggggagataggtggaygggggagaaaggtattttaattagttggttttaaatttattaataataataaygataataataatgtaaagtaaaataaaataaataagtggttyggyggtattttagaattttttgyggygttttgttttttatttygttttttygaggagaggtagtttygygagtagtgtgtgtatagttygtattgttaataataygygygygyggtygggtgygygygtttgttagygtatatttatatatatagatatatagatatatatatatatatatatatatatatagattygggtggggggagyggttgygygagatagygygagttttygagaaagygygagataygtyggygygtgtagtttygyggtygtygtttygttttagttttagtttygygttattygtagttygttygygaaygttygtttyggttatttatgyggyggtygygttygttggttgyggttttttyggtttttttttttttygggygygttttttattygyggtagtagttgttyggattygygygtgggtgtgttgtttgggggtttttgtttygtygtygygggtgttatttttygggaygttgtttayggygttttyggtygyggtaagttttttggtttttattttggygygttatattttygtattttattttgttttagttatttttaygttgggtygagttgygattttattttgtttygygtttttttygyggtggygataaagtttygttttaaaggtagygttttgtttgtyggggygagtgtgatatgtgttaaatttgggttyggygttggggtygtatttyggatttagtattattatttgttgtttttttttattttgttttgtgatgggggaaaaaggggtggagaggggagatttgttgttggtttayggatgatttttagtttggataatgtaaaatgttgtttygttyggagagatttyggttggaggagaatgtgtgtygaaatattagatgtgtgtttgtttatttttttttttttaattgtttgttgttttttttttttttttttygtatttttatttttaatttygggaggagaaataatagtaaaaatatttggyggttagaagtatatattttattgatttaattgttgatttttatttatttagttgggtaagtgtaygtttttygygtttaagttgggtattttagygtttattttagaagtatttttttaggaaggagagagatggaaaggggatatttttgtttttggagttaagaaatttttgggttttattgaygtttygggataatygtgtatagggatgattgttgttttgatygygtttttttttttgtttaygygttagtaygatyggtttttttyggtgtttggtttggttttatttttatttygttttagagaggtygtttggttgtttgtgggtgggtttggggtgaaatygtatttygyggtatttggtgaggggaygtgggaggagygtagatatttttyggtgatagggagggttttttatttggttgttatttggaagtttatagtggtttyggygggtaggygggygggtagagygygggttygaaygtttttygygtttgyggyggygtaygtgyggyggyggyggyggygtyggyggygygggygggatttattgggtggtygygygygttattygygygttttttgygygtttttgtttattygygaggtygtaaygygttttgatattyg

SEQ ID NO: 6069 - DNA, 2906 bp, Artificial Sequence
  Description of Artificial Sequence: Synthetic polynucleotide
tygygggggtgyggttttgygtaattgggtgattygygtgttttttygtattttatttgtattaagggagygygtgttagaygaagggaattttttttttttttttggtgattttgttatttttttattaattgtaygaagtttaagggatattygagttttttggttgggyggatgggtttygygtttggtatggttgagyggtttatttttattttttygtttttatttttattataatagygattatttagttygttaggagtttttgttttttagygtaggtttttttttttttttagttttttgggttgttgaagtygggttttgggtagatagagattggggtygtggggagagygttaggttgtttttgtttttttygygtttyggggtatttyggygygttggggatgtagttttygttttygtygtatttggtygttygagygttygygtttaygtttygygyggggtygttygaaattggggtygygttagtygygggagttatygaggagttgttggggtgygtttgtttttgttttttaaataagattttygagattttttttttatttttttaatttttagtaggatayggaatttyggygtttttygaaagttataaaagaggggtayggaaattttaagttygtygtgttaattyggagaaygtaaattygaggtagagygtgygtygtgyggggatgtgggtgtygaggatttygaagygttyggtttttttygygatttttattttttttagattttggttagatatttatttagtttaygtttagagggygggggttatttygatttatttyggaagtygttaattttagaaattttttttgttaggttygygaaaygaaggtatttygttatttyggyggggtaagttyggattttattagggtaggttygggaggttatttagggtagaygattygaggtagagygttttaaaattttgtygtygtaygtttagttagagygtygagygygtttgtttttttttygttattttttagttttttattygtygattaaatttttgggggattatatttttaagttttgggagtttygggtaaagttttttttttttttgaatttttttattgtaatgtaattatgggtagataagaggggtggttgttttgttttttgtaaygtaaaattaatagatatttaattaagttttaatgttyggttagtttttygttttttggtgtttattttttttttttttttattttygttattttygttygttattttttttatagattayggatatgtagggttatttatttgtgtttaggaaaaataaattattagagtgatatgagaaggaatggtgtatttggttgttygttgaaaggttttagagaagaaaayggaaaggggaataaaayggggggattttttttttttaataagtagggygttttggggaagtttgggggttaggggttttttgtttygtggttyggtatttgtttttttyggagtygttttttgttgtygggyggygagttttattttgtttttygtagagggygyggtgaggaagttygtygggggttygtagttttatgttagygtygtygtygtygtygtygtygtygtgtgaggygagtatagyggtygtatttgtggttgatttttgggttgagggggttgagttggtttagtaggygttaagttttttttatgtgaataataaatatttttatyggyggtygygattggtttgygttyggygtttttygatttttygttygyggttatttattyggygyggygyggggagtygyggttaggatygygttygggatygttaatygtttygygttaattagttatttygggaagygggaggaggaattttygaggggygggagtttttggatttyggtgttatttagyggttttggygygggtagggagggggattttyggttygyggattttttttygttttttagtttgaagygaygaggagattagaaatgttaatagttttgatttttaaaaattattttttttttttygtttttaagaaaaaggggaggatttaattatagagtgagagggtgggaagaagygggagyggtagaagaaggaatatggttgtggaggagtttagyggtttyggttgtttggygagttygggatyggygyggggaggygygaygttygttygagtatagygggtagtattygygagttygggttttyggtgaatatagttttagaaagygttatygagaataatatatggtagatgataagtgtttygttatatgtttttttttygggaatgtttaaagtagagtyggtaagtygygyggtttttttgtaaagtttgtttggygtygygyggyggtttygttatttgtttygtttygyggttttggygattgtttttttatttttygttttygagggtttgagggaygygtgtaatagagtttttagggttygaggtattatatagygyggttygttgygggtattgygtaggaaggggtatgggtggttatygggayggttattttattgagatgatttaaggagtygtagaygyggggtaggaaatttygggggagtygtgttygggttttgtagggaaatttygggatttttttygtatgtygtatgyggaaatttgtygggttygaygtgtatagtttagygtttttttttattagttattgtttaggtttttygattttgtattygtyggaatgagagaaagtagtttttygtygtttagttttygggtagttgtttyggtygggttttgygttggtgagaaagttttatttagaggyggtygygygtaattgtaggyggygttttaggttygggygagttagggagagyggggygyg

SEQ ID NO: 6070 - DNA, 2906 bp, Artificial Sequence; identical to SEQ ID NO: 6069
  Description of Artificial Sequence: Synthetic polynucleotide

SEQ ID NO: 6071 - DNA, 1696 bp, Artificial Sequence
  Description of Artificial Sequence: Synthetic polynucleotide
tyggagtyggagtyggygaagtygyggagttgaggygygtttgggagagttaaggttyggygggttatgtaggtgtatgttttttttttygtttaaggagyggygttattagygtttttyggttttgtttttggattttggtatyggttygttttagtygygggggaaggygttttatygttaaagtgygtttyggyggtttyggttygttttgygggtygtygtyggagggagtgygggggygtttygaagtygtttaggtygtattygttggatgttgygttttttttttyggygtyggtygtttygggtyggyggtagttgattgyggtygtgagttygyggagyggygagagttaagaggaggtgttygyggygttttygttttttttagatatatatttttttttttttygttttttttyggagggtggaagagataaaaayggggggttagttttttagttygtyggttgtyggtaygyggggyggygtttygttyggttttygaggattagyggygtggyggttgygttyggattyggttygtyggtyggaggagygygyggygttygyggtygygttygtatygtaggtttttttagagagttygggggygggygygggttyggyggyggyggyggtygtagttttyggyggygygtaatygttygtygtygttygtygttgttyggttttyggygygtygtyggtttyggttttgtgyggagggagygagttygyggtttyggttttyggygtttttagtggtygygtygttagyggattgttgtagyggygtgagtagygggggtygyggttgygggaaaygtttyggagtttaggaatatagttttygttggttagyggyggtagtagtagtagyggggtttttgygygyggygtttatygtttttttttygygtygggttygyggtgttgtaggyggtagttaygtagattgtttttttatttttttgttttttagttagaaygtgaatgtattgttgaygtatattgttttgggagaagattagygtgatgtagtgtttttatgtattagygtygtttttttttygtygtttgtttygyggggttaaygtyggygttttttagygtygygtyggtyggygtygygtagtttygygttttyggtygttygtttttttttttttttttttttttttttttttttttttttttttttttttttttttttttttttygggtygtttttttttygttttttttagaygagyggagyggggttagggygagygggygagygagtyggagtgagygttaagtgaggggtygygygtaagtygtaggygttygtagttattttgggtyggtyggagggagtagttgggtggtygttgataggttggagyggygyggggttgyggygggagagttygygtyggttttygtttttyggttygtattyggggttttttggttttgaagagyggggtttaggggttyggyggttygyggyggggttgttgtatttggtttgtttttygttyggttygygttatttttattttygttgattgttgayggggygyggattygygttyggagttyggaattgygtggtggggattygggggayggyggtyggggttaygaggtttttaggatygagagttygggtttygttgttgtattgtygttagtttttttttyg

SEQ ID NO: 6072 - DNA, 2054 bp, Artificial Sequence
  Description of Artificial Sequence: Synthetic polynucleotide
aygyggygatgttttaagtygttttttgtttgaaatttyggygtattttyggggaagtagtgttaygttttagaaaggygtttgtgttgttttttattggggaaaygtagtgtttgttttatatgygtygttttatagaattgtagttttaatygtttatttggtttttttttygggygttgggttattattttttttaaatatgygttygaatatttgtgggtttgtttttygttgaaattttagggtgtttaaaggttayggggtygygatgatattgggtaggttttyggaaattttttaggattttttttattttaaagtttagttagggaygaaaggggttgggagttgaaaaattgtttttttaattttttygggtgggaggtagagtygggaatatatagaattttatttygaaagtttygggaaagagaagtttgagtttaggagygtgagaggagaatatattygggaaatttttgtttyggtygttgtattttygygggygtttaggtgggaygtgggtaggtgygygagygtygtgtgtgtyggtgtggatttgtgtgtgtgtttgygtgtgtgygtgtgygtgtgtygygggttggtttygggatattgaggattttygggtyggtttaggtttgttygattttgttgttttygtygttygttyggttttatttttyggygggtyggttttttatttggaygygtygygttttttttttttagygggagygtygtattgatattgtagatggagtttatgtygttgtttttygtttttttttgaaygtgtgygtgtgygygygtgtggttgttttttttagttttagtttygaaygtaaatattttatygaggtatagggaagtygggagtagtygaggaaygyggagggygtygaattagagtttgyggggtttgatagttttttttgyggygtttaaggtgggygtaatgtttaataaaaaggtyggaaaatggggatygatttygaatattttttttttttatttagtttyggagttygagtagyggyggyggttttygggggttgyggtggygaygtygggttgttttttttygtttttattttygygggttgaatgtttttgatgttaagygggtatagyggygttatttygygtygtttatgttygttyggtygggtygttgttygggygyggygagtgygygggggattygtyggggagygttttyggygtttttgygygtttttttgggtagyggyggtygtttttyggtagttygyggtyggtygygtygyggtagtttttatttttgtygagatattygtygggtagtgttttggggtyggggttggggggtygygggagtygtyggttgtttttyggggaggtgyggggttgyggyggtggtggttgyggyggttggygttgyggyggyggagagttyggtygygggtygagtygggtttttygggygygttttyggtttttygggygggttgttygtaaagtttgtagggggtagggagyggggtygtygttggttyggtygtygtyggagttttygggttgtttgttgtygtygyggttygttgttgttgtgtattgaagttyggttaagygttgtaaaaattttagttgtttggygttttttgggttttttttttttttttttygttttttttgtttttttttttttttttttygtttygtttttttttttttttgtygttygtygttygtygtygttttttttttggttygttttygttggttyggagttygyggttgatatttagagygagggagagyggtyggtagagggggtagggggygtttttttatatgtttttattygtygtygttyggtttgtyggttttttttygtattaaygtttgtygatatttttttgggttttttyggttygtayggagttattttggyggtggygatgtggggyggagagaggggtatatatgggtgatyggagygtayggygygygtttagagggaggygtttagtygtttyggaatttgtagttttgggygttggtygtyg

SEQ ID NO: 6073 - DNA, 1258 bp, Artificial Sequence
  Description of Artificial Sequence: Synthetic polynucleotide
tygyggaagygttttttgttgggtagaagagtgggtttttygtygyggygtatttgtttyggttgtyggtttttygtatttatttgtaygagatttgttttyggaaagttaagttttttagttttttttttagygtttygtttttttttttttggtyggyggtygygggttygtttagggtagyggttttygtygtygyggttgattttgygtttygygggttygygtygttttyggygtttaggtagtagttttyggygtygttttygttgttgttgttgtygttygtygttttttttttttttttygtygaggagttggggtttatggygttygtttyggyggtygyggagggagygtaggyggygtygttgtaggggtygggygggttggyggyggyggyggyggyggttgtaggagygygggtaggttygygygtygttggtaggggtagtaaatggtagttttttttygtagtatttattygyggttgtatygtatyggggtattgtgggaaatttygtttattttttygtttyggttaattagaggtygtygtttttygtttttygygttttttygygtyggttygtattttttagtttygttggtttttttttaaatttygagygaaagtttaagttgaatatgaattttgttyggaggygaygggttgyggyggagggggagagagaggaggataggttgygatttygggttggggaygttagggtagggatagygagtattaggaaggagagygttyggggaattygagtggtygygttttgggttttgtatygtgaggttggggggattaggatyggygggygtttattttggttttgagtttagttgtygaygttgggttagtattttttttatygtygttttttagtgagtagagttgggtttaggtagtagtttttgggygygggaaggtagygggagttgtatttaggggaggggggaggtagtaggagtttygttagtgggaattttggagtgaattygtyggygggtgttaagtygaagygtygattttttgtttttggattggggttyggatttttgygtttttaaattgygttttygttttgttygtygttyggtgttttttttaggygtagtagattttyggtaaatagyggttaattygatggaatyggattatagggttttyggtgaagtagaaaggyggaggaaatttaggaggtagaagtgaggattttggygtttggygtygttgygttgttyg

SEQ ID NO: 6074 - DNA, 628 bp, Artificial Sequence
  Description of Artificial Sequence: Synthetic polynucleotide
gygtggaggttgyggttyggyggggtaggygttgagygtatygyggyggtattyggygtagaggttttagygyggggagtygggtttagtttyggtttgttagygtygyggttttagtttattygaggtyggtttggggggttygtagggygygyggagygtygagtgygygtygggttgggtttygtatttyggtgtaggagygygggygyggygyggyggagygtttygtatggagtyggttygggagtttttttygygggttyggtygtygtygtttttygtygygygtttygygttygttttygtygtttttaggtygygttygttygtagaggttgaggttygyggtttygaggggttgttgyggygattygggtygggttaygagggtagtattagttggaaggyggttttggagggtaagygyggagyggttttttttttttggtttagggatttttgtttaggttygattygygattyggaggyggttagagttattttggtygttgtttyggaggggagygttgggagygyggygtygggaygyggyggagttatttattttagggyggttagaygtyggttygtggggtggggtgggagggaatygggggttatygyg

SEQ ID NO: 6075 - DNA, 1075 bp, Artificial Sequence
  Description of Artificial Sequence: Synthetic polynucleotide
gyggtttttagggygagtattttygtttttagygttttttggttattaaagaaaaattagaygtttgygaygggtttttttttygttygggttttttygtttttygtttttygtyggttatygggygttattatygygggtagtagggyggggygttttgggagtygttgggtgtttgggttggygtttgtaggggtttygygggattaggtyggttgtaggggygyggyggygtagtttattttgttgttgaagagtygygagaggttgygtatgggyggagggggtygyggggtatttyggagttygygtaygttttagaggygtagggygtygtygtgygaggyggtgtagagtatttggtygtgtatttgygggygtaggggygggygttatyggtgaygyggtaggygggggggatatygttgttygygtggatggatyggggyggggtatttttttttttaygggyggyggtttygagaagggtagagggatttatttggatgtagttgatgatgaatgtgtggtttyggaatatttttygtagttttttagattgygygtygaaggttygggygtaagygttttygttgttygtgaatattgyggatatatagygygygttgggtttttttttttgttyggtttttygtaagtagggatggggyggygagagygtgatttggggygttttygagatttygttttaygggggtattttgaggtttatatgggaagtggatagtgtttttttagagaaaygggtttttayggttattttgttttattttgtagatgtttgygygttagttggttttgtttttgttttgttgaatatygttygggtttagtttttatttygyggtttggtgaagttggttttygtgtttgtttgggaagtttttgtttggggataatygttaggttttygagtygttttttttttatttttygttgygtyggtaattttattttttygtttttattaayggatyggtatttaaattaaagtttagttttttggggtttatgattaygtattttygggatttttagygggggygagttttyg

SEQ ID NO: 6076 - DNA, 5566 bp, Artificial Sequence
  Description of Artificial Sequence: Synthetic polynucleotide
gygtttttttagygatyggggtagaattaggaygtgtaatgygattgttttttttttttygtttttyggtagagtttttgttygygttaatttatttattaggttttgttygygttaygygygtttttggtaggtttggggyggggaaaggygaagygttgggtaygygagggtttgtgtattttagtttttaygaygtttttggttttttttaggttygtygttgtygtatttaatttttttttttygggggttattttgaagaagttttagattttagatttagttttttagatttygttttygagttygttyggtgggtttgtaggtyggttttttttygtttagaggagagygtagataygtaatgttygttygttggtttygttygttttatttttgtttttygygttttttygtttyggtttttgtttataggtygggtyggaaygttagttttaggagtygayggtggttttttgttygtttyggggaaggtgttgtttttttatyggttttaatttttygttyggygtttggggtttggttgyggggttyggtttttagtygagggygtagggttggttaggtttgttttggttgaggtggagatttygtttttagggattgttgggygtttttgtttygygagtaaygagatygtygygagygaayggtttttattgagtttatttttttaagtgttattaygttaagttagagaagygaggygagtggaggggaygtagaggggtyggaaaagttatttttttttggtttygtttttagataaaaaygggagtttggttyggtattygggygttyggtgttttyggggygttttattgaggttttgtttgtaaaattagygttygtgttttgaagygtayggygtttggaagttgtttttttgttygtttttttygaggtttttttttgtgtagygagtttgagaaatatggaggatygtttttygtaagygggtggtygygggygtttttygatttttgggtgaagttagagggaaaayggggttttygggttagtgttttattttttatttygggagaaattaatgttyggagagggttygtttgattygtatagaaaggtygattttgagggyggyggtygttygggggagaaagyggaggttttgggttygygggagygyggtagtyggggttggtatygtagaggagagataygttattgtttygtatttttagaaagygygaggygtygttttagttggggtaggyggtygaggtyggtttttatgygygtttttygaagttttttgaaatattttgyggagtttygtgtgtatagaatttagtatygtttagtttttgggtagtttaattttttgtagttttattttagttttttyggttttttgaayggtgattttttttatygtttttttagagttgtttygtgtttgggtttattttggggggttyggtattttttagttatttttttttttatttattttttttttttttatttttttttttattttttattttttttttttttaggagagygatttaygaatttttttttttttagttaattttagggtttagttygtagattttgygagggtaggtttttgtttatyggttygttaggygttttggaggtgaygttttgttttttagagtttttgttgtagttaygaattggggtttgggtygtaggaaagtatagggttgaagtttagygttttggggttatttatattgaggtagttagaggtaaagagttttaagaatttagaaaatattttttaggaagtygtttaattggtttttatgggataggtggagttattaatttgggatggttttgtaggaattaaagagtttagggttttttttttttttaatattatgtttaggagatttagagtygttggatttttttttttttgattggtgattattagagtttttagagttgtagaaaattttttttttaaaaaattaagtaagygttaataagattttttataaatttttattagttttattttttyggggggtaggtagattgtggggtttgattttttgagattyggggaggatttttggtagatgtgtgtttagttagaatatttggtaaggatttttttaatgaagaaaaagtggaggaatttagttttagygagaagaggtttttttattttgttttagatatatyggatagagggtatattttgattagagttaygtttagtggttaggaggttagtttagtatttttttttttattattttygttttgggtgggggggtaatttttttgggagtagttgtgggaattgtygttttttattttagtttagttagtattttgaagtttgtaggggaaggatagtaygtgggatggatattggggaaggagtttygtaaggttagggtgtaatttttaggttttaggtggtttggtaggttaygttgtttyggagatgtttgttagattttttaagtttatttagggtttggtagtaatttgttggttgtttttgygggggtttgggttgttgagtayggtgtagttgtttagggttaattagttttagggtgttygtgttaggttgyggttttttygtttttttygtattgagggtatttatggygtgtaaatgttttygtatttttagagttgttttatyggatgtttttaggaatttatatatttttataaaaatgtattttaaatgatggataggygagtttggggtaataaygggtgtttggtgggtagataagagtaaatgggaaggagttygagggaggagggggaagagaagaggaaatagaatttttagttggatattttgataatagttggaaggaaagtttagaaaagatgaagagagaggaggggagaaattaattggggtttttatttttgtygttggatttttaattttygttttaaatgggttttgtttttyggtaaaattagtttaaaggattttaaaataaagaaaaygagatgatyggtttgggagttttttaattagagtagagaagttagaggggggygggygatttggttttgaagttttagttgaatagttattttttttttttttggtaaaaaggatttttttagaattttygaggtttttggattttttttttygtaaatggagtygtatattgtattttttygttttttyggatygttaagtatgttttatgagggtygttgttttygggtggaatgyggtygtatgtaygygtttttttgtataygtatatataygtatatttataataagtgtttgtaggaggagtgttttgygygttagttttgygtttaagataggaagttgtygggttatygagttaaatgggagtgatattatttttttttattagtaaggaaagyggattataaaagtttttttgtatttyggtagtttatttaatattatttatgtattttgtgtaaggaattgtgggatttygttttayggtaaataatatggaaattttaaaaatagygatttttttgtgygtgtttatttaygygtttyggggtgatttggyggggttgtygtygggtgatttatatttttgaatygygaagygatagggaaagygygggygagygtaggagaygyggtygggggttttttygggtttttgggttttygtattyggagygggggaygyggtygttttaaggggaggaggggyggygggttgtttttgttatttagyggyggtyggagygttaygtgggygygyggygtygyggttattggttygaggtaygtgtttaggagatyggtttgygaygttattygagggggttttgttaaaaataagaataaaaatttagagtgaaagtgttttaggttgygtygagtggtttggaaattttygagttygygyggaggtygaggyggygagggyggyggayggtyggggagygygggyggtttagttyggttyggtygggttttggtttygygttttttatttatgygattygggtygyggagttttgyggggttyggygggggygyggtygtaygtyggtggggygtttyggttygtagyggggyggyggtygygaggagggggtttttatgtgygtgygggyggtggygggygygttgatygygggygttyggtattttygagggtyggttagggygtgygggyggggayggtygggyggyggyggyggtyggagtyggttygggygggygtgagygtyggggaaygygttgtttgtatgygygtagttttygtttygggyggtttaggyggyggygtyggagttygaggyggtyggaygyggagaggagyggggagttygggaggyggttygygttttygtyggattattgygattgtttagatttyggttgygyggygaagtygaggatttggttttgttgaattttttatygtttgggygagyggggyggttygtggtgtttttaatttagttygtggatttaaaggtggtttygygtygagygyggtyggygatttgtaggattttagttttggtygyggtygtygygtaygttttyggaagattyggyggggtgggggygygggggttttygtgtgygtygygggagggtygaaggttgatttggaagggygttttyggagaattagtgtgggatttattgtgaatagtatggaggagaatgattttaagtttggygaagtagyggyggyggtggagggatagyggtagtyggaatttagtttyggyggyggttygggyggyggyggyggtagtagttygggygaagyggatatygggygtyggygggttttgatgttgttygyggttttgtaggygttyggtaattattagtattygtatygtattattaatttttttatygataatattttgyggttygagttyggtyggygaaaggaygyggggatttgttgtgygggygygggaggaggaaggggyggyggagtyggyggygaaggyggygygagyggtgyggagggaggyggyggygygggyggttyggagtagtttttgggttygggttttygagagtttyggtagaattygttatgtgygttyggygygggygggtygtttttagtygtyggtagygatttttygggtgayggggaaggyggttttaagaygttttygttgtayggtggygttaagaaaggyggygatttyggyggttttttggaygggtygtttaaggttygyggtttgggyggyggygatttgtyggtgagttyggattyggatagttygtaagtyggygttaatttgggygygtagtttatgttttggtyggygtgggtttattgtaygygttattyggatyggttttttttaggtgagttygyggggattaygygtttyggttygtygyggggaggttygyggagttggggggyggtgttggygygggaatttatygggaggaaaatatttygaatttttttygygtataygtataaagatttaygygatattgtgtgaagttgaygtyggttygggtagyggttaggagtttagyggtaggattgattyg

SEQ ID NO: 6077 - DNA, 5566 bp, Artificial Sequence; identical to SEQ ID NO: 6076
  Description of Artificial Sequence: Synthetic polynucleotide

SEQ ID NO: 6078 - DNA, 1164 bp, Artificial Sequence
  Description of Artificial Sequence: Synthetic polynucleotide
gygatttgtttagygttaaatygyggttttagttttttttagttttyggtttagtyggtttattagtyggttygygttttgtagtttttttagagggaygygtttygagatggagagtaaagttttgttygtgttgattttggtygtgtggttttagagtttgatygtttttygyggaggggtggtygtygtygatygtaagttttgygygtaaatttttttttatttgtagattyggygggtggttattgttattygaattgaggatgagaagaaggaagttggaaggggyggtggatgygtttagggatttttttagtttgggttttagtttygaaayggttttyggagtgggatttaggaggggtygggagggaattttttttygatygtgaagyggyggygtttagttttygttttttttttttgtygggttttygygttattttttttattttggttgggatygygttttygggttygtaggtttygtyggggaggtttyggggtgtgggggtygggayggyggaggyggggagtaagggttyggttggyggtgatttgtagttatttttttgtyggaggggttttggaatgaaaggygygygggttaaggtgatttygttttggttggtattgyggtttagttttygttyggggattygygggtygattgtggttttttttggggaagtyggggygyggggaggygtttygggtattttagtygtayggggtaygttygttttyggyggggtttttygtttygttgtgggagtggtagtgggtgtyggggtggagaaagtaygygtggygyggagttttggggaygyggygttttattygttttggggagtttyggattttttttagtttttaggttygtatgtttttttttttttagtgttttgagaatttagygaggggttgattttttygaaatygtggygtagttattagtaatttgtggtygtygattyggggggttgttaggtttgygtttggttattttttttgttttgggggttgaggttagtttygggygttyggtttygtygygyggttgygagtaygtggggttgaygggygtygygtggaggtagygagtataayggtggttatygtygttagggaatygttygttygttggggtttaggygttyg

SEQ ID NO: 6079 - DNA, 1495 bp, Artificial Sequence
  Description of Artificial Sequence: Synthetic polynucleotide
tygtaaatttttttttgygtygttttttttygygtggaatgggayggagtagtttttttaggygttgtttggttgyggaggggagygggtagygagagtttygggttttygtttgggttttygggttttyggggygttggtttyggttttygygtagygtttagygatttttgtygggggttttyggtagtygygtygttatttttygttyggttagygygggaggaaaaggggttgygttygggagygtygagtttaggtttttttyggtggygtgttygygttttggggtgggggtgtggtggggaagagggagggggygaggttaggggagggtgygaaggaggygtttgtttttaatttgygggygggaggtgggtggttgyggggtaattgaaaaagagtyggygaggagtttttygaaatttgttggaatttygggttygygyggaggttaggagttgagyggyggyggttgtyggaygatgggagygtgagtaggayggtgataattttttttygatygggttgygagggygtygggtagaggttaggaygygagtygttagyggtgggatttatygaygatttttyggggygataggagtagtttygagagttagggygagygttygttttaggtggtyggatygttygtygygttygygtygygttttttgtaggtaaygggagaygttttygygtagygygagygttttagygyggtygttygttttttttttygagggataaattttttttaaattygattygagtttttggattaaattygtttgygtygagagtygttygygtagagygtttygttttyggygagatgttygagygtaaagaaggtagaggtaaagggaagggtaagaagaaggagygaggtttyggtaagaagtyggagttygyggygggtagttagagtttaggtgggtgygtagygyggttygggttttaygattttttttttgttttttttatttttttttttttttggatgtygtggtttttttttttttttttttttygtttgtttttttygttttgygttttgagygttygttgagtygygyggtgtttttttttttgggggtygtygtttatttgggygtygagttttatygggygtttaygtttagagtttagggtaagggatagtagtttyggtygtatttttttagagtttygggagygtttygttttttggtayggtttttttttagygttttagyggttgagtttagttygggagtgggatttgggttataggagtygaggttgygtgygygygtgtttygygttataagygttttgtaygggggtygtgtgttttttagygggaaaygttggaatgggtygtttggagggagagtyggttttttyggtgtgtttggtagygtagaagtgggtggtygagtaagaggtygygtgggaagttagtttyggygttttggggtatagggtaagygatgtagagtgygygtyg

SEQ ID NO: 6080 - DNA, 352 bp, Artificial Sequence
  Description of Artificial Sequence: Synthetic polynucleotide
gygtttttggtagtagtygtttaygttttyggttttgygtatygggtttgtttygggaggggygygtgaygttatygyggggtagtygagaggggatygygggtttygggtagggtaggygttttygtagttttagttataatataagggagagaaagtaaygttttggttttagaaatttttatygttaaggttagttttggttagaygtatagttaaagagtttttttagtttagyggatgaatygttygygagtggtattttttaaaattttggttttattttttaagatgtttttttattgygtaatttagaaagtattyggatygtygttatttattagyggyggyg

SEQ ID NO: 6081 - DNA, 1141 bp, Artificial Sequence
  Description of Artificial Sequence: Synthetic polynucleotide
tygtttagtttttagygttgygttgttttygygtttatyggatgattaygaatatgattagygagttgtttattaagtttaygaygaatattayggagtagatygtygtgatgatgatygggatggtyggggagatgtgygygggttttagttgygygtttttygagtyggygttgtygttgttgtygggttyggtttagtygggaaattaggygttgttgttggggggtaggtaggygttyggggygtaggtagggttyggtttttygyggaagatttggatyggggagtttatggtggggygattgtagtaggaaggygaggataggyggtatttgyggygttgygggagygaaagaatyggttggaygyggagaggtaaattttgttygygttttggttagyggygttggggattyggagtttgyggatttttattygggtygtaagtygtygggggtaggatagggagaayggatttttygttgttttttyggttagtaggygygtygttgggtgttagagaggggygaagagygttygtttttttttttttagtttttgaggtgttttttttattaattttaggtatyggtttttggtggaattgtttttagattgtttgagtttttagggttaagttttttttttattttttagtayggagttttatttagaattgtatttygaaagtttaaagtttatttatggtttttagagataggygaaggygaggttttttaygggaygttttggtaggtgttgaatygygygtttaygagtttygtttagtttttggtattatttgttttyggatttyggtttygtttttygttygagggttgttgtttygtygagygtagttttygttttttagygtaygttttttattattggyggyggttttgyggggyggggyggggygggatyggygggaygtagtygggaygyggttgggygttgggggtttgygggyggagagttygtttggtgygttygttttaggtyggtaggtttttgtttygtttygttygttyggagttagtttttagttttttagttttttagtttygygttttttttagtttygtaggttygttyggtttattaattgttygagyggtatatygtttggttttyg

SEQ ID NO: 6082 - DNA, 3297 bp, Artificial Sequence
  Description of Artificial Sequence: Synthetic polynucleotide
tygttygtygtttygaagttgttyggttttttttttagttygttttttagtttygtaaggttttttttttatttttttyggygattttttttygaggtttttyggaggygtttggattttttttttttgtttttygttttgtyggtygttyggttttygagggggtaygaggagttgtygggtygtttttygtttttgttyggggyggygttggtattgttyggtygattttyggggggtygttygttgaggtttttttattyggtagttaagtttagggaagaagaygttatygttgggtagagttygtttatgtyggtgagtatygtggtttttattaygttttatatttagtttttttaggatattagtttttttygattttttttaattttaattgattygtttygttggggttagtagtagggagggtggtaaggtygggaaggtygggaygtggttgggtaagttttaggaygggatattggyggttttygggatatygttttttttygygggaagatattttaagttatttttttttgggttattttttttttatggtttaagaaaaygggagggagttttygttttttttygaggttgttttttaaatttttagygtgtygttttttttygtttatttygagttttttttaaaygygttttygtttgtttttagygttygtttttttatttttttgttttttyggtaggtaagggaggaaatgaygtgatgttatttttgtgttaggttagtttttagttttagtttagtttttygggttttagggaattaatttygyggttttatygggttttattttygaagggaygttgygggttayggggataygyggtgttgygagttyggagagttgggyggttgggttttttttttygttgttttttggtttattttttttttyggatttyggagtttttggagaaggggaygyggagggygattgtygagggttttagygggatttggagttaggggttagtttttttttttatttttygttyggttgttgggtggggttttygygttttggttagttgggagggggygagggtygttttttagggygggaagatyggaggtttaggttgygtyggggtggggyggggatagagtttagagaggygtttygggtyggggagaaggtagggggttgttttttagagaygygtagtttatagaygygaagttttggggattaagygttttttttatgtttgtygtttattttygtttttttttttygttttttttatttaygaggttygagtaygtagtttagtatattttagtttygttyggtttygygygtygaggggaggygatgatatagagggtttygyggaygttttttaygygygtttggtttygtatttatatttttgggatttgttaatgyggggttggagtagtggggttgyggtyggggtggaggtygygtttygygtggggtttygggggtatttttagtattygyggyggtggagtgygtygtygttggagggaggygagaygtgggattgttyggtygggtaaaaggagtgagggggyggggaggaggtagagtaaggggaggaagaggtygggagaagagggttagagtaaagatygagagtyggagaaaggygaaaggygyggtgagtaatygtygaygtagagagggtagtttttygygttgtaatattgagaaggtattygygggaygtatgygtayggyggayggaggygagtyggtyggggtttttttttyggtyggtagggtggayggtgggttygtgagtattttagtttttygaatttttttttttygtttygggttygttttgaggtttygtgttggaaagtggtygaggttgggaggggygygtygttygttyggattttagggtgtygtygttgttgyggggygggagtyggtgygagtygggggttttttttygtagtgygagtttgggggagtggggttgygagtgygttygygtgygaagaggggtatygygttattaggattaatatgtttygggtttgttagggygttygygattttatttttgyggtttygygtyggtgttttggtggggaaygygggagtttagtttttagattttagaaatygtattgattattygaagygtatttyggaaagattaggygggtggaagygtyggtttttttaygggatagggagaggataaggaaggggttgggygttyggggttggtggtttgagygtygttgggaagggtaaggagatagagttttttggaatygtagygtttttttttaggagaagtgtaattagggtaggggtatygaggggtagggtgaggaagtggaygttttaygygtggattttagaagatygattaggtatgggygtttattyggagtttttgtttaygtttttgaaaatygaatgaatagagaagtgttttttatttttygtttgygttagggtagttaaygtgtaggygtygtygggatttttttggaataaattygggtatttgatttttygtattttyggagttgttttgggaagtygaaataagtttgggygttyggattgyggagattggaaagtagggggyggagggygggagattgggggygggaagtggaggtgtaggttgtagttggggatygyggtgggygttggaggggagggtttgtgtgygyggttgttttttagygttgggggagyggaygggttaggggtttttagggaagyggygtttygggatyggggtggttttttygtttttgtgtgygyggygatttttatatttagttygggyggaggagttttgagagaagyggttagttgagagtggggtgggygttttggggaaaggtttgygtgygttgyggttttatygttgttagagaagtggaagagagagagtgggygtygggagggggtttataggygtygygatttattttatttttttttaygtttgtgggggagtgagtggggaaggggttttgggagaggyggygygygggtattgaggtgtatygtgagtttttyggatttgatagtattaaaggaaaattttggygagtagttagggttagygagygattttagtagtagggaygyggtygtgygagagttygyggataggygagggggattttaggggagtagttgttgtttaygggttaygggygatgtayggagtggagaagtgaaygtggtttataggatttttgttyggaaggtggagagygttataggggaattttttygatttttgttygtttyg

SEQ ID NO: 6083 - DNA, 2213 bp, Artificial Sequence
  Description of Artificial Sequence: Synthetic polynucleotide
tyggttttaaaygtttttttagttatttgtgaatygygaaggagtyggttttygyggyggggattttgttattagtattttygygggtygaggtygttttttyggtyggtttttygttttattygaaaaggaattagagtatttatttaagayggtgattggtagggtagattaaggtgttttggtttyggttttagtttygyggtgygtttygttygtttattttgatygggtgtaggtagttatygtygygtagggygtttaattyggygttygtyggygtttyggygtygttttgtaggttgygggtgagatgygygatgtaggtggtggttagtagtagtaygtttagtttggatagtttggtgtygggyggtayggayggtagygtgygttgtagttttaggaaagygtgtygtagggtttgtattyggttgygttttygygtygtattygtygtygtyggtygttygttttyggaaygygagtygtttttagggttygtyggtttyggttyggttygttygggaygygagtygyggatggyggyggttaggggygygggttyggygttggygttgagggggttgttygttgggyggtygyggtttatggtagtttttygygtygygygygttgtaaaggatygaaggtgyggtgaggtyggggggyggtygggtttaattygagaggygtagttttttggtttttttygtgygtttattagtagtttaayggggttaagggygtttttaagygagttygttttgtttgggaygygatttgttttyggaygtttggggagagttgyggaatttyggagtttttgggttttttagaaggataagaagaggygtagtgtyggttttgttttttaggggtaaattaagtaaaaggtttattttattygggaagaaagatttyggaagtatagtttaggattagtattygttygygtttgggtgattttatttaattyggtaygtaygagaggtggygyggttttttttygtygaygtygyggaaaattayggtttattagtygttttyggttttttaygttaggggggatttttgttygaggagygggggatttttagttttatttyggggtayggtattygttatygtttygagttygagagttgygtagtaygygtttgaygggttttttattttttttggagyggttgagtggagtttygtttygtygtgagggygggygaggggygtggagtagggtttgtgtggttagggtygygttggttattttattttygttyggtygatgtttaagtygayggttgtttttaattttygttggttgtgatttttatgygggygtttygyggttaggygtgtgtgtttygatyggttaaggtaggtygggyggaggatttggtttatyggagaggttaygtygggggttgaggyggtttagagggttattaattaaatttttyggyggggygggttygggggyggggygtttttttggtttygtttttyggtttattgttttaygttgtttttttygaggygtttygttgagggyggygtgtggagagtttggggtgtttgtygtyggttgyggtggggtygggttggaggtygygggtgaggtttgtggttaatttygygttgtygaggttttattttttygagtttagtttgattttaggtygtttttaggtyggtgtttagttgaggygggaaygttgtagtttggttgagygtgatttttaggttttgtgaggaaaagtygagygygttatatygaggygttagtygtttattttattataaggtaaaagatttatgttgttttagttattttaaagttgggagatatattgtattttttattagatttygaatgtttttagtgtttgtaattttttaagaagtttttagagtagatagtttttggatygtgggtattttttttyggggayggggattttgttgatygttttygttgttttygygggggttatygttttttaattatttgggygaaatatttttttttggttttgtatttgtggatttaygggaagygtgatttgtagygaggtaggattygattttaggtttttttagaaagyggaygttgygttttaaggtttgtttagagtygttttaggaagtygtgggttttygatygttttaaatygtagyggtttttgtaggttttggattygtygttttyg

SEQ ID NO: 6084 - DNA, 363 bp, Artificial Sequence
  Description of Artificial Sequence: Synthetic polynucleotide
gygtttagtayggygggtagygtygygttgygtatygtygtygattatgagygaggatagtygyggagatagtygygtygagagygttaaggatttggagaagtagtttygtttgygygtgtgygtgtttagygagttttagaagatygagygggattatgtgggtaygttggagtttttggtgtyggtgagtgttttyggtagaygtagggggaygttygggyggygyggggygygggtttyggagtggttgygggaaggaygygyggtattgtttgtgyggggattygggaygggtyggggtattataggygygggaatttaygtgtggattttgygttygygggygyggtgattttygyg

SEQ ID NO: 6085 - DNA, 960 bp, Artificial Sequence
  Description of Artificial Sequence: Synthetic polynucleotide
tygtttttygaygttttaattagttattattttttygaaggaaaataaatyggtttttgatatatttttttaygtgtagygttygaygttaygggttttgggyggttgtattttttttttgtyggttayggtttaaggttttattattgygygtatttagtttttttttaggtgattttygygtatttggyggyggygttttaggtttyggaggttgttygggygggttggggttygggyggygttygttgagagtygyggygttttttagtygtttttygggygtygatygtygtttttttgtttyggggtggggtttaggggtattagtagtygygggttttyggtygtygtttgggaatttagggttagatttagttttataataaygttttttygttayggtaatttaattggaggtagaagtyggyggggyggtygagyggggyggggygggagygyggtygtygygagttayggtggggagygggygygggggattttggygggtttygggtagygyggttgtatttatttgtgttataattgyggygayggggggttgaggaatyggtttttttaaaagtaaatygaaaatgggtaatagagaggtyggggtagygttaagaggggttttgtttyggtgtttagggtaaaaaattyggtttyggtttttagaaattygagttagyggtggtttttttttttttttttttttaaaygtttttgtgttttygggtygaggggygtttttygygyggtttygagtgtatagygatattagggttggygttggagaggggagttttttttttagtatttttygggtttttttygtatttttatttatagttttttttttgggttygaygttttttygttttgtagtyggagtttgggtttggtgtttattgtttygyggggtgtttyggaygtttggtttttgtagygttttttayg

SEQ ID NO: 6086 - DNA, 1404 bp, Artificial Sequence
  Description of Artificial Sequence: Synthetic polynucleotide
aygyggggttttygggaatygtygtttttttttttygttttygygttygygttttttttttyggggtttyggtttatttatttttggtgyggtttygtyggatttaggagtttyggtygttygggttgyggggagggggygtttygggtyggttttagaagttattttgtaaagaggtagggggygyggggtygygyggggygagttygggattygyggggaagaagtttttygggatygygtttyggtygttygagtttttygygttygtygttttttatttyggtygggggtttatttgggagttygttgttttyggttagtygttygygtgtgtttagggttagtagtaygtataagtgttagygtayggtygtygygtttatgtttaatgygggtttygttgggygtgygggygtgyggggygyggggattygatygatyggtygttttygtaggygttgttygttgttygtygtttygttatygttygggttttygagtygtttagttagttyggttgatgagttgatagygygygtttattggttygtggygtyggaggggyggggygtygtttagggtyggttaatgggygtyggttttyggtttttygaggaagaggggggttygggygtygtyggggggattttttttttggggygggyggtaggtggggggtgtgggtttggtyggtyggttygttaggygyggggtttaggttaggttggggttgtttggaggttgygtttttttttgttygyggygtttyggttttygtygtygagagtggaygtttttttggggtaatttttttyggtttagaggtagtttygggggyggggattttgygaatyggggatttygtgaggtygttygttattygtgggtagtgaaaygygttagygygtagagtagattygtttgygttgtygtttgttggaygttttttgagtatttattggggatygagtgygggygaggtagtagygaaggaatygggaggggaaatttygtgaagattatttgaaaattgaygtttaaaataaaygaattttttagtattygttaaaggatagtggttygttagtgtgtttgttayggggyggtygtaggatttgygtttggaatygggygggygttygggayggataatgtygtttggyggtyggtttygygggaggttttygtayggggttaatttyggtyggygaagttygttgttyggaatgygaggtygaggtttttttttgtgatagatygggyggggttaggaggaggggtagggygggtatttyggttygaagatttaggaattgttttggtttggtttggggtttatatttgaygtttggygagggttggtttygggtttggttttatygggtttgggagggaygggyg

SEQ ID NO: 6087 - DNA, 1247 bp, Artificial Sequence
  Description of Artificial Sequence: Synthetic polynucleotide
tygtggggtattaygygyggatttttgtttggyggtttttgygttyggggttgttgagttyggggttygttttgaggtygyggttgtggtttttggttttttyggttygygttattgtygygyggygttygttgtattttgttttttttgyggtttygtatgtttttggtggaatttagttyggyggaygaygaggaggatgagatggaagtttgttggaaatygggtaaattttatagaaaattgatgaggaagayggtygagagtaggattttgggagtatttatggygggtaagtggttgygtttttttaggaggyggtggyggyggygtaggaygygyggggtayggagyggttggatagyggtyggggttyggtttttygggyggattyggagtgygaggagtygggttttagttatataaatttyggtttygttaygttttttttygtttttygttgggaggggaggaatggggagggagggtagaggaggggtggggagggtgggaggagagtygggtggtgygggtyggaggtgtgggggagaggggtygyggtgygtyggtgtggtaggaagaygtagygttttygygggaygygygyggggttgtygggyggtgygygyggygygggtygtaagygttgatygggggaaggygggygttgtyggttygtggtyggggagtaaaggttggttygtygygttagggtttttttygaattttyggaggtgtggttttttygtagygyggtttyggttttyggttttygttagtygtttttatttttttgggagygagyggtttyggaggagggaagyggyggyggygtttttaagagatagtttggagtaggygtttttgttgtaggttgygtgttgtttyggggyggtggtatttttttttttyggttttaatygttaggtttgtygtttgygttttttaggggttagttyggagttagagaagtttygttttgggttaggygtagggtttagttyggaatagttttattttttyggttgggtatygttttttataaagataggygtttattttygattttygaggttaggtaaaggttaygagtttttagagtttggatygatgttaaaagttgttgygtttttttgtaggttttagttttttttttygtagtttttaattttttttgaygtagattttagttgttttattttttygtttgttttygggattttttttttttygyggtttgtttttyg

SEQ ID NO: 6088 - DNA, 1861 bp, Artificial Sequence
  Description of Artificial Sequence: Synthetic polynucleotide
tyggtgagtagagtyggygtagttatagygyggagtygyggygtttattggttttyggagttgttaatyggygtgtaattttgtaggaatttttttygggtttatttgggagttatattgtygttttttttttttagtygtttaggggagtttggagaagtaggtttaggagggagggagttagaggaaaagaagaggaggagaaggaggaggattyggggagggaggygyggygygggaggaggaggggygtagtygyggagttagtggtttygtttggaygygttgttttttagatattttyggagttttagtygygyggatygygygttttygtygttttgtttttaaatttttgtygtagtttttttttaagttagygaatttattttttaaaattagaaattgaatttyggtaygggaaaggagttygyggaggagtaaaattatagtagagtaagaagagttttagagagtagttttttyggagtattaatttygtgtygggagtgtagaaattaataagtgagagggygtygygttttyggggygtagttgygggyggygggagtaggygtaggaggaggaagygagygttttygagtttygagttygagttttygagtttgagtygtaatygttgyggtattttgtttyggattygtgtgygygggttgygtygagygttgggtaggaggtttygttttgttttggttgtaagtagyggttgggagtagtyggtttttggggaatatgyggygygygtggattttgtttattttgggtttggtggtttgygtgtyggyggagtyggtgagtgggttaggyggaggatgygygygtygtttagggtgtttgaagttaygagaggagttygtagggaataggggagygttatttggggaatttttagtttttaagtatatatyggagattygttgggataaatgygttygttyggttattttttttttttttttttttttttagaaaagygttgttygttggygttatttygyggttygygggaatgggggtatygagaattgyggtttggtttagtygtagaggtttttgaagttatttttaattttttygttttyggygggttttgttgygtggtttgggaaggayggaggggaaagggtggtaggaggggggagtttgggtygggttygygagggaayggttttatttygygygtttttygagattagggatgatttggaaatttyggggttttttttttygtatattatttttttygygttagtttttttgtttgattgtatgtaagttttggggagatgggggttagatttaagagattygygagtgtttagagagaaaagtttgtaaaagtttttttgtttgatgttttttgyggttagggygaggtaatygatattaygtggaatygtagtaggygattttttaaggggatattgggggaggtayggaaygygttygaaaatgttgggaygtyggttattggatttttagttttgyggygatttttttttygttgaggggtggaggttgtatygyggggygttagggaygggaggatatttttataggagttataygggagtgtygtaagtagggygaggyggggtaygtgtgatayggygttyggtttygggtygtttggtygttgggggatagaggtttttttttygttaygttygttttttttggttttggyggggygtttttggggtygggaggagtttygttttyggyggagygtttgtyggtatttagtttttttttttygttttggyggtgggaatttgatttttttttttggtygygtttygggggttggagtttgtttttttaygtygtttaatgagyg

SEQ ID NO: 6089 - DNA, 3044 bp, Artificial Sequence
  Description of Artificial Sequence: Synthetic polynucleotide
gygygygtgtggaaggttgggtggggtgygtatataygtttatttgtgtaygtatatatatatatatatatatatatatataggtatatatattygagtttagttatttatattgtttgtttagggygtttggaagagttggygagttygtttagttttgtttattyggtttygtttygtttttttygggagggtttttygggyggygtttagtttygagtagagtaaaggayggyggyggttattttygtttttyggtygttggtttttygttttttttygtttttttattgaatttattttygtgtttygaaaatttgattttaattygattttttygygttttygttttttttttttagagtgagygttaaaaagggtttgatagatagaagtttttggttttagtatyggtttagttygtttttagaygatttttgttttttttatttttatagtttttagtggtygttttattttygtattttttyggttaattttaatttttttygttttttttygygttgtttygygttttttttttaggattttttygtatatttttagygtttagygyggttttttataatttttttaygtttygtttttttygttttgttttygttttygatattatttgygttttttattygttttaatttttttttttygttatttttatttgtgggtttttagttttttgttttttttttggtttttatttttgatattttagggattttttttttttttttaygttttttttttttttaggatttygtttygatatttyggggttttttygttaygygtattttttttttttaggttttgatatttgggygttttttttttgttatttatttttagttttagttttgattttygggygttttgttatttttaygtttttygtttygtttyggtttttygggygtttttattygtygtttttatttttttatttgttatatttggtatttttgtttttatttttgtttatatttttttttygttttygatatttygggygtttttttataygtttttattttttatattttygttttygaaaattygggygttttttttttttaygtttagtttttttttttttttygttyggtttyggatttagtttggagatygygttygggaggggyggttgtygttygyggggygttygyggtgttygggtttgggtagygaggaggtgaygtygttttygygggatgagttygggaggyggaggggyggaggaggtgttggyggyggtattgagyggyggyggygtagggygygygggtttttygygtygattttatygatttaaggggyggyggyggtggyggyggttgagygattttgggtygggygygtgatgaggaggggtyggygttagatttygttgtaygtyggagttygtttggattygggygttggtagtygaagggttttggtttygggatttttygtygttagttttygttatatttttttygttttygtttttttattttagtygggggtggggtgggtggggttggggttttygygggggttttyggtttygyggttygttttygggtgtgtttggaggagttttttttttgtggygygygggagttttgtgatgygttagtyggygggayggatgagttgttttttygggaaatygttttygtttttttaygattttttyggttttygtttgggtgtttttygggtyggtagtatttygttttygggygttygaagygagtttttygggggtttgttygtaggtattttttttttttygaggyggygygygygttttyggttttgatygyggtyggatatattygygtttyggttygtttgtygttttttygtttgttttttttagttattttatttttagttgttttygttattttattttattattttttttygttttttygygtatttygygtttyggtttttagttttttttttttttgaatygtttattttatagtttttygttttygggaagaagaaatatttttygaagygtattttttagttttttttttttaygygttygtttttttttttttttgttttttttgggggaggggggttgtygttttggattgaaggttattgatttgtatgtatttgttttagygttggaggttgttttagtygtygygtyggtgtygtygttgttagtggagttgttttttygtttttttagggtggttyggttttattaaatatgtyggtttttgtygggtttyggggtygtttggtttttatttyggyggttttttagtygtttttgtagttygagatgtttgattttagttattttayggaggaggagaggaaaattattttggtygttatggataggtagaagaaagaagaggagaaggagtagttygtgtttaagtaaggatttggttttatattttygtttttttttttgtttttygttttttygtttattgttttgyggtygtttgygygttttagttygtygttttttttttygttggyggygtttaggttaygagggttgyggttagygtyggtygttygggttgttttaggggtgtttgagagtaggggtgtgtgtyggggagggagggygttaaggtyggttgaggtgagggtggygagttttaggyggtgtgattttttttggygttttttyggattttttygttggttattttggtttyggggttttagygggattggggttgaatttaggttttgtgygtatttttttttttttygtygygttgaggtagtgattggggtatagaatttaatatggtygtgtataggtgttttttggayggattygggygaaggygygttggtaggggatgyggaygttattttggttttaygttttygyggggyggttttattagtaaygygggatagagtagggttgtttatagtggttgygagtagygggyggyggygygggttaggggtttaagttttgtygyggtygggtgggtgtgygttygtygttattttttagtttttttttttyggyg

SEQ ID NO: 6090 - DNA, 1603 bp, Artificial Sequence
  Description of Artificial Sequence: Synthetic polynucleotide
tygtatttygttygattaaggtyggggtygtagtttgtattyggattggatttggatgtagttaatttttttttggttgatggaatagttttttttttttatagtttyggygygtttttttttygygygtttygtygtttttygtygtagaataggagttgygyggttyggagyggyggyggyggygtyggagtattygtttygtaygtyggggygaggggygagygagygygttttttttttygygttttgygttttygygtttttttttttttygttgttygttttttygtttttttttttttttttttttttttttygtgttattttttttttttttttttttttttttttttttttgatygttygtttgtatatttttatttttttttygtygttttttttttttttttttttttttattgttatattttttgtgttttygtttttttttttttatttgtttgtttattttygaaygtgaattygyggttttyggaggagtttagygttyggagtatttggagttyggtyggyggygggtygagtttggttagyggyggyggyggyggyggyggyggygggagtygagggagyggtagtygygatygygggtatygygggagttttagyggtagtagtygtygtygagatgtttyggygaaagtaaagtaaatttyggtagattaaaygtaagtttgygygyggggtygggagttggtgggattattgtttaggagyggggtgygygggaygggaaagyggtgggtgggtggyggggttaggggagattygttttyggttttttagatgttttaaattttgtttgagtagtygaagggataattagatagttatagatagatagayggttagttygagtttygggtaggagagaggttgygaggagtagtttatgtttgtttygtttagttttygygttttygggttgtttttttaatttygattygygtaygttgygagttttyggygttgtygtttagtyggaggggtagtttygtttttttagaygtttattattgttgttgttattgttttgtgygattgaygtgggattatttttgggaattatttttagtaattagggtagaaattttttagaaaagttgggyggtygagatttyggggygagggaggtaatttttttaygyggtggaaaattagagygttagggtttygattttgggyggtgttagagttatattaaattygaagygaaataaaaagtaggtgtaaaagttygygtttttgyggygggyggtygtgygtttttgttttgygggygygggttggtggttggtaggtygtgttttgggatttygggygggttyggtttaygtygttaggaygtttagtygagyggggattygggtggtgtttggttttggtggygygyggagttttttttgggaggggtygttagttattttttagygyggaagttgtgagtttaaggyggtgggygygtaggggagtgtatggttttgagttttygggtgttygggggtttygatggtgtttagaggatayggygggttaagagatatttttygaaataggtaygttygtagagattaagtyg

SEQ ID NO: 6091 - DNA, 1365 bp, Artificial Sequence
  Description of Artificial Sequence: Synthetic polynucleotide
gyggygaatatgagtgyggatygtaygatttagttttgagygttygattggygttyggttygtygagtttttagygygtttygtttyggtttttygygtttttagggtatagaaaatagagtgttttgtagagttttagggttttaaaggtggggattggggattygtaaaagttggggtggagagtatagttttgattatttgagttttyggagttagggygtgagtgagygtttttataygttatttttgaagtttattaygtatttttggtagagagggatttatttygtttattgygtttttatyggttgttttggtagtggttgtaatttatgtagtttagaatgatgagggtaaaggagaaaaggygaaattgtatttgggyggtygggygggggagagaygttttttaaagtttaggaattggagggttygtttaaagagtyggygtyggtygygttgttggggaggatttagagggagattygttatttattttygggtygtatyggttagtttagygygattagtattttttygttaygaatttgagagataagaagygaaaatagggtgtgtgggggatggagagagtttyggggaggtagttgygttttygtaygttttaatttaaagaagagagggaaggaggaagygaatttattgtttagtaygagtygyggagyggtttaatttagagygggtagttgyggaygagttggagaggaaggtgattataattagtgaattagtaatttttgtygagttttaagtttygatttagyggtataatgygttgtgtyggygtttyggggaaaggaaagaattttaaaggtattgagagygtagggttaaaagaaygtttttaggttatttggagtttayggyggtgtatttaagygtygtagttgyggttgttttggtgtgggttgtttatygtgygtaygtttygggyggygyggtttttttaggygyggtgttttatttygggttygggaagygagtygtttggttagtaygtgggttggggaaaagtttgtygagatyggttgggagygtttggtagttttggaattttagyggtygtygyggggttggygaygttaggtaggagygyggagyggygggtgtagttattgggatgtttygttttygttygygagygyggtttttaggtaaggggtgygttygtttatattttttgtttttttaattaattgtgtygttttttgygttttttttayggttattttatagttaagattttttttttttygagttgtagaaggtagaaygttttygggaggaygaagtgattygaagggatgtggtaagygtatttttygatggagatgtagatyg

SEQ ID NO: 6092 - DNA, 419 bp, Artificial Sequence
  Description of Artificial Sequence: Synthetic polynucleotide
tyggggaggygatttttggatgygttttgtgygagtaaagtygggagagygagttttaagtatttggtagyggtgtttttagtaggygtygaggaattyggttatttatttttggtgaattttgygtttattgaggtattygaggtayggatgtgttygtttagtattyggagaygaaggagagagagyggggatatgygttttagttttgttaggttttagggtttttatttttgtatttaaagtttttattttattttatttttygttatttattttttgtttyggttattyggtgyggttttagtatygygygttttttyggtayggttttyggagaaagttttttaattattagttayggtatttgtagtttttgtaygtygttyggtttygtygggtgggtagygttygttayg

SEQ ID NO: 6093 - DNA, 3675 bp, Artificial Sequence
  Description of Artificial Sequence: Synthetic polynucleotide
tygygtagtttagttygygtyggggyggtgggtgggtgggtgtttgttatgggattatttttagygttttatttttttygtaaaagtggygttttygttttttyggtttaggtatattygttyggggttygtaygttyggtttagatattagygyggtggagagtatygggtggggttttygaagggtgaggttyggaggygtygyggagggggggttttttagagaggagggggygttgygggaaggtttttaagggaggttgygtttaattttygaygttttgtatttagttyggygyggygygtttagtygttttttyggatttttttyggggygygggagtttagyggygygtttagtttttatttatggtggtgatgatygtgatygtaaagtagaaggagtyggygaatttttattggaygtyggygyggtgyggtttygattgtaggattattagttttagttgtyggtagttttygttgttgatgttgtatttttttttgattyggattttttyggttttgagtttttttttttygygtatttygtggttygattygagggygtygaatayggyggygtttattagtaggtaggtgaaggtgtagaygatgagggatagagttygtaygttttgtttttttatggtygttagtaaggagtyggygyggggggtatgtttygtaggtttatagtygygygygttttattgtagygttyggyggtygtygtygttttttttttygtygtygtygtygtygtttttaagttgtaagyggyggyggtagtagtagtagtagtagtggggaggyggggggyggggaggttggggggggtttttttygttggggtygttatagttatygttatygygaggyggttggyggggtaggggyggygygggttygggtttagtygagaaggyggataggtataggaggttgttygagygtyggggttaggygttygggaatttygatattttgygttagattyggtygaagtagttygttttattgygtagggttatgtagggyggtttygttgggtatygygygggttttgttgtttttygtatttygtttttygttttygygggaaaygtagggaygggaatyggagttagaaagyggtyggagggyggtygyggggttyggtatttttgtgggtttagttygygggtggyggtgtttagtaaggagtttgtaggttygygygtttagyggaatttgtttttttttttattttttttygttttttttyggtggtggggaggaaaagtttgygaagtggyggtgtttttggagttttttgtaagyggggagggggtygagtaggtgtagygggaggggtagttygttttttaaaggttygygygtttagygtttattygggygygygggtgygtagyggggttttygtygggygtyggtyggtgygygaagtttgttyggtttaatttttaaggygygggagyggggygyggttttaggayggtagggatygygatggagyggtttygggggyggtygggggayggygyggtggyggtyggttagttygttttttygggggyggygggygyggyggyggyggygggaggggtttygygggtttygyggagtagyggggyggaygygggygtatgagtygygygggggtyggggtttttyggygttygggygtttygggaggyggtygtygygttggtttgtttygggygttaygtgygtgygygtygttgggagttygaatgtgtgtgtgygygtgtgtatgtgygtgtgtgtgtgtgtgtgtgtgtgygtttggtagtttygtttyggygggagggtttyggggagygggggtygggttaygtygaggtygggttttttttttttttttttttttgtagtttttagggygygttatttttygtttggtttttagttagttggygaggttgttgtggtagttttygttgtagatttagygyggygtagggygtaygyggagggagttygggaggggyggtttgagtygttagggagggggygggggyggagtygtyggygggttttggygggggatgggaggataaaygyggttttttgggtttttttagtttygttttttaagagygtaagtagttttggygggtggagagtttgagggattyggggttggaggaggaaaaygggatttagttagagatggtaggttgatagttttaggtagattgggtagagagtggggagtagaaggggagggggttatgggtatataggagagyggtagtagyggtttaygaagttttttttattttttattttttatttagttattyggygygggagygtgttattggttagggatatggtttygtggagtggtggggtttygagggttgtttyggttttttygttttttagyggtatagttygtttgggttagtatttgtagattygagtygtttttttggagagygttaaggatagtatgggtygttatttttggagttaggatagyggggaaagatatygtaatttttygatttagtaatttttttgttgttttattgaaggaaaaaaaaaaaatatatatatatatatatatatatatatatatatatatatatatatatatatatatatatatatatatatataattattttttgatatatataattattttttggttttttatagttgggygtaaggtgygtygtggatgtagttttgagttaygygatagttttttygagattatttggggtaggaataygaggttygggttggggygtatttattttttgtttttagatgagttttttttaggttttattttttttttattttggttttttttatttttttttttttttygttttttttttttaggttatygaggggtttttttttgattttyggttttttgaatttygtttggagttttggagttttaaaaggatagatttaagttttagagatttttgggttttttttttttttttgattttagttaaggaagggatggagatgggaaagagttgtttggyggtaggttagtagttggttaaggggtggttggggaattagatttaattttygggtagttygygggttttaggagattagttttttttgtgggtygttttttggagyggtgttygggttttttggttttagggatttygggtttagagggtttgggattttagtgatttatygaggttttttagttgggaygttttgtattttatttttagggattaygggtgtttattagggaaggggagttygygttgtgggttaygtttgagtygttaggttttygttgggtttgygggygttttggggygagggagyggggagttttatttygagtaggtattttttttagatttattttggaaattaaggttttygygttyggtaagtgagtttggttgtygggtgagttatygygagygggygataaggatttttagtagttggtaattaattgygtygtggtttagtttaygayggaattttagttaggtttttygtygttttggtagyggygttatttttgagttatagtygtygggttttygygyggttyggaagtygtttgttygtttyggygttattagggggtattggatttygatttaygyggyggtygygtagtyggtttygttgyg

SEQ ID NO: 6094 - DNA, 3675 bp, Artificial Sequence; identical to SEQ ID NO: 6093
  Description of Artificial Sequence: Synthetic polynucleotide

SEQ ID NO: 6095 - DNA, 3378 bp, Artificial Sequence
  Description of Artificial Sequence: Synthetic polynucleotide
gygagygyggagtyggagagtygggagtataggyggtygygtygygttttggttyggttygggttygygygttagtatygttygtagygygggtattyggatttttygggygttyggggggttttagtaggygygggggaaygggagggggtttgygtgygtyggygggtgttttttagggggygtttyggygaggtttagagygggtygggggyggyggyggttggaggagttttttttattttyggtygggygttyggtttagtygtyggygaygygaggygttygyggggatttgtaattygtyggatygagttttygtyggyggggtygttgttgttggggaaggtaaggaaggttttggyggggggttgggggygyggygggtgggggygtagygagggtgggagggggtygggggaggggygggygtttagattttttaatttygtygtttggggtttygtagtttygaggttttgygtttagagtttaggagtttggatttttattttttatttttttagttttttgttttttttagyggtggygatggaatgtggtaggttttygygagttygtattgggtaggttgaggagggggygattttggaygtaggagaggtttttyggygtygtygttttttttttatttatatattatagtttggtatttttttttattatatgtatagggtaggttggggagggygttttygttgtatttttagtatatatagaygttggygggggtttaagggagttttttatggtttttaatagttatatatagaygtagtaggtttyggagagttttygagygtgttttttttttgttaattaygtttagggttttttatagatattgtaagggttygagaygttttttttttaygtatagagttyggggtaggtaggagaaaattttagattttttttygaagttttygttygtagaagttttygtttgtagatttggtattggtagtggagattttttggaggtatttttttttatttygggyggagggttatttttgygttttttatttttaygygaaygtttggtttttttttttttgtttatttttttattgggtyggataggtygygyggataagtygtttttaattttgggtyggttttatgtygttttygttttaagygtygagtattttygggygtygagtattttygggttygygtygtyggtgagtagaggtygtyggttttttatygtygtygygttagtttggagtygygyggagttgtttygaggaaygagtayggttttygtttttttttggggaggttgggagttttggattyggttaggagttttttttttaggttttygyggttttttgggygaggtagagagttttttyggtttygggagggggyggyggagttgagaattatygygaagygatgygatygggagggtttgayggaggttgyggtttygagttygygtttttttttttggtygyggyggtttttgtttggttatttttyggtagtttgaagagaaygtttaatttggtattttagttttaggtygttgggtattttatttttttttatttttattttgggtttttaagttttttggagygtaggygtttaggttgggattygaagagttttaagttagtttttttttagtattygttttygtygygattttttygtttttttttygggtttggggygtagatttttgggttgtaatttyggagtagttgaaaggtaggaaggygtgtgggygggtagggggtttgtattttygttttagaggagtygtttgtygtttgtgttggggagggagttgggaggtttgttttttygttttattttgggaatttayggagattttyggtattttttttatagatataaatataygttttttyggagygagagtygtygygggggaatagtagaggtygygygggyggaggygggggaaaggggagttgggttttttttttatttgggagggaggtggtatayggtgtgtggggtttggggaggygattgttaygttttttagaatttttatgttttttattygtttgygatttyggttgtygaggaggtaaygagggaggtygagtygttttttttygtgggyggtagygaaattttgygttygtaygtyggggtgtygtygagttyggttttgagtatttagtaaggttaagtaggygaaggagggggygggggtttttgggygygttttygttygygtatagtyggggttttggaagggggtgtgygtagttygtygagttagtttygttygtttgtygttygygttyggttttyggaggyggaygttgygygygttyggggatttyggagygttyggygttttaygtttttttttyggttygttagttgttttttggygttgtttttagatttgttgygtttygatttggggggtagaaggttggttygggagattyggyggttgagggtygagtygygaagtttagggatgygttagagaggygygyggtttygygggtgggygttgygttggggggttygagtttggggtttgtygttttygattttagggaygggygtttgtttttgtyggggtttygygtaggggyggatagagggygattygtygtttyggttttaggtagtatttattyggatttygggttagggagggggygtagttaagttgtggagttttyggaggtttttttttttttygtaggtttyggtttttttyggatttyggtggtygygttygtgaaatggggaygygggttttgttttyggattttttttagttttygatttttygtatttgtttygagatttaaygtgttyggttygtagygtgttgggtttgyggygttagggtggttygagtttygagattatttgygtttgyggatatagtygyggggtttggtatgaagggttttagggagggtttagtaagygttyggggttygagtagttttttgyggygtttttygttttyggtyggttygatttygttttygggagtgggtygtggggygyggagttygtttttyggggaygtygyggggttttaggtttaggyggtyggygyggggtygtagtggyggaaggyggagggtyggygygttgtygttgattgtygggagagggygttygtatygygttygygyggttttgttygtttttttygtttttttygygtttggttygyggtttyggttttattttgggtagtttyggtygttatttttttttygttygttygttygttygttygttygttygttygttgttygttttygtygtygggtttygtgaygygtttygygtttyggtyggagtttttttygtyggttyggttyg

SEQ ID NO: 6096 - DNA, 1108 bp, Artificial Sequence
  Description of Artificial Sequence: Synthetic polynucleotide
gygtgtttagatgaaaagyggggtagtygyggttygtagatagygggyggttgggttagatygtagagggaagtttttagyggtaagttttttygyggggaaggttgtgtttgttttaggagatgagtygtaggtattaggggtgatgaggttygggggaggtggatgtgggggatggagyggttttaaggtygttagttttagtyggygttttgggtygyggggtyggagagtttyggagyggattttygtygygtttygaattygtttygygtttttaggttatattyggttygtatttttttygttttaygtgygtttaygygttttttygggtttttttttttttttygygygggtygggggygygggtttyggaggagttgggggyggygggggygyggggygggygattgtygggtttygggttagttttygtttttygtttygttttygatygttyggttttttygttyggygttttttygggttgygtttygyggtttttggyggyggyggyggygggygtagagygyggtatgggygttygggtygyggggtttggyggyggygggyggaygggygygyggttgygggygtaggtgyggggyggygggtyggggtyggggtyggggygyggagtygtygttygggggtyggggygttygygttttygtygtygttgaygtttygtttgtttttttttygtgtttygttygtttttagatttttttttttygttttttygtagttygggttttggtygtggygyggttgtygtayggtgtttttygaygtttttyggaygygttgtttttgtgatyggttttttattttygttattttagtttagtttagygtygaygyggtgagatttyggtygggtyggygggaggggygtygggtaggggygygggygggggttgtyggygggtttgygggtggggagggttygtattygttttgtttyggaggggtygttgtggttygtagtygtygtggtttggttyggtyggyggggtttatgygtttttggagagggtgggtgggygtygagygggtggtagtgtggagttggagaygggtttgggaggagtygggattttyg

SEQ ID NO: 6097 - DNA, 1700 bp, Artificial Sequence
  Description of Artificial Sequence: Synthetic polynucleotide
gygyggggtgggygttttyggttttttagtttttaattttttygygtattygggaygggtgaaggygtttagttgtygagtatattygygaygygggtttaaatttygtyggtttttaggtatttttatttygttatagygygggttgttttttttttttttttyggaggaattttttaattttttagtatttatattataataaaggaggttyggtttattaatgygygatygtagtttatagggatttttaaygaatttyggtttagagaatgtatttggtygtgttaygygygattttygaggggtaggyggaygggtttaggygyggataaaggggtttttyggggygtttaagttyggggygggaygtygggagyggagttggtygggaatttattttygtagyggttyggttgtgtttttygtggagtagaagggyggygggtagtagtagtagttagaygttgagtyggggttttatggtggygygttygaggyggygagggayggttgttyggygtgygggggtygyggyggatagttagttttyggaaggtyggatttttagygttaygtatygtttygggtgyggyggttttaagyggagatttgagygyggygggtygagttttttaatttgttggygttgttttttttttttyggyggtgygygggyggygttttaaaggggaggattttgyggygygggtaagaggyggygggagygygyggttygggagtgtggttgtagtgygtygggatattagggtttygygtttygtatttaagaggttttygygttttaatttttygygttygygygttygyggatttaggtygaggatygaaaggggtygttygagttttyggggtyggygtttagagagtttagtaaggtyggtygttttgtyggtgtgtygtyggygggtgtttttggaagggttaatgygttygggtagtagtttttgaagtygagttygaggtgagagygattttygagyggygtttagattttggttygagagtatygatttggagygttttgtgtaggttagggttgtaygtttttttgtttgggagtagaaagggggagggtgggagagygaagatygagtttttyggttaaggagtatttataggggtttaaygggaggtttttttttttttygggtygtgggggggayggtttttyggttatttttgtatgygggtygygtatygygttgttttygygtttygyggatygagatyggyggtgaggatgggttgttttttttattttgygttaaattygttttgtttgtygtttttaggttaagtgggattgatyggggtttagagtggaygaatygttagtatggggagagattagygygyggtggtyggttttgttttayggyggtaagygattttttgtttggttttygtgggttaygygygtatggatttttyggtgtaattttyggggattgataagtygggttygtaygtttaygttttttttttttttttttttatgtaggtggttgttgttggggatagtgatygtggggtttttygtttagagygttttggyggtaagttttggttttygygtttggatttgygygttygagagtggttgggaygtttgagtggttttggagaaggtagttygttygtgygttttygagtgtgtgtgtgygtgtggatgttyg

SEQ ID NO: 6098 - DNA, 692 bp, Artificial Sequence
  Description of Artificial Sequence: Synthetic polynucleotide
tyggygattyggttatttttygagggttttaggygttttatttaayggtygtttttygttttttgttygttattttttygtttttttaygaaggygygaaygttttagattttygtyggttttygatagtatttatttagttttttttttggagattttaggttgtattttgggatagaaaagaaggygggtaygatygyggtgtygggttttattttagtygtttttttttttgagggagttaggygggagagaggggaattatygaggtttyggttttttygygttttagagyggtygggygagttttattttyggtttgtgattygttgatttgtttttgttttattagtygggyggtgaattggattgattggtgatttttggtattaggtttttttatgggtatyggagtaggyggataggggtggggtttygygagygatayggaagggttagtgtggyggagyggattttgtggaggyggggttattgtgtttttgagaagggttttygggggtggagtttattaaggttgygggggygtggttayggagyggagttaataaaagyggggygtgtayggtygygggttagtgtttatgaagggygaggggtgtggttatagggygggatttaygaaggatgtaggggygaggtygggtttttgtaggatgtgyggtygygggtyg

SEQ ID NO: 6099 - DNA, 1924 bp, Artificial Sequence
  Description of Artificial Sequence: Synthetic polynucleotide
tygtygtttgtttaatgttttygttagttttgtyggtttttatygtygtttgattttattgtttttttygtggtttttgttgtttttttaaattgtttaaygatygttatttagtaaaaatgaatgaaayggggtygtgtgatttaggtagtttggagatgagattttggaattataagttatattttaaygtataaatygattttattygttttggatattygatgtaygyggaatgggygttgtaaaatgyggttgtttygtyggaggtatttgtttgggatttgttggtagtygtyggttttttttgtttgygattttyggtttagtygtygggattttggtgtatttgtttttgggygttttttttattttttagtggtygttagttttatttttagtttgtggtttyggattygtyggtttgagygttygtagagggtyggtygtygttatagtttygygtttyggttttygygttttttggattttygttttaggtyggygtagtttagtttttygggtaggttttaygttatyggggtttagtgygyggygaygaagyggagagttgtgtttagatttyggagagaaatttyggtttygyggggyggygyggggyggygyggggttyggagttgtttaatttygtygtttygggaaggyggtttygggttygtagggagtttyggggagggttttyggtttygtyggtagyggygtygaggggtgtttgggtttttggggatygygagaggaaaaagaayggaaatygtatyggggaggaaggaygygtagaaygttttygtgaagyggggtgtttyggttaggygtgygygggagygyggttygggggagttyggyggygtygtygygygtattyggtagaggtttygygggagaaygygtagttyggggygtggggyggggaattgttygygygaggttttyggygygtttgggtttyggygagagtaaagygygttttggtatygggggyggyggygtagaggtygggaggaagaaattygggttttggtttaggtygggtttttatttttgygattygygagaggtttaggygggaaaggyggygagtggygttagyggtttygaaagtaaatttggttyggtgttattgttygagggtygtygggygygttttttaattttttygagtttggaaaayggagattttygtagygttttttttagtgygtgttgygagtgttgaaggaggattyggtgtttggaygattyggagtaggggaagtattyggtygaygttgtygttgttatyggygttattggygggtaggatagtggggygggtaaggggttttttygygtttttyggtttttygygttyggygttagttttttggtttttttttttgygtagttttaggtttagtttttagttattttttaagaagaygatttygagggtygaaggtygtttttgatttttgattayggatttttygtgtaattyggaagagtygtgattttaaaattyggtttyggggttatagaagttygagatttgggaggygttygggattttttttttagaatygtagggattyggtttgggatttagggtgtggtttttygttttgygyggtygggaaggyggtygggttyggttatygygttaagtattgygtatttttgggaygygtygttgyggggggttggggggttggggygtttttaygaygtttggtttgttyggttagtgtttggtgtygttggtgggttygtggttgygaygggtaaaygttygtttygygagtygggtaaggtaatttttgygggtygygttygaaggtyggatttttttaagtygtttgggagtttttaaataggtggattygaagtttttgtttgatyggagaataaygtttaatttatttygtyg

SEQ ID NO: 6100 - DNA, 1991 bp, Artificial Sequence
  Description of Artificial Sequence: Synthetic polynucleotide
tyggtgtatygtgttttggtaatygggttttggygttttygagagyggggygaggggtgttaygygatttttaggtygttttgtatttttyggtgygtttgtagggattttgtagtaaagttttggatgtttgtagtyggtgtaagtttgtaagtagttggagagyggtggttggagtyggggggyggtgggygtggttaygtttttttttaggtagtttygggaatgttttgaaaagtattygaaagttttgagtygygygygygttaaaagaaaaggtataattttttattatttygggygtggygtgtttagatttygttattttagttgygttttyggttgtagygtataygttttttgygttttttttttyggagygtygttgttygtygggtttatttttygtagtagtttttaggygagagagggggttagagtgttygtattttttttaggggtattatgtttaaygaygaggtatttagtaagttttttatatygtyggaagttttttaygttttyggggtatygtygtagggtagagtygggggttttggtaaagygtttggggygttagtgggggyggttagyggttygagygtygggggtagtagtagaggaggyggtttyggtttyggggygtyggatttgggtgtygggagtaagaagttttygyggttgtttaagtgygtaygttgtaggaattayggttaygtttygtygtttaagggttataagygtttttgtatgtggygygattgttagtgtaagaagtgtaatttgatygtygagaggtagygygtgatggtygygtaggtgggtgygggygtgygggagttygggtttagttttagtttttttttttttttttttttttagatggagtttygttyggttgtttaggttgtagtgtagtggygygattttggtttattgtaattttygtttttygggtttaagtaatttttttgttttagttttttaagtagttgggattataggygtatattattatgttyggttaatttttgtatttttagtagagaygggggttttattatattggttaggtyggtttygagtttttgattttaggtgatttattygtttyggttttttaaagtgttgggattataggygtgggttatygttttyggtggggttygagttttttgaatgaagtttttttagtatggtygttgttatgygggttttgggttgtggagagatgyggyggtatttgtygatagyggyggygtttggggttttgggttttyggttaygttatatygtyggtttgggagygtyggagaygygtttgatttygttygtygggtagagttgygggtttygttyggttyggggttttttaygattttttattttgtgtttyggyggagttgygggggttttttttgttttygggtttttgagatttttgatttygtttttagggtagggaatttyggggttygtttttttgggttttttygygattttagagttygygttttaatagaattgggagggtttattgygttagaggagtttttaggattttygttttygtttttygaggtgaggttagaggggagggttygattttaagggaattttagggatttttagtttygtttttttagtagagaattaaggaatttttttygttttggggttttaaaaattttygatygygttttgggagtagagggtttyggggttygattttttygagygtttttagaatttttgattttttttttttgttgagttgtatttaaattagaaaggattttggagggyggtagygttggttgttaggttagygggaaagggaggttyggtyggttgttgtttaygygggtaatttgtyggaaagttttgtttgtttttttggaaaagtygttgtaatggatatagygttgygyggtttttttgygygtttggggygttttttgttttygtttttygtggatggaggttgagyg

SEQ ID NO: 6101 - DNA, 1667 bp, Artificial Sequence
  Description of Artificial Sequence: Synthetic polynucleotide
tyggggtgtaatygtaatattttygtaggttygagttttttyggagttgagtttttgyggttaaatgtygggataaaagyggttttgggttyggaaaaaygyggttagatttggattggagggaggagaagagagagaagyggagyggttattttattygtttataggtatttttatttttattttygttggtttttttttttttygtttygygagtatygtygygttttggagygtygtagtttttagtygygggttggggtagyggagagggtttggaggagggggtygygagygttttygygagagtggtttggttgtaggtggtaaggaaggtgaagtgtaggtattygaggggygtaaaggaggaggaaggygtggggyggggagtgtaaggagatagggattttaggggygggggtggyggtgggaaggaggaggggttgggggagggyggyggaggtgttgggttyggtyggtttaygagggagttgtagaagagttggtttagattttaattagagttgtygtyggttttttgtagtygtygtagygttttygygaaggaggaygtgtygattyggttgygygtttaaggtagaggttygygtyggygttggttgggygtgagttgggaggtygagttgtgagygygaagggagttggagagaygattgyggtattttyggtygtttyggagtatataygattatyggggttgygggattaagggtygygtygttyggaggtygtttttgagygggtttygtagtttygtygtttagygttttttggttttttttygtagttaggttgttaatttattygggagttyggggtatgaayggttayggttttttttatttgtatatgggyggttyggtgtygtagtygttaygggygtttttgtagygtaygtttaagtgygygygttgtygtaattatggygttttgttttggtttaagggttataagygttattgtygttttaaggattgtatttgygagaagtgtatttttattatygagyggtagygggttatggttgygtaggtggygttgygtyggtagtaggttaaygagagtttggagagttttattttygattygttgygygttttgttagggttttygtygtygggggaygtygtygtygtttygtagtygtygttagttttttagtygtygtagtygtagtygtygygttttgttgtygagttggtygyggtygtygtgttgygttggattgtygagtygtagttyggggttttgtaggygtagttygttaagttaggtaagagygtttgaggtgygggagtttggtygggygygggggtaatttyggagtgttagttgtagttttatttgggaggattggaggtaaagttttgggaygtgggtttgtyggggtttttttttttatttttygttaggtyggggttttttttttygggagaagtyggttgagtttggatttagygygagtggtattygygttygtagggaaggygttttygggtagttaaaygaygggattgtgygttagtatygttaggtgtttttttaggttgaagggttyggaaygtgttagattgagtagggagataayggagttgagataggataaaattaaaatttaygtgygtatatttattayggtggggtyg

SEQ ID NO: 6102 - DNA, 433 bp, Artificial Sequence
  Description of Artificial Sequence: Synthetic polynucleotide
tygygagataaatggtgattttttttttgtaggtatygttatatttygggtttagattttggataggygagtyggttgtatygaaggttyggtaggyggattttggyggagygttttagagagaagagtgtagatygygggaggyggagggttttttgttagygtgtttyggttaattagtatttatatygtttgataatyggttaattagaggaygtaaagtttyggggtttgagyggatagtattaggaaggggagygtagtttgtagattgaagttagtggygttgygttgaatgtaattgygygygttygtygggtgagttagygatttgagttaggygggggyggttygatttttttygtttagtttgggttagaggaagtygaaagyggttttagtaaggtgaggygttygaggttgtagaagatyg

(The sequence listing continues in the following parts.)

We claim:

1. A method of identifying a human subject for treatment of esophageal neoplasia or metaplasia and treating, comprising:
    providing an esophageal sample obtained from the subject and treating with bisulfite to generate a plurality of bisulfite converted SqBE18 nucleic acid sequences;
    amplifying the plurality of bisulfite converted SqBE18 nucleic acid sequences to generate amplicons for each bisulfite converted SqBE18 nucleic acid, wherein each amplicon is a read and wherein the amplicon comprises a nucleotide sequence that is at least 90% identical to the nucleotide sequence of SEQ ID NOs: 8318, 8360, 8332, and/or 8374, or a fragment thereof, said fragment comprising at least 50 nucleotides in length;
    identifying methylated reads by measuring the number of methylated cytosines of the CpG dinucleotides in each amplicon of the bisulfite converted SqBE18 nucleic acid sequence, wherein a read is classified as a methylated read when at least 70% of the cytosines in the CpG dinucleotides of the individual amplicon of the bisulfite converted SqBE18 nucleic acid sequence is methylated;
    calculating a percentage of total reads that are methylated reads from the amplifying and measuring steps, wherein the esophageal sample obtained from the subject has at least 0.1% of the total reads that are methylated reads; and,
    administering to the human subject having an esophageal sample with at least 0.1% of the total reads that are methylated reads, cryotherapy, photodynamic therapy (PDT); radiofrequency ablation (RFA); laser ablation; argon plasma coagulation (APC); electrocoagulation (electrofulguration); esophageal stent, endoscopic mucosal resection (EMR), esophagectomy, anti-reflux surgery, and/or a therapeutic agent selected from a proton pump inhibitor, a Histamine H2 receptor blocking agents, an anti-reflux medication, a drug that moves food thru the gastrointestinal tract more quickly, carboplatin and paclitaxel; cisplatin and 5-fluorouracil (5-FU); ECF: epirubicine, cisplatin, and 5-FU; DCF: docetaxel, cisplatin, and 5-FU; Cisplatin with capecitabine; oxaliplatin and either 5-FU or capecitabine; doxorubicin, bleomycin, mitomycin, methotrexate, vinorelbine, topotecan, and irinotecan, trastuzumab, and/or ramucirumab.

2. The method of claim 1, wherein the human subject is administered a therapeutic agent selected from a proton pump inhibitor, a Histamine H2 receptor blocking agents, an anti-reflux medication, a drug that moves food thru the gastrointestinal tract more quickly, carboplatin and paclitaxel; cisplatin and 5-fluorouracil (5-FU); ECF: epirubicine, cisplatin, and 5-FU; DCF: docetaxel, cisplatin, and 5-FU; Cisplatin with capecitabine; oxaliplatin and either 5-FU or capecitabine; doxorubicin, bleomycin, mitomycin, methotrexate, vinorelbine, topotecan, and irinotecan, trastuzumab, and/or ramucirumab.

3. The method of claim 1, wherein the endoscopic mucosal resection (EMR), esophagectomy, and/or anti-reflux surgery is performed on the human subject.

4. The method of claim 1, wherein the sequence of the bisulfite converted nucleic acid sequences is determined by next-generation sequencing.

5. The method of claim 1, wherein the amplified portion comprises 21 dinucleotides that correspond to or are derived from 21 CpG dinucleotides present in the native non-bisulfite converted SqBE18 genomic sequence.

6. The method of claim 1, wherein primers used to amplify the portion of the bisulfite converted SqBE18 nucleic acid sequence comprise SEQ ID NOs: 8388 and/or 8402.

7. The method of claim 1, wherein the amplified portion comprises the nucleotide sequence of SEQ ID NOs: 8318, 8360, 8332 and/or 8374.

8. The method of claim 1, wherein the esophageal sample obtained from the subject is classified as a methylated sample when 1% to 3.5% of the reads are classified as methylated reads.

9. The method of claim 1, wherein the esophageal sample obtained from the subject is classified as a methylated sample when 1% to 3.11% of the reads are classified as methylated reads.

10. The method of claim 1, wherein the esophageal sample obtained from the subject is classified as a methylated sample when at least 3.11% of the reads are classified as methylated reads.

11. The method of claim 1, wherein the esophageal sample obtained from the subject is classified as a methylated sample when 0.5% to 3.5% of the reads are classified as methylated reads.

12. The method of claim 1, wherein the amplicon comprises a nucleotide sequence that is at least 95% identical to the nucleotide sequence of SEQ ID NOs: 8318, 8360, 8332 and/or 8374.

13. A method for detecting methylation status of an esophageal sample from a human subject suspected of having esophageal neoplasia or metaplasia, comprising:
    providing an esophageal sample obtained from the subject and treating with bisulfite to generate a plurality of bisulfite converted SqBE18 nucleic acid sequences;
    amplifying the plurality of bisulfite converted SqBE18 nucleic acid sequences to generate amplicons for each bisulfite converted SqBE18 nucleic acid, wherein each amplicon is a read and wherein the amplicon comprises a nucleotide sequence that is at least 90% identical to the nucleotide sequence of SEQ ID NOs: 8318, 8360, 8332, and/or 8374, or a fragment thereof, said fragment comprising at least 50 nucleotides in length;

measuring the number of methylated cytosines of the CpG dinucleotides in each amplicon of the bisulfite converted SqBE18 nucleic acid sequence, wherein a read is classified as a methylated read when at least 70% of the cytosines in the CpG dinucleotides of the individual amplicon of the bisulfite converted SqBE18 nucleic acid sequence is methylated;

calculating a percentage of total reads that are methylated reads from the amplifying and measuring steps, wherein the esophageal sample obtained from the human subject has at least 0.1% of the total reads that are methylated reads, whereby the esophageal sample obtained from the subject is classified as a methylated sample; and administering an endoscopy to the human subject with a methylated sample.

14. A method of diagnosing a subject that has an esophageal neoplasia or metaplasia, comprising:

providing an esophageal sample obtained from the subject and treating with bisulfite to generate a plurality of bisulfite converted SqBE18 nucleic acid sequences;

amplifying the plurality of bisulfite converted SqBE18 nucleic acid sequences to generate amplicons for each bisulfite converted SqBE18 nucleic acid, wherein each amplicon is a read and wherein the amplicon comprises a nucleotide sequence that is at least 90% identical to the nucleotide sequence of SEQ ID NOs: 8318, 8360, 8332, and/or 8374, or a fragment thereof, said fragment comprising at least 50 nucleotides in length;

wherein primers used to amplify the portion of the bisulfite converted SqBE18 nucleic acid sequence comprise SEQ ID NOs: 8388 and/or 8402;

measuring the number of methylated cytosines of the CpG dinucleotides in each amplicon of the bisulfite converted SqBE18 nucleic acid sequence, wherein a read is classified as a methylated read when at least 70% of the cytosines in the CpG dinucleotides of the individual amplicon of the bisulfite converted SqBE18 nucleic acid sequence are methylated; and, calculating a percentage of total reads that are methylated reads from the amplifying and measuring steps wherein the sample has at least 0.1% of the total reads that are methylated reads, whereby the subject is diagnosed with esophageal neoplasia or metaplasia.

* * * * *